(12) United States Patent
Alexandrov et al.

(10) Patent No.: US 8,183,436 B2
(45) Date of Patent: May 22, 2012

(54) NUCLEOTIDE SEQUENCES AND POLYPEPTIDES ENCODED THEREBY USEFUL FOR MODIFYING PLANT CHARACTERISTICS

(75) Inventors: Nickolai Alexandrov, Thousand Oaks, CA (US); Vyacheslav Brover, Simi Valley, CA (US)

(73) Assignee: Ceres, Inc., Thousand Oaks, CA (US)

( * ) Notice: Subject to any disclaimer, the term of this patent is extended or adjusted under 35 U.S.C. 154(b) by 0 days.

(21) Appl. No.: 12/974,661

(22) Filed: Dec. 21, 2010

(65) Prior Publication Data

US 2011/0247101 A1 Oct. 6, 2011

Related U.S. Application Data

(63) Continuation of application No. 12/145,273, filed on Jun. 24, 2008, now abandoned, which is a continuation of application No. 11/649,663, filed on Jan. 3, 2007, now abandoned, which is a continuation of application No. 11/174,307, filed on Jun. 30, 2005, now abandoned.

(60) Provisional application No. 60/583,671, filed on Jun. 30, 2004, provisional application No. 60/583,781, filed on Jun. 30, 2004, provisional application No. 60/583,651, filed on Jun. 30, 2004.

(51) Int. Cl.
*A01H 9/00* (2006.01)
*C12N 15/00* (2006.01)
*C12N 1/20* (2006.01)
*C12N 9/00* (2006.01)
*C07H 21/04* (2006.01)

(52) U.S. Cl. .... 800/295; 536/23.2; 435/183; 435/252.3; 435/320.1

(58) Field of Classification Search ................. 536/23.2; 435/69.1, 320.1, 252.3; 800/295
See application file for complete search history.

(56) References Cited

U.S. PATENT DOCUMENTS

| | | |
|---|---|---|
| 2004/0034888 A1 | 2/2004 | Liu et al. |
| 2004/0123343 A1* | 6/2004 | La Rosa et al. ............... 800/278 |
| 2004/0214272 A1 | 10/2004 | La Rosa et al. |
| 2007/0283460 A9 | 12/2007 | Liu et al. |

* cited by examiner

*Primary Examiner* — Maryam Monshipouri
(74) *Attorney, Agent, or Firm* — Birch, Stewart, Kolasch & Birch, LLP

(57) ABSTRACT

Isolated polynucleotides and polypeptides encoded thereby are described, together with the use of those products for making transgenic plants.

15 Claims, No Drawings

NUCLEOTIDE SEQUENCES AND POLYPEPTIDES ENCODED THEREBY USEFUL FOR MODIFYING PLANT CHARACTERISTICS

CROSS REFERENCE TO RELATED APPLICATION

This application is a Continuation of application Ser. No. 12/145,273 filed on Jun. 24, 2008 now abandoned, which is a Continuation of application Ser. No. 11/649,663 filed on Jan. 3, 2007 now abandoned, which is a Continuation of application Ser. No. 11/174,307 filed on Jun. 30, 2005, now abandoned, and for which priority is claimed under 35 U.S.C. §120; and this application claims priority under 35 U.S.C. §119 on U.S. Provisional Application No(s). 60/583,671; 60/583,781 and 60/583,651 filed on Jun. 30, 2004; the entire contents of each of which are hereby incorporated by reference.

INCORPORATION-BY-REFERENCE OF SEQUENCE LISTING OR TABLE

In accordance with 37 CFR 1.52 (e)(5), this application contains three (3) CDRs, two (2) CDRs act as a paper copy and one (1) CDR acts as the CRF copy of the sequence listing, each of which contain identical files and the entire contents of which are hereby incorporated by reference. The CDR contains the following files:

| Creation Date | File Size | File Name |
| --- | --- | --- |
| Jun. 6, 2011 | 29.8 MB | 2011-06-10 2750-1601PUS2_ST25.TXT |

FIELD OF THE INVENTION

The present invention relates to isolated polynucleotides, polypeptides encoded thereby, and the use of those products for making transgenic plants or organisms, such as transgenic plants.

BACKGROUND OF THE INVENTION

There are more than 300,000 species of plants. They show a wide diversity of forms, ranging from delicate liverworts, adapted for life in a damp habitat, to cacti, capable of surviving in the desert. The plant kingdom includes herbaceous plants, such as corn, whose life cycle is measured in months, to the giant redwood tree, which can live for thousands of years. This diversity reflects the adaptations of plants to survive in a wide range of habitats. This is seen most clearly in the flowering plants (phylum Angiospermophyta), which are the most numerous, with over 250,000 species. They are also the most widespread, being found from the tropics to the arctic.

The process of plant breeding involving man's intervention in natural breeding and selection is some 20,000 years old. It has produced remarkable advances in adapting existing species to serve new purposes. The world's economics was largely based on the successes of agriculture for most of these 20,000 years.

Plant breeding involves choosing parents, making crosses to allow recombination of gene (alleles) and searching for and selecting improved forms. Success depends on the genes/alleles available, the combinations required and the ability to create and find the correct combinations necessary to give the desired properties to the plant. Molecular genetics technologies are now capable of providing new genes, new alleles and the means of creating and selecting plants with the new, desired characteristics.

Plants specifically improved for agriculture, horticulture and other industries can be obtained using molecular technologies. As an example, great agronomic value can result from modulating the size of a plant as a whole or of any of its organs. The green revolution came about as a result of creating dwarf wheat plants, which produced a higher seed yield than taller plants because they could withstand higher levels and inputs of fertilizer and water.

Similarly, modulation of the size and stature of an entire plant, or a particular portion of a plant, allows production of plants better suited for a particular industry. For example, reductions in the height of specific ornamentals, crops and tree species can be beneficial by allowing easier harvesting. Alternatively, increasing height may be beneficial by providing more biomass. Other examples of commercially desirable traits include increasing the length of the floral stems of cut flowers, increasing or altering leaf size and shape, enhancing the size of seeds and/or fruits, enhancing yields by specifically stimulating hormone (e.g. Brassinolide) synthesis and stimulating early flowering or evoking late flowering by altering levels of gibberellic acid or other hormones in specific cells. Changes in organ size and biomass also result in changes in the mass of constituent molecules such as secondary products. To summarize, molecular genetic technologies provide the ability to modulate and manipulate growth, development and biochemistry of the entire plant as well as at the cell, tissue and organ levels Thus, plant morphology, development and biochemistry are altered to maximize or minimize the desired plant trait.

SUMMARY OF THE INVENTION

The present invention, therefore, relates to isolated polynucleotides, polypeptides encoded thereby, and the use of those products for making transgenic organisms, such as plants, bacteria, yeast, fungi and mammals, depending upon the desired characteristics.

In the field of agriculture and forestry efforts are constantly being made to produce plants with improved characteristics, such as increased overall yield or increased yield of biomass or chemical components, in particular in order to guarantee the supply of the constantly increasing world population with food and to guarantee the supply of reproducible raw materials. Conventionally, people try to obtain plants with an increased yield by breeding, but this is time-consuming and labor-intensive. Furthermore, appropriate breeding programs must be performed for each relevant plant species.

Recently, progress has been made by the genetic manipulation of plants. That is, by introducing into and expressing recombinant nucleic acid molecules in plants. Such approaches have the advantage of not usually being limited to one plant species, but being transferable to other plant species as well. EP-A 0 511 979, for example, discloses that the expression of a prokaryotic asparagine synthetase in plant cells inter alia leads to an increase in biomass production. Similarly, WO 96/21737 describes the production of plants with increased yield from the expression of deregulated or unregulated fructose-1,6-bisphosphatase due to an increased rate of the photosynthesis. Nevertheless, there still is a need for generally applicable processes that improve yield in plants interesting for agriculture or forestry purposes.

DETAILED DESCRIPTION OF THE INVENTION

1. Definitions

The following terms are utilized throughout this application:

Domain: Domains are fingerprints or signatures that can be used to characterize protein families and/or parts of proteins. Such fingerprints or signatures can comprise conserved (1) primary sequence, (2) secondary structure, and/or (3) three-dimensional conformation. Generally, each domain has been associated with either a family of proteins or motifs. Typically, these families and/or motifs have been correlated with specific in-vitro and/or in-vivo activities. A domain can be any length, including the entirety of the sequence of a protein. Detailed descriptions of the domains, associated families and motifs, and correlated activities of the polypeptides of the instant invention are described below. Usually, the polypeptides with designated domain(s) can exhibit at least one activity that is exhibited by any polypeptide that comprises the same domain(s). Domains also define areas of non-coding sequences such as promoters and miRNAs.

Endogenous: The term "endogenous," within the context of the current invention refers to any polynucleotide, polypeptide or protein sequence which is a natural part of a cell or organisms regenerated from said cell.

Exogenous: "Exogenous," as referred to within, is any polynucleotide, polypeptide or protein sequence, whether chimeric or not, that is initially or subsequently introduced into the genome of an individual host cell or the organism regenerated from said host cell by any means other than by a sexual cross. Examples of means by which this can be accomplished are described below, and include *Agrobacterium*-mediated transformation (of dicots—e.g. Salomon et al. *EMBO J.* 3:141 (1984); Herrera-Estrella et al. *EMBO J.* 2:987 (1983); of monocots, representative papers are those by Escudero et al., *Plant J.* 10:355 (1996), Ishida et al., *Nature Biotechnology* 14:745 (1996), May et al., *Bio/Technology* 13:486 (1995)), biolistic methods (Armaleo et al., *Current Genetics* 17:97 1990)), electroporation, in planta techniques, and the like. Such a plant containing the exogenous nucleic acid is referred to here as a $T_0$ for the primary transgenic plant and $T_1$ for the first generation. The term "exogenous" as used herein is also intended to encompass inserting a naturally found element into a non-naturally found location.

Gene: The term "gene," as used in the context of the current invention, encompasses all regulatory and coding sequence contiguously associated with a single hereditary unit with a genetic function. Genes can include non-coding sequences that modulate the genetic function that include, but are not limited to, those that specify polyadenylation, transcriptional regulation, DNA conformation, chromatin conformation, extent and position of base methylation and binding sites of proteins that control all of these. Genes comprised of "exons" (coding sequences), which may be interrupted by "introns" (non-coding sequences), encode proteins. A gene's genetic function may require only RNA expression or protein production, or may only require binding of proteins and/or nucleic acids without associated expression. In certain cases, genes adjacent to one another may share sequence in such a way that one gene will overlap the other. A gene can be found within the genome of an organism, artificial chromosome, plasmid, vector, etc., or as a separate isolated entity.

Heterologous sequences: "Heterologous sequences" are those that are not operatively linked or are not contiguous to each other in nature. For example, a promoter from corn is considered heterologous to an *Arabidopsis* coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence originates from, are considered heterologous to said coding sequence. Elements operatively linked in nature and contiguous to each other are not heterologous to each other. On the other hand, these same elements remain operatively linked but become heterologous if other filler sequence is placed between them. Thus, the promoter and coding sequences of a corn gene expressing an amino acid transporter are not heterologous to each other, but the promoter and coding sequence of a corn gene operatively linked in a novel manner are heterologous.

Homologous gene: In the current invention, "homologous gene" refers to a gene that shares sequence similarity with the gene of interest. This similarity may be in only a fragment of the sequence and often represents a functional domain such as, examples including without limitation a DNA binding domain, a domain with tyrosine kinase activity, or the like. The functional activities of homologous genes are not necessarily the same.

Misexpressiom The term "misexpression" refers to an increase or a decrease in the transcription of a coding region into a complementary RNA sequence as compared to the parental wild-type, This term also encompasses expression of a gene or coding region for a different time period as compared to the wild-type and/or from a non-natural location within the plant genome.

Percentage of sequence identity: "Percentage of sequence identity," as used herein, is determined by comparing two optimally aligned sequences over a comparison window, where the fragment of the polynucleotide or amino acid sequence in the comparison window may comprise additions or deletions (e.g., gaps or overhangs) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Optimal alignment of sequences for comparison may be conducted by the local homology algorithm of Smith and Waterman *Add. APL. Math.* 2:482 (1981), by the homology alignment algorithm of Needleman and Wunsch *J. Mol. Biol.* 48:443 (1970), by the search for similarity method of Pearson and Lipman *Proc. Natl. Acad. Sci. (USA)* 85: 2444 (1988), by computerized implementations of these algorithms (GAP, BESTFIT, BLAST, PASTA, and TFASTA in the Wisconsin Genetics Software Package, Genetics Computer Group (GCG), 575 Science Dr., Madison, Wis.), or by inspection. Given that two sequences have been identified for comparison, GAP and BESTFIT are preferably employed to determine their optimal alignment. Typically, the default values of 5.00 for gap weight and 0.30 for gap weight length are used. The term "substantial sequence identity" between polynucleotide or polypeptide sequences refers to polynucleotide or polypeptide comprising a sequence that has at least 80% sequence identity, preferably at least 85%, more preferably at least 90% and most preferably at least 95%, even more preferably, at least 96%, 97%, 98% or 99% sequence identity compared to a reference sequence using the programs.

Regulatory Sequence: The term "regulatory sequence," as used in the current invention, refers to any nucleotide sequence that influences transcription or translation initiation and rate, and stability and/or mobility of the transcript or polypeptide product. Regulatory sequences include, but are not limited to, promoters, promoter control elements, protein binding sequences, 5' and 3' UTRs, transcriptional start site, termination sequence, polyadenylation sequence, introns, certain sequences within a coding sequence, etc.

Stringency: "Stringency" as used herein is a function of probe length, probe composition (G+C content), and salt concentration, organic solvent concentration, and temperature of hybridization or wash conditions. Stringency is typically compared by the parameter $T_m$, which is the temperature at which 50% of the complementary molecules in the hybridization are hybridized, in terms of a temperature differential from $T_m$. High stringency conditions are those providing a condition of $T_m-5°$ C. to $T_m-10°$ C. Medium or moderate stringency conditions are those providing $T_m-20°$ C. to $T_m-29°$ C. Low stringency conditions are those providing a condition of $T_m-40°$ C. to $T_m-48°$ C. The relationship of hybridization conditions to $T_m$ (in ° C.) is expressed in the mathematical equation $$T_m = 81.5 - 16.6(\log_{10}[Na^+]) + 0.41(\% \ G+C) - (600/N) \quad (1)$$

where N is the length of the probe. This equation works well for probes 14 to 70 nucleotides in length that are identical to the target sequence. The equation below for $T_m$ of DNA-DNA hybrids is useful for probes in the range of 50 to greater than 500 nucleotides, and for conditions that include an organic solvent (formamide).

$$T_m = 81.5 + 16.6 \log\{[Na^+]/(1+0.7[Na^+])\} + 0.41(\% \ G+C) - 500/L \ 0.63(\% \ formamide) \quad (2)$$

where L is the length of the probe in the hybrid. (P. Tijessen, "Hybridization with Nucleic Acid Probes" in Laboratory Techniques in Biochemistry and Molecular Biology, P. C. vand der Vliet, ed., c. 1993 by Elsevier, Amsterdam.) The $T_m$ of equation (2) is affected by the nature of the hybrid; for DNA-RNA hybrids $T_m$ is 10-15° C. higher than calculated, for RNA-RNA hybrids $T_m$ is 20-25° C. higher. Because the $T_m$ decreases about 1° C. for each 1% decrease in homology when a long probe is used (Bonner et al., *J. Mol. Biol.* 81:123 (1973)), stringency conditions in polynucleotide hybridization reactions can be adjusted to favor hybridization of polynucleotides from identical genes or related family members.

Equation (2) is derived assuming equilibrium and therefore, hybridizations according to the present invention are most preferably performed under conditions of probe excess and for sufficient time to achieve equilibrium. The time required to reach equilibrium can be shortened by inclusion of a hybridization accelerator such as dextran sulfate or another high volume polymer in the hybridization buffer.

Stringency conditions can be selected during the hybridization reaction or after hybridization has occurred by altering the salt and temperature conditions of the wash solutions used. The formulas shown above are equally valid when used to compute the stringency of a wash solution. Preferred wash solution stringencies lie within the ranges stated above; high stringency is 5-8° C. below $T_m$, medium or moderate stringency is 26-29° C. below $T_m$ and low stringency is 45-48° C. below $T_m$.

Substantially free of: A composition containing A is "substantially free of" B when at least 85% by weight of the total A+B in the composition is A. Preferably, A comprises at least about 90% by weight of the total of A+B in the composition, more preferably at least about 95% or even 99% by weight. For example, a plant gene or DNA sequence can be considered substantially free of other plant genes or DNA sequences.

Translational start site: In the context of the current invention, a "translational start site" is usually an ATG in the cDNA transcript, more usually the first ATG. A single cDNA, however, may have multiple translational start sites.

Transcription start site: "Transcription start site" is used in the current invention to describe the point at which transcription is initiated. This point is typically located about 25 nucleotides downstream from a TFIID binding site, such as a TATA box. Transcription can initiate at one or more sites within the gene, and a single gene may have multiple transcriptional start sites, some of which may be specific for transcription in a particular cell-type or tissue.

Untranslated region (UTR): A "UTR" is any contiguous series of nucleotide bases that is transcribed, but is not translated. These untranslated regions may be associated with particular functions such as increasing mRNA message stability. Examples of UTRs include, but are not limited to polyadenylation signals, terminations sequences, sequences located between the transcriptional start site and the first exon (5' UTR) and sequences located between the last exon and the end of the mRNA (3' UTR).

Variant: The term "variant" is used herein to denote a polypeptide or protein or polynucleotide molecule that differs from others of its kind in some way. For example, polypeptide and protein variants can consist of changes in amino acid sequence and/or charge and/or post-translational modifications (such as glycosylation, etc).

2. Important Characteristics of the Polynucleotides of the Invention

The genes and polynucleotides of the present invention are of interest because when they are misexpressed (i.e. when expressed at a non-natural location or in an increased amount) they produce plants with important modified characteristics as discussed below. These traits can be used to exploit or maximize plant products or to minimize undesirable characteristics. For example, an increase in plant height is beneficial in species grown or harvested for their main stem or trunk, such as ornamental cut flowers, fiber crops (e.g. flax, kenaf, hesperaloe, hemp) and wood producing trees. Increase in inflorescence thickness is also desirable for some ornamentals, while increases in the number, shape and size of leaves can lead to increased production/harvest from leaf crops such as lettuce, spinach, cabbage and tobacco. Likewise, a decrease in plant height is beneficial in species that are particularly susceptible to lodging or uprooting due to wind stress.

The polynucleotides and polypeptides of the invention were isolated from *Arabidopsis thaliana*, corn, soybean, wheat, *Brassica* and others as noted in the Sequence Listing. The polynucleotides and polypeptides are useful to confer on transgenic plants the properties identified for each sequence in the relevant portion (miscellaneous feature section) of the Sequence Listing. The miscellaneous feature section of the sequence listing contains, for each sequence, a description of the domain or other characteristic from which the sequence has the function known in the art for other sequences. Some identified domains are indicated with "PFam Name", signifying that the pfam name and description can be found in the pfam database at http://pfam.wustl.edu. Other domains are indicated by reference to a "GI Number" from the public sequence database maintained by GenBank under the NCBI, including the non-redundant (NR) database.

The sequences of the invention can be applied to substrates for use in array applications such as, but not limited to, assays of global gene expression, under varying conditions of development, and growth conditions. The arrays are also used in diagnostic or forensic methods The polynucleotides, or fragments thereof, can also be used as probes and primers. Probe length varies depending on the application. For use as primers, probes are 12-40 nucleotides, preferably 18-30 nucleotides long. For use in mapping, probes are preferably 50 to 500 nucleotides, preferably 100-250 nucleotides long. For Southern hybridizations, probes as long as several kilobases are used.

The probes and/or primers are produced by synthetic procedures such as the triester method of Matteucci et al. *J. Am. Chem. Soc.* 103:3185 (1981) or according to Urdea et al. *Proc. Natl. Acad.* 80:7461 (1981) or using commercially available automated oligonucleotide synthesizers.

The polynucleotides of the invention can be utilized in a number of methods known to those skilled in the art as probes and/or primers to isolate and detect polynucleotides including, without limitation: Southerns, Northerns, Branched DNA hybridization assays, polymerase chain reaction microarray assays and variations thereof. Specific methods given by way of examples, and discussed below include:
   Hybridization
   Methods of Mapping
   Southern Blotting
   Isolating cDNA from Related Organisms
   Isolating and/or Identifying Homologous and Orthologous Genes.
Also, the nucleic acid molecules of the invention can be used in other methods, such as high density oligonucleotide hybridizing assays, described, for example, in U.S. Pat. Nos. 6,004,753 and 5,945,306.

The polynucleotides or fragments thereof of the present invention can be used as probes and/or primers for detection and/or isolation of related polynucleotide sequences through hybridization. Hybridization of one nucleic acid to another constitutes a physical property that defines the polynucleotide of the invention and the identified related sequences. Also, such hybridization imposes structural limitations on the pair. A good general discussion of the factors for determining hybridization conditions is provided by Sambrook et al. ("Molecular Cloning, a Laboratory Manual, 2nd ed., c. 1989 by Cold Spring Harbor Laboratory Press, Cold Spring Harbor, N.Y.; see esp., chapters 11 and 12). Additional considerations and details of the physical chemistry of hybridization are provided by G. H. Keller and M. M. Manak "DNA Probes", $2^{nd}$ Ed. pp. 1-25, c. 1993 by Stockton Press, New York, N.Y.

When using the polynucleotides to identify orthologous genes in other species, the practitioner will preferably adjust the amount of target DNA of each species so that, as nearly as is practical, the same number of genome equivalents are present for each species examined. This prevents faint signals from species having large genomes, and thus small numbers of genome equivalents per mass of DNA, from erroneously being interpreted as absence of the corresponding gene in the genome.

The probes and/or primers of the instant invention can also be used to detect or isolate nucleotides that are "identical" to the probes or primers. Two nucleic acid sequences or polypeptides are said to be "identical" if the sequence of nucleotides or amino acid residues, respectively, in the two sequences is the same when aligned for maximum correspondence as described below.

Isolated polynucleotides within the scope of the invention also include allelic variants of the specific sequences presented in the Sequence Listing. The probes and/or primers of the invention are also used to detect and/or isolate polynucleotides exhibiting at least 80% sequence identity with the sequences of the Sequence Listing or fragments thereof. Related polynucleotide sequences can also be identified according to the methods described in U.S. Patent Publication 20040137466A1, dated Jul. 15, 2004 to Jofuku et al.

With respect to nucleotide sequences, degeneracy of the genetic code provides the possibility to substitute at least one nucleotide of the nucleotide sequence of a gene with a different nucleotide without changing the amino acid sequence of the polypeptide. Hence, the DNA of the present invention also has any base sequence that has been changed from a sequence in the Sequence Listing by substitution in accordance with degeneracy of genetic code. References describing codon usage include: Carels et al., *J. Mol. Evol.* 46: 45 (1998) and Fennoy et al., *Nucl. Acids Res.* 21(23): 5294 (1993).

The polynucleotides of the invention are also used to create various types of genetic and physical maps of the genome of corn, *Arabidopsis*, soybean, rice, wheat, or other plants. Some are absolutely associated with particular phenotypic traits, allowing construction of gross genetic maps. Creation of such maps is based on differences or variants, generally referred to as polymorphisms, between different parents used in crosses. Common methods of detecting polymorphisms that can be used are restriction fragment length polymorphisms (RFLPs, single nucleotide polymorphisms (SNPs) or simple sequence repeats (SSRs).

The use of RFLPs and of recombinant inbred lines for such genetic mapping is described for *Arabidopsis* by Alonso-Blanco et al. (*Methods in Molecular Biology*, vol. 82, "*Arabidopsis Protocols*", pp. 137-146, J. M, Martinez-Zapater and J. Salinas, eds., c. 1998 by Humana Press, Totowa, N.J.) and for corn by Burr ("Mapping Genes with Recombinant Inbreds", pp. 249-254. In Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; Gardiner, J. et al., (1993) *Genetics* 134: 917). This procedure, however, is not limited to plants and is used for other organisms (such as yeast) or for individual cells.

The polynucleotides of the present invention are also used for simple sequence repeat (SSR) mapping. Rice SSR mapping is described by Morgante et al. (*The Plant Journal* (1993) 3: 165), Panaud et al. (*Genome* (1995) 38: 1170); Senior et al. (*Crop Science* (1996) 36: 1676), Taramino et al. (*Genome* (1996) 39: 277) and Ahn et al. (*Molecular and General Genetics* (1993) 241: 483-90). SSR mapping is achieved using various methods. In one instance, polymorphisms are identified when sequence specific probes contained within a polynucleotide flanking an SSR are made and used in polymerase chain reaction (PCR) assays with template DNA from two or more individuals of interest. Here, a change in the number of tandem repeats between the SSR-flanking sequences produces differently sized fragments (U.S. Pat. No. 5,766,847). Alternatively, polymorphisms are identified by using the PCR fragment produced from the SSR-flanking sequence specific primer reaction as a probe against Southern blots representing different individuals (U. H. Refseth et al., (1997) *Electrophoresis* 18: 1519).

The polynucleotides of the invention can further be used to identify certain genes or genetic traits using, for example, known AFLP technologies, such as in EP0534858 and U.S. Pat. No. 5,878,215.

The polynucleotides of the present invention are also used for single nucleotide polymorphism (SNP) mapping.

Genetic and physical maps of crop species have many uses. For example, these maps are used to devise positional cloning strategies for isolating novel genes from the mapped crop species. In addition, because the genomes of closely related species are largely syntenic (i.e. they display the same ordering of genes within the genome), these maps are used to isolate novel alleles from relatives of crop species by positional cloning strategies.

The various types of maps discussed above are used with the polynucleotides of the invention to identify Quantitative Trait Loci (QTLs). Many important crop traits, such as the solids content of tomatoes, are quantitative traits and result from the combined interactions of several genes. These genes reside at different loci in the genome, often times on different chromosomes, and generally exhibit multiple alleles at each locus. The polynucleotides of the invention are used to identify QTLs and isolate specific alleles as described by de Vicente and Tanksley (*Genetics* 134:585 (1993)). Once a desired allele combination is identified, crop improvement is accomplished either through biotechnological means or by directed conventional breeding programs (for review see Tanksley and McCouch, *Science* 277:1063 (1997)). In addition to isolating QTL alleles in present crop species, the polynucleotides of the invention are also used to isolate alleles from the corresponding QTL of wild relatives.

In another embodiment, the polynucleotides are used to help create physical maps of the genome of corn, *Arabidopsis* and related species. Where polynucleotides are ordered on a genetic map, as described above, they are used as probes to discover which clones in large libraries of plant DNA fragments in YACs, BACs, etc. contain the same polynucleotide or similar sequences, thereby facilitating the assignment of the large DNA fragments to chromosomal positions. Subsequently, the large BACs, YACs, etc. are ordered unambiguously by more detailed studies of their sequence composition (e.g. Marra et al. (1997) Genomic Research 7:1072-1084) and by using their end or other sequences to find the identical sequences in other cloned DNA fragments. The overlapping of DNA sequences in this way allows building large contigs of plant sequences to be built that, when sufficiently extended, provide a complete physical map of a chromosome. Sometimes the polynucleotides themselves provide the means of joining cloned sequences into a contig. All scientific and patent publications cited in this paragraph are hereby incorporated by reference.

U.S. Pat Nos. 6,287,778 and 6,500,614, both hereby incorporated by reference, describe scanning multiple alleles of a plurality of loci using hybridization to arrays of oligonucleotides. These techniques are useful for each of the types of mapping discussed above.

Following the procedures described above and using a plurality of the polynucleotides of the present invention, any individual is genotyped. These individual genotypes are used for the identification of particular cultivars, varieties, lines, ecotypes and genetically modified plants or can serve as tools for subsequent genetic studies involving multiple phenotypic traits.

Identification and isolation of orthologous genes from closely related species and alleles within a species is particularly desirable because of their potential for crop improvement. Many important crop traits, result from the combined interactions of the products of several genes residing at different loci in the genome. Generally, alleles at each of these loci make quantitative differences to the trait. Once a more favorable allele combination is identified, crop improvement is accomplished either through biotechnological means or by directed conventional breeding programs (Tanksley et al. *Science* 277:1063(1997)).

4. Use of the Genes to Make Transgenic Plants

To use the sequences of the present invention or a combination of them or parts and/or mutants and/or fusions and/or variants of them, recombinant DNA constructs are prepared which comprise the polynucleotide sequences of the invention inserted into a vector, and which are suitable for transformation of plant cells. The construct is made using standard recombinant DNA techniques (Sambrook et al. 1989) and is introduced to the species of interest by *Agrobacterium*-mediated transformation or by other means of transformation as referenced below.

The vector backbone is any of those typical in the art such as plasmids (such as Ti plasmids), viruses, artificial chromosomes, BACs, YACs and PACs and vectors of the sort described by (a) BAC: Shizuya et al., Proc. Natl. Acad. Sci. USA 89: 8794-8797 (1992); Hamilton et al., Proc. Natl. Acad. Sci. USA 93: 9975-9979 (1996);
(b) YAC: Burke et al., Science 236:806-812 (1987);
(c) PAC: Sternberg N. et al., Proc Natl Acad Sci USA. Jan; 87(1):103-7 (1990);
(d) Bacteria-Yeast Shuttle Vectors: Bradshaw et al., Nucl Acids Res 23: 4850-4856 (1995);
(e) Lambda Phage Vectors: Replacement Vector, e.g., Frischauf et al., J. Mol Biol 170: 827-842 (1983); or Insertion vector, e.g., Huynh et al., In: Glover NM (ed) DNA Cloning: A practical Approach, Vol. 1 Oxford: IRL Press (1985); T-DNA gene fusion vectors: Walden et al., Mol Cell Biol 1: 175-194 (1990); and
(g) Plasmid vectors: Sambrook et al., infra.

Typically, the construct comprises a vector containing a sequence of the present invention with any desired transcriptional and/or translational regulatory sequences, such as promoters, UTRs, and 3' end termination sequences. Vectors can also include origins of replication, scaffold attachment regions (SARs), markers, homologous sequences, introns, etc. The vector may also comprise a marker gene that confers a selectable phenotype on plant cells. The marker may encode biocide resistance, particularly antibiotic resistance, such as resistance to kanamycin, G418, bleomycin, hygromycin, or herbicide resistance, such as resistance to chlorosulfuron, glyphosate or phosphinotricin.

A plant promoter fragment is used that directs transcription of the gene in all tissues of a regenerated plant and/or is a constitutive promoter. Alternatively, the plant promoter directs transcription of a sequence of the invention in a specific tissue (tissue-specific promoter) or is otherwise under more precise environmental control (inducible promoter).

If proper polypeptide production is desired, a polyadenylation region at the 3'-end of the coding region is typically included. The polyadenylation region is derived from the natural gene, from a variety of other plant genes, or from T-DNA, synthesized in the laboratory.

Transformation

Techniques for transforming a wide variety of higher plant species are well known and described in the technical and scientific literature. See, e.g. Weising et al., *Ann. Rev. Genet.* 22:421 (1988); and Christou, Euphytica, v. 85, n. 1-3:13-27, (1995).

The person skilled in the art knows processes for the transformation of monocotyledonous and dicotyledonous plants. A variety of techniques are available for introducing DNA into a plant host cell. These techniques comprise transformation of plant cells by DNA injection, DNA electroporation, use of bolistics methods, protoplast fusion and via T-DNA using *Agrobacterium tumefaciens* or *Agrobacterium rhizogenes*, as well as further possibilities, or other bacterial hosts for Ti plasmid vectors. See for example, Broothaerts et al., Gene Transfer to Plants by Diverse Species of Bacteria, Nature, Vol. 433, pp. 629-633, 10 Feb. 2005.

DNA constructs of the invention are introduced into the cell or the genome of the desired plant host by a variety of conventional techniques. For example, the DNA construct is introduced using techniques such as electroporation, microinjection and polyethylene glycol precipitation of plant cell protoplasts or protoplast fusion. Electroporation techniques are described in Fromm et al. *Proc. Natl Acad. Sci. USA* 82:5824 (1985). Microinjection techniques are known in the art and well described in the scientific and patent literature. The plasmids do not have to fulfill specific requirements for use in DNA electroporation or DNA injection into plant cells. Simple plasmids such as pUC derivatives can be used.

The introduction of DNA constructs using polyethylene glycol precipitation is described in Paszkowski et al. *EMBO J.* 3:2717 (1984). Introduction of foreign DNA using protoplast fusion is described by Willmitzer (Willmitzer, L., 1993 Transgenic plants. In: Biotechnology, A Multi-Volume Comprehensive Treatise (H. J. Rehm, G. Reed, A. Pühler, P. Stadler, eds.), Vol. 2, 627-659, VCH Weinheim-New York-Basel-Cambridge).

Alternatively, the DNA constructs of the invention are introduced directly into plant tissue using ballistic methods, such as DNA particle bombardment. Ballistic transformation techniques are described in Klein et al. *Nature* 327:773 (1987). Introduction of foreign DNA using ballistics is described by Willmitzer (Willmitzer, L., 1993 Transgenic plants. In: Biotechnology, A Multi-Volume Comprehensive Treatise (H. J. Rehm, G. Reed, A. Pühler, P. Stadler, eds.), Vol. 2, 627-659, VCH Weinheim-New York-Basel-Cambridge).

DNA constructs are also introduced with the help of Agrobacteria. The use of Agrobacteria for plant cell transformation is extensively examined and sufficiently disclosed in the specification of EP-A 120 516, and in Hoekema (In: The Binary Plant Vector System Offsetdrukkerij Kanters B. V., Alblasserdam (1985), Chapter V), Fraley et al. (Crit. Rev. Plant. Sci. 4, 1-46) and DePicker et al. (EMBO J. 4 (1985), 277-287). Using this technique, the DNA constructs of the invention are combined with suitable T-DNA flanking regions and introduced into a conventional *Agrobacterium tumefaciens* host vector. The virulence functions of the *Agrobacterium tumefaciens* host direct the insertion of the construct and adjacent marker(s) into the plant cell DNA when the cell is infected by the bacteria (McCormac et al., 1997, *Mol. Biotechnol.* 8:199; Hamilton, 1997, *Gene* 200:107; Salomon et al., 1984 *EMBO J* 3:141; Herrera-Estrella et al., 1983 *EMBO J.* 2:987). *Agrobacterium tumefaciens*-mediated transformation techniques, including disarming and use of binary or co-integrate vectors, are well described in the scientific literature. See, for example Hamilton, C M., *Gene* 200:107 (1997); Müller et al. *Mol. Gen. Genet.* 207:171 (1987); Komari et al. *Plant J.* 10:165 (1996); Venkateswarlu et al. *Biotechnology* 9:1103 (1991) and Gleave, A P., *Plant Mol. Biol.* 20:1203 (1992); Graves and Goldman, *Plant Mol. Biol.* 7:34 (1986) and Gould et al., *Plant Physiology* 95:426 (1991).

For plant cell T-DNA transfer of DNA, plant organs, e.g. infloresences, plant explants, plant cells that have been cultured in suspension or protoplasts are co-cultivated with *Agrobacterium tumefaciens* or *Agrobacterium rhizogenes* or other suitable T-DNA hosts. Whole plants are regenerated from the infected plant material or seeds generated from infected plant material using a suitable medium that contains antibiotics or biocides for the selection of transformed cells or by spraying the biocide on plants to select the transformed plants. Plants obtained in this way are then examined for the presence of the DNA introduced. The transformation of dicotyledonous plants via Ti-plasmid-vector systems and *Agrobacterium tumefaciens* is well established.

Monocotyledonous plants are also transformed by means of *Agrobacterium* based vectors (See Chan et al., Plant Mol. Biol. 22 (1993), 491-506; Hiei et al., Plant J. 6 (1994), 271-282; Deng et al., Science in China 33 (1990), 28-34; Wilmink et al., Plant Cell Reports 11 (1992), 76-80; May et al., Bio/Technology 13 (1995), 486-492; Conner and Domisse; Int. J. Plant Sci. 153 (1992), 550-555; Ritchie et al., Transgenic Res. 2 (1993), 252-265). Maize transformation in particular is described in the literature (see, for example, WO95/06128, EP 0 513 849; EP 0 465 875; Fromm et al., Biotechnology 8 (1990), 833-844; Gordon-Kamm et al., Plant Cell 2 (1990), 603-618; Koziel et al., Biotechnology 11 (1993), 194-200). In EP 292 435 and in Shillito et al. (1989, Bio/Technology 7, 581) fertile plants are obtained from a mucus-free, soft (friable) maize callus. Prioli and Söndahl (1989, Bio/Technology 7, 589) also report regenerating fertile plants from maize protoplasts of the maize Cateto inbred line, Cat 100-1.

Other cereal species have also been successfully transformed, such as barley (Wan and Lemaux, see above; Ritala et al., see above) and wheat (Nehra et al., 1994, Plant J. 5, 285-297).

Alternatives to *Agrobacterium* transformation for plants are ballistics, protoplast fusion, electroporation of partially permeabilized cells and use of glass fibers (See Wan and Lemaux, Plant Physiol. 104 (1994), 37-48; Vasil et al., Bio/Technology 11 (1993), 1553-1558; Ritala et al., Plant Mol. Biol. 24 (1994), 317-325; Spencer et al., Theor. Appl. Genet. 79 (1990), 625-631)).

Introduced DNA is usually stable after integration into the plant genome and is transmitted to the progeny of the transformed cell or plant. Generally the transformed plant cell contains a selectable marker that makes the transformed cells resistant to a biocide or an antibiotic such as kanamycin, G 418, bleomycin, hygromycin, phosphinotricin or others. Therefore, the individually chosen marker should allow the selection of transformed cells from cells lacking the introduced DNA.

The transformed cells grow within the plant in the usual way (McCormick et al., 1986, Plant Cell Reports 5, 81-84) and the resulting plants are cultured normally. Transformed plant cells obtained by any of the above transformation techniques are cultured to regenerate a whole plant that possesses the transformed genotype and thus the desired phenotype. Such regeneration techniques rely on manipulation of certain phytohormones in a tissue culture growth medium, typically relying on a biocide and/or herbicide marker that has been introduced together with the desired nucleotide sequences.

Plant regeneration from cultured protoplasts is described in Evans et al., *Protoplasts Isolation and Culture* in "Handbook of Plant Cell Culture," pp. 124-176, MacMillan Publishing Company, New York, 1983; and Binding, *Regeneration of Plants, Plant Protoplasts*, pp. 21-73, CRC Press, Boca Raton, 1988. Regeneration also occurs from plant callus, explants, organs, or parts thereof. Such regeneration techniques are described generally in Klee et al. *Ann. Rev. of Plant Phys.* 38:467 (1987). Regeneration of monocots (rice) is described by Hosoyama et al. (*Biosci. Biotechnol. Biochem.* 58:1500 (1994)) and by Ghosh et al. (*J. Biotechnol.* 32:1 (1994)). Useful and relevant procedures for transient expression are also described in U.S. Application No. 60/537,070 filed on Jan. 16, 2004 and PCT Application No. PCT/US2005/001153 filed on Jan. 14, 2005.

After transformation, seeds are obtained from the plants and used for testing stability and inheritance. Generally, two or more generations are cultivated to ensure that the phenotypic feature is stably maintained and transmitted.

One of skill will recognize that after the expression cassette is stably incorporated in transgenic plants and confirmed to be operable, it can be introduced into other plants by sexual crossing. Any of a number of standard breeding techniques can be used, depending upon the species to be crossed.

The nucleotide sequences according to the invention generally encode an appropriate protein from any organism, in particular from plants, fungi, bacteria or animals. The sequences preferably encode proteins from plants or fungi. Preferably, the plants are higher plants, in particular starch or oil storing useful plants, such as potato or cereals such as rice, maize, wheat, barley, rye, triticale, oat, millet, etc., as well as spinach, tobacco, sugar beet, soya, cotton etc.

In principle, the process according to the invention can be applied to any plant. Therefore, monocotyledonous as well as dicotyledonous plant species are particularly suitable. The process is preferably used with plants that are interesting for agriculture, horticulture and/or forestry. Examples are vegetable plants such as cucumber, melon, pumpkin, eggplant, zucchini, tomato, spinach, cabbage species, peas, beans, etc., as well as fruits such as pears, apples, etc.

Thus, the invention has use over a broad range of plants, preferably higher plants, pertaining to the classes of Angiospermae and Gymnospermae. Plants of the subclasses of the Dicotylodenae and the Monocotyledonae are particularly suitable. Dicotyledonous plants belong to the orders of the Magniolales, Illiciales, Laurales, Piperales Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, Santales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales. Monocotyledonous plants belong to the orders of the Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchidales. Plants belonging to the class of the Gymnospermae are Pinales, Ginkgoales, Cycadales and Gnetales.

The method of the invention is preferably used with plants that are interesting for agriculture, horticulture, biomass for bioconversion and/or forestry. Examples are tobacco, oilseed rape, sugar beet, potato, tomato, cucumber, pepper, bean, pea, citrus fruit, apple, pear, berries, plum, melon, eggplant, cotton, soybean, sunflower, rose, poinsettia, petunia, guayule, cabbage, spinach, alfalfa, artichoke, corn, wheat, rye, barley, grasses such as switch grass or turf grass, millet, hemp, banana, poplar, eucalyptus trees, conifers.

The invention being thus described, it will be apparent to one of ordinary skill in the art that various modifications of the materials and methods for practicing the invention can be made. Such modifications are to be considered within the scope of the invention as defined by the following claims.

Each of the references from the patent and periodical literature cited herein is hereby expressly incorporated in its entirety by such citation.

SEQUENCE LISTING (5544 sequences)

SEQ ID NO: 1 - DNA, 492 bp, Zea mays
  misc_feature (1)..(492): Ceres cDNA ID no. 1439877
  misc_feature (1)..(492): Ceres CLONE  ID no. 306485
  misc_feature (52)..(52): n is a, c, t, g, unknown, or other
  misc_feature (90)..(90): n is a, c, t, g, unknown, or other
gcaccgcatcgcctcgccgctgttccccgcaacctatcgacccaatctcgtncgacccggcgcgtcgtcccctccagatctccgtcgcyntctccaggtacaagatgcccagaatgattaccaagatagaaggccgtggtaatggtatcaagacaaatgttgtgaacatggttgacatagcaaaagcacttgccaggccagcttcctacacaaccaagtactttggatgtgagcttggtgcacagtccaaatttgatgagaagacagggatttccttggttaacggggctcatgatactgcaaagctggctggtctccttgaggtattcatcaagaagtatgtccaatgttatgggtgtggaaatcctgagacagagattctcatctcaaagacccagatgatatcactgaaatgtgcagcctgtgggttcgtctcagatgttgatatgagggacaagctcacaaccttcattctgaaaaacccaccagaac

SEQ ID NO: 2 - protein, 129 aa, Zea mays
  misc_feature: PFam Name: eIF-5_eIF-2B; PFam Description: Domain found in
  misc_feature: GI Number: 4160402; NR Description: eukaryotic translation
  misc_feature: GI Number: 1806575; NR Description: Eukaryotic initiation factor-5 [Zea mays] gi|2494320|sp|P55876|IF5_MAIZE Eukaryotic translation initiation factor 5 (eIF-5) gi|7489730|pir||JC5595
  misc_feature: GI Number: 15810339; NR Description: putative eukaryotic
  misc_feature: GI Number: 21387159; NR Description: putative eukaryotic translation initiation factor 5 [Arabidopsis thaliana] gi|17473619|gb|AAL38273.1| putative eukaryotic translation initiation factor 5 [Arabidopsis thaliana]
  misc_feature: GI Number: 42733476; NR Description: BRI1-KD interacting
MPRMITKIEGRGNGIKTNVVNMVDIAKALARPASYTTKYFGCELGAQSKFDEKTGISLVNGAHDTAKLAGLLEVFIKKYVQCYGCGNPETEILISKTQMISLKCAACGFVSDVDMRDKLTTFILKNPPE

SEQ ID NO: 3 - DNA, 407 bp, Zea mays
  misc_feature (1)..(407): Ceres cDNA ID no. 1669111
  misc_feature (1)..(407): Ceres CLONE  ID no. 345697
  misc_feature (1)..(407): Also known as  Ceres CDNA ID no. 23786979
aataaaatctcccgtggcctccttcttctccggttctcgctcgtgcccttctctcctggcggcgacggctgggcgagcggcgcggcccgttatcacttcccaggtcttcggcggcgacgagtttccaccagatggtcaacaaatgggcctctgcgagcaaagtataatgcaaaaatggcaggcatgaatgcacctattgctaaaccaaagggaagtaagaagctgaaggattgggatgcaaaatgagatgccaggttagctggtattatctaagcgttataagaactatgtagccaaaaagtgcaaacaatgcttatgcagatgctttcttctcattttgactgcataaacaatgtgacctttatgtgctattatctgttgaagtgtcccaatagtatgatgtgatg

SEQ ID NO: 4 - protein, 407 aa, Zea mays
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
AATAAAATCTCCCGTGGCCTCCTTCTTCTCCGGTTCTCGCTCGTGCCCTTCTCTCCTGGCGGCGACGGCTGGGCGAGCGGCGCGGCCCGTTATCACTTCCCAGGTCTTCGGCGGCGACGAGTTTCCACCAGATGGTCAACAAATGGGCCTCTGCGAGCAAAGTATAATGCAAAAATGGCAGGCATGAATGCACCTATTGCTAAACCAAAGGGAAGTAAGAAGCTGAAGGATTGGGATGCAAAATGAGATGCCAGGTTAGCTGGTATTATCTAAGCGTTATAAGAACTATGTAGCCAAAAAGTGCAAACAATGCTTATGCAGATGCTTTCTTCTCATTTTGACTGCATAAACAATGTGACCTTTATGTGCTATTATCTGTTGAAGTGTCCCAATAGTATGATGTGATG

SEQ ID NO: 5 - DNA, 1974 bp, Arabidopsis thaliana
  misc_feature (1)..(1974): Ceres cDNA ID no. 1815764
atgtttctgtctcaccctcctcaagtaatacaaccaacttatcatacagttaacttcttacctcgctctcctctgaagccaccgtcgtgttccgttgctttaaacaatccttcaatttcctccggcgccggagctaaaatctctaataatcagctaattcaatcattgtgcaaagagggtaaacttaaacaagcgattcgcgtcttgtctcaggaatctagcccaagtcaacagacttacgagcttctgattctctgctgcggtcatcggagctctctttctgatgctctacgtgttcatcgacatattctggataatgggtctgatcaagatccttttttggctacgaagcttattggtatgtactcggatttgggttctgtggattatgcacggaaggtgttcgataaaacgcgtaagagaactatatatgtctggaacgctttgtttcgagcccttacgttagcaggtcatggagaagaagtgttgggtttgtattggaagatgaataggattggagttgagtcagataggttcacatacacttatgttctcaaggcttgtgttgcatcggaatgcacggtgaatcatctgatgaaagggaaagagattcatgcacatcttactcgacgaggttacagttctcatgtttacattatgactacgttggtggacatgtatgctagatttggctgtgtggattatgccagctatgtgtttgggggaatgccggtgaggaacgttgtttcttggagcgctatgatcgcctgctatgcaaagaacgggaaagcttttgaagctctgaggactttccgtgaaatgatgagagaaaccaaagattcatctccgaattctgtgactatggttagtgtgcttcaagcttgtgcttcgcttgcggctttagagcaagggaaattgattcatgggtacatactcagacgggggcttgactccatattgccagtgatcagtgctcttgtgacgatgtatggtagatgcggtaagcttgaagtgggacaaagagtatttgatcgaatgcatgaccgggatgttgtgtcctggaattccttgatatcaagctatggcgttcacgggtatggaaaaaaagcaattcagatatttgaagagatgctcgccaacggggcttccccaactcccgtaacatttgtcagcgttttgggagcttgcagccacgagggtcttgttgaagaaggaaagagactgtttgaaacaatgtggagagaccatgggataaaaccacaaatcgaacattatgcttgtatggttgatctgttaggtcgggcgaataggttagacgaggcagcaaagatggtacaagacatgaggactgaaccagggcctaaggtttggggttcccttcttggttcttgtagaattcacggtaatgttgagcttgcagagcgggcgagtagaaggctctttgcgcttgaaccaaaaaatgcagggaactatgtgttgttggcagacatttacgcggaagctcagatgtgggatgaggttaagagagtgaagaagcttctagaacacaggggactgcagaagctgcctggtcgatgctggatggaagtgaggaggaaaatgtactcgtttgtctcggttgatgagtttaaccctcttatggaacagattcatgctttcttggttaagttagccgaagatatgaaggagaaagggtacataccacagaccaaaggagttctgtatgagcttgaaacagaagaaaaagagaggatagtgttgggacacagtgagaaacttgcgttggcgtttgggctgataaatacatcgaaaggagaaccaatcagaatcacgaagaacttgcgtttgtgcgaggactgtcacttgtttacaaagttcatctcgaagtttatggagaaagagattctagtcagagatgtgaaccggtttcatcgattcaagaatggagtgtgttcttgtggagattactggtaa

SEQ ID NO: 6 - protein, 657 aa, Arabidopsis thaliana
  misc_feature: PFam Name: PPR; PFam Description: PPR repeat
  misc_feature: PFam Name: FBA_1; PFam Description: F-box associated
  misc_feature: GI Number: 34908292; NR Description: P0005H10.18 [Oryza sativa (japonica cultivar-group)] >gi|15408890|dbj|BAB64281.1|
  misc_feature: GI Number: 30694644; NR Description: pentatricopeptide (PPR)
  misc_feature: GI Number: 42565133; NR Description: pentatricopeptide (PPR)
  misc_feature: GI Number: 34897884; NR Description: Similar to Arabidopsis thaliana DNA chromosome 4, BAC clone F4I10; vegetative storage protein. (AL035525) [Oryza sativa (japonica cultivar-group)] >gi|7363286|dbj|BAA93030.1| Similar to storage protein.
  misc_feature: GI Number: 11994419; NR Description: selenium-binding
MFLSHPPQVIQPTYHTVNFLPRSPLKPPSCSVALNNPSISSGAGAKISNNQLIQSLCKEGKLKQAIRVLSQESSPSQQTYELLILCCGHRSSLSDALRVHRHILDNGSDQDPFLATKLIGMYSDLGSVDYARKVFDKTRKRTIYVWNALFRALTLAGHGEEVLGLYWKMNRIGVESDRFTYTYVLKACVASECTVNHLMKGKEIHAHLTRRGYSSHVYIMTTLVDMYARFGCVDYASYVFGGMPVRNVVSWSAMIACYAKNGKAFEALRTFREMMRETKDSSPNSVTMVSVLQACASLAALEQGKLIHGYILRRGLDSILPVISALVTMYGRCGKLEVGQRVFDRMHDRDVVSWNSLISSYGVHGYGKKAIQIFEEMLANGASPTPVTFVSVLGACSHEGLVEEGKRLFETMWRDHGIKPQIEHYACMVDLLGRANRLDEAAKMVQDMRTEPGPKVWGSLLGSCRIHGNVELAERASRRLFALEPKNAGNYVLLADIYAEAQMWDEVKRVKKLLEHRGLQKLPGRCWMEVRRKMYSFVSVDEFNPLMEQIHAFLVKLAEDMKEKGYIPQTKGVLYELETEEKERIVLGHSEKLALAFGLINTSKGEPIRITKNLRLCEDCHLFTKFISKFMEKEILVRDVNRFHRFKNGVCSCGDYW

SEQ ID NO: 7 - DNA, 1716 bp, Arabidopsis thaliana
  misc_feature (1)..(1716): Ceres cDNA ID no. 1816550
  misc_feature (1)..(1716): Also known as  Ceres CDNA ID no. 23786979
atggttttttccgttgcaacaagctctgttacgaacccaaagctccatcatcaccaccatcttagtgacttcaacagaaacagagtatctacatctctcaagataatgaactcgaagaatcacacaaacccaagaaagtgtgagtgttttgatctctacgatcaattaattccatacaagaaagcttggtcatggcaaaaaagcattctcaatgagaaaaaagctttgattgataaaaaccaagagtgttcagattcattaattatactacaacatccttctgtttacacaatgggaactggaagctcagagaattatctcaatttcgacataaagaatgctcctttcgatgtttatagaacagaacgtggtggtgaagttacttatcatggtcctggtcagctagttatgtatcctataatcaatctacggaatcacaaaatggatcttcattggtacttaaggaagcttgaggaagtagttattcgtgttctttcttcggctttcgccatcaatgcttctcgtctcgacggttttactggagtttgggttggcaacaaaaaaatggcggcgataggtattcgtgtgtcgaaatggatgacatatcatggtctagctcttaatgttacaacagatttaacaccctttaactccatagttccatgtgggataaggaaccgtggggttggaagcgtaaagggtttgattgaggatggagaacattataataagcttgaagatttgcagttgttagatatagctcatgagtcgttactaaaggaattctctgaagtttttcagcttcagatggaaaagcaaacacttacaagtgatttatgggatggtggttatgcaggaaaccttttgtggaccagtgattttattggcagtttgttaagttgtttgttttcttgtagatatgtgtgtgagagatttgatttctctatttctctctccaaagaaagcttatctgcttcttggattgaccacaaagggatggctctggaagctgctttctccatgagtttttgctccttctctgtccctaaagcaatcttctgtgagagagaaacttcatcttttcaacgaatcacctcgagagcaaagggaattgcgggtgagagtcaagttcaaagctctgatggagttgagactcaagtcaaggaaacttctcccaaagtatttgataaactgcctgaaagaaatttagatacttggagcggtggcagagaaacagcaagaggactttcaggttcagtagtaagaaacactgtacgaaaagatactactttacgacatatctcaccttctagtcattcaacaaaggttagaggagataagccagagatttcagggggtgagaagaaagctattgtagatagaagcaaggcctacgtaaagctgaaatctttagggaaagaagtgagagacgcaggctatgtaccagagactaagtatgttcttcacgacattgatgaagaagctaaagagaaagccttgatgcatcatagtgaacggttagctattgctttcgggattataaacactcctccagggacgacaataagggtgatgaagaatctgaggatatgtggagattgccataacttcataaagatattatcgagtatcgaagatagagagatcattgtaagagataacaagaggttccatcattttagagatggtaactgctcttgtggagattattggtag

SEQ ID NO: 8 - protein, 1716 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGTTTTTTCCGTTGCAACAAGCTCTGTTACGAACCCAAAGCTCCATCATCACCACCATCTTAGTGACTTCAACAGAAACAGAGTATCTACATCTCTCAAGATAATGAACTCGAAGAATCACACAAACCCAAGAAAGTGTGAGTGTTTTGATCTCTACGATCAATTAATTCCATACAAGAAAGCTTGGTCATGGCAAAAAAGCATTCTCAATGAGAAAAAAGCTTTGATTGATAAAAACCAAGAGTGTTCAGATTCATTAATTATACTACAACATCCTTCTGTTTACACAATGGGAACTGGAAGCTCAGAGAATTATCTCAATTTCGACATAAAGAATGCTCCTTTCGATGTTTATAGAACAGAACGTGGTGGTGAAGTTACTTATCATGGTCCTGGTCAGCTAGTTATGTATCCTATAATCAATCTACGGAATCACAAAATGGATCTTCATTGGTACTTAAGGAAGCTTGAGGAAGTAGTTATTCGTGTTCTTTCTTCGGCTTTCGCCATCAATGCTTCTCGTCTCGACGGTTTTACTGGAGTTTGGGTTGGCAACAAAAAAATGGCGGCGATAGGTATTCGTGTGTCGAAATGGATGACATATCATGGTCTAGCTCTTAATGTTACAACAGATTTAACACCCTTTAACTCCATAGTTCCATGTGGGATAAGGAACCGTGGGGTTGGAAGCGTAAAGGGTTTGATTGAGGATGGAGAACATTATAATAAGCTTGAAGATTTGCAGTTGTTAGATATAGCTCATGAGTCGTTACTAAAGGAATTCTCTGAAGTTTTTCAGCTTCAGATGGAAAAGCAAACACTTACAAGTGATTTATGGGATGGTGGTTATGCAGGAAACCTTTTGTGGACCAGTGATTTTATTGGCAGTTTGTTAAGTTGTTTGTTTTCTTGTAGATATGTGTGTGAGAGATTTGATTTCTCTATTTCTCTCTCCAAAGAAAGCTTATCTGCTTCTTGGATTGACCACAAAGGGATGGCTCTGGAAGCTGCTTTCTCCATGAGTTTTTGCTCCTTCTCTGTCCCTAAAGCAATCTTCTGTGAGAGAGAAACTTCATCTTTTCAACGAATCACCTCGAGAGCAAAGGGAATTGCGGGTGAGAGTCAAGTTCAAAGCTCTGATGGAGTTGAGACTCAAGTCAAGGAAACTTCTCCCAAAGTATTTGATAAACTGCCTGAAAGAAATTTAGATACTTGGAGCGGTGGCAGAGAAACAGCAAGAGGACTTTCAGGTTCAGTAGTAAGAAACACTGTACGAAAAGATACTACTTTACGACATATCTCACCTTCTAGTCATTCAACAAAGGTTAGAGGAGATAAGCCAGAGATTTCAGGGGGTGAGAAGAAAGCTATTGTAGATAGAAGCAAGGCCTACGTAAAGCTGAAATCTTTAGGGAAAGAAGTGAGAGACGCAGGCTATGTACCAGAGACTAAGTATGTTCTTCACGACATTGATGAAGAAGCTAAAGAGAAAGCCTTGATGCATCATAGTGAACGGTTAGCTATTGCTTTCGGGATTATAAACACTCCTCCAGGGACGACAATAAGGGTGATGAAGAATCTGAGGATATGTGGAGATTGCCATAACTTCATAAAGATATTATCGAGTATCGAAGATAGAGAGATCATTGTAAGAGATAACAAGAGGTTCCATCATTTTAGAGATGGTAACTGCTCTTGTGGAGATTATTGGTAG

SEQ ID NO: 9 - DNA, 1005 bp, Arabidopsis thaliana
  misc_feature (1)..(1005): Ceres cDNA ID no. 1817433
atgggttgcgtctcatctaacctcctaaaccacgacgaagacttctctcaaatcggcggtggaagctccgccttcggtcaccacatcgtcaaactaacctccaccacttatggtcttctcacactcgatcctcctcctcctccttctcctcctatgacgccgccggagaaattcacagtcgatacaaaatctaagtcaatatggtctgagccaagggtgataaagtcggaaccggagattattaactcttgggagttaatgtctggtctcgacggagagagtttccgattcacgccacttcctaagactccggtgaagtataaagtgtttggtggagagaacaaagagaattcagatcctagtcggagaaaccctagaaaaaacttgaacgacgaggttttgaaaccgctagatctgaacagagaggattcggattctaattcgagaagccctagaaaatcgtttaaaccgttagatttgaaattggatgagaaatttgagaggatttgtccaccaggaggagagaatcgtgtggtgatgtacacgacgtcgttgcgaggtgttcgtcaaacgtttgaggcgtgtaacgctgtgagagcggcggtggagagttttggtgttgtggtttgcgagagagatgtgtcgatggatagaaggtttagagaagagcttgtgagtctaatggcgaagagagttggggatgagggagtggctgcattgccgcctcgggtttttgtgaagggaaggtacattggtggaggagaggaagtgttgagactagttgaggaaggttctttcggagagctgatcagcgggattccgagaaagaaagcgggaggatgcgagagcggcgcgtgtgatggttgcggcggtttgtttttcttgccgtgttttcggtgtaatggaagctgtaagatggtgaaaggatggggtagtgcttcggtggttgtgagatgtaatgagtgtaatgagaatggtcttgttccatgtcctatttgcagttga

SEQ ID NO: 10 - protein, 334 aa, Arabidopsis thaliana
  misc_feature: PFam Name: Glutaredoxin; PFam Description: Glutaredoxin
  misc_feature: GI Number: 17381052; NR Description: putative peptide
  misc_feature: GI Number: 34899868; NR Description: OJ1714_H10.16 [Oryza sativa (japonica cultivar-group)] >gi|22831078|dbj|BAC15940.1|
  misc_feature: GI Number: 10241626; NR Description: Contains similarity to
  misc_feature: GI Number: 51535014; NR Description: glutaredoxin-like [Oryza
  misc_feature: GI Number: 34877331; NR Description: similar to
MGCVSSNLLNHDEDFSQIGGGSSAFGHHIVKLTSTTYGLLTLDPPPPPSPPMTPPEKFTVDTKSKSIWSEPRVIKSEPEIINSWELMSGLDGESFRFTPLPKTPVKYKVFGGENKENSDPSRRNPRKNLNDEVLKPLDLNREDSDSNSRSPRKSFKPLDLKLDEKFERICPPGGENRVVMYTTSLRGVRQTFEACNAVRAAVESFGVVVCERDVSMDRRFREELVSLMAKRVGDEGVAALPPRVFVKGRYIGGGEEVLRLVEEGSFGELISGIPRKKAGGCESGACDGCGGLFFLPCFRCNGSCKMVKGWGSASVVVRCNECNENGLVPCPICS

SEQ ID NO: 11 - DNA, 1242 bp, Arabidopsis thaliana
  misc_feature (1)..(1242): Ceres cDNA ID no. 1818595
  misc_feature (1)..(1242): Also known as  Ceres CDNA ID no. 23786979
atggacagtgtaattaggtttaggaacagtatcaagatcaacagatctcgtgcttactacaaatcagaggagtcagatatcacggaaggagttgtgccatcggctgatggctcagctgaagctattttagttgaaggaaatctacagaacgcatctccatggtggcagcagtttcctagacgctgggtgatcgtcttgttatgcttttcgtcttttcttctttgcaatatggaccgtgtgaacatgagcattgcaattcttcccatgtcacaagaatataactggagtagtgcaactgttggcttaattcagtcctctttcttctggggctatttacttactcagattctgggaggtatatgggcagataagtttggcgggaagggtgttgcaatgcctgctatgaacaacatgctttctaaatggatccctgtctcagagagaagcagatcgcttgcactggtctatagtggcatgtatcttggttccgtcacaggattggcattctctcctatgctaatcaccaagttcggatggccatctgttttctactcgtttggctccctcggaagtatatggtttttgctatggctaaaatttgcatatagctctcccaaggatgacccggacctaagtgaagaagaaaaaaaggttatactgggaggtagcaaaccaagggaacctgttacagtgattccatggaagctaatactgtctaaacccccagtctgggctctcataatttcccacttctgccataattggggaactttcatactattgacatggatgcccacatattacaatcaggcacggagttcagcttcagttatatccttactgtttaatattttttgtgaacaagtcttgaagttcaacctcactgaatccgggctactatgcgttttgccatggctaaccatggctgtttttgctaatattggaggttggattgctgatactcttgtgagcagaggtctttcaattacaaacggctctgatgcattctctcagtcgggtctctactctaatcatcaagacattggcccacgatacgctggtgtactcttaggactatcaaacacagcaggagtcctagctggtgtctttggcactgcagctactggttacatcctccaacgaggttcatgggatgatgtgttcaaagtagcagttgcactgtatctaattggaactctggtctggaacttgttcgcaaccggagaaaaaattctcgactag

SEQ ID NO: 12 - protein, 1242 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGACAGTGTAATTAGGTTTAGGAACAGTATCAAGATCAACAGATCTCGTGCTTACTACAAATCAGAGGAGTCAGATATCACGGAAGGAGTTGTGCCATCGGCTGATGGCTCAGCTGAAGCTATTTTAGTTGAAGGAAATCTACAGAACGCATCTCCATGGTGGCAGCAGTTTCCTAGACGCTGGGTGATCGTCTTGTTATGCTTTTCGTCTTTTCTTCTTTGCAATATGGACCGTGTGAACATGAGCATTGCAATTCTTCCCATGTCACAAGAATATAACTGGAGTAGTGCAACTGTTGGCTTAATTCAGTCCTCTTTCTTCTGGGGCTATTTACTTACTCAGATTCTGGGAGGTATATGGGCAGATAAGTTTGGCGGGAAGGGTGTTGCAATGCCTGCTATGAACAACATGCTTTCTAAATGGATCCCTGTCTCAGAGAGAAGCAGATCGCTTGCACTGGTCTATAGTGGCATGTATCTTGGTTCCGTCACAGGATTGGCATTCTCTCCTATGCTAATCACCAAGTTCGGATGGCCATCTGTTTTCTACTCGTTTGGCTCCCTCGGAAGTATATGGTTTTTGCTATGGCTAAAATTTGCATATAGCTCTCCCAAGGATGACCCGGACCTAAGTGAAGAAGAAAAAAAGGTTATACTGGGAGGTAGCAAACCAAGGGAACCTGTTACAGTGATTCCATGGAAGCTAATACTGTCTAAACCCCCAGTCTGGGCTCTCATAATTTCCCACTTCTGCCATAATTGGGGAACTTTCATACTATTGACATGGATGCCCACATATTACAATCAGGCACGGAGTTCAGCTTCAGTTATATCCTTACTGTTTAATATTTTTTGTGAACAAGTCTTGAAGTTCAACCTCACTGAATCCGGGCTACTATGCGTTTTGCCATGGCTAACCATGGCTGTTTTTGCTAATATTGGAGGTTGGATTGCTGATACTCTTGTGAGCAGAGGTCTTTCAATTACAAACGGCTCTGATGCATTCTCTCAGTCGGGTCTCTACTCTAATCATCAAGACATTGGCCCACGATACGCTGGTGTACTCTTAGGACTATCAAACACAGCAGGAGTCCTAGCTGGTGTCTTTGGCACTGCAGCTACTGGTTACATCCTCCAACGAGGTTCATGGGATGATGTGTTCAAAGTAGCAGTTGCACTGTATCTAATTGGAACTCTGGTCTGGAACTTGTTCGCAACCGGAGAAAAAATTCTCGACTAG

SEQ ID NO: 13 - DNA, 1125 bp, Arabidopsis thaliana
  misc_feature (1)..(1125): Ceres cDNA ID no. 1821290
atgacacaacgggtattccaagtctggaaaggaagcaataaattcatcctgggtgggagattgatatttggaccagatgctaggtcactgcctcttaccttgctattgatcatagttccggttgttttgttctgtgtatttgtagcaaggcaccttcgccatgagttctctccctacaatgcgggatatgctatcatggtggtagcaattcttttcactatttatgtattgatcctcctcttcttcacatctgcacgagatcctggtattgttcctcgaaattcgcatccaccagaggaagacctacgttatgagacaactgtatcagctgatggaagacaaacaccgagtgttcaaattcccaggacgaaagaagtcattgttaatggcgtttctgttagagtgaaatactgtgatacatgcatgctttacaggcctcctcgctgctctcattgctccatatgcaacaactgtgttgagcgctttgatcatcattgcccatgggtgggacaatgcattggactgagaaactataggtatttctttatgtttgtttcttcgtcaacacttctctgcatctatattttctcgatgtcggcggtatacatcaagattctgatggatcatcaacaagcaactgtgtggagggcaatgaaagaatcaccttgggctgttgtgttgatgatatattgctttattgccctgtggtttgttggagggctcacagcgtttcacttgtacctcataagtacaaaccaggtgaagccctcgaggaacaactttagagccttcatcgaagaagaacccccaagagttattactctgcctagcaccaccagggaatcaggggaagcagaagacgaaaatgtgacccggcgacagaaagtggaagacgatctagacattggagacgatctaatgaatctctcacggcgttgtaatgcagaagatgccaacaacaatcagcctcatcacacattggacatagaccatgagagagcaggctcgataaggacagaagcaagacatgaaagctggggaagaagaagtgggagctgggatgtagcagcaacagatgtgagggaaagtcgaagctacgcaacagcaaaggatggaaggggataa

SEQ ID NO: 14 - protein, 374 aa, Arabidopsis thaliana
  misc_feature: PFam Name: zf-DHHC; PFam Description: DHHC zinc finger domain
  misc_feature: GI Number: 56784777; NR Description: putative NEW1 domain
  misc_feature: GI Number: 30688566; NR Description: DHHC-type zinc finger
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 57900122; NR Description: putative zisp [Oryza sativa (japonica cultivar-group)] gi|57899394|dbj|BAD88041.1|
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
MTQRVFQVWKGSNKFILGGRLIFGPDARSLPLTLLLIIVPVVLFCVFVARHLRHEFSPYNAGYAIMVVAILFTIYVLILLFFTSARDPGIVPRNSHPPEEDLRYETTVSADGRQTPSVQIPRTKEVIVNGVSVRVKYCDTCMLYRPPRCSHCSICNNCVERFDHHCPWVGQCIGLRNYRYFFMFVSSSTLLCIYIFSMSAVYIKILMDHQQATVWRAMKESPWAVVLMIYCFIALWFVGGLTAFHLYLISTNQVKPSRNNFRAFIEEEPPRVITLPSTTRESGEAEDENVTRRQKVEDDLDIGDDLMNLSRRCNAEDANNNQPHHTLDIDHERAGSIRTEARHESWGRRSGSWDVAATDVRESRSYATAKDGRG

SEQ ID NO: 15 - DNA, 918 bp, Arabidopsis thaliana
  misc_feature (1)..(918): Ceres cDNA ID no. 1821525
  misc_feature (1)..(918): Also known as  Ceres CDNA ID no. 23786979
atggaagcagctactgttcagaggtttcagtactcatcatggaatgatttgagaaattttgaagggaagcctcgtggttctctgaggtataatacacagcgaattaaggaagataaaaggtttagagttgttgctttaactcttgacaaaagaagggatcatcgacttagatcagtttctgataagaactcctcagcattgttggaaactggaagtcttcttcattctccatttgatgaagaacaacagattttgaaggccatggattacattagcttctgcagaaaaaagctgaagagcttctcttgcattttggtagttgaacagtttcctcgtgaatgcgttaggtatgatgggttccgggaaaacgactgtagggaagattatggcaagatcgcttgtgacactttgatcgagcaggctatgaagggaacttctgtagctgagatatttgagcatttcggtgagagtgtcttcagagaaaaagagactgaagcgttaaagaaactctctttgatgtaccaccaagttgttgtttcaaccgggggaggggcagttataagacccatcaattggaagtacatgcataaaggtattagtatttggcttgatgtacctctagaagccttagcgcatagaatagctgctgtaggaactggttcaagaccattgctacatgatgatgagtcaggggacacatacacagcggctttaaaccgtctttcaacgatttgggatgcacgtggtgaagcatacactaaagccagcgcaagagtttccttggagaatattactttgaagctcggttatagaagtgtctcagatcttacaccagctgaaatcgccattgaggcctttgagcaagttcagagctatttagagaaagaagatggtatggctagaccagatggactctag

SEQ ID NO: 16 - protein, 918 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGAAGCAGCTACTGTTCAGAGGTTTCAGTACTCATCATGGAATGATTTGAGAAATTTTGAAGGGAAGCCTCGTGGTTCTCTGAGGTATAATACACAGCGAATTAAGGAAGATAAAAGGTTTAGAGTTGTTGCTTTAACTCTTGACAAAAGAAGGGATCATCGACTTAGATCAGTTTCTGATAAGAACTCCTCAGCATTGTTGGAAACTGGAAGTCTTCTTCATTCTCCATTTGATGAAGAACAACAGATTTTGAAGGCCATGGATTACATTAGCTTCTGCAGAAAAAAGCTGAAGAGCTTCTCTTGCATTTTGGTAGTTGAACAGTTTCCTCGTGAATGCGTTAGGTATGATGGGTTCCGGGAAAACGACTGTAGGGAAGATTATGGCAAGATCGCTTGTGACACTTTGATCGAGCAGGCTATGAAGGGAACTTCTGTAGCTGAGATATTTGAGCATTTCGGTGAGAGTGTCTTCAGAGAAAAAGAGACTGAAGCGTTAAAGAAACTCTCTTTGATGTACCACCAAGTTGTTGTTTCAACCGGGGGAGGGGCAGTTATAAGACCCATCAATTGGAAGTACATGCATAAAGGTATTAGTATTTGGCTTGATGTACCTCTAGAAGCCTTAGCGCATAGAATAGCTGCTGTAGGAACTGGTTCAAGACCATTGCTACATGATGATGAGTCAGGGGACACATACACAGCGGCTTTAAACCGTCTTTCAACGATTTGGGATGCACGTGGTGAAGCATACACTAAAGCCAGCGCAAGAGTTTCCTTGGAGAATATTACTTTGAAGCTCGGTTATAGAAGTGTCTCAGATCTTACACCAGCTGAAATCGCCATTGAGGCCTTTGAGCAAGTTCAGAGCTATTTAGAGAAAGAAGATGGTATGGCTAGACCAGATGGACTCTAG

SEQ ID NO: 17 - DNA, 1557 bp, Arabidopsis thaliana
  misc_feature (1)..(1557): Ceres cDNA ID no. 1821576
atggctagaaagaagactgaaactgcaactgagtcctcaaaggagatcaaagcgaaaggaaaattcaccagagccaagaagtctatgaaaacaactactaagaatatccatcaatctggaaaacataatagtggaaaagaggagaagtataaatgttcagctcagccttcatcttctcaagagcaaaggctgatacatactgaagaccaaactcaaaaagtacctgtccttgatatccattcgagcaaggacgttccacgttctggaaaaatgaagctgcagctctttcctttggatgctcatacccgtgaaggattggaaaaggacggctttcacccatacttggagctcactcttagctcacggaagaagatttcttcagtgcttcaacgcattcacagtaagtggggcagctcagagattgctcgtggagatcccacgttgtacccttatgatacatcggtacttgcttctggtcataaatgggtagcaaacagcaacatcactacaggcaatgtctatgaagctattggagctccatttattttccgcttacggtatgggtggtcctctgcgactgaaaataaaaccaatgaaccgccatctccttcaactccaggtacaggaacgcagatgttaggttcagagaacccattgactatgctgtcctctccaaatcaagtgactgacacacctcccttggaaaacttaccgcatgatggacaagttgagtcaacggagaataagataaacgatggatctggcccgacattgcttttttgggatgatggattaacaagcctaagtattggtggcttgctttcagaagtatcattgaagggaaactttggaaatcattgtaaaaattcaaacgcagggaatgcaaatgcaactctctgggaagacaatcttactaacataagcattggaggtctattttctgaggcttctttacaagacagatggcatatgaacaatgaacgagaaccagctcataatggtcagtctattggaagtataggaggcttactatctgaagcatcaattctaggagaaggaaggattagtgactgtaacaaaacatgggaaacaaggagagctatcaaacaaccaccattacctctaatctctgattcattagatgctttcctcgtgaaccaaacagataaccgtcgagctccttgccatgcccctcttcctgagtcgtcacattcgtctatactcgatgcagaagatacgtgccatgcattttcatttcgaaagcgtaccacaataacaccaaaggttcacgatcaggtaagtggagaagttgagaaggagaaacagattgatgaatcgaaccccgcaaaaccattattgggttcctcggtgtttaatcaagacagcagcctcggattatcaggaatcaagtgggctgaatcacggggaccatttgatttcggcttatcttcatcgcgaaagtttgctaatggagacagcgtaagctttggtgctgtagtaaaagatttgcaggaaatggagcctttagaaaagaaaataaagcttcaaaagcattga

SEQ ID NO: 18 - protein, 518 aa, Arabidopsis thaliana
  misc_feature: GI Number: 22218300; NR Description: myb/SANT domain protein
  misc_feature: GI Number: 30686982; NR Description: myb family transcription
  misc_feature: GI Number: 34906224; NR Description: P0666G04.18 [Oryza sativa (japonica cultivar-group)] >gi|13122435|dbj|BAB32916.1|
MARKKTETATESSKEIKAKGKFTRAKKSMKTTTKNIHQSGKHNSGKEEKYKCSAQPSSSQEQRLIHTEDQTQKVPVLDIHSSKDVPRSGKMKLQLFPLDAHTREGLEKDGFHPYLELTLSSRKKISSVLQRIHSKWGSSEIARGDPTLYPYDTSVLASGHKWVANSNITTGNVYEAIGAPFIFRLRYGWSSATENKTNEPPSPSTPGTGTQMLGSENPLTMLSSPNQVTDTPPLENLPHDGQVESTENKINDGSGPTLLFWDDGLTSLSIGGLLSEVSLKGNFGNHCKNSNAGNANATLWEDNLTNISIGGLFSEASLQDRWHMNNEREPAHNGQSIGSIGGLLSEASILGEGRISDCNKTWETRRAIKQPPLPLISDSLDAFLVNQTDNRRAPCHAPLPESSHSSILDAEDTCHAFSFRKRTTITPKVHDQVSGEVEKEKQIDESNPAKPLLGSSVFNQDSSLGLSGIKWAESRGPFDFGLSSSRKFANGDSVSFGAVVKDLQEMEPLEKKIKLQKH

SEQ ID NO: 19 - DNA, 1914 bp, Arabidopsis thaliana
  misc_feature (1)..(1914): Ceres cDNA ID no. 1822181
  misc_feature (1)..(1914): Also known as  Ceres CDNA ID no. 23786979
atggtggctggtaaggttcgtgtaacaatgggttttcacaaatcaccttctactaaaaaaaccaaagacatgccttctcctttacctcttcctcctcctcctcctcctccacttaaaccaccttcttccggttccgctactactaaaccaccgattaatcctagtaaaccgggtttcactcgctctttcggtgtttatttcccacgcgcttccgctcaagttcacgccactgctgctgctgcttctcataacggcgtcgtttctgagcttcgtcgtcaagtcgaggagcttcgtgagagagaagctctgttgaaaacagagaatctcgagatcgctgataagaacggcgaaatcgatgagcttaggaaagagacggcgagattagcggaggacaacgagagattacggcgagaatttgaccggagcgaggaaatgaggagagagtgtgagacgagggagaaggaaatggaggcggagattgttgagcttcggaaacttgtttcgtcggagagtgacgaccacgcgctctctgtttctcagaggtttcagggtttaatggatgtgtcggcgaaatctaacctaatcagaagtttaaaacgggtcgggtcgttgaggaatttacccgaaccgattacgaatcaagagaataccaacaagagcatttcatcatccggagacgccgacggcgacatttatcggaaagacgagatcgagagttattcacggagtagtaactcggaggaactcactgagtcatcgtctctctcaaccgtcagatctagagttccgagagtccctaaaccaccgccgaaacggtctatttcgttaggtgattccacggagaacagagcagacccgccaccgcagaaatcgattccgcctcctcctcctccacctccgccaccgcttcttcaacaaccaccaccacctccgtctgtttccaaagctcctcctccgcctcctccaccaccgccgccgaagagtttaagcattgcgtcggcgaaagtgagaagagtaccggaagtggttgagttttatcactcgttgatgcgaagagactccacaaactcgagaagagattccaccggcggtggaaacgccgccgcggaagcaatacttgctaactccaacgccagagacatgatcggagaaatcgaaaaccgatcggtttatctcctcgcgataaaaaccgacgtagaaacgcaaggagatttcataaggttcttgatcaaagaagtcggaaacgctgcgttttcagacattgaagacgttgttcctttcgtcaaatggctcgacgacgaactctcttacctgttcaaagtttgtaaatttgttgttgtatctttgaaggttgatgagagagcagtgttgaaacatttcgagtggccggagcaaaaagctgatgctttacgtgaagcagcgttttgttatttcgatctaaagaaactcatatcagaagcttctcgtttccgggaagatcctcgtcaatcttctagctctgctcttaagaaaatgcaagctttgtttgaaaagttagagcatggtgtttatagtctttcgaggatgagagaatcggcggcaacaaaattcaagagtttccagattccggttgattggatgctcgaaaccggtattactagccagattaaactggcatccgtgaaactagcgatgaagtatatgaagagagtatccgcagagctagaggctattgaaggtggtggccctgaagaggaagagctaattgtccaaggtgttcgattcgcattccgtgttcatcagtttgccggaggatttgatgcagaaacaatgaaggcatttgaagagctaagagataaagcaagatcatgtcatgttcagtgtcaaagccaaacacatcaacataaactttgttttcgatctaccccttgttaa

SEQ ID NO: 20 - protein, 1914 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGTGGCTGGTAAGGTTCGTGTAACAATGGGTTTTCACAAATCACCTTCTACTAAAAAAACCAAAGACATGCCTTCTCCTTTACCTCTTCCTCCTCCTCCTCCTCCTCCACTTAAACCACCTTCTTCCGGTTCCGCTACTACTAAACCACCGATTAATCCTAGTAAACCGGGTTTCACTCGCTCTTTCGGTGTTTATTTCCCACGCGCTTCCGCTCAAGTTCACGCCACTGCTGCTGCTGCTTCTCATAACGGCGTCGTTTCTGAGCTTCGTCGTCAAGTCGAGGAGCTTCGTGAGAGAGAAGCTCTGTTGAAAACAGAGAATCTCGAGATCGCTGATAAGAACGGCGAAATCGATGAGCTTAGGAAAGAGACGGCGAGATTAGCGGAGGACAACGAGAGATTACGGCGAGAATTTGACCGGAGCGAGGAAATGAGGAGAGAGTGTGAGACGAGGGAGAAGGAAATGGAGGCGGAGATTGTTGAGCTTCGGAAACTTGTTTCGTCGGAGAGTGACGACCACGCGCTCTCTGTTTCTCAGAGGTTTCAGGGTTTAATGGATGTGTCGGCGAAATCTAACCTAATCAGAAGTTTAAAACGGGTCGGGTCGTTGAGGAATTTACCCGAACCGATTACGAATCAAGAGAATACCAACAAGAGCATTTCATCATCCGGAGACGCCGACGGCGACATTTATCGGAAAGACGAGATCGAGAGTTATTCACGGAGTAGTAACTCGGAGGAACTCACTGAGTCATCGTCTCTCTCAACCGTCAGATCTAGAGTTCCGAGAGTCCCTAAACCACCGCCGAAACGGTCTATTTCGTTAGGTGATTCCACGGAGAACAGAGCAGACCCGCCACCGCAGAAATCGATTCCGCCTCCTCCTCCTCCACCTCCGCCACCGCTTCTTCAACAACCACCACCACCTCCGTCTGTTTCCAAAGCTCCTCCTCCGCCTCCTCCACCACCGCCGCCGAAGAGTTTAAGCATTGCGTCGGCGAAAGTGAGAAGAGTACCGGAAGTGGTTGAGTTTTATCACTCGTTGATGCGAAGAGACTCCACAAACTCGAGAAGAGATTCCACCGGCGGTGGAAACGCCGCCGCGGAAGCAATACTTGCTAACTCCAACGCCAGAGACATGATCGGAGAAATCGAAAACCGATCGGTTTATCTCCTCGCGATAAAAACCGACGTAGAAACGCAAGGAGATTTCATAAGGTTCTTGATCAAAGAAGTCGGAAACGCTGCGTTTTCAGACATTGAAGACGTTGTTCCTTTCGTCAAATGGCTCGACGACGAACTCTCTTACCTGTTCAAAGTTTGTAAATTTGTTGTTGTATCTTTGAAGGTTGATGAGAGAGCAGTGTTGAAACATTTCGAGTGGCCGGAGCAAAAAGCTGATGCTTTACGTGAAGCAGCGTTTTGTTATTTCGATCTAAAGAAACTCATATCAGAAGCTTCTCGTTTCCGGGAAGATCCTCGTCAATCTTCTAGCTCTGCTCTTAAGAAAATGCAAGCTTTGTTTGAAAAGTTAGAGCATGGTGTTTATAGTCTTTCGAGGATGAGAGAATCGGCGGCAACAAAATTCAAGAGTTTCCAGATTCCGGTTGATTGGATGCTCGAAACCGGTATTACTAGCCAGATTAAACTGGCATCCGTGAAACTAGCGATGAAGTATATGAAGAGAGTATCCGCAGAGCTAGAGGCTATTGAAGGTGGTGGCCCTGAAGAGGAAGAGCTAATTGTCCAAGGTGTTCGATTCGCATTCCGTGTTCATCAGTTTGCCGGAGGATTTGATGCAGAAACAATGAAGGCATTTGAAGAGCTAAGAGATAAAGCAAGATCATGTCATGTTCAGTGTCAAAGCCAAACACATCAACATAAACTTTGTTTTCGATCTACCCCTTGTTAA

SEQ ID NO: 21 - DNA, 810 bp, Arabidopsis thaliana
  misc_feature (1)..(810): Ceres cDNA ID no. 1822400
atggcctcttctagattccaatctgggttttgtcctatctcttcgtgtccctctcttgagaatttcatcgaaaggattaaagacgcatgtcgtttcaccctctccgctgttctagggacaattctctcggcggtcttgactttcttcttcgctttagagctaagaaagttgtttccttcttcagtgggcacattgcttggagcacttactggagctttgataggccaagaaaccgaaagtgggtttatccgaggagcggcggttggagccatttcgggagctgttttctctatcgaaattgatgtcattgttagtctgataagtggtagacttgtgcgggaacgaataggtccagcaatgctaagtgcggttcaaacaatgagatctcctctaatcatattcatctctcttctcactgatcagatgggagctgtggattcaactttcgaagagctctcgagtattttcgataccggtggctcaaaggggttaacaggagatttggttgataaaatacctaaaatcaaaatcactggcaaaaacaacttagatgcttctggcaacaaagactcatgttctgtttgtcttcaggttttttgctcatttcagctcaaacgaaatcttaattccccaaatgcagaaccaaaaggtttagttcttgatcttcttttgtgtaactttttgcaggattttcaacttggtgaaacggtgagaagcttgccacattgtcatcacatgtttcacttgccttgcatagacaattggctcttcaggcacggatcttgtccaatgtgtagacgcgatctgtaa

SEQ ID NO: 22 - protein, 269 aa, Arabidopsis thaliana
  misc_feature: PFam Name: zf-C3HC4; PFam Description: Zinc finger, C3HC4
  misc_feature: GI Number: 27524902; NR Description: NEP1-interacting protein
  misc_feature: GI Number: 27524904; NR Description: NEP1-interacting protein 2 [Arabidopsis thaliana] gi|30680091|ref|NP_179364.2| zinc finger
  misc_feature: GI Number: 38228693; NR Description: zinc finger protein
  misc_feature: GI Number: 32526674; NR Description: zinc finger protein like
  misc_feature: GI Number: 50912679; NR Description: putative NEP1-interacting protein [Oryza sativa (japonica cultivar-group)] >gi|46390630|dbj|BAD16113.1| putative NEP1-interacting protein
MASSRFQSGFCPISSCPSLENFIERIKDACRFTLSAVLGTILSAVLTFFFALELRKLFPSSVGTLLGALTGALIGQETESGFIRGAAVGAISGAVFSIEIDVIVSLISGRLVRERIGPAMLSAVQTMRSPLIIFISLLTDQMGAVDSTFEELSSIFDTGGSKGLTGDLVDKIPKIKITGKNNLDASGNKDSCSVCLQVFCSFQLKRNLNSPNAEPKGLVLDLLLCNFLQDFQLGETVRSLPHCHHMFHLPCIDNWLFRHGSCPMCRRDL

SEQ ID NO: 23 - DNA, 1257 bp, Arabidopsis thaliana
  misc_feature (1)..(1257): Ceres cDNA ID no. 1826595
  misc_feature (1)..(1257): Also known as  Ceres CDNA ID no. 23786979
atgaaaactctaagagacttacaggatcaatcatttgagctggaagattggcttccaattacagcatcacgaaatgctaattggtactattcagctttccacaacgtcactgccatagttggtgctggagttcttggtctcccttacgccatgtcagaacttggatggggacctggagttgtggtgttgatcctgtcatgggtcataacgttatacacgttctggcaaatgattgagatgcacgaaatgtttgaagggaaacggtttgataggtaccacgagctaggacaagcagcctttggcaaaaagcttggtttgtacatcgtcgtgccgcttcaacttcttgttgagacaagtgcttgcatagtgtatatggtgacaggaggtgaatcactgaaaaagattcatcaactttctgtgggagactacgagtgtagaaagttgaaagttcgacacttcattttgatctttgcctcttcacagtttgtgctttcccttcttaaaaatttcaactccatttccggtgtctctttggtagctgccgtcatgtctatgagctattccacaattgcttgggtagcttcactgacaaagggtgtcgcgaacaatgttgaatatggatataaaagaagaaacaacacctcagtgccattagccttcttaggcgcattgggggagatggcttttgcgtatgcaggtcacaatgttgttttagaaattcaagcaacgattccatcaacaccagaaaatccatcaaaacgacccatgtggaagggagccattgtagcctatattattgtagctttctgttacttccctgtggcccttgtagggttttggacattcggaaacaacgttgaagaaaacattctcaaaacactccggggcccgaagggacttataattgtggccaacatttttgtgattatacatctcatgggaagctaccaggtgtacgcaatgcccgtgtttgacatgatcgaatctgtaatgataaagaaatggcacttcagtccaacaagagttctacggtttaccatccgttggacttttgtggccgccacgatggggatagcagtcgctctaccgcatttcagtgctttgctgtcattttttggaggattcatatttgccccgaccacatactttatcccttgcatcatatggctgatcctgaagaaaccaaagagatttagtctatcatggtgtatcaattgggcaagtggaactcctccctttggtctttttgtcaattga

SEQ ID NO: 24 - protein, 1257 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGAAAACTCTAAGAGACTTACAGGATCAATCATTTGAGCTGGAAGATTGGCTTCCAATTACAGCATCACGAAATGCTAATTGGTACTATTCAGCTTTCCACAACGTCACTGCCATAGTTGGTGCTGGAGTTCTTGGTCTCCCTTACGCCATGTCAGAACTTGGATGGGGACCTGGAGTTGTGGTGTTGATCCTGTCATGGGTCATAACGTTATACACGTTCTGGCAAATGATTGAGATGCACGAAATGTTTGAAGGGAAACGGTTTGATAGGTACCACGAGCTAGGACAAGCAGCCTTTGGCAAAAAGCTTGGTTTGTACATCGTCGTGCCGCTTCAACTTCTTGTTGAGACAAGTGCTTGCATAGTGTATATGGTGACAGGAGGTGAATCACTGAAAAAGATTCATCAACTTTCTGTGGGAGACTACGAGTGTAGAAAGTTGAAAGTTCGACACTTCATTTTGATCTTTGCCTCTTCACAGTTTGTGCTTTCCCTTCTTAAAAATTTCAACTCCATTTCCGGTGTCTCTTTGGTAGCTGCCGTCATGTCTATGAGCTATTCCACAATTGCTTGGGTAGCTTCACTGACAAAGGGTGTCGCGAACAATGTTGAATATGGATATAAAAGAAGAAACAACACCTCAGTGCCATTAGCCTTCTTAGGCGCATTGGGGGAGATGGCTTTTGCGTATGCAGGTCACAATGTTGTTTTAGAAATTCAAGCAACGATTCCATCAACACCAGAAAATCCATCAAAACGACCCATGTGGAAGGGAGCCATTGTAGCCTATATTATTGTAGCTTTCTGTTACTTCCCTGTGGCCCTTGTAGGGTTTTGGACATTCGGAAACAACGTTGAAGAAAACATTCTCAAAACACTCCGGGGCCCGAAGGGACTTATAATTGTGGCCAACATTTTTGTGATTATACATCTCATGGGAAGCTACCAGGTGTACGCAATGCCCGTGTTTGACATGATCGAATCTGTAATGATAAAGAAATGGCACTTCAGTCCAACAAGAGTTCTACGGTTTACCATCCGTTGGACTTTTGTGGCCGCCACGATGGGGATAGCAGTCGCTCTACCGCATTTCAGTGCTTTGCTGTCATTTTTTGGAGGATTCATATTTGCCCCGACCACATACTTTATCCCTTGCATCATATGGCTGATCCTGAAGAAACCAAAGAGATTTAGTCTATCATGGTGTATCAATTGGGCAAGTGGAACTCCTCCCTTTGGTCTTTTTGTCAATTGA

SEQ ID NO: 25 - DNA, 1032 bp, Arabidopsis thaliana
  misc_feature (1)..(1032): Ceres cDNA ID no. 1989254
atggagaagaagaaggtgacgattccacaagtgtgtcatggccattcaagacctgttgttgatttgttctacagtccaattactcctgacggtttcttcctcatcagcgctagcaaagattcgcatccaatgttgagaaatggggaaactggagactggattggtacatttgaagggcataaaggtgcagtttggagttcttgtctggataacaatgcattacgtgctgcatctgcttctgccgatttttcagccaaactttgggatgcgttaacaggggatgtgctgcattcttttgagcacaagcatattgtccgagcatgcgccttctcagaggatacaaaatcgttgctcacaggagggtttgagaaaattcttcgtgtttttgacatgaatcggttggatgcacctcctacagaagttgataaatctcctggttctatcagaaccctcacatggcttcacagtgatcaaacaatattaagttcatgtactgatattggcggtgtaaggttatgggatgtgaggagtgggaaaattgtgcaaacgttagaaactaagtctcctgtcaccagtgctgaagtgagccaagatggacggtatataacaactgctgatgggtcaactgttaaattctgggacgctaaccattttggactagtgaagagttacgacatgccctgcaatattgaatctgcatcgttggagccaaagtctggtgaaaaatttgttgctggtggagaggatatgtgggtccgagtgtttgatttctacactggcgaagagattggatgcaacaagggacatcacggtccagtacactgcgttaggtttactcccactggtttatcctatgcctcgggatctgaagacgggacaatcagaatctggcaaacaacaccagcaaatcccgaagagaacgaaactagctcgaggagagtgaagcatagcgtggatgaagtttcaaagaagattgaaggctttcacatcaacaaagaaggaaaaaccgcagagaaaccatctgatacttaa

SEQ ID NO: 26 - protein, 343 aa, Arabidopsis thaliana
  misc_feature: PFam Name: WD40; PFam Description: WD domain, G-beta repeat
  misc_feature: GI Number: 50906147; NR Description: putative serine-threonine kinase receptor-associated protein [Oryza sativa (japonica cultivar-group)] >gi|46390530|dbj|BAD16018.1| putative serine-threonine kinase receptor-associated protein [Oryza sativa
  misc_feature: GI Number: 12667270; NR Description: serine-threonine kinase
  misc_feature: GI Number: 48122105; NR Description: similar to
  misc_feature: GI Number: 50729050; NR Description: PREDICTED: similar to UNR-interacting protein (Serine-threonine kinase
  misc_feature: GI Number: 4519417; NR Description: WD-40 repeat protein
MEKKKVTIPQVCHGHSRPVVDLFYSPITPDGFFLISASKDSHPMLRNGETGDWIGTFEGHKGAVWSSCLDNNALRAASASADFSAKLWDALTGDVLHSFEHKHIVRACAFSEDTKSLLTGGFEKILRVFDMNRLDAPPTEVDKSPGSIRTLTWLHSDQTILSSCTDIGGVRLWDVRSGKIVQTLETKSPVTSAEVSQDGRYITTADGSTVKFWDANHFGLVKSYDMPCNIESASLEPKSGEKFVAGGEDMWVRVFDFYTGEEIGCNKGHHGPVHCVRFTPTGLSYASGSEDGTIRIWQTTPANPEENETSSRRVKHSVDEVSKKIEGFHINKEGKTAEKPSDT

SEQ ID NO: 27 - DNA, 1248 bp, Arabidopsis thaliana
  misc_feature (1)..(1248): Ceres cDNA ID no. 2703868
  misc_feature (1)..(1248): Also known as  Ceres CDNA ID no. 23786979
atgtctcctgcgatcaaagcaccgctcttaccaaaccaagagccttcatcatcatcatcggagaaccatggatcattcgccggagctgtgtttaacatctcgacaagcatcgtcggagctggaattatggcgattccggcggctttcaaagtcctagctgggtttttaatgaaatccagtctcgccggagaatcaacaacttacgccggcgtgatgaaggaatcgttcggaaaatctggtgccgttgctgttacggttgttacaatggttgtgacttttgggtctatgattattttctcgattatcattggtgatgttatttcgggtaatgagaaagatggaatcatacatttaggtcttcttcaagaatggtttggttctcattggtggaatacgagattctttgaaagattggcatttagttctgcaatttcgtttctgcttgcgttactctttgttgtcataagctcggtgttagcgattattgctctcgtgcaagggaagacaaagcctccgagactcttccctgaactcaatgatggtggattatcgtttttcagtctcttcactgcttcccctgtcattgtaacagccttcacctttcatttcaatggtaagaaaccaagaaccaagaactttatggttattgcagtccatccagtagcattcgaactcaaagatccattaaatgtgctttcagcaacaaggatctctgtgattctgtgtgctacgatctactcagctactggtctcttttgttaccttctgtttggggattccactatgacagatgttctaatgaactttgatcaaagcaccagttcttcggttggttcattactaaatgatattgttagactcagctacgcgattcacctcatgctcgtgtttcctctgctcaacttctcgcttagagccaacctcgacgaactcttgttccctatgaagctttctttagtggaagacaacaaaagattcttcgcactcacttttccattactgatatcttgtttcttgggtgcaattgccataccagacatttggtacttctttcagttcttgggatcaacttctacagtctctatagcattcatctttccagctgcaattgtcctacggaatgtaaatggtttctcgactttaagagagaagattgtagcttcagtaatgcttgttcttgctgttgccacaagtatcatcgctatttcgacaaatatatacactttcacagcaacagaagaaacatga

SEQ ID NO: 28 - protein, 1248 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGTCTCCTGCGATCAAAGCACCGCTCTTACCAAACCAAGAGCCTTCATCATCATCATCGGAGAACCATGGATCATTCGCCGGAGCTGTGTTTAACATCTCGACAAGCATCGTCGGAGCTGGAATTATGGCGATTCCGGCGGCTTTCAAAGTCCTAGCTGGGTTTTTAATGAAATCCAGTCTCGCCGGAGAATCAACAACTTACGCCGGCGTGATGAAGGAATCGTTCGGAAAATCTGGTGCCGTTGCTGTTACGGTTGTTACAATGGTTGTGACTTTTGGGTCTATGATTATTTTCTCGATTATCATTGGTGATGTTATTTCGGGTAATGAGAAAGATGGAATCATACATTTAGGTCTTCTTCAAGAATGGTTTGGTTCTCATTGGTGGAATACGAGATTCTTTGAAAGATTGGCATTTAGTTCTGCAATTTCGTTTCTGCTTGCGTTACTCTTTGTTGTCATAAGCTCGGTGTTAGCGATTATTGCTCTCGTGCAAGGGAAGACAAAGCCTCCGAGACTCTTCCCTGAACTCAATGATGGTGGATTATCGTTTTTCAGTCTCTTCACTGCTTCCCCTGTCATTGTAACAGCCTTCACCTTTCATTTCAATGGTAAGAAACCAAGAACCAAGAACTTTATGGTTATTGCAGTCCATCCAGTAGCATTCGAACTCAAAGATCCATTAAATGTGCTTTCAGCAACAAGGATCTCTGTGATTCTGTGTGCTACGATCTACTCAGCTACTGGTCTCTTTTGTTACCTTCTGTTTGGGGATTCCACTATGACAGATGTTCTAATGAACTTTGATCAAAGCACCAGTTCTTCGGTTGGTTCATTACTAAATGATATTGTTAGACTCAGCTACGCGATTCACCTCATGCTCGTGTTTCCTCTGCTCAACTTCTCGCTTAGAGCCAACCTCGACGAACTCTTGTTCCCTATGAAGCTTTCTTTAGTGGAAGACAACAAAAGATTCTTCGCACTCACTTTTCCATTACTGATATCTTGTTTCTTGGGTGCAATTGCCATACCAGACATTTGGTACTTCTTTCAGTTCTTGGGATCAACTTCTACAGTCTCTATAGCATTCATCTTTCCAGCTGCAATTGTCCTACGGAATGTAAATGGTTTCTCGACTTTAAGAGAGAAGATTGTAGCTTCAGTAATGCTTGTTCTTGCTGTTGCCACAAGTATCATCGCTATTTCGACAAATATATACACTTTCACAGCAACAGAAGAAACATGA

SEQ ID NO: 29 - DNA, 2466 bp, Arabidopsis thaliana
  misc_feature (1)..(2466): Ceres cDNA ID no. 2704018
atggcgacaagtgaagaacctagtacggatgcctccataatatgttatgcgccaagcatgatcaccaccaatggtgtttggcaaggcgataatcctctcgacttttcgctacctctctttgttcttcagctaactttggttgttgtcgtcactcgtttcttcgtctttatcctcaaaccctttcgccaacctcgtgtcatctccgagatccttggcggaattgttcttggaccatcggtgctagggcgctccacaaaatttgcacacactattttccctcaaagaagtgtgatggtacttgaaacaatggctaatgtgggtttactttacttcctattcttggtgggtgtagagatggacattatggttgtacgtaagacagggaagcgagccctaaccatcgctattggtggtatggttttaccattcctcattggtgctgccttctctttctctatgcatagatcagaagaccacttagggcaaggcacctatatacttttccttggtgttgcactctccgttactgcattcccggttcttgcaagaattcttgctgagctcaagctcatcaataccgagattgggcggatatcgatgtctgcagctttagttaacgacatgttcgcttggattcttttggccttagctattgcattggctgagagtgacaaaacttcatttgcctctctttgggttatgatctctagtgcagttttcattgccgtttgtgtttttgttgtgagaccaggcattgcttggatcatacgtaaaacccctgaaggagagaatttcagtgagttccacatatgcctaatcttgacaggagttatgatctccggtttcattactgatgcaatcggaacacattcagtctttggtgcttttgtgtttggtcttgtgattcccaatggacctcttggtctaaccctcattgagaagcttgaagatttcgtctctggccttctcctacctctcttctttgccataagtggtctcaagactaatatagctgccattcaaggccctgccacgtggttaactctgtttcttgtcattttcctcgcttgtgctggaaaggtcatcggtacagttattgttgcgtttttccatggaatgccagttcgtgaaggaatcactcttggactactcttgaacactaaaggtcttgttgaaatgattgtacttaatgttggaaaagaccaaaaggttttggatgatgagacatttgctactatggtacttgtggccttggttatgactggagtcattactcctattgtaacaatcctttacaagccagtgaagaaatctgtttcatacaagagacgaacaatccaacaaacgaagccagacagcgagcttcgggtattggtttgcgttcacacaccgcgtaatgttcctactataattaaccttcttgaagcttcacatcccacaaagagatctcctatatgcatctacgttctccaccttgttgagctcacgggccgcgcatccgcgatgttgattgtccacaacactcgtaagtcaggacgacccgcgcttaacagaactcaagctcaatcagatcatatcatcaacgcctttgagaactatgaacaacacgctgcctttgtcgctgtacaacctttaacagctatttcaccttactcaacaatgcatgaagatgtttgtagcttagcagaggacaaacgtgtctccttcataatcataccatttcacaaacaacaaacagttgatggaggaatggaatcaaccaacccggcctaccgtttagtcaaccaaaacctactcgaaaactcgccttgttcggtcggaatactcgtggatagaggactcaatggagcgacaagactcaactcaaacactgtttctcttcaagttgctgttctgtttttcggcggtccagacgatagagaagctttggcttatgcatggagaatggctcaacatcctggcatcactctaactgttttacggttcattcatgatgaagatgaagcagacacagcttcaacacgagcgaccaatgacagtgacctaaagataccaaagatggaccatagaaaacaaagacaacttgatgatgactacattaatctctttagggcagaaaatgcggaatacgagtcaattgtgtatatagaaaaactagtgagcaatggggaagagactgttgcagcagtgagatcaatggacagttctcatgatttgtttatagttggaagaggagaaggaatgtcgtctcctcttaccgcgggtttaactgattggagtgagtgtcctgagcttggtgccattggagatttgcttgcttcatcagactttgcagctactgtgtcggttcttgtggttcaacagtatgttgggtcatgggcacaagaagatgatatggattttcctgagagtccagtacattcacatgaaacaaaagtcacatatggtttagagaatccacgttag

SEQ ID NO: 30 - protein, 821 aa, Arabidopsis thaliana
  misc_feature: PFam Name: Na_H_Exchanger; PFam Description: Sodium/hydrogen
  misc_feature: GI Number: 34909252; NR Description: B1148D12.14 [Oryza sativa (japonica cultivar-group)] >gi|15528788|dbj|BAB64829.1|
  misc_feature: GI Number: 9294151; NR Description: Na+/H+ exchangeing
  misc_feature: GI Number: 15128390; NR Description: P0454H12.8 [Oryza sativa
  misc_feature: GI Number: 8778833; NR Description: T6D22.24 [Arabidopsis thaliana]
  misc_feature: GI Number: 25407027; NR Description: protein T23G18.2 [imported] - Arabidopsis thaliana >gi|6579214|gb|AAF18257.1|AC011438_19 T23G18.2 [Arabidopsis
MATSEEPSTDASIICYAPSMITTNGVWQGDNPLDFSLPLFVLQLTLVVVVTRFFVFILKPFRQPRVISEILGGIVLGPSVLGRSTKFAHTIFPQRSVMVLETMANVGLLYFLFLVGVEMDIMVVRKTGKRALTIAIGGMVLPFLIGAAFSFSMHRSEDHLGQGTYILFLGVALSVTAFPVLARILAELKLINTEIGRISMSAALVNDMFAWILLALAIALAESDKTSFASLWVMISSAVFIAVCVFVVRPGIAWIIRKTPEGENFSEFHICLILTGVMISGFITDAIGTHSVFGAFVFGLVIPNGPLGLTLIEKLEDFVSGLLLPLFFAISGLKTNIAAIQGPATWLTLFLVIFLACAGKVIGTVIVAFFHGMPVREGITLGLLLNTKGLVEMIVLNVGKDQKVLDDETFATMVLVALVMTGVITPIVTILYKPVKKSVSYKRRTIQQTKPDSELRVLVCVHTPRNVPTIINLLEASHPTKRSPICIYVLHLVELTGRASAMLIVHNTRKSGRPALNRTQAQSDHIINAFENYEQHAAFVAVQPLTAISPYSTMHEDVCSLAEDKRVSFIIIPFHKQQTVDGGMESTNPAYRLVNQNLLENSPCSVGILVDRGLNGATRLNSNTVSLQVAVLFFGGPDDREALAYAWRMAQHPGITLTVLRFIHDEDEADTASTRATNDSDLKIPKMDHRKQRQLDDDYINLFRAENAEYESIVYIEKLVSNGEETVAAVRSMDSSHDLFIVGRGEGMSSPLTAGLTDWSECPELGAIGDLLASSDFAATVSVLVVQQYVGSWAQEDDMDFPESPVHSHETKVTYGLENPR

SEQ ID NO: 31 - DNA, 2361 bp, Arabidopsis thaliana
  misc_feature (1)..(2361): Ceres cDNA ID no. 2705693
atggatgctccggttccactctctttatctactctgttagaactctgcaccaatctcttgcaaaaatctgtaaacaagtccaatggtcgtttcacagcgcaattggttcattgccgtgttatcaaatcgggtcttatgttcagcgtctacctgatgaataatctcatgaacgtctactcaaaaactggttatgctcttcacgcacgcaagctgttcgacgaaatgcctctaagaacagctttttcatggaacacggttctttcggcttattctaaacgaggagatatggattcgacttgtgagttctttgatcagttgcctcaaagggattcggtttcgtggactacgatgattgttgggtataagaacattggtcaatatcataaggctataagagttatgggggatatggtcaaggaagggattgagccgacgcagtttacgcttacgaatgtgcttgcatcggtggctgcaacgcggtgtatggaaacaggtaaaaaggttcattctttcatcgttaagcttggtcttcgcggtaacgtttctgtgtcgaattcactgcttaatatgtatgcaaaatgtggtgatccaatgatggcaaaatttgttttcgatagaatggttgttagagatatctcaagctggaatgctatgattgcgttacatatgcaggtcggtcaaatggatcttgctatggcgcagttcgagcaaatggctgagcgagatatagtcacttggaattctatgatttctggtttcaatcagagagggtatgatctcagagctctagatatcttttcgaagatgctgagggattctctgttgtcgccggatagattcactctggcgagtgtgttatctgcttgtgccaatcttgagaaactttgtattgggaagcagattcattcgcacattgttactacagggtttgatatttccggaatcgtgttaaatgcattgatctcgatgtattcgaggtgtggaggggtcgagactgcccggagactgatagaacaaagaggaaccaaagatctcaagattgaaggttttacagctttacttgatgggtacattaagcttggagatatgaatcaagctaagaatatatttgtttcgttgaaagatcgtgatgtagtcgcatggaccgccatgattgtaggatatgagcaacacggttcgtatggtgaagctataaaccttttcagatcaatggttggaggagggcagagaccaaacagttacactcttgcagcaatgttaagtgtagcttcaagtttggcatcattgagccatggcaagcaaatccatgggagtgctgtaaagtcaggggaaatttattcagtttctgtcagcaatgcattgataacaatgtatgcaaaggcgggtaacattacatcggcaagccgggcatttgatttgatacgctgtgagagggatacagtatcgtggacatccatgattatcgcgttggcacagcacggtcacgcagaagaagcacttgagctttttgagacaatgctgatggaaggactaagacctgatcacataacatatgttggtgttttctctgcctgtactcatgccggtttggtcaaccaaggtcgtcaatacttcgatatgatgaaggacgttgataagattatacctacccttagccactatgcttgtatggtggacctgtttggacgtgctggtttattgcaggaagcacaagagttcatcgaaaagatgcctattgagcctgatgtagtgacatggggttcactgctttctgcttgcagagttcacaagaacatcgatcttgggaaagttgcagcagagagattgcttcttctcgagccagagaacagcggggcatactcagccttggctaacttatactcagcttgtggaaaatgggaagaagctgctaagataagaaaatcaatgaaagatggaagagtaaagaaggaacaagggtttagctggattgaagtgaagcataaagtccatgtctttggagtggaagacgggactcatccagagaagaacgagatctacatgaccatgaagaagatttgggacgagatcaagaaaatgggttatgttcccgacacagcttctgtactacacgacctcgaagaagaggttaaagaacagattctaaggcaccacagcgagaaactagcaatcgcatttggactaattagcactccggataaaaccacattgaggatcatgaagaatctcagagtgtgcaatgattgccacacggctataaagttcatttccaagcttgtgggaagggaaatcatagtgagagatacaacaagatttcaccatttcaaagatgggttttgttcttgccgagattattggtga

SEQ ID NO: 32 - protein, 786 aa, Arabidopsis thaliana
  misc_feature: PFam Name: PPR; PFam Description: PPR repeat
  misc_feature: PFam Name: FBA_1; PFam Description: F-box associated
  misc_feature: GI Number: 51535971; NR Description: putative pentatricopeptide (PPR) repeat-containing protein [Oryza sativa
  misc_feature: GI Number: 50905853; NR Description: putative pentatricopeptide (PPR) repeat-containing protein [Oryza sativa (japonica cultivar-group)] >gi|46390971|dbj|BAD16484.1| putative pentatricopeptide (PPR) repeat-containing protein [Oryza sativa
  misc_feature: GI Number: 50899520; NR Description: putative pentatricopeptide (PPR) repeat-containing protein [Oryza sativa (japonica cultivar-group)] >gi|48716903|dbj|BAD23598.1| putative pentatricopeptide (PPR) repeat-containing protein [Oryza sativa
  misc_feature: GI Number: 58743498; NR Description: Putative Putative Pentatricopeptide (PPR) repeat-containing protein [Brassica
  misc_feature: GI Number: 30693150; NR Description: pentatricopeptide (PPR)
MDAPVPLSLSTLLELCTNLLQKSVNKSNGRFTAQLVHCRVIKSGLMFSVYLMNNLMNVYSKTGYALHARKLFDEMPLRTAFSWNTVLSAYSKRGDMDSTCEFFDQLPQRDSVSWTTMIVGYKNIGQYHKAIRVMGDMVKEGIEPTQFTLTNVLASVAATRCMETGKKVHSFIVKLGLRGNVSVSNSLLNMYAKCGDPMMAKFVFDRMVVRDISSWNAMIALHMQVGQMDLAMAQFEQMAERDIVTWNSMISGFNQRGYDLRALDIFSKMLRDSLLSPDRFTLASVLSACANLEKLCIGKQIHSHIVTTGFDISGIVLNALISMYSRCGGVETARRLIEQRGTKDLKIEGFTALLDGYIKLGDMNQAKNIFVSLKDRDVVAWTAMIVGYEQHGSYGEAINLFRSMVGGGQRPNSYTLAAMLSVASSLASLSHGKQIHGSAVKSGEIYSVSVSNALITMYAKAGNITSASRAFDLIRCERDTVSWTSMIIALAQHGHAEEALELFETMLMEGLRPDHITYVGVFSACTHAGLVNQGRQYFDMMKDVDKIIPTLSHYACMVDLFGRAGLLQEAQEFIEKMPIEPDVVTWGSLLSACRVHKNIDLGKVAAERLLLLEPENSGAYSALANLYSACGKWEEAAKIRKSMKDGRVKKEQGFSWIEVKHKVHVFGVEDGTHPEKNEIYMTMKKIWDEIKKMGYVPDTASVLHDLEEEVKEQILRHHSEKLAIAFGLISTPDKTTLRIMKNLRVCNDCHTAIKFISKLVGREIIVRDTTRFHHFKDGFCSCRDYW

SEQ ID NO: 33 - DNA, 1686 bp, Arabidopsis thaliana
  misc_feature (1)..(1686): Ceres cDNA ID no. 2705983
atggcgacagtaggatccctgaaacctctgcaccattcctcatgttcatcgagtttccctcggaatccgatcgtaaaccggaaagcccttcttggttttgtgtttgattctgcccggaaaaaccagattcgatgtgagaatttacgatattcatcggaaagcgatgggaagagaagaaatgcggcggcgaagaagaggaatcaatccccggaaagatgtgcggcggagggagtactgaccggaggaggggggtcggaggcgattgcggaggtgaggacgatgatgcctgagaggattaaggtagtgatattgacggcgtgcatgatgtgtctatgtaacgccgacagagttgttatgtccgtcgcggtggttccactcgccgataagcttggctggtcgagttctttcttaggggtagttcagtcctccttcctatggggttacattttttcatccgttatcggaggggcattggtggatcggtatggaggaaaaagagtgttggcttggggtgtggcattgtggtccttagccactctactcactccttgggcagctgcacactcgaccttagccttattgtgtgtccgcgccttttttggcctcgctgaaggcgttgcaatgccctccatgaccaccctactctctcggtggtttccaatggatgaacgagcgagtgcggttggtatatctatggccgggtttcacatgggaaatgttgtgggacttctgttgacgccactcatgttatcttccataggaatctctggtccatttattctttttgcatccttaggtctattgtgggtatccacttggtcaagcggagttacaaacaaccctcaggacagtcctttcatcactaggtcagaactcaggcttatccaggctggaaaaccagttcaaccgtcaaccatttcgccgaaaccaaacccatctttgcgacttcttttgtcgaaattgcctacttgggcgatcatttttgctaatgtgactaacaactggggatactttgttcttctctcatggatgcctgtttacttccagacggtgtttaatgtgaatttgaagcaagcagcttggtttagcgctcttccatgggcgacaatggcgatctcaggttactatgcaggagcagcatcggacttcttgataagaactggtcactctgtaacctcagtacgaaagatcatgcaatctattggatttatgggtcccgggctgtctctgctctgcctcaacttcgcaaagtcgccttcttgtgcagcggttttcatgaccattgcattgagcttgagttcctttagccaagctggatttctcctcaatatgcaagacatcgcaccgcaatatgctggtttcctgcacggtaataatgttatcagatggtggatcttttcttcttcttcttttgcatcgattttgtttcttgctgaaaaagttagggtttgtatatctggtgtgcgagacaggtatttcgaattgtgcgggtacgttggctgcgatcgtaagtacaatagggacgggatattttgtgcagtggctcggctcttttcaggcgttcttgacggttacggcctttctttactttgcaaccaccgtgttttggctcctctttgcaaccggagaacgagtcttctagatccaaaacgctctccttggacactttactgtttagagctttga

SEQ ID NO: 34 - protein, 561 aa, Arabidopsis thaliana
  misc_feature: PFam Name: MFS_1; PFam Description: Major Facilitator Superfamily
  misc_feature: PFam Name: Sugar_tr; PFam Description: Sugar (and other)
  misc_feature: GI Number: 34908356; NR Description: P0529H11.31 [Oryza sativa (japonica cultivar-group)] >gi|18461191|dbj|BAB84388.1| P0529E05.3 [Oryza sativa (japonica cultivar-group)] >gi|20805189|dbj|BAB92858.1| P0529H11.31 [Oryza sativa (japonica
  misc_feature: GI Number: 42569720; NR Description: transporter-related
  misc_feature: GI Number: 42572593; NR Description: transporter-related
  misc_feature: GI Number: 56784504; NR Description: putative membrane glycoprotein HP59 [Oryza sativa (japonica cultivar-group)] gi|56784255|dbj|BAD81937.1| putative membrane glycoprotein HP59
  misc_feature: GI Number: 52077187; NR Description: putative sialin [Oryza
MATVGSLKPLHHSSCSSSFPRNPIVNRKALLGFVFDSARKNQIRCENLRYSSESDGKRRNAAAKKRNQSPERCAAEGVLTGGGGSEAIAEVRTMMPERIKVVILTACMMCLCNADRVVMSVAVVPLADKLGWSSSFLGVVQSSFLWGYIFSSVIGGALVDRYGGKRVLAWGVALWSLATLLTPWAAAHSTLALLCVRAFFGLAEGVAMPSMTTLLSRWFPMDERASAVGISMAGFHMGNVVGLLLTPLMLSSIGISGPFILFASLGLLWVSTWSSGVTNNPQDSPFITRSELRLIQAGKPVQPSTISPKPNPSLRLLLSKLPTWAIIFANVTNNWGYFVLLSWMPVYFQTVFNVNLKQAAWFSALPWATMAISGYYAGAASDFLIRTGHSVTSVRKIMQSIGFMGPGLSLLCLNFAKSPSCAAVFMTIALSLSSFSQAGFLLNMQDIAPQYAGFLHGNNVIRWWIFSSSSFASILFLAEKVRVCISGVRDRYFELCGYVGCDRKYNRDGIFCAVARLFSGVLDGYGLSLLCNHRVLAPLCNRRTSLLDPKRSPWTLYCLEL

SEQ ID NO: 35 - DNA, 1521 bp, Arabidopsis thaliana
  misc_feature (1)..(1521): Ceres cDNA ID no. 2706628
  misc_feature (1)..(1521): Also known as  Ceres CDNA ID no. 23786979
atgttcatcctcagagttcattccgttgactccgagagaccaatctccgttgaagaagaagaatcaggtttcacttacgcatcgaaaagagctcagcctcctcttaaactcatacaaccatctctcaaactcaccgaccgcaaaggcttgatccatctctatcgcaaatcttcacatagctctctgcctaaccctagctcccgatccaccactctcttcatcgtcgctgttcccaattatctctcctctctcgattttatccgtttctgtgattcccgcatctcccaagtctccgacatcctcttcatcaggaacgatggaatggaagatagatatagtgttcttatcacattttctgatcaatccgaagctgatggtttctacaacaacttgaatgggaaaaagttcgcaccatctgaggctgaggtttgtcatattctatatgtaatgtcggtggaacacacagaatttgatgaggttgctgcagaagcacctactggatttaccgagttacctacgtgtccaatatgtcttgagagattagatcctgacaccagtggtatagttagcactctttgtgatcactcgtttcagtgttcttgcacttcgaaatggacttatctgtcttgtcaggtttgtcgattgtgtcaacagcaagatgagatattaaactgttctatttgtggaaaaactgagaatgtatgggcatgccttgtctgtggcttcgtaggttgtggaagatacaaggaagggcattctattaggcactggaaagaaacgcatcactgctattctcttgatttgcgaacacaacaaatctgggattatgttggtgacagctatgttcatcggttaaaccattcaaaaattgatggaaagtcagtagagatgagcaccagttgtctgtcacaccagggggactgtggcctctgtgagtgtagtgaggatacaggaattagcggagctatctttaacagcaaagttgattcaaatatgaatcttagatcatcagtttgcctcagtggttttatttttgtggaacagattgtaatcgagtataatgaccttcttgcaagtcaactaaagggacagcgacagtactatgaatctctcattgttgaggcgagaagcaagcaagaaagtagtattgccgaagcagtagagcaaattgttgttaacacaatgcaggagcttcagaataagattgaaaaatgtgaagaggaaaaaagtggtatcactgaagttaacacaaaacttataaaagagcaggatacttggcggaagaaggccaaagaaatagaagagagggaagctgcattgctaggatcaaaagacgagatgataactgatcttcaagaacagataagagatattacggtcttcattgaagccaagaaaaccttaaagaagatgtcatcagatacggatggtatacgcgaaggaaccgtcttaccagtgcctatcagtcccgagccagtttcctcagttagaaggcaaaagaagtcaaaccggagaaagtaa

SEQ ID NO: 36 - protein, 1521 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGTTCATCCTCAGAGTTCATTCCGTTGACTCCGAGAGACCAATCTCCGTTGAAGAAGAAGAATCAGGTTTCACTTACGCATCGAAAAGAGCTCAGCCTCCTCTTAAACTCATACAACCATCTCTCAAACTCACCGACCGCAAAGGCTTGATCCATCTCTATCGCAAATCTTCACATAGCTCTCTGCCTAACCCTAGCTCCCGATCCACCACTCTCTTCATCGTCGCTGTTCCCAATTATCTCTCCTCTCTCGATTTTATCCGTTTCTGTGATTCCCGCATCTCCCAAGTCTCCGACATCCTCTTCATCAGGAACGATGGAATGGAAGATAGATATAGTGTTCTTATCACATTTTCTGATCAATCCGAAGCTGATGGTTTCTACAACAACTTGAATGGGAAAAAGTTCGCACCATCTGAGGCTGAGGTTTGTCATATTCTATATGTAATGTCGGTGGAACACACAGAATTTGATGAGGTTGCTGCAGAAGCACCTACTGGATTTACCGAGTTACCTACGTGTCCAATATGTCTTGAGAGATTAGATCCTGACACCAGTGGTATAGTTAGCACTCTTTGTGATCACTCGTTTCAGTGTTCTTGCACTTCGAAATGGACTTATCTGTCTTGTCAGGTTTGTCGATTGTGTCAACAGCAAGATGAGATATTAAACTGTTCTATTTGTGGAAAAACTGAGAATGTATGGGCATGCCTTGTCTGTGGCTTCGTAGGTTGTGGAAGATACAAGGAAGGGCATTCTATTAGGCACTGGAAAGAAACGCATCACTGCTATTCTCTTGATTTGCGAACACAACAAATCTGGGATTATGTTGGTGACAGCTATGTTCATCGGTTAAACCATTCAAAAATTGATGGAAAGTCAGTAGAGATGAGCACCAGTTGTCTGTCACACCAGGGGGACTGTGGCCTCTGTGAGTGTAGTGAGGATACAGGAATTAGCGGAGCTATCTTTAACAGCAAAGTTGATTCAAATATGAATCTTAGATCATCAGTTTGCCTCAGTGGTTTTATTTTTGTGGAACAGATTGTAATCGAGTATAATGACCTTCTTGCAAGTCAACTAAAGGGACAGCGACAGTACTATGAATCTCTCATTGTTGAGGCGAGAAGCAAGCAAGAAAGTAGTATTGCCGAAGCAGTAGAGCAAATTGTTGTTAACACAATGCAGGAGCTTCAGAATAAGATTGAAAAATGTGAAGAGGAAAAAAGTGGTATCACTGAAGTTAACACAAAACTTATAAAAGAGCAGGATACTTGGCGGAAGAAGGCCAAAGAAATAGAAGAGAGGGAAGCTGCATTGCTAGGATCAAAAGACGAGATGATAACTGATCTTCAAGAACAGATAAGAGATATTACGGTCTTCATTGAAGCCAAGAAAACCTTAAAGAAGATGTCATCAGATACGGATGGTATACGCGAAGGAACCGTCTTACCAGTGCCTATCAGTCCCGAGCCAGTTTCCTCAGTTAGAAGGCAAAAGAAGTCAAACCGGAGAAAGTAA

SEQ ID NO: 37 - DNA, 1452 bp, Arabidopsis thaliana
  misc_feature (1)..(1452): Ceres cDNA ID no. 2708787
  misc_feature (1)..(1452): Also known as  Ceres CDNA ID no. 23786979
atgggtattatcagatttcaaatcctgaatccgacgaggatttgtaggtctactatatattatatgtcttgccgttatctgccatcatcatcatcatcatcatcaccactccgagtatcttcttcttcatcgcaaaaacctagtttcgatttctccagaaggtggcattttggtcaccctgatcatcaccagcaatatcaaaagcctggagaagaaggggagaagatattccggctaggtctcaccgcagatataggtttatctgtcgcaaaagctctcaccggttatctctgcggcagcaccgccattatcgccgatgctgctcattccgtttccgatgtggttctaagtggtgttgctctagtgtcttacagagctgcaaatgttcccaaggacaaagaacatccttatggtcatggtaaatttgaaacgcttggagcacttggcatctctgccatgcttttggctactggctctggtattgcctggcatgctttagaccttttatctattgcactgtccgcagctcctgaggtaattcatagtggacatcatcacggcattgatatgaatcatcccattctcgctttgactgttactattgcttccatttctatcaaagaagggctttattggatcacaaaacgagcaggtgaaaaacaagggagtggtttgatgatggcaaatgcttggcatcatcgatcagatgctatttcttctctagttgcacttgttggagttggaggttctattctcggagttaattttttagatcctctagctggccttgttgtctcgacaatgattgtcaatgccggactgaaaacaggacaccaaagtatcttggaactcgtggatgctgctataccagctcagcaattagagccaataagacaaaccatattacaggttgaaggagtgaagggatgtcatcggctaaggggtaggagagctggttcatcgttgtatcttgatgtacacattgtggtagatcctttttccagtgtgagtgtcgcacatgaggtaggagaatatgtacggagacagattaatttgaaccatcctgaagtgtccgaagtttttattcatataggtattgagcatctatcatctcaaactttccttgcagatccagcctttttacagttttcttgtagcaccaaggatcatgacagtataacgaaggaaagtaacatctgccaagagattaaacatgttgaagccactgtctcagacattttttcgtcgcagttgtctgagaaattgacgatcaaacgaattacaccccacttgttacatagcaagatcttgctccaaatcgtagtcgccatgccatcaaccatgtccatacaggacgtcatgatagctgctgaacatgcagagaaagagattctgaaggcagccccaaatgtggctcgtgtcagcattcagcttagtcttaactccgaataa

SEQ ID NO: 38 - protein, 1452 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGGTATTATCAGATTTCAAATCCTGAATCCGACGAGGATTTGTAGGTCTACTATATATTATATGTCTTGCCGTTATCTGCCATCATCATCATCATCATCATCACCACTCCGAGTATCTTCTTCTTCATCGCAAAAACCTAGTTTCGATTTCTCCAGAAGGTGGCATTTTGGTCACCCTGATCATCACCAGCAATATCAAAAGCCTGGAGAAGAAGGGGAGAAGATATTCCGGCTAGGTCTCACCGCAGATATAGGTTTATCTGTCGCAAAAGCTCTCACCGGTTATCTCTGCGGCAGCACCGCCATTATCGCCGATGCTGCTCATTCCGTTTCCGATGTGGTTCTAAGTGGTGTTGCTCTAGTGTCTTACAGAGCTGCAAATGTTCCCAAGGACAAAGAACATCCTTATGGTCATGGTAAATTTGAAACGCTTGGAGCACTTGGCATCTCTGCCATGCTTTTGGCTACTGGCTCTGGTATTGCCTGGCATGCTTTAGACCTTTTATCTATTGCACTGTCCGCAGCTCCTGAGGTAATTCATAGTGGACATCATCACGGCATTGATATGAATCATCCCATTCTCGCTTTGACTGTTACTATTGCTTCCATTTCTATCAAAGAAGGGCTTTATTGGATCACAAAACGAGCAGGTGAAAAACAAGGGAGTGGTTTGATGATGGCAAATGCTTGGCATCATCGATCAGATGCTATTTCTTCTCTAGTTGCACTTGTTGGAGTTGGAGGTTCTATTCTCGGAGTTAATTTTTTAGATCCTCTAGCTGGCCTTGTTGTCTCGACAATGATTGTCAATGCCGGACTGAAAACAGGACACCAAAGTATCTTGGAACTCGTGGATGCTGCTATACCAGCTCAGCAATTAGAGCCAATAAGACAAACCATATTACAGGTTGAAGGAGTGAAGGGATGTCATCGGCTAAGGGGTAGGAGAGCTGGTTCATCGTTGTATCTTGATGTACACATTGTGGTAGATCCTTTTTCCAGTGTGAGTGTCGCACATGAGGTAGGAGAATATGTACGGAGACAGATTAATTTGAACCATCCTGAAGTGTCCGAAGTTTTTATTCATATAGGTATTGAGCATCTATCATCTCAAACTTTCCTTGCAGATCCAGCCTTTTTACAGTTTTCTTGTAGCACCAAGGATCATGACAGTATAACGAAGGAAAGTAACATCTGCCAAGAGATTAAACATGTTGAAGCCACTGTCTCAGACATTTTTTCGTCGCAGTTGTCTGAGAAATTGACGATCAAACGAATTACACCCCACTTGTTACATAGCAAGATCTTGCTCCAAATCGTAGTCGCCATGCCATCAACCATGTCCATACAGGACGTCATGATAGCTGCTGAACATGCAGAGAAAGAGATTCTGAAGGCAGCCCCAAATGTGGCTCGTGTCAGCATTCAGCTTAGTCTTAACTCCGAATAA

SEQ ID NO: 39 - DNA, 2640 bp, Arabidopsis thaliana
  misc_feature (1)..(2640): Ceres cDNA ID no. 2708977
atggaaggtcgtcgtcaacgtttactggtgttcatctttggggctttggccattacacatcttgttcaagctcagccgcctgatcaacgaggattcatcagtttggattgcggtttacccgttaatgagtctccttataccgacccacgaaccggattaacattctcatctgatgctgattttattttaagtggtttacgtggtgaagctggggatgataacacatatatctacaggcagtacaaggatttgagatattttcccgatggaatacgaaactgctataatctgaaagtagagcaaggcatcaactatttgataagagcagggttcggatatggaaattatgatggtcttaatgtatatcccaaatttgatttacatgttgggcctaacatgtggattgcggttgatttggaattcggaaaagatcgtgagatcatttacatgacaacgtcgaacttattgcagatttgtcttgtcaaaacaggatcaactataccaatgatatcaaccttggaactacggccactaagaaatgattcatatttgactcaattcggtcccttagacctcatctaccggcgggcctatagtagcaattctaccggttttatacggtatcctgatgatatttttgatcgcaaatgggaccgatataatgaatttgaaacggatgtgaacaccaccctcaacgtgagatcctcgagtccctttcaagtaccagaagctgtaagtaggatgggaatcacgcccgaaaatgccagcttgccattgagattttacgtgtctctagatgacgacagtgacaaggttaacgtgtactttcactttgccgaaatccaagctttgaggggcaatgagactagagaattcgacattgaattggaagaagatattattcagtcagcatatagtcctacgatgttacaatcagataccaaatataacctatcacctcacaaatgtagctccgggttgtgctacttgaaactcgttagaactccaaggtcaactcttccaccgctgattagtgctattgaggctttcaaggttgtggactttccatacgctgaaacaaatccaaatgacgtcgctgctatgaaggatatcgaagcattttatggattgaagatgattagttggcaaggagatccttgtgtccctgaactattaaagtgggaagatctaaaatgcagctacacaaataagtctactcctccaagaattatttctttagatttgtcatcacgagggttaaaaggggtcattgcgcctgccttccaaaatttgaccgagcttcgaaaactagacttgtcaaataatagttttactggaggagtgcccgagtttctagccagcatgaagtcattatcgatcataaatttaaattggaatgaccttacgggtcctcttcctaaattgcttcttgatagagaaaagaatgggcttaagctaacgatccaaggaaacccaaagttgtgtaacgatgcgtcatgcaaaaataataacaatcaaacgtacattgtaccagttgttgcgtcagtagcttctgtgctcatcattatagccgtactgattctcattcttgttttcaaaaagagaaggccaacgcaagttgattcattacctacagtgcaacatgggttaccaaatagaccgtctatatttactcaaacgaaaaggttcacttattcagaggtagaagcattaacagataattttgaaagagttcttggagaaggagggtttggggtagtgtatcatggtattttaaatggtacgcaaccaatagctgttaaactactctctcaatcatcagtacaaggctataaggaattcaaagctgaggttgaacttcttttgagagtgcaccacgtcaatttggttagtttggttggatattgtgatgaagaaagcaacttggccctgctttatgagtatgcaccgaacggagacttaaaacaacatctatcagaacggggtggctctccattgaagtggtcaagtagactaaaaattgtcgtcgaaactgcgcaaggattagaatacttgcatacgggttgcaaacctccaatggtacatcgtgatgtaaaaacaacaaatatacttttagacgaacacttccaagcaaaactcgccgattttggcctttcaagatcatttccagttggaggtgaaactcatgtttcaacagctgttgctggaactcctggatatttggatcccgaatattatcgaacaaataggttgaacgaaaagagtgatgtatatagctttgggattgtattattggagatcatcacaagtcgacctgtgattcagcaaacccgagagaagccgcacatagcagcatgggtgggatacatgcttactaagggagatattgagaacgttgtggatccaagactcaatagagattatgagcctacttctgtttggaaggctcttgagatagcaatgtcttgcgtgaatccttcttcggagaaaagaccaaccatgtctcaagttactaatgaactaaagcaatgtctaacattagaaaactcaaagcgaggagtgagagaagacatgggatcaagaagttctgttgaaatgagcacaagctttacaaccgaaattaacccaaaagcacgataa

SEQ ID NO: 40 - protein, 879 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 8778538; NR Description: F22G5.7 [Arabidopsis thaliana]
  misc_feature: GI Number: 42569429; NR Description: leucine-rich repeat family protein / protein kinase family protein [Arabidopsis
  misc_feature: GI Number: 42561786; NR Description: leucine-rich repeat
  misc_feature: GI Number: 42562688; NR Description: leucine-rich repeat
  misc_feature: GI Number: 42562690; NR Description: leucine-rich repeat
MEGRRQRLLVFIFGALAITHLVQAQPPDQRGFISLDCGLPVNESPYTDPRTGLTFSSDADFILSGLRGEAGDDNTYIYRQYKDLRYFPDGIRNCYNLKVEQGINYLIRAGFGYGNYDGLNVYPKFDLHVGPNMWIAVDLEFGKDREIIYMTTSNLLQICLVKTGSTIPMISTLELRPLRNDSYLTQFGPLDLIYRRAYSSNSTGFIRYPDDIFDRKWDRYNEFETDVNTTLNVRSSSPFQVPEAVSRMGITPENASLPLRFYVSLDDDSDKVNVYFHFAEIQALRGNETREFDIELEEDIIQSAYSPTMLQSDTKYNLSPHKCSSGLCYLKLVRTPRSTLPPLISAIEAFKVVDFPYAETNPNDVAAMKDIEAFYGLKMISWQGDPCVPELLKWEDLKCSYTNKSTPPRIISLDLSSRGLKGVIAPAFQNLTELRKLDLSNNSFTGGVPEFLASMKSLSIINLNWNDLTGPLPKLLLDREKNGLKLTIQGNPKLCNDASCKNNNNQTYIVPVVASVASVLIIIAVLILILVFKKRRPTQVDSLPTVQHGLPNRPSIFTQTKRFTYSEVEALTDNFERVLGEGGFGVVYHGILNGTQPIAVKLLSQSSVQGYKEFKAEVELLLRVHHVNLVSLVGYCDEESNLALLYEYAPNGDLKQHLSERGGSPLKWSSRLKIVVETAQGLEYLHTGCKPPMVHRDVKTTNILLDEHFQAKLADFGLSRSFPVGGETHVSTAVAGTPGYLDPEYYRTNRLNEKSDVYSFGIVLLEIITSRPVIQQTREKPHIAAWVGYMLTKGDIENVVDPRLNRDYEPTSVWKALEIAMSCVNPSSEKRPTMSQVTNELKQCLTLENSKRGVREDMGSRSSVEMSTSFTTEINPKAR

SEQ ID NO: 41 - DNA, 561 bp, Arabidopsis thaliana
  misc_feature (1)..(561): Ceres cDNA ID no. 2710444
atgttttccccggaaacgcatccggagattgtgaggagctttgagtcggcggatagaaaccggagcggatttctcgaagaatcggagctccggcaagcgttgtcgttatctgggtacgatggaattagtaacagaacgattaggttgctgttgtttatttacaagattcctgtagattctctgcttcggcttggtaaattcacttattgtcctaaggagtatgttgagttatggaactgccttgcgcaatggcgtgcaatatttaacaggtacgatagagataggagtggaaagatgaattctacccagctcagagacgctttctataatctcgggtgcgtgcttccaacctcggttcaccagcttatcgtatctcagtttgatgatgggactggcaaaactgttgacctatgtttcgacagcttcctcgagtgtgggatgattgtgaagggattgacagagaagttcagggagaacgaccctggttacacaggctacgcaacgctctcttacgatgtcttcatgttgatggtcattccgttcatcgccacctatgattaa

SEQ ID NO: 42 - protein, 186 aa, Arabidopsis thaliana
  misc_feature: PFam Name: efhand; PFam Description: EF hand
  misc_feature: GI Number: 25992527; NR Description: fiber protein Fb1
  misc_feature: GI Number: 6624721; NR Description: putative cysteine
  misc_feature: GI Number: 30681239; NR Description: calcium-binding EF-hand
  misc_feature: GI Number: 55770946; NR Description: apoptosis-linked gene 2
  misc_feature: GI Number: 17512472; NR Description: RIKEN cDNA 2600002E23
MFSPETHPEIVRSFESADRNRSGFLEESELRQALSLSGYDGISNRTIRLLLFIYKIPVDSLLRLGKFTYCPKEYVELWNCLAQWRAIFNRYDRDRSGKMNSTQLRDAFYNLGCVLPTSVHQLIVSQFDDGTGKTVDLCFDSFLECGMIVKGLTEKFRENDPGYTGYATLSYDVFMLMVIPFIATYD

SEQ ID NO: 43 - DNA, 840 bp, Arabidopsis thaliana
  misc_feature (1)..(840): Ceres cDNA ID no. 2710944
  misc_feature (1)..(840): Also known as  Ceres CDNA ID no. 23786979
atggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgattttaacctcgcagttcagatatttctacagctcgtacatcaagagtctgctctgctcttcttccctcctccttgagtttcatagtcattgtaggactcctagttctctaatgtacaaagaaacacaaaaatag

SEQ ID NO: 44 - protein, 840 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGCCTCGTCATCATCATCATCTTATAGATTCCAATCTGGGTCTTACCCTCTTTCGTCAAGTCCTTCTCTTGGGAATTTCGTCGAACGCATTAAAGACGCTTGTCATTTCCTTGTCTCTGCTGTTTTGGGTACCATTATCTCCGCGATCTTGACCTTCTTCTTCGCACTAGTGGGCACATTGCTAGGGGCACTTACAGGAGCTTTGATAGGTCAAGAAACTGAGAGTGGTTTCATTAGAGGAGCAGCAATTGGAGCCATTTCGGGAGCTGTTTTCTCTATCGAGGTCTTTGAATCATCTCTGGATCTCTGGAAATCCGATGAGTCGGGTTTCGGATGTTTTCTCTACTTGATTGATGTCATTGTTAGTCTTCTAAGCGGGAGACTTGTACGAGAGCGCATTGGTCCTGCAATGCTAAGTGCAGTGCAAAGTCAAATGGGAGCTGTGGATACAGCTTTTGATGATCACACAAGCCTTTTTGATACAGGAGGCTCAAAAGGATTGACAGGAGACCTTGTTGAGAAAATCCCAAAGATGACAATCACTGGCAACAATAACACTGATGCTTCTGAGAACACAGACTCATGTTCTGTTTGTCTTCAGGATTTCCAGCTCGGTGAAACAGTTAGAAGCTTGCCTCATTGTCATCACATGTTTCACTTACCTTGCATAGACAATTGGCTCCTTAGACACGGTTCTTGCCCGATTTTAACCTCGCAGTTCAGATATTTCTACAGCTCGTACATCAAGAGTCTGCTCTGCTCTTCTTCCCTCCTCCTTGAGTTTCATAGTCATTGTAGGACTCCTAGTTCTCTAATGTACAAAGAAACACAAAAATAG

SEQ ID NO: 45 - DNA, 2247 bp, Arabidopsis thaliana
  misc_feature (1)..(2247): Ceres cDNA ID no. 2711549
atggcggattcaagcttttctcttcctcctctttgtgaaaggatctcatacacgaactattttctaagagctgtatatctcacggttctaggccttttcttttctcttctcttgcaccgaatccgacatacgagcgaatacgacaacgtttggctcgtggctttcttttgtgaatcttgtttcttcttggtatgtctgcttattacttgcctaaaatggagtcctgctgatactaaaccctttcctgatagacttgatgaaagggttcatgaccttccttcggtggatatgttcgtgcccacagcagatccggttcgagagccaccgattatggttgtggacaccgtgctttcgctgttagctgtaaattatccggcaaataaactagcttgttatgtgtcggacgatggatgctcacctctcacttatttctctctcaaggaagcttctaagttcgccaagatttgggtaccgttctgcaaaaagtacaacactagagttagagctccttctagatattttctgaaacctataagcgtcgcaacagaggattatgaattcaatagagactgggaaaagacgaagagggagtacgagaagttgaggcggaaagtggaagatgccaccggagattctcatatgttggatgtagaagatgattttgaagcattctcaaacacaaaaccaaatgatcattcaactctagttaaggtggtatgggagaacaagggaggtgtaggagacgagaaagagatccctcatatcatatacatatcaagagagaaaagaccaaattatgttcataatcaaaaatgtggagccatgaactttctggcaagagtgtcagggttgatgacaaacgcaccatacatcttgaacgtggattgcgacatgtatgccaatgatgcagatgtagtccgacaagcaatgtgtatacttctgcaagaatcattaaatatgaaacattgtgcttttgttcaattccgtcaagaattctatgattcaagcaccgagctaatagtcgtcctacaatcacatttgggacgaggaatcgcgggaatccaaggaccgatatatataggatcaggatgcgtccacacgagaagagttatgtatggtttatctccagacgatttcgaagttgatggaagtctttcttcagttgctacaagggagtttttggttaaggatagtttagcgagaagatttggtaattctaaagagatgatgaaatcagtggttgatgcaatacaaagaaatccaaatccacaaaatatacttacaaactccatagaagcggctcgagaagtgggacattttatgcagatcggctggttatatgattcagtggcggaagatttaaacacgagtatcggaatacattcgagaggttggactagctcatacatttctccggatacacctgcatttcttggatctatgccggcaggagtacccgaggcgttactccagcagcgtcgatgggcgacaggatggatcgaaatccttttcaacaagcaaagtccgttgcgaggattgtttagcaagaaaataagattccgacaacgattagcttatctttgcattatcacctgtctaaggtcaatccctgagcttatttattgtctccttcctgcttattgcctactccacaactctaccttattccccaagggactttatttaggcataactgtcacacttgttgggatacattgtctctatactctatgggaatttatgagccttggttattccgtacaatcgtggctagtctcccaatcagtttggagaatagtagccactagtagttggttatttagcatctttgatatcacactcaagcttcttggcatctcggaaacggtgttcataatcactaaaaagactgtggctgggaccaagtcagcattagggtctggaccctctcaaggagaagacgttggtccaaactcagacttgtttaaatttgaatttgatggctcactttgtttcttgcctggcacatttattgtgttggtgaatatagccgctctagctgttttttctgtgggtctacaacggtcgagttacagccatgaaggaggtggttcgggtctggcagaggcttgcggatgtgttttggtaatgatgttgttccttccatttctaatgggtttgtttaagaaaggaaaatatggaaccccattgtctactctctctatagctggctttttagcagttttatttgttgttttctctgtttga

SEQ ID NO: 46 - protein, 748 aa, Arabidopsis thaliana
  misc_feature: PFam Name: Cellulose_synt; PFam Description: Cellulose synthase
  misc_feature: GI Number: 33589710; NR Description: At4g15290 [Arabidopsis
  misc_feature: GI Number: 17385973; NR Description: CSLH1 [Oryza sativa]
  misc_feature: GI Number: 34419212; NR Description: TPA: cellulose
  misc_feature: GI Number: 42566818; NR Description: cellulose synthase
  misc_feature: GI Number: 42569566; NR Description: cellulose synthase
MADSSFSLPPLCERISYTNYFLRAVYLTVLGLFFSLLLHRIRHTSEYDNVWLVAFFCESCFFLVCLLITCLKWSPADTKPFPDRLDERVHDLPSVDMFVPTADPVREPPIMVVDTVLSLLAVNYPANKLACYVSDDGCSPLTYFSLKEASKFAKIWVPFCKKYNTRVRAPSRYFLKPISVATEDYEFNRDWEKTKREYEKLRRKVEDATGDSHMLDVEDDFEAFSNTKPNDHSTLVKVVWENKGGVGDEKEIPHIIYISREKRPNYVHNQKCGAMNFLARVSGLMTNAPYILNVDCDMYANDADVVRQAMCILLQESLNMKHCAFVQFRQEFYDSSTELIVVLQSHLGRGIAGIQGPIYIGSGCVHTRRVMYGLSPDDFEVDGSLSSVATREFLVKDSLARRFGNSKEMMKSVVDAIQRNPNPQNILTNSIEAAREVGHFMQIGWLYDSVAEDLNTSIGIHSRGWTSSYISPDTPAFLGSMPAGVPEALLQQRRWATGWIEILFNKQSPLRGLFSKKIRFRQRLAYLCIITCLRSIPELIYCLLPAYCLLHNSTLFPKGLYLGITVTLVGIHCLYTLWEFMSLGYSVQSWLVSQSVWRIVATSSWLFSIFDITLKLLGISETVFIITKKTVAGTKSALGSGPSQGEDVGPNSDLFKFEFDGSLCFLPGTFIVLVNIAALAVFSVGLQRSSYSHEGGGSGLAEACGCVLVMMLFLPFLMGLFKKGKYGTPLSTLSIAGFLAVLFVVFSV

SEQ ID NO: 47 - DNA, 2655 bp, Arabidopsis thaliana
  misc_feature (1)..(2655): Ceres cDNA ID no. 2712086
atgaagattcaccttttgttggccatgattggaacctttgtcgttataattggagcccaggatcaagaaggtttcatcagtttagattgtggattacctagtgacgaatctccttacgatgattcgtttaacggattaacattcacatcggattccactttcatccaaacaggaaaaattgatagtgtcgataaagatcttaacataaacttatcaaaacaatatttgactcttagatacttcccagaaggaaaacgtaattgttatagtcttgatgtcaagcgtggcacaacttatctcatcgtggttagctttgtatatggaaattatgatggtcttaaccgtgatccaaacttcgatatccatcttggtcccaataagtggaaaagaatagatttggatggagagaaagaaggtacaagagaagagatcatacacaaagccaggtcaaactctttggatatttgtcttgttaagacaggagaaactttgccaataatttcagccatagaaatacggccactaaggaataatacgtatgttacacaatctggttcgctgatgatgtctttccgggtttatcttagcaattcagatgcatctataaggtatgctgatgacgtccatgatcgtatttggtctccattcaacggatcttcacatacacatataacaactgatctcaatataaacaactcaaatgcatatgagattccaaaaaatatactccaaactgctgccataccaagaaacgccagtgcgccgctgattattacgtgggatccactacccattaatgcggaggtatacttgtacatgcactttgcggagattcaaacccttgaagccaacgagacgaggcagtttgacgttatcttgagaggaaactttaatcattcaggatttagtccaaccaagttaaaggtatttacattatacacagaagaaccaatgaaatgtggttcagaaggttgttatttacagctagtaaaaacaccgaactcaactctgccacctctgatcaacgctattgaggcatacagtgttatcgagttctcacaattggaaacaagtcttagtgatgtggacgctatcaagaacatcaaaaatacttataagctgaataaaatcacttggcaaggagatccatgtctccctcaagatttgtcgtgggaaagtattagatgcacctacgtagatggctccacttcaccaacaatcatttccttagatttgtcgaaaagtggattaaatgggagtataccccaaattttacaaaatttcacgcaattacaagaactggacttatcaaataatagcttgactggaccggtgcctatcttccttgccaacatgaaaacgttatctttaataaacttaagtgggaacaatctcagtggttcagttcctcaagctcttcttgacaaagaaaaagaaggacttgtgttaaaacttgaaggaaatccagatttgtgcaaatccagtttttgcaataccgaaaagaaaaataaattcttgctcccggttattgcatcagctgcctctttggttattgtagttgtggttgtggctcttttttttgtcttccgaaagaagaaggccagcccttcaaatctacatgctccaccaagtatgcctgtatcgaatcccgggcacaatagtcaatcagaatcatcattcacatcgaaaaaaattaggtttacttactctgaggttcaagaaatgacaaataacttcgataaagctctcggtgaaggaggatttggagtcgtgtatcatggttttgttaatgttattgaacaagtagcagttaaattgctatcacaatcatcttctcaaggctataagcatttcaaggcagaggtggaactccttatgagagttcaccatataaatttggtgagtcttgttgggtattgtgatgaaggagaacacttggctcttatttatgaatacatgccaaatggagacttaaagcaacatttgtcaggaaagcatggcggattcgtcctgagctgggaaagtagactaaaaatagttttggatgcagcactaggattggagtatttacatactggatgtgtaccaccaatggttcacagagatatcaaaactacgaatatacttctagatcaacatctccaagctaaattagctgattttgggctttcaagatcttttcccatcggaaatgagaaaaatgtgtcaactgttgttgctggtactcctggatatcttgatcctgagtattatcaaacaaattggttgacagaaaagagtgatatatacagtttcggaattgtactgttagagataatttcaaaccgtcctataatccagcaatcccgtgaaaagcctcacatagtggaatgggtcagttttatgataacaaaaggagatcttagaagtattatggatccaaacctccaccaagattatgatattggttctgtctggaaggccattgaattagcaatgtcatgtgtgagtctttcttctgcaagacgaccaaacatgtctcgagttgtgaatgaattaaaagaatgtcttatatccgaaacctctaggataggtgagggacgagacatggaatcaaaaggttcaatggaattcagcagagacatttataatgaggtaatacctcaagctcgctag

SEQ ID NO: 48 - protein, 884 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 8778538; NR Description: F22G5.7 [Arabidopsis thaliana]
  misc_feature: GI Number: 42562690; NR Description: leucine-rich repeat
  misc_feature: GI Number: 42562692; NR Description: leucine-rich repeat
  misc_feature: GI Number: 15238490; NR Description: leucine-rich repeat transmembrane protein kinase, putative; protein id: At5g59660.1
  misc_feature: GI Number: 15218050; NR Description: light repressible receptor protein kinase, putative; protein id: At1g51850.1
MKIHLLLAMIGTFVVIIGAQDQEGFISLDCGLPSDESPYDDSFNGLTFTSDSTFIQTGKIDSVDKDLNINLSKQYLTLRYFPEGKRNCYSLDVKRGTTYLIVVSFVYGNYDGLNRDPNFDIHLGPNKWKRIDLDGEKEGTREEIIHKARSNSLDICLVKTGETLPIISAIEIRPLRNNTYVTQSGSLMMSFRVYLSNSDASIRYADDVHDRIWSPFNGSSHTHITTDLNINNSNAYEIPKNILQTAAIPRNASAPLIITWDPLPINAEVYLYMHFAEIQTLEANETRQFDVILRGNFNHSGFSPTKLKVFTLYTEEPMKCGSEGCYLQLVKTPNSTLPPLINAIEAYSVIEFSQLETSLSDVDAIKNIKNTYKLNKITWQGDPCLPQDLSWESIRCTYVDGSTSPTIISLDLSKSGLNGSIPQILQNFTQLQELDLSNNSLTGPVPIFLANMKTLSLINLSGNNLSGSVPQALLDKEKEGLVLKLEGNPDLCKSSFCNTEKKNKFLLPVIASAASLVIVVVVVALFFVFRKKKASPSNLHAPPSMPVSNPGHNSQSESSFTSKKIRFTYSEVQEMTNNFDKALGEGGFGVVYHGFVNVIEQVAVKLLSQSSSQGYKHFKAEVELLMRVHHINLVSLVGYCDEGEHLALIYEYMPNGDLKQHLSGKHGGFVLSWESRLKIVLDAALGLEYLHTGCVPPMVHRDIKTTNILLDQHLQAKLADFGLSRSFPIGNEKNVSTVVAGTPGYLDPEYYQTNWLTEKSDIYSFGIVLLEIISNRPIIQQSREKPHIVEWVSFMITKGDLRSIMDPNLHQDYDIGSVWKAIELAMSCVSLSSARRPNMSRVVNELKECLISETSRIGEGRDMESKGSMEFSRDIYNEVIPQAR

SEQ ID NO: 49 - DNA, 1542 bp, Arabidopsis thaliana
  misc_feature (1)..(1542): Ceres cDNA ID no. 2716118
  misc_feature (1)..(1542): Also known as  Ceres CDNA ID no. 23786979
atgtttcaggatgggtcaagatcctcaggaagtggcagaggactgtcgacaacggctgtatcaaatggtggatggagaacccgtgggtttttgcgcggttggcagatccagaataccttatttaacaacatcaagttcatgattctctgctgcttcgtgaccattctcatcctacttggcacaatccgtgttgggaaccttggaagctccaacgccgactctgttaatcagagtttcatcaaggaaaccattccgattctcgcggagatcccctctgattcgcattcgacggacttggctgagcctcctaaagctgatgttagtcccaatgcaacgtatactctagagccaagaatcgcggagatcccatctgatgtgcattcaacggacttggttgagctgcctaaagctgatattagtcccaatgcaacgtatactctaggccccagaatcgcggagatcccatctgattcgcatttgacagacttgcttgagccgcctaaagctgatattagtcccaatgcgacatatactctagggcccaaaatcaccaactgggatagtcaacgcaaggtatggctgaatcagaaccctgagtttcctaatattgtcaatggcaaagctcgaatattgcttctcacagggtcttcccccggaccctgtgataaaccaattggaaactattatctattgaaagctgtgaagaacaagattgattactgtagactccacgggatagagattgtgtataacatggcgaatttggatgaggaactctcagggtattggacgaaattacctatgattaggacattaatgctgtctcatccagaagtagaatggatttggtggatggatagtgatgctttgttcactgatatactgtttgagatcccgttgcctcggtacgaaaatcataatctggtgatacacggttatccagacttgctgttcaaccaaaaatcatgggttgcattgaacacgggtatctttctgttgagaaattgtcagtggtcattggatttattagatgcttgggccccaatgggaccaaaagggaagatccgtgacgaaactgggaagatactgacagcttatctgaaaggcaggccagcatttgaggccgatgatcaatcggcgttgatatatctcttgctttcgcagaaggaaaaatggatagagaaggtttatgtggagaatcaatactacttgcacgggttttgggaaggtttggttgacaggtatgaagagatgatagagaagtatcatccaggattgggcgatgagagatggccctttgtgacacattttgtagggtgcaaaccgtgtggcagctatgctgattacgcagtcgatagatgcttcaagagcatggagagggcttttaattttgcagataatcaagtgctgaagctgtatgggtttagccacaggggactgttgagtcccaagattaaaaggatcagaaatgagacagtctctcctctggagtcagtagacaagtttgatattcgaagaatgcacatggaaaccaaaccatag

SEQ ID NO: 50 - protein, 1542 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGTTTCAGGATGGGTCAAGATCCTCAGGAAGTGGCAGAGGACTGTCGACAACGGCTGTATCAAATGGTGGATGGAGAACCCGTGGGTTTTTGCGCGGTTGGCAGATCCAGAATACCTTATTTAACAACATCAAGTTCATGATTCTCTGCTGCTTCGTGACCATTCTCATCCTACTTGGCACAATCCGTGTTGGGAACCTTGGAAGCTCCAACGCCGACTCTGTTAATCAGAGTTTCATCAAGGAAACCATTCCGATTCTCGCGGAGATCCCCTCTGATTCGCATTCGACGGACTTGGCTGAGCCTCCTAAAGCTGATGTTAGTCCCAATGCAACGTATACTCTAGAGCCAAGAATCGCGGAGATCCCATCTGATGTGCATTCAACGGACTTGGTTGAGCTGCCTAAAGCTGATATTAGTCCCAATGCAACGTATACTCTAGGCCCCAGAATCGCGGAGATCCCATCTGATTCGCATTTGACAGACTTGCTTGAGCCGCCTAAAGCTGATATTAGTCCCAATGCGACATATACTCTAGGGCCCAAAATCACCAACTGGGATAGTCAACGCAAGGTATGGCTGAATCAGAACCCTGAGTTTCCTAATATTGTCAATGGCAAAGCTCGAATATTGCTTCTCACAGGGTCTTCCCCCGGACCCTGTGATAAACCAATTGGAAACTATTATCTATTGAAAGCTGTGAAGAACAAGATTGATTACTGTAGACTCCACGGGATAGAGATTGTGTATAACATGGCGAATTTGGATGAGGAACTCTCAGGGTATTGGACGAAATTACCTATGATTAGGACATTAATGCTGTCTCATCCAGAAGTAGAATGGATTTGGTGGATGGATAGTGATGCTTTGTTCACTGATATACTGTTTGAGATCCCGTTGCCTCGGTACGAAAATCATAATCTGGTGATACACGGTTATCCAGACTTGCTGTTCAACCAAAAATCATGGGTTGCATTGAACACGGGTATCTTTCTGTTGAGAAATTGTCAGTGGTCATTGGATTTATTAGATGCTTGGGCCCCAATGGGACCAAAAGGGAAGATCCGTGACGAAACTGGGAAGATACTGACAGCTTATCTGAAAGGCAGGCCAGCATTTGAGGCCGATGATCAATCGGCGTTGATATATCTCTTGCTTTCGCAGAAGGAAAAATGGATAGAGAAGGTTTATGTGGAGAATCAATACTACTTGCACGGGTTTTGGGAAGGTTTGGTTGACAGGTATGAAGAGATGATAGAGAAGTATCATCCAGGATTGGGCGATGAGAGATGGCCCTTTGTGACACATTTTGTAGGGTGCAAACCGTGTGGCAGCTATGCTGATTACGCAGTCGATAGATGCTTCAAGAGCATGGAGAGGGCTTTTAATTTTGCAGATAATCAAGTGCTGAAGCTGTATGGGTTTAGCCACAGGGGACTGTTGAGTCCCAAGATTAAAAGGATCAGAAATGAGACAGTCTCTCCTCTGGAGTCAGTAGACAAGTTTGATATTCGAAGAATGCACATGGAAACCAAACCATAG

SEQ ID NO: 51 - DNA, 774 bp, Arabidopsis thaliana
  misc_feature (1)..(774): Ceres cDNA ID no. 2730195
atggcgaattactcaagtattcacattctcttcttggtcttcatcacaatttttattgttgttgtttgttttgaaattgcaggcggcattgctgtttccgccgccaccgtcttcactttacagaacagttgtccttacaccgtttggcctggaattctctccggcaacgacaacaccctcggcgacggcggatttcccttaacaccaggcgcttccgtacagctcacggctcctgcaggatggtcaggacggttctgggctcgtaccggctgcaacttcgacgcctccggccacggtaactgcggcaccggagactgcggcggtgttcttaaatgtaacggcggcggagttccaccagtcactctggctgaattcacacttgtaggcgacggcggcaaggatttctacgacgtgagtctcgtcgacggttacaatgtcgagatggggattaaacctcaaggaggttccggtgattgccattacgccggctgcgtcgccgacgtcaacgcggtttgccctaacgagcttcggctcatggatccacatacaggaatcatcgcggcgtgtaaaagcgcttgtgcggcgtttaattctgaggagttctgttgtaccggtgctcacgcgacgccgcaaacttgttctccgacgcattactcggcgatgtttaaaagcgcttgccctggtgcttacagttacgcctacgacgacgccacgagcaccttcacttgtaccggctctaactacttgatctctttctgccccacccggaactaa

SEQ ID NO: 52 - protein, 257 aa, Arabidopsis thaliana
  misc_feature: PFam Name: Thaumatin; PFam Description: Thaumatin family
  misc_feature: GI Number: 2435406; NR Description: thaumatin-like protein
  misc_feature: GI Number: 6273385; NR Description: SCUTL2 [Vitis vinifera]
  misc_feature: GI Number: 28973703; NR Description: putative
  misc_feature: GI Number: 48310686; NR Description: At1g19320 [Arabidopsis thaliana] gi|8778412|gb|AAF79420.1| F18O14.4 [Arabidopsis thaliana] gi|30686314|ref|NP_173365.2| pathogenesis-related thaumatin family
  misc_feature: GI Number: 60543124; NR Description: thaumatin-like protein
  misc_feature: Utility: Useful for making low fiber seeds with increased
MANYSSIHILFLVFITIFIVVVCFEIAGGIAVSAATVFTLQNSCPYTVWPGILSGNDNTLGDGGFPLTPGASVQLTAPAGWSGRFWARTGCNFDASGHGNCGTGDCGGVLKCNGGGVPPVTLAEFTLVGDGGKDFYDVSLVDGYNVEMGIKPQGGSGDCHYAGCVADVNAVCPNELRLMDPHTGIIAACKSACAAFNSEEFCCTGAHATPQTCSPTHYSAMFKSACPGAYSYAYDDATSTFTCTGSNYLISFCPTRN

SEQ ID NO: 53 - DNA, 1125 bp, Arabidopsis thaliana
  misc_feature (1)..(1125): Ceres cDNA ID no. 2999395
  misc_feature (1)..(1125): Also known as  Ceres CDNA ID no. 23786979
atgggtgatgaggcagagatcaaggaacatttaaagccacaagcttcatctgaaacaatagacaagaaacataatgtgaaagggaagaggttatggcagaaagtcaagtatcaattggtggagtttcattcattgcctgcttatttaagagacaatgagtacatcattggtcattaccgatccgaatggccgatcaaacagattcttctcagcatctttaccattcataatgagactttgaatgtttggacgcatttgattgggtttttcctgtttttggcactcactatatacactgcaacgaaagtaccgagtgtcgtggatcttcattcgcttcaacaccgtttacccgatttgttgaggaaaacagatctccacaaacttcattctgagctcatgtctcgccttccttctagtccatctagttggcatgtgatggaccttctttataactgtttgcctgaaagattttctcatggcaactacactgacatgtgtgttctgcattctgtgagggaagatcttgcaaacttgatagctcctttgatcttcaggccaattactcgatggccgttttatgcatttctaggtggtgctatattctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcctggagtttcgggtggtgagggcgtctctgttctttggaatgggattctctggcttagctccgattcttcacaagctgatcatcttttgggaccaacctgaagcccttcacatgacaggttatgagattttgatgggtttgctttatgggttaggagctgtggtttatgcaactaggatcccagagagatggatgccgggtaaattcgatatagcaggacatagccatcagttgtttcatgttctggttgttgctggtgcgttaacgcactatagagctgggctatga

SEQ ID NO: 54 - protein, 1125 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGGTGATGAGGCAGAGATCAAGGAACATTTAAAGCCACAAGCTTCATCTGAAACAATAGACAAGAAACATAATGTGAAAGGGAAGAGGTTATGGCAGAAAGTCAAGTATCAATTGGTGGAGTTTCATTCATTGCCTGCTTATTTAAGAGACAATGAGTACATCATTGGTCATTACCGATCCGAATGGCCGATCAAACAGATTCTTCTCAGCATCTTTACCATTCATAATGAGACTTTGAATGTTTGGACGCATTTGATTGGGTTTTTCCTGTTTTTGGCACTCACTATATACACTGCAACGAAAGTACCGAGTGTCGTGGATCTTCATTCGCTTCAACACCGTTTACCCGATTTGTTGAGGAAAACAGATCTCCACAAACTTCATTCTGAGCTCATGTCTCGCCTTCCTTCTAGTCCATCTAGTTGGCATGTGATGGACCTTCTTTATAACTGTTTGCCTGAAAGATTTTCTCATGGCAACTACACTGACATGTGTGTTCTGCATTCTGTGAGGGAAGATCTTGCAAACTTGATAGCTCCTTTGATCTTCAGGCCAATTACTCGATGGCCGTTTTATGCATTTCTAGGTGGTGCTATATTCTGTCTATTAGCAAGCAGCACGTGCCACCTCCTCTCATGTCACTCCGAGCGAGTCTCCTACATAATGCTTAGGCTTGATTACGCCGGCATCGCAGCTCTAATAGCGACTTCCTTCTACCCTCCGGTTTATTACTCCTTCATGTGTGATCCTTTCTTCTGCAACCTCTACTTAGGATTCATAACCATCTTAGGAATCGCCACTGTGCTTGTTTCTCTCCTCCCGGTTTTCCAAAGCCTGGAGTTTCGGGTGGTGAGGGCGTCTCTGTTCTTTGGAATGGGATTCTCTGGCTTAGCTCCGATTCTTCACAAGCTGATCATCTTTTGGGACCAACCTGAAGCCCTTCACATGACAGGTTATGAGATTTTGATGGGTTTGCTTTATGGGTTAGGAGCTGTGGTTTATGCAACTAGGATCCCAGAGAGATGGATGCCGGGTAAATTCGATATAGCAGGACATAGCCATCAGTTGTTTCATGTTCTGGTTGTTGCTGGTGCGTTAACGCACTATAGAGCTGGGCTATGA

SEQ ID NO: 55 - DNA, 2274 bp, Arabidopsis thaliana
  misc_feature (1)..(2274): Ceres cDNA ID no. 3024092
  misc_feature (1)..(2274): Also known as  Ceres CDNA ID no. 23786979
atggcggattcaagcttttctcttcctcctctttgtgaaaggatctcatacacgaactattttctaagagctgtatatctcacggttctaggccttttcttttctcttctcttgcaccgaatccgacatacgagcgaatacgacaacgtttggctcgtggctttcttttgtgaatcttgtttcttcttggtatgtctgcttattacttgcctaaaatggagtcctgctgatactaaaccctttcctgatagacttgatgaaagggttcatgaccttccttcggtggatatgttcgtgcccacagcagatccggttcgagagccaccgattatggttgtggacaccgtgctttcgctgttagctgtaaattatccggcaaataaactagcttgttatgtgtcggacgatggatgctcacctctcacttatttctctctcaaggaagcttctaagttcgccaagatttgggtaccgttctgcaaaaagtacaacactagagttagagctccttctagatattttctgaaacctataagcgtcgcaacagaggattatgaattcaatagagactgggaaaagacgaagagggagtacgagaagttgaggcggaaagtggaagatgccaccggagattctcatatgttggatgtagaagatgattttgaagcattctcaaacacaaaaccaaatgatcattcaactctagttaaggtggtatgggagaacaagggaggtgtaggagacgagaaagagatccctcatatcatatacatatcaagagagaaaagaccaaattatgttcataatcaaaaatgtggagccatgaactttctggcaagagtgtcagggttgatgacaaacgcaccatacatcttgaacgtggattgcgacatgtatgccaatgatgcagatgtagtccgacaagcaatgtgtatacttctgcaagaatcattaaatatgaaacattgtgcttttgttcaattccgtcaagaattctatgattcaagcaccgagctaatagtcgtcctacaatcacatttgggacgaggaatcgcgggaatccaaggaccgatatatataggatcaggatgcgtccacacgagaagagttatgtatggtttatctccagacgatttcgaagttgatggaagtctttcttcagttgctacaagggagtttttggttaaggatagtttagcgagaagatttggtaattctaaagagatgatgaaatcagtggttgatgcaatacaaagaaatccaaatccacaaaatatacttacaaactccatagaagcggctcgagaagtgggacattgtcagtacgagtaccaaaccagctggggaaacaccatcggctggttatatgattcagtggcggaagatttaaacacgagtatcggaatacattcgagaggttggactagctcatacatttctccggatacacctgcatttcttggatctatgccggcaggagtacccgaggcgttactccagcagcgtcgatgggcgacaggatggatcgaaatccttttcaacaagcaaagtccgttgcgaggattgtttagcaagaaaataagattccgacaacgattagcttatctttgcattatcacctgtctaaggtcaatccctgagcttatttattgtctccttcctgcttattgcctactccacaactctaccttattccccaagggactttatttaggcataactgtcacacttgttgggatacattgtctctatactctatgggaatttatgagccttggttattccgtacaatcgtggctagtctcccaatcagtttggagaatagtagccactagtagttggttatttagcatctttgatatcacactcaagcttcttggcatctcggaaacggtgttcataatcactaaaaagactgtggctgggaccaagtcagcattagggtctggaccctctcaaggagaagacgttggtccaaactcagacttgtttaaatttgaatttgatggctcactttgtttcttgcctggcacatttattgtgttggtgaatatagccgctctagctgttttttctgtgggtctacaacggtcgagttacagccatgaaggaggtggttcgggtctggcagaggcttgcggatgtgttttggtaatgatgttgttccttccatttctaatgggtttgtttaagaaaggaaaatatggaaccccattgtctactctctctatagctggctttttagcagttttatttgttgttttctctgtttga

SEQ ID NO: 56 - protein, 2274 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGCGGATTCAAGCTTTTCTCTTCCTCCTCTTTGTGAAAGGATCTCATACACGAACTATTTTCTAAGAGCTGTATATCTCACGGTTCTAGGCCTTTTCTTTTCTCTTCTCTTGCACCGAATCCGACATACGAGCGAATACGACAACGTTTGGCTCGTGGCTTTCTTTTGTGAATCTTGTTTCTTCTTGGTATGTCTGCTTATTACTTGCCTAAAATGGAGTCCTGCTGATACTAAACCCTTTCCTGATAGACTTGATGAAAGGGTTCATGACCTTCCTTCGGTGGATATGTTCGTGCCCACAGCAGATCCGGTTCGAGAGCCACCGATTATGGTTGTGGACACCGTGCTTTCGCTGTTAGCTGTAAATTATCCGGCAAATAAACTAGCTTGTTATGTGTCGGACGATGGATGCTCACCTCTCACTTATTTCTCTCTCAAGGAAGCTTCTAAGTTCGCCAAGATTTGGGTACCGTTCTGCAAAAAGTACAACACTAGAGTTAGAGCTCCTTCTAGATATTTTCTGAAACCTATAAGCGTCGCAACAGAGGATTATGAATTCAATAGAGACTGGGAAAAGACGAAGAGGGAGTACGAGAAGTTGAGGCGGAAAGTGGAAGATGCCACCGGAGATTCTCATATGTTGGATGTAGAAGATGATTTTGAAGCATTCTCAAACACAAAACCAAATGATCATTCAACTCTAGTTAAGGTGGTATGGGAGAACAAGGGAGGTGTAGGAGACGAGAAAGAGATCCCTCATATCATATACATATCAAGAGAGAAAAGACCAAATTATGTTCATAATCAAAAATGTGGAGCCATGAACTTTCTGGCAAGAGTGTCAGGGTTGATGACAAACGCACCATACATCTTGAACGTGGATTGCGACATGTATGCCAATGATGCAGATGTAGTCCGACAAGCAATGTGTATACTTCTGCAAGAATCATTAAATATGAAACATTGTGCTTTTGTTCAATTCCGTCAAGAATTCTATGATTCAAGCACCGAGCTAATAGTCGTCCTACAATCACATTTGGGACGAGGAATCGCGGGAATCCAAGGACCGATATATATAGGATCAGGATGCGTCCACACGAGAAGAGTTATGTATGGTTTATCTCCAGACGATTTCGAAGTTGATGGAAGTCTTTCTTCAGTTGCTACAAGGGAGTTTTTGGTTAAGGATAGTTTAGCGAGAAGATTTGGTAATTCTAAAGAGATGATGAAATCAGTGGTTGATGCAATACAAAGAAATCCAAATCCACAAAATATACTTACAAACTCCATAGAAGCGGCTCGAGAAGTGGGACATTGTCAGTACGAGTACCAAACCAGCTGGGGAAACACCATCGGCTGGTTATATGATTCAGTGGCGGAAGATTTAAACACGAGTATCGGAATACATTCGAGAGGTTGGACTAGCTCATACATTTCTCCGGATACACCTGCATTTCTTGGATCTATGCCGGCAGGAGTACCCGAGGCGTTACTCCAGCAGCGTCGATGGGCGACAGGATGGATCGAAATCCTTTTCAACAAGCAAAGTCCGTTGCGAGGATTGTTTAGCAAGAAAATAAGATTCCGACAACGATTAGCTTATCTTTGCATTATCACCTGTCTAAGGTCAATCCCTGAGCTTATTTATTGTCTCCTTCCTGCTTATTGCCTACTCCACAACTCTACCTTATTCCCCAAGGGACTTTATTTAGGCATAACTGTCACACTTGTTGGGATACATTGTCTCTATACTCTATGGGAATTTATGAGCCTTGGTTATTCCGTACAATCGTGGCTAGTCTCCCAATCAGTTTGGAGAATAGTAGCCACTAGTAGTTGGTTATTTAGCATCTTTGATATCACACTCAAGCTTCTTGGCATCTCGGAAACGGTGTTCATAATCACTAAAAAGACTGTGGCTGGGACCAAGTCAGCATTAGGGTCTGGACCCTCTCAAGGAGAAGACGTTGGTCCAAACTCAGACTTGTTTAAATTTGAATTTGATGGCTCACTTTGTTTCTTGCCTGGCACATTTATTGTGTTGGTGAATATAGCCGCTCTAGCTGTTTTTTCTGTGGGTCTACAACGGTCGAGTTACAGCCATGAAGGAGGTGGTTCGGGTCTGGCAGAGGCTTGCGGATGTGTTTTGGTAATGATGTTGTTCCTTCCATTTCTAATGGGTTTGTTTAAGAAAGGAAAATATGGAACCCCATTGTCTACTCTCTCTATAGCTGGCTTTTTAGCAGTTTTATTTGTTGTTTTCTCTGTTTGA

SEQ ID NO: 57 - DNA, 2643 bp, Arabidopsis thaliana
  misc_feature (1)..(2643): Ceres cDNA ID no. 3025301
  misc_feature (1)..(2643): Also known as  Ceres CDNA ID no. 23786979
atggaaggtcgtcgtcaacgtttactggtgttcatctttggggctttggccattacacatcttgttcaagctcagccgcctgatcaacgaggattcatcagtttggattgcggtttacccgttaatgagtctccttataccgacccacgaaccggattaacattctcatctgatgctgattttattttaagtggtttacgtggtgaagctggggatgataacacatatatctacaggcagtacaaggatttgagatattttcccgatggaatacgaaactgctataatctgaaagtagagcaaggcatcaactatttgataagagcagggttcggatatggaaattatgatggtcttaatgtatatcccaaatttgatttacatgttgggcctaacatgtggattgcggttgatttggaattcggaaaagatcgtgagatcatttacatgacaacgtcgaacttattgcagatttgtcttgtcaaaacaggatcaactataccaatgatatcaaccttggaactacggccactaagaaatgattcatatttgactcaattcggtcccttagacctcatctaccggcgggcctatagtagcaattctaccggttttatacggtatcctgatgatatttttgatcgcaaatgggaccgatataatgaatttgaaacggatgtgaacaccaccctcaacgtgagatcctcgagtccctttcaagtaccagaagctgtaagtaggatgggaatcacgcccgaaaatgccagcttgccattgagattttacgtgtctctagatgacgacagtgacaaggttaacgtgtactttcactttgccgaaatccaagctttgaggggcaatgagactagagaattcgacattgaattggaagaagatattattcagtcagcatatagtcctacgatgttacaatcagataccaaatataacctatcacctcacaaatgtagctccgggttgtgctacttgaaactcgttagaactccaaggtcaactcttccaccgctgattagtgctattgaggctttcaaggttgtggactttccatacgctgaaacaaatccaaatgacgtcgctgctatgaaggatatcgaagcattttatggattgaagatgattagttggcaaggagatccttgtgtccctgaactattaaagtgggaagatctaaaatgcagctacacaaataagtctactcctccaagaattatttctttagatttgtcatcacgagggttaaaaggggtcattgcgcctgccttccaaaatttgaccgagcttcgaaaactagacttgtcaaataatagttttactggaggagtgcccgagtttctagccagcatgaagtcattatcgatcataaatttaaattggaatgaccttacgggtcctcttcctaaattgcttcttgatagagaaaagaatgggcttaagctaacgatccaaggaaacccaaagttgtgtaacgatgcgtcatgcaaaaataataacaatcaaacgtacattgtaccagttgttgcgtcagtagcttctgtgctcatcattatagccgtactgattctcattcttgttttcaaaaagagaaggccaacgcaagttgattcattacctacagtgcaacatgggttaccaaatagaccgtctatatttactcaaacgaaaaggttcacttattcagaggtagaagcattaacagataattttgaaagagttcttggagaaggagggtttggggtagtgtatcatggtattttaaatggtacgcaaccaatagctgttaaactactctctcaatcatcagtacaaggctataaggaattcaaagctgaggttgaacttcttttgagagtgcaccacgtcaatttggttagtttggttggatattgtgatgaagaaagcaacttggccctgctttatgagtatgcaccgaacggagacttaaaacaacatctatcaggagaacggggtggctctccattgaagtggtcaagtagactaaaaattgtcgtcgaaactgcgcaaggattagaatacttgcatacgggttgcaaacctccaatggtacatcgtgatgtaaaaacaacaaatatacttttagacgaacacttccaagcaaaactcgccgattttggcctttcaagatcatttccagttggaggtgaaactcatgtttcaacagctgttgctggaactcctggatatttggatcccgaatattatcgaacaaataggttgaacgaaaagagtgatgtatatagctttgggattgtattattggagatcatcacaagtcgacctgtgattcagcaaacccgagagaagccgcacatagcagcatgggtgggatacatgcttactaagggagatattgagaacgttgtggatccaagactcaatagagattatgagcctacttctgtttggaaggctcttgagatagcaatgtcttgcgtgaatccttcttcggagaaaagaccaaccatgtctcaagttactaatgaactaaagcaatgtctaacattagaaaactcaaagcgaggagtgagagaagacatgggatcaagaagttctgttgaaatgagcacaagctttacaaccgaaattaacccaaaagcacgataa

SEQ ID NO: 58 - protein, 2643 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGAAGGTCGTCGTCAACGTTTACTGGTGTTCATCTTTGGGGCTTTGGCCATTACACATCTTGTTCAAGCTCAGCCGCCTGATCAACGAGGATTCATCAGTTTGGATTGCGGTTTACCCGTTAATGAGTCTCCTTATACCGACCCACGAACCGGATTAACATTCTCATCTGATGCTGATTTTATTTTAAGTGGTTTACGTGGTGAAGCTGGGGATGATAACACATATATCTACAGGCAGTACAAGGATTTGAGATATTTTCCCGATGGAATACGAAACTGCTATAATCTGAAAGTAGAGCAAGGCATCAACTATTTGATAAGAGCAGGGTTCGGATATGGAAATTATGATGGTCTTAATGTATATCCCAAATTTGATTTACATGTTGGGCCTAACATGTGGATTGCGGTTGATTTGGAATTCGGAAAAGATCGTGAGATCATTTACATGACAACGTCGAACTTATTGCAGATTTGTCTTGTCAAAACAGGATCAACTATACCAATGATATCAACCTTGGAACTACGGCCACTAAGAAATGATTCATATTTGACTCAATTCGGTCCCTTAGACCTCATCTACCGGCGGGCCTATAGTAGCAATTCTACCGGTTTTATACGGTATCCTGATGATATTTTTGATCGCAAATGGGACCGATATAATGAATTTGAAACGGATGTGAACACCACCCTCAACGTGAGATCCTCGAGTCCCTTTCAAGTACCAGAAGCTGTAAGTAGGATGGGAATCACGCCCGAAAATGCCAGCTTGCCATTGAGATTTTACGTGTCTCTAGATGACGACAGTGACAAGGTTAACGTGTACTTTCACTTTGCCGAAATCCAAGCTTTGAGGGGCAATGAGACTAGAGAATTCGACATTGAATTGGAAGAAGATATTATTCAGTCAGCATATAGTCCTACGATGTTACAATCAGATACCAAATATAACCTATCACCTCACAAATGTAGCTCCGGGTTGTGCTACTTGAAACTCGTTAGAACTCCAAGGTCAACTCTTCCACCGCTGATTAGTGCTATTGAGGCTTTCAAGGTTGTGGACTTTCCATACGCTGAAACAAATCCAAATGACGTCGCTGCTATGAAGGATATCGAAGCATTTTATGGATTGAAGATGATTAGTTGGCAAGGAGATCCTTGTGTCCCTGAACTATTAAAGTGGGAAGATCTAAAATGCAGCTACACAAATAAGTCTACTCCTCCAAGAATTATTTCTTTAGATTTGTCATCACGAGGGTTAAAAGGGGTCATTGCGCCTGCCTTCCAAAATTTGACCGAGCTTCGAAAACTAGACTTGTCAAATAATAGTTTTACTGGAGGAGTGCCCGAGTTTCTAGCCAGCATGAAGTCATTATCGATCATAAATTTAAATTGGAATGACCTTACGGGTCCTCTTCCTAAATTGCTTCTTGATAGAGAAAAGAATGGGCTTAAGCTAACGATCCAAGGAAACCCAAAGTTGTGTAACGATGCGTCATGCAAAAATAATAACAATCAAACGTACATTGTACCAGTTGTTGCGTCAGTAGCTTCTGTGCTCATCATTATAGCCGTACTGATTCTCATTCTTGTTTTCAAAAAGAGAAGGCCAACGCAAGTTGATTCATTACCTACAGTGCAACATGGGTTACCAAATAGACCGTCTATATTTACTCAAACGAAAAGGTTCACTTATTCAGAGGTAGAAGCATTAACAGATAATTTTGAAAGAGTTCTTGGAGAAGGAGGGTTTGGGGTAGTGTATCATGGTATTTTAAATGGTACGCAACCAATAGCTGTTAAACTACTCTCTCAATCATCAGTACAAGGCTATAAGGAATTCAAAGCTGAGGTTGAACTTCTTTTGAGAGTGCACCACGTCAATTTGGTTAGTTTGGTTGGATATTGTGATGAAGAAAGCAACTTGGCCCTGCTTTATGAGTATGCACCGAACGGAGACTTAAAACAACATCTATCAGGAGAACGGGGTGGCTCTCCATTGAAGTGGTCAAGTAGACTAAAAATTGTCGTCGAAACTGCGCAAGGATTAGAATACTTGCATACGGGTTGCAAACCTCCAATGGTACATCGTGATGTAAAAACAACAAATATACTTTTAGACGAACACTTCCAAGCAAAACTCGCCGATTTTGGCCTTTCAAGATCATTTCCAGTTGGAGGTGAAACTCATGTTTCAACAGCTGTTGCTGGAACTCCTGGATATTTGGATCCCGAATATTATCGAACAAATAGGTTGAACGAAAAGAGTGATGTATATAGCTTTGGGATTGTATTATTGGAGATCATCACAAGTCGACCTGTGATTCAGCAAACCCGAGAGAAGCCGCACATAGCAGCATGGGTGGGATACATGCTTACTAAGGGAGATATTGAGAACGTTGTGGATCCAAGACTCAATAGAGATTATGAGCCTACTTCTGTTTGGAAGGCTCTTGAGATAGCAATGTCTTGCGTGAATCCTTCTTCGGAGAAAAGACCAACCATGTCTCAAGTTACTAATGAACTAAAGCAATGTCTAACATTAGAAAACTCAAAGCGAGGAGTGAGAGAAGACATGGGATCAAGAAGTTCTGTTGAAATGAGCACAAGCTTTACAACCGAAATTAACCCAAAAGCACGATAA

SEQ ID NO: 59 - DNA, 1095 bp, Arabidopsis thaliana
  misc_feature (1)..(1095): Ceres cDNA ID no. 3027024
  misc_feature (1)..(1095): Also known as  Ceres CDNA ID no. 23786979
atgagattcagaagaggaagtagagttgaggtgtttagcatcaaagaagcctcttatggtgtgtggcgatcagcggagattatatctggtaatggtcacacttacaatgttagatattactcttttgaaattgctaacaatgaggttgttgaggatagagttccaaggaagataattaggccgtgtcctccgcaagtagatgttgatagatgggaagctggtgaattggttgaggttcttgataataatatttcatggaaaactgctactgtcttggaggtgttatctggaagatattatgttgttcggttacttggtgctaaagcagaactcacggttcacaaagtttacctcagggctagacaatcttggcaagatgaaagatgggttatgattggaaaggtatcttgttctgtgaagtcctccacgctgactggatcagatgaacaccagaatagaccttcaccatgtgattgggcggagtctgctgaatcatgcactagaagtcctaagaagatacgatcattggaggaagaaggacaccagcaccggtttgcttcttcttcagcacagaaggtatataatgatagttctgaacgtaggggtgttgaattgtacgtgaaagcttcgtgtaacgagaataaaagtggtttccgtcaaatggtcagggtaagatcaaaaaggtttagtgaatgtgttggtacaggaaactcagtctctaatagttgttatgatactgatgcatcctcagttggtagttgtagccctattagttatgatgagagtgacaaaccaacttcttttctagatggtgccgactcttgtagtagtgatgctgaatcttcaaaagaagcatctggatgcagagatgaagctaggcgaaaacattcattatcaggtaatggatcagtggtgagatcatgtaggcctgaactttacacttaccgtagtacactgacgaagttatttgcttctggctccctaagttgggatcaggaagcatcactaactgatctccgactttctcttaatatatcaaatgatgaacatttgatggagctaagaaatctcaagtctgccggtacccacagttaa

SEQ ID NO: 60 - protein, 1095 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGAGATTCAGAAGAGGAAGTAGAGTTGAGGTGTTTAGCATCAAAGAAGCCTCTTATGGTGTGTGGCGATCAGCGGAGATTATATCTGGTAATGGTCACACTTACAATGTTAGATATTACTCTTTTGAAATTGCTAACAATGAGGTTGTTGAGGATAGAGTTCCAAGGAAGATAATTAGGCCGTGTCCTCCGCAAGTAGATGTTGATAGATGGGAAGCTGGTGAATTGGTTGAGGTTCTTGATAATAATATTTCATGGAAAACTGCTACTGTCTTGGAGGTGTTATCTGGAAGATATTATGTTGTTCGGTTACTTGGTGCTAAAGCAGAACTCACGGTTCACAAAGTTTACCTCAGGGCTAGACAATCTTGGCAAGATGAAAGATGGGTTATGATTGGAAAGGTATCTTGTTCTGTGAAGTCCTCCACGCTGACTGGATCAGATGAACACCAGAATAGACCTTCACCATGTGATTGGGCGGAGTCTGCTGAATCATGCACTAGAAGTCCTAAGAAGATACGATCATTGGAGGAAGAAGGACACCAGCACCGGTTTGCTTCTTCTTCAGCACAGAAGGTATATAATGATAGTTCTGAACGTAGGGGTGTTGAATTGTACGTGAAAGCTTCGTGTAACGAGAATAAAAGTGGTTTCCGTCAAATGGTCAGGGTAAGATCAAAAAGGTTTAGTGAATGTGTTGGTACAGGAAACTCAGTCTCTAATAGTTGTTATGATACTGATGCATCCTCAGTTGGTAGTTGTAGCCCTATTAGTTATGATGAGAGTGACAAACCAACTTCTTTTCTAGATGGTGCCGACTCTTGTAGTAGTGATGCTGAATCTTCAAAAGAAGCATCTGGATGCAGAGATGAAGCTAGGCGAAAACATTCATTATCAGGTAATGGATCAGTGGTGAGATCATGTAGGCCTGAACTTTACACTTACCGTAGTACACTGACGAAGTTATTTGCTTCTGGCTCCCTAAGTTGGGATCAGGAAGCATCACTAACTGATCTCCGACTTTCTCTTAATATATCAAATGATGAACATTTGATGGAGCTAAGAAATCTCAAGTCTGCCGGTACCCACAGTTAA

SEQ ID NO: 61 - DNA, 1089 bp, Arabidopsis thaliana
  misc_feature (1)..(1089): Ceres cDNA ID no. 3031423
  misc_feature (1)..(1089): Also known as  Ceres CDNA ID no. 23786979
atgggggagcaaagggcaagcggtgcttcctcctccaccgactcatattcaactccttcgccgtctgcgtcaccgtctccatctccggctccacgtcaacatgtcacgttactcgaaccatctcatcaacacaagaagaaaagcaaaaaagtcttccgagtttttcgttcggttttccgatctttcccgatcatcacaccggcagcttgcaaaatcccggtcctccccggcggtagcttacctgaccagcaccgaagcgggtcaagcggatcaagagttaccggaaccttattcggataccgtaaaggccgtgtaagcctctcgattcaagaaagccctagatgtttaccatctctcgtcgtcgagctcgcaatgcaaacaatggtgctacaaaaagagcttagcggagggatggttaggatcgcgttagagacagagaaacgaggtgataaagagaagatcaagatcatggacgagccattatggacaatgtttagtaacggtaagaaaacggggtacggtgtgaaacgtgacgcgacggaggaagacctcaacgttatggagctattaagaccggtttcgatgggtgccggagttttgccagggaacacggagtttgaaggaccagactcggagatggcttacatgagggcttacttcgaacgagtcgttgggtctaaagattcagagacattttatatgttgagtcccgaaggaaataatggaccagaacttagtatcttcttcaaaatccttgcgcaactagaagatgatgtagtagttccttgtgaatcacgcatggaaaattggaaaacaaatatggaagtaacggcaatcaaggaggaagagattatgcatccaatatgtcaatcaaaatctctgagatcagccacaaaagtgttagtagaaatggcagagcacctaacggaattggagaagatgactaaacccgttcttgatgctctgagaagctaccaggatttgcctccggataaagctttggctacactagaattcgaagacaagaaaaggcaatacgaagcagcggagaagcgtctagaagaagtattacaatcagctcttgagtga

SEQ ID NO: 62 - protein, 1089 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGGGGAGCAAAGGGCAAGCGGTGCTTCCTCCTCCACCGACTCATATTCAACTCCTTCGCCGTCTGCGTCACCGTCTCCATCTCCGGCTCCACGTCAACATGTCACGTTACTCGAACCATCTCATCAACACAAGAAGAAAAGCAAAAAAGTCTTCCGAGTTTTTCGTTCGGTTTTCCGATCTTTCCCGATCATCACACCGGCAGCTTGCAAAATCCCGGTCCTCCCCGGCGGTAGCTTACCTGACCAGCACCGAAGCGGGTCAAGCGGATCAAGAGTTACCGGAACCTTATTCGGATACCGTAAAGGCCGTGTAAGCCTCTCGATTCAAGAAAGCCCTAGATGTTTACCATCTCTCGTCGTCGAGCTCGCAATGCAAACAATGGTGCTACAAAAAGAGCTTAGCGGAGGGATGGTTAGGATCGCGTTAGAGACAGAGAAACGAGGTGATAAAGAGAAGATCAAGATCATGGACGAGCCATTATGGACAATGTTTAGTAACGGTAAGAAAACGGGGTACGGTGTGAAACGTGACGCGACGGAGGAAGACCTCAACGTTATGGAGCTATTAAGACCGGTTTCGATGGGTGCCGGAGTTTTGCCAGGGAACACGGAGTTTGAAGGACCAGACTCGGAGATGGCTTACATGAGGGCTTACTTCGAACGAGTCGTTGGGTCTAAAGATTCAGAGACATTTTATATGTTGAGTCCCGAAGGAAATAATGGACCAGAACTTAGTATCTTCTTCAAAATCCTTGCGCAACTAGAAGATGATGTAGTAGTTCCTTGTGAATCACGCATGGAAAATTGGAAAACAAATATGGAAGTAACGGCAATCAAGGAGGAAGAGATTATGCATCCAATATGTCAATCAAAATCTCTGAGATCAGCCACAAAAGTGTTAGTAGAAATGGCAGAGCACCTAACGGAATTGGAGAAGATGACTAAACCCGTTCTTGATGCTCTGAGAAGCTACCAGGATTTGCCTCCGGATAAAGCTTTGGCTACACTAGAATTCGAAGACAAGAAAAGGCAATACGAAGCAGCGGAGAAGCGTCTAGAAGAAGTATTACAATCAGCTCTTGAGTGA

SEQ ID NO: 63 - DNA, 1356 bp, Arabidopsis thaliana
  misc_feature (1)..(1356): Ceres cDNA ID no. 3034710
  misc_feature (1)..(1356): Also known as  Ceres CDNA ID no. 23786979
atgggtggagaagagagatcaggagatggagaaaaaagaggggaagaagtagttgatgctggttctctcttcgtccttaaatccaaagggacatggtggcactgcggattccacttgacgacgtctatagtggcgcctgcgctactgagtctaccgtacgccttcaagttcttaggatgggctgccgggatatcttgtctggtcggaggagcagccgttactttctactcgtacactcttctttctcttactctcgaacaccacgcttctctcggcaaccgttacctccgcttccgtgacatggctcatcacatcctcagtccgaaatggggaaggtactacgttggaccaatacaaatggcggtgtgctatggtgtggttattgccaatgcgctcttgggagggcaatgcctaaaggcaatgtacttggtagtgcagccaaatggggaaatgaaactctttgagtttgtgattatttttggatgcttacttttggttttggcacaattcccatcctttcactctctacgatacatcaactcactgtctctcctcctctgcctcctctacagtgcttctgccgctgctgcatccatctacattggaaaagaaccaaatgcaccagagaaggactatactatagttggtgatccagaaactagagtgtttggaatctttaatgctatggctattattgctactacatacggcaatggcattatacctgaaattcaggcaacaatatcggcaccagtgaaaggaaaaatgatgaaagggttgtgtatgtgttaccttgtagtaataatgacatttttcacagtagccatcacaggatattgggcattcggtaaaaaagccaatggacttatcttcaccaatttcttaaatgccgagacaaaccattactttgtccctacttggtttatttttctcgtcaatctcttcactgtccttcaactttcggccgttgctgtggtatacctacaacctataaacgatattttggaaagtgtgatcagcgatccaacaaagaaagaattctctatccgcaatgtcatccctcgactagttgtgcgttccctcttcgtcgtgatggctacaatcgttgcggcaatgcttccattttttggagatgtaaactccttgttaggcgctttcggttttatacctctagacttcgttcttcctgtagttttcttcaactttactttcaagccgtctaaaaaaagtttcattttttggatcaacactgtgatcgccgtggttttttcgtgtttaggggtgattgctatggtagcggcggttagacagattataatagatgccaatacgtataagttgtttgcggatgtataa

SEQ ID NO: 64 - protein, 1356 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGGTGGAGAAGAGAGATCAGGAGATGGAGAAAAAAGAGGGGAAGAAGTAGTTGATGCTGGTTCTCTCTTCGTCCTTAAATCCAAAGGGACATGGTGGCACTGCGGATTCCACTTGACGACGTCTATAGTGGCGCCTGCGCTACTGAGTCTACCGTACGCCTTCAAGTTCTTAGGATGGGCTGCCGGGATATCTTGTCTGGTCGGAGGAGCAGCCGTTACTTTCTACTCGTACACTCTTCTTTCTCTTACTCTCGAACACCACGCTTCTCTCGGCAACCGTTACCTCCGCTTCCGTGACATGGCTCATCACATCCTCAGTCCGAAATGGGGAAGGTACTACGTTGGACCAATACAAATGGCGGTGTGCTATGGTGTGGTTATTGCCAATGCGCTCTTGGGAGGGCAATGCCTAAAGGCAATGTACTTGGTAGTGCAGCCAAATGGGGAAATGAAACTCTTTGAGTTTGTGATTATTTTTGGATGCTTACTTTTGGTTTTGGCACAATTCCCATCCTTTCACTCTCTACGATACATCAACTCACTGTCTCTCCTCCTCTGCCTCCTCTACAGTGCTTCTGCCGCTGCTGCATCCATCTACATTGGAAAAGAACCAAATGCACCAGAGAAGGACTATACTATAGTTGGTGATCCAGAAACTAGAGTGTTTGGAATCTTTAATGCTATGGCTATTATTGCTACTACATACGGCAATGGCATTATACCTGAAATTCAGGCAACAATATCGGCACCAGTGAAAGGAAAAATGATGAAAGGGTTGTGTATGTGTTACCTTGTAGTAATAATGACATTTTTCACAGTAGCCATCACAGGATATTGGGCATTCGGTAAAAAAGCCAATGGACTTATCTTCACCAATTTCTTAAATGCCGAGACAAACCATTACTTTGTCCCTACTTGGTTTATTTTTCTCGTCAATCTCTTCACTGTCCTTCAACTTTCGGCCGTTGCTGTGGTATACCTACAACCTATAAACGATATTTTGGAAAGTGTGATCAGCGATCCAACAAAGAAAGAATTCTCTATCCGCAATGTCATCCCTCGACTAGTTGTGCGTTCCCTCTTCGTCGTGATGGCTACAATCGTTGCGGCAATGCTTCCATTTTTTGGAGATGTAAACTCCTTGTTAGGCGCTTTCGGTTTTATACCTCTAGACTTCGTTCTTCCTGTAGTTTTCTTCAACTTTACTTTCAAGCCGTCTAAAAAAAGTTTCATTTTTTGGATCAACACTGTGATCGCCGTGGTTTTTTCGTGTTTAGGGGTGATTGCTATGGTAGCGGCGGTTAGACAGATTATAATAGATGCCAATACGTATAAGTTGTTTGCGGATGTATAA

SEQ ID NO: 65 - DNA, 1353 bp, Arabidopsis thaliana
  misc_feature (1)..(1353): Ceres cDNA ID no. 3038950
  misc_feature (1)..(1353): Also known as  Ceres CDNA ID no. 23786979
atgccaaaataccttgatcagaatgacgaggagaacaaaggaagatcaacggacaataacaatcaccgtcaaatggattacaacgattggttaccagtcacagcgtctagagaagccaaatggtattactccgccttccacaatgtcacggccatggttggcgccggagttcttggtctccctttcgccatgtcacaacttggctggggacctggacttgttgctataataatgtcatgggctataacgttctactcgttatggcaaatggtacagttgcacgaagccgttccagggaaacggttggaccgttaccccgagctagggcaagaagcttttggaccaaaactaggttactggatcgtcatgccgcaacagcttcttgtccaaatcgcttccgacatagtctacaacgtgacaggaggaaaatctctcaagaaatttgtcgagcttctatttccgaatctcgaacatatccgtcagacttattacatccttggattcgccgcgcttcagcttgtcctctctcaatctcctgatttcaactccatcaagatcgtctctctcctcgccgccctcatgtctttcctttactcaatgatagcttcggtggcgtcaatagcaaaaggaacggaacaccgtccttcaacttacggagtcaggggagacacggtggcctcaatggtctttgatgcatttaacggcattggaaccatagcgtttgcgtttgcaggacacagtgtggttcttgagatccaagcaactattccttcaacacctgaagtgccttccaagaaaccaatgtggaaaggagttgttgtagcttacataatcgtcatcatttgttacctttttgtggctatctccggctattgggcgtttggggctcatgttgaggatgatgttctcatttccttagagagaccagcttggcttatagcggctgctaacttcatggtttttatccatgtcataggaagttatcaggtttttgcgatgattgtgtttgacacgatcgagtcttatcttgtgaaaacactgaaattcactccttcaacaacactgcgtctagtcgcacgtagtacatatgttgcattgatttgtcttgtagcagtttgtatcccctttttcggaggtcttttagggttcttcggcggtcttgtcttctcatcaacctcgtacttcttgccttgcattatatggttgataatgaagcgaccaaaaagatttagcgcccattggtggtgttcttgggtagcaatagtcactggtatctcgatagcgattcttgcgcccattggaggaatgagacacattattctttcagcaagaacctacaagctcttctcatag

SEQ ID NO: 66 - protein, 1353 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGCCAAAATACCTTGATCAGAATGACGAGGAGAACAAAGGAAGATCAACGGACAATAACAATCACCGTCAAATGGATTACAACGATTGGTTACCAGTCACAGCGTCTAGAGAAGCCAAATGGTATTACTCCGCCTTCCACAATGTCACGGCCATGGTTGGCGCCGGAGTTCTTGGTCTCCCTTTCGCCATGTCACAACTTGGCTGGGGACCTGGACTTGTTGCTATAATAATGTCATGGGCTATAACGTTCTACTCGTTATGGCAAATGGTACAGTTGCACGAAGCCGTTCCAGGGAAACGGTTGGACCGTTACCCCGAGCTAGGGCAAGAAGCTTTTGGACCAAAACTAGGTTACTGGATCGTCATGCCGCAACAGCTTCTTGTCCAAATCGCTTCCGACATAGTCTACAACGTGACAGGAGGAAAATCTCTCAAGAAATTTGTCGAGCTTCTATTTCCGAATCTCGAACATATCCGTCAGACTTATTACATCCTTGGATTCGCCGCGCTTCAGCTTGTCCTCTCTCAATCTCCTGATTTCAACTCCATCAAGATCGTCTCTCTCCTCGCCGCCCTCATGTCTTTCCTTTACTCAATGATAGCTTCGGTGGCGTCAATAGCAAAAGGAACGGAACACCGTCCTTCAACTTACGGAGTCAGGGGAGACACGGTGGCCTCAATGGTCTTTGATGCATTTAACGGCATTGGAACCATAGCGTTTGCGTTTGCAGGACACAGTGTGGTTCTTGAGATCCAAGCAACTATTCCTTCAACACCTGAAGTGCCTTCCAAGAAACCAATGTGGAAAGGAGTTGTTGTAGCTTACATAATCGTCATCATTTGTTACCTTTTTGTGGCTATCTCCGGCTATTGGGCGTTTGGGGCTCATGTTGAGGATGATGTTCTCATTTCCTTAGAGAGACCAGCTTGGCTTATAGCGGCTGCTAACTTCATGGTTTTTATCCATGTCATAGGAAGTTATCAGGTTTTTGCGATGATTGTGTTTGACACGATCGAGTCTTATCTTGTGAAAACACTGAAATTCACTCCTTCAACAACACTGCGTCTAGTCGCACGTAGTACATATGTTGCATTGATTTGTCTTGTAGCAGTTTGTATCCCCTTTTTCGGAGGTCTTTTAGGGTTCTTCGGCGGTCTTGTCTTCTCATCAACCTCGTACTTCTTGCCTTGCATTATATGGTTGATAATGAAGCGACCAAAAAGATTTAGCGCCCATTGGTGGTGTTCTTGGGTAGCAATAGTCACTGGTATCTCGATAGCGATTCTTGCGCCCATTGGAGGAATGAGACACATTATTCTTTCAGCAAGAACCTACAAGCTCTTCTCATAG

SEQ ID NO: 67 - DNA, 1176 bp, Arabidopsis thaliana
  misc_feature (1)..(1176): Ceres cDNA ID no. 3064164
  misc_feature (1)..(1176): Also known as  Ceres CDNA ID no. 23786979
atggattgcttagaacccaaaacaaagaacaatctcactggaaagcttctcttagtagcttcactcttaattttagccattattgtgatcagtcaatcttcaagtttcacatctccaagcgcgttttctcaaagagaggaaggagtgactcatgtgttagtcactggtggtgctggttatatcgggtcacatgcggctttaagacttcttagagattcataccgcgtaaccattgtggacaatctttcgcgtggaaatcttggtgcggttaagactttacagcaattattcccgcagacaggaagacttcagttcatttatgctgacttaggagatcccttagcggtcgagaaaatcttctcggagaatgcttttgacgctgtaatgcattttgctgcggtagcttatgtcggagaaagcactctttatcctctaaaatattaccataacattacatcaaacacgttaggagttcttgaagctatggctagacataaagtaaagaaactgatatattctagcacttgtgctacatatggagagcctgaaaaaatgccgattactgaagacactccacaggtaccgattaatccatacggaaaagctaaaaagatggcagaggatatgatcttggatttctcaaagaactctgacatggcggttatgatcttaagatacttcaatgtgattggttcagatccaggaggtagattaggagaagcgccaagacccgaacttcgtgagcaaggaaggatttctggtgcttgtttcgatgcagctcgtggtttcattcccggactacaagtgaaaggaacggattacaaaacatcggacggtacttgcattagagactatatagatgttactgacctcgtggatgctcacgtgaaggctctcgagaaagctcagcctcgaaaagtcggtatctacaatgttggaaccggaaaagggagatcggttaaagaattcgttgaggcatgtaagaaggcgacaggagttgagatcaaagtagatttcttgcctcgacgaccgggagattacgcagaggtttacagtgatccaacaaagattttgaaagatttgaattggactgctcgattcactaatcttcaagatagtcttcaagttgcttggagatggcaaaaaattcatcctcatggatataattcttattaa

SEQ ID NO: 68 - protein, 1176 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGATTGCTTAGAACCCAAAACAAAGAACAATCTCACTGGAAAGCTTCTCTTAGTAGCTTCACTCTTAATTTTAGCCATTATTGTGATCAGTCAATCTTCAAGTTTCACATCTCCAAGCGCGTTTTCTCAAAGAGAGGAAGGAGTGACTCATGTGTTAGTCACTGGTGGTGCTGGTTATATCGGGTCACATGCGGCTTTAAGACTTCTTAGAGATTCATACCGCGTAACCATTGTGGACAATCTTTCGCGTGGAAATCTTGGTGCGGTTAAGACTTTACAGCAATTATTCCCGCAGACAGGAAGACTTCAGTTCATTTATGCTGACTTAGGAGATCCCTTAGCGGTCGAGAAAATCTTCTCGGAGAATGCTTTTGACGCTGTAATGCATTTTGCTGCGGTAGCTTATGTCGGAGAAAGCACTCTTTATCCTCTAAAATATTACCATAACATTACATCAAACACGTTAGGAGTTCTTGAAGCTATGGCTAGACATAAAGTAAAGAAACTGATATATTCTAGCACTTGTGCTACATATGGAGAGCCTGAAAAAATGCCGATTACTGAAGACACTCCACAGGTACCGATTAATCCATACGGAAAAGCTAAAAAGATGGCAGAGGATATGATCTTGGATTTCTCAAAGAACTCTGACATGGCGGTTATGATCTTAAGATACTTCAATGTGATTGGTTCAGATCCAGGAGGTAGATTAGGAGAAGCGCCAAGACCCGAACTTCGTGAGCAAGGAAGGATTTCTGGTGCTTGTTTCGATGCAGCTCGTGGTTTCATTCCCGGACTACAAGTGAAAGGAACGGATTACAAAACATCGGACGGTACTTGCATTAGAGACTATATAGATGTTACTGACCTCGTGGATGCTCACGTGAAGGCTCTCGAGAAAGCTCAGCCTCGAAAAGTCGGTATCTACAATGTTGGAACCGGAAAAGGGAGATCGGTTAAAGAATTCGTTGAGGCATGTAAGAAGGCGACAGGAGTTGAGATCAAAGTAGATTTCTTGCCTCGACGACCGGGAGATTACGCAGAGGTTTACAGTGATCCAACAAAGATTTTGAAAGATTTGAATTGGACTGCTCGATTCACTAATCTTCAAGATAGTCTTCAAGTTGCTTGGAGATGGCAAAAAATTCATCCTCATGGATATAATTCTTATTAA

SEQ ID NO: 69 - DNA, 2544 bp, Arabidopsis thaliana
  misc_feature (1)..(2544): Ceres cDNA ID no. 3078914
atgggtactttggtcaacggtactattccggcgatgaagtgtcccaagaatgtggcgatgatgaagacaacgtctaacggagtgttcgatggagagagtccattagatttcgcttttcctcttgtcattcttcagatttgccttgtcgtcgccgtcactcgctctttggccttccttctccgtcccatgagacaaccacgtgttgtcgccgagatcattgtaagtcctccatcaaccggtttaggtcagtcttatagtttccggtttaataaatatcctaccagactgaaatatgagttataccgggattccgttcagcttattactggcgggattcttcttggcccgtcggctctcggtagaatcacgtcgtacaagaattcaattttcccggcgagaagtctaacggtgctcgacactctagcaaacctcggcctccttctcttccttttcctcgtcggactcgagatcgatctgacatctctccgacgtaccggcaaaaaagcgatttccatcgccgccgccggaatgcttctccccttcggtatgggcattgtcacctccttcgctttccctgaagcttcttcttctggcgacaatagcaaagtacttccgttcatcattttcatgggagtcgcgctctcgatcactgctttcggagttttggcgagaatactcgctgaattaaagctactcacaaccgatctcggccggatttcaatgaacgccgccgcaattaacgacgtcgcggcttgggttctcctagctctcgctgtatctctctccggcgataggaattctccgcttgttcctctctgggttctgttaagtggaatcgcgtttgtgatcgcgtgttttttaatcgtaccgcgaattttcaaattcatctctcggcgttgcccagaaggcgaacccataggcgaaatgtacgtttgcgtcgccctttgcgcggttctactcgcgggtttcgcgacagacgccattgggattcacgcgattttcggtgcgtttgtgatgggcgttttgtttcccaaaggacatttctcagacgcgattgtggagaagattgaagatcttgtaatgggtcttcttctaccactgtacttcgttatgagcggtttgaaaacggatataactacgattcaaggtgtgaaatcgtggggacgactcgcgttggtgattgttacggcttgttttggcaaaatcgttgggactgtgagtgttgccttgttatgcaaggtaaggctccgtgaatcggttgttcttggggttttaatgaacacaaagggtttagtggagctaattgttctcaacattggcaaagacagaaaggttttgagcgatcagacttttgcaattatggttctcatggcgatattcacaacattcatcacaacgccaatagtcttggcgttatacaaaccaagcgagacaacacaaacacatagtagcgtcagctacaagaaccgcaaacatagacgcaagattgagaatgatgaagaaggcgagaagatgcagcagcttaaggttttggtatgtcttcaaagcagtaaagatattgatcccatgatgaaaataatggaagctactcgtggaagcaacgaaaccaaagaaagattttgcgtttacgttatgcatttaactcaactctccgagagaccttcttctattcgaatggttcaaaaggtgagaagcaacggtttgcccttttggaacaagaaaagagagaattctagtgccgttacggtcgcgttcgaggcgtctagtaagctaagtagcgtttcggtgcgttctgtgaccgcgatttcaccgttgtcaacaattcatgaggatatatgtagctctgctgatagtaaatgcacagcgtttgtgattttgccgttccataagcaatggagatctctggagaaagaatttgaaacggtgagatcggagtatcaggggattaacaaaagagttcttgagaattcaccgtgttctgttggaattttggttgatcgtggtctcggcgacaacaattctccggtagcttcgagcaacttttcactttccgtcaatgttctgttctttggcggttgcgatgatcgtgaagctttggtttacgggttacgaatggctgaacatccgggcgttaacttgaccgttgtggttatctctggtccggagagcgcaaggtttgataggcttgaagcgcaagaaacatcactatgttccttagacgagcaattccttgcagcaatcaagaaaagggccaatgcagctagatttgaagagaggacggtgaattcaacggaggaagtggttgagattatccgccaattttacgagtgcgatattttattggtgggaaaatcttccaaaggacctatggtttcaagattaccggttatgaagatagagtgtccagaactgggaccggtcggaaacttgatcgtgtcaaatgagatttctacttcagtgtctgttttggtggttcaacaatacaccgggaaaggtccttctgtggtgggttccgtctctgtcccggtggtggagacgccatga

SEQ ID NO: 70 - protein, 847 aa, Arabidopsis thaliana
  misc_feature: PFam Name: Na_H_Exchanger; PFam Description: Sodium/hydrogen
  misc_feature: GI Number: 34909252; NR Description: B1148D12.14 [Oryza sativa (japonica cultivar-group)] >gi|15528788|dbj|BAB64829.1|
  misc_feature: GI Number: 6692096; NR Description: F22C12.7 [Arabidopsis thaliana]
  misc_feature: GI Number: 9294151; NR Description: Na+/H+ exchangeing
  misc_feature: GI Number: 15128390; NR Description: P0454H12.8 [Oryza sativa
  misc_feature: GI Number: 61658325; NR Description: cation/H+ exchanger
MGTLVNGTIPAMKCPKNVAMMKTTSNGVFDGESPLDFAFPLVILQICLVVAVTRSLAFLLRPMRQPRVVAEIIVSPPSTGLGQSYSFRFNKYPTRLKYELYRDSVQLITGGILLGPSALGRITSYKNSIFPARSLTVLDTLANLGLLLFLFLVGLEIDLTSLRRTGKKAISIAAAGMLLPFGMGIVTSFAFPEASSSGDNSKVLPFIIFMGVALSITAFGVLARILAELKLLTTDLGRISMNAAAINDVAAWVLLALAVSLSGDRNSPLVPLWVLLSGIAFVIACFLIVPRIFKFISRRCPEGEPIGEMYVCVALCAVLLAGFATDAIGIHAIFGAFVMGVLFPKGHFSDAIVEKIEDLVMGLLLPLYFVMSGLKTDITTIQGVKSWGRLALVIVTACFGKIVGTVSVALLCKVRLRESVVLGVLMNTKGLVELIVLNIGKDRKVLSDQTFAIMVLMAIFTTFITTPIVLALYKPSETTQTHSSVSYKNRKHRRKIENDEEGEKMQQLKVLVCLQSSKDIDPMMKIMEATRGSNETKERFCVYVMHLTQLSERPSSIRMVQKVRSNGLPFWNKKRENSSAVTVAFEASSKLSSVSVRSVTAISPLSTIHEDICSSADSKCTAFVILPFHKQWRSLEKEFETVRSEYQGINKRVLENSPCSVGILVDRGLGDNNSPVASSNFSLSVNVLFFGGCDDREALVYGLRMAEHPGVNLTVVVISGPESARFDRLEAQETSLCSLDEQFLAAIKKRANAARFEERTVNSTEEVVEIIRQFYECDILLVGKSSKGPMVSRLPVMKIECPELGPVGNLIVSNEISTSVSVLVVQQYTGKGPSVVGSVSVPVVETP

SEQ ID NO: 71 - DNA, 1161 bp, Arabidopsis thaliana
  misc_feature (1)..(1161): Ceres cDNA ID no. 3084650
  misc_feature (1)..(1161): Also known as  Ceres CDNA ID no. 23786979
atggagacagacgaagcataccaaaagaaagagcgagctgcattagtagccatcgttgtccttgcttgtcttgctttatcttctttgttcgtcgcctttagctactactgctatattcgtaacaaggaaaaaggcgattgtcagaaagtacaagatgttactgaaaatgggttgcaaattttcacctttaagcaattgcattcagcaactggtggatttagcaagtctaatgtggttgggaatggtgggtttggcttggtttatcgtggtgtgcttaacgatggcagaaaagttgctatcaagctcatggatcatgcaggaaagcaaggggaagaagaattcaagatggaggttgagttactgagccgtctgcgttcaccatacttgttggcacttcttggttattgctcagacaatagtcataagctgcttgtgtatgagttcatggcaaatggtggtctgcaggaacacctgtatcttcccaacaggtctggttctgtcccaccaagattagattgggaaactaggatgagaatagctgtggaagctgcaaaaggcttggaatatctccatgaacaagtatcacccccggtgattcatagagactttaagagcagcaatattctgctggacagaaacttcaatgccaaagtttcagattttggattggctaaagtcggatcagataaagctggtggacacgtttctacccgtgtattaggcacacaaggatatgtagctcctgagtacgctttaactggtcacttgacaacaaagtcggatgtctatagctacggtgttgtcctgttagagttactaaccggtagagttccagtagatatgaagagagctacaggagaaggtgttcttgtctcttgggctttgcctcaattggctgatagagacaaagtagtagacataatggatccaacactcgaaggacaatactctacgaaagaagttgttcaagttgcagcaatagcagcaatgtgtgttcaagcagaagctgactacagacccttaatggcagatgtggtgcagtcactggttccattagtgagaaaccgtaggtcagcttcaaagcttagtggctgctctagtagctttagcttggctcggtctcctaactctccgggtaaagcaagcataggttctcaatga

SEQ ID NO: 72 - protein, 1161 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGAGACAGACGAAGCATACCAAAAGAAAGAGCGAGCTGCATTAGTAGCCATCGTTGTCCTTGCTTGTCTTGCTTTATCTTCTTTGTTCGTCGCCTTTAGCTACTACTGCTATATTCGTAACAAGGAAAAAGGCGATTGTCAGAAAGTACAAGATGTTACTGAAAATGGGTTGCAAATTTTCACCTTTAAGCAATTGCATTCAGCAACTGGTGGATTTAGCAAGTCTAATGTGGTTGGGAATGGTGGGTTTGGCTTGGTTTATCGTGGTGTGCTTAACGATGGCAGAAAAGTTGCTATCAAGCTCATGGATCATGCAGGAAAGCAAGGGGAAGAAGAATTCAAGATGGAGGTTGAGTTACTGAGCCGTCTGCGTTCACCATACTTGTTGGCACTTCTTGGTTATTGCTCAGACAATAGTCATAAGCTGCTTGTGTATGAGTTCATGGCAAATGGTGGTCTGCAGGAACACCTGTATCTTCCCAACAGGTCTGGTTCTGTCCCACCAAGATTAGATTGGGAAACTAGGATGAGAATAGCTGTGGAAGCTGCAAAAGGCTTGGAATATCTCCATGAACAAGTATCACCCCCGGTGATTCATAGAGACTTTAAGAGCAGCAATATTCTGCTGGACAGAAACTTCAATGCCAAAGTTTCAGATTTTGGATTGGCTAAAGTCGGATCAGATAAAGCTGGTGGACACGTTTCTACCCGTGTATTAGGCACACAAGGATATGTAGCTCCTGAGTACGCTTTAACTGGTCACTTGACAACAAAGTCGGATGTCTATAGCTACGGTGTTGTCCTGTTAGAGTTACTAACCGGTAGAGTTCCAGTAGATATGAAGAGAGCTACAGGAGAAGGTGTTCTTGTCTCTTGGGCTTTGCCTCAATTGGCTGATAGAGACAAAGTAGTAGACATAATGGATCCAACACTCGAAGGACAATACTCTACGAAAGAAGTTGTTCAAGTTGCAGCAATAGCAGCAATGTGTGTTCAAGCAGAAGCTGACTACAGACCCTTAATGGCAGATGTGGTGCAGTCACTGGTTCCATTAGTGAGAAACCGTAGGTCAGCTTCAAAGCTTAGTGGCTGCTCTAGTAGCTTTAGCTTGGCTCGGTCTCCTAACTCTCCGGGTAAAGCAAGCATAGGTTCTCAATGA

SEQ ID NO: 73 - DNA, 1596 bp, Arabidopsis thaliana
  misc_feature (1)..(1596): Ceres cDNA ID no. 3085952
atggccacaaggagattaagagcattcaagagatggatgcaagctaacggcgttgattgcagcgaagctctcaacctcgtcgacgacgaaaacgatggtgtctctgtgagagcattctgcgatttgaaggaaggagatgttgttgccaatatctcaaaaactgcttgtctcactatcaaaaccagtggagctcgtgagatgatcgaatctgctgatttagatggaagtttaggtctctctgtggctctcatgtacgagagaagcttaggtgaagaatctccttgggctggttatcttcagattcttcctattcaagaagatttgcctcttgtttggtctcttgaagacttagattctctcttatctggaactgagcttcataagttggtgaaggaagatcatgttcttatatatgaggattggaaagaaaacattttgccgcttacctcttcactgcctcagaatgttgattctgattcgtttggaatcaaagagtatcttgctgctaagagtttaattgcttcacggtctttcgaaatcgatgattaccatggatccgggatggttcctcttgcagacctctttaatcataaaactggggcagaagacgttcacttcactcatgaatccgattctgaagctgatgaatctgacaacgatgatgctgcaaatgagaccactgatgaagacgagccttccagtaaaatttcttcctcgcctgagcagtcttttgaggaagttcctggtgaaaacactgatgacgaagccaaagaagaagaagaagaagaagaagaagaagaagaaggagaagaagaagaagaaggagaagaggaagaagaaaactcttcaatgctgcaaaatgatcaatccggtctaaaaatgattatggtgaaggatgtctcagctggagctgaggtattcaatacatacggtttgatgggtaatgctgcattactccacaggtacggatttacagagctcgataatccatatgacatagtaaacatagatctagaattagtaaccgaatggagcacatcctcattcacaagccggtacactcgagctagactggccttgtggagaaaactaggttacacaggatgcgagagtcaaaactcagaatactttgaggtatcttcaaccggagaaccccaaaccgagctcctgatcctactctatatactgctcttaccagacgacacatacaataaactggatctagctgaatcaacaacaggagcttctccctcgaaagaaggaaaaagatcttcttcttacgagataacaattgggaaacacaagtttgtgtatggagaaagcggaaatgatattcttctgacagatggtgtttgtgaagctcttctaactattgtggataagcgagagagtttatatggatcattgagctcattggaagatgacattgttagggtgaagacttgttgtcttccgagagacaggagactatatcattcgcttgtgttgcgtgtgagtgagaggaagattctaaagaagcttaggagctacatccatacccagaccaatgagtcttccagcggaaagcgccggaagaagatggttccaaaatcctag

SEQ ID NO: 74 - protein, 531 aa, Arabidopsis thaliana
  misc_feature: PFam Name: SET; PFam Description: SET domain
  misc_feature: PFam Name: Merozoite_SPAM; PFam Description: Merozoite
  misc_feature: PFam Name: S-antigen; PFam Description: S-antigen protein
  misc_feature: PFam Name: Daxx; PFam Description: Daxx Family
  misc_feature: PFam Name: SDA1; PFam Description: SDA1
  misc_feature: GI Number: 34907380; NR Description: P0471B04.24 [Oryza sativa (japonica cultivar-group)] >gi|21952799|dbj|BAC06215.1| P0018C10.16 [Oryza sativa (japonica cultivar-group)] >gi|22202682|dbj|BAC07340.1| P0471B04.24 [Oryza sativa (japonica
  misc_feature: GI Number: 28829640; NR Description: similar to Arabidopsis thaliana (Mouse-ear cress). Hypothetical 59.5 kDa protein
  misc_feature: GI Number: 19114984; NR Description: hypothetical coiled-coil protein [Schizosaccharomyces pombe] >gi|7768489|emb|CAB90780.1| putative transcriptional regulator; SET domain; putative histone lysine methyltransferase; similar to S. cerevisiae RMS1
  misc_feature: GI Number: 66845253; NR Description: SET domain protein
  misc_feature: GI Number: 29251343; NR Description: GLP_574_57226_57648
MATRRLRAFKRWMQANGVDCSEALNLVDDENDGVSVRAFCDLKEGDVVANISKTACLTIKTSGAREMIESADLDGSLGLSVALMYERSLGEESPWAGYLQILPIQEDLPLVWSLEDLDSLLSGTELHKLVKEDHVLIYEDWKENILPLTSSLPQNVDSDSFGIKEYLAAKSLIASRSFEIDDYHGSGMVPLADLFNHKTGAEDVHFTHESDSEADESDNDDAANETTDEDEPSSKISSSPEQSFEEVPGENTDDEAKEEEEEEEEEEEGEEEEEGEEEEENSSMLQNDQSGLKMIMVKDVSAGAEVFNTYGLMGNAALLHRYGFTELDNPYDIVNIDLELVTEWSTSSFTSRYTRARLALWRKLGYTGCESQNSEYFEVSSTGEPQTELLILLYILLLPDDTYNKLDLAESTTGASPSKEGKRSSSYEITIGKHKFVYGESGNDILLTDGVCEALLTIVDKRESLYGSLSSLEDDIVRVKTCCLPRDRRLYHSLVLRVSERKILKKLRSYIHTQTNESSSGKRRKKMVPKS

SEQ ID NO: 75 - DNA, 1164 bp, Arabidopsis thaliana
  misc_feature (1)..(1164): Ceres cDNA ID no. 3089968
atggcttcttcttctctacctctttctcttccgtttccactccgatctcttactagtaccactcgatctctaccatttcaatgttctcctctctttttctctattccttcttcaatcgtttgcttctccactcaaaatcccgaccgcgaagaggtccggtggctccgggaagagcagagatggattcgcgaggagcaacgatggattcgtgaagaacagagatggatacgcgaacgtgaatcgcttctacaagagatttcggatctacagctcagaattcaatccctagagtcacgaaattcgcaattggggaattctattcccgatacgatttcgaatatcgctgctttgcttcaggttttgaaggagaagaatcggatttctgagagtggattgagcgcaacgccgatggtattggagagtacgagagaacaaattgttgaggaggtggaagaagaagagaagcgagtgattattgctgaagagaaagttagggtttcggagccggtgaagaagatcaagaggaggatattgaaagttggaagcgaaggcgacgatgttcaagctttgcaggaagctctgttgaaattaggattctattcgggcgaagaggatatggagttctcgagcttttcaagtgggactgcaagtgctgttaagacttggcaagcatcgcttggggtccgtgaggatggggtaatgacagcagagcttcttcagaggttgttcatggatgaagacgtagagacagataaggatgaagcaagtacaatgaagaaagaggaagctggtaatggggcggtatttacttcagtgacacaagtccctgagaagaagcaatcaatcgtgaaagatcaaagtgacagagaagttgacgttactcaaaatcgggtttttcttcttggagaaaacagatgggaagatccctccaggctcattggcaggaacaaaccggtagacagaagtgaatcaacaaacaccaaaacgaggtgcatcacttgtcgaggggagggtcgattgatgtgcctagagtgcgatggaaccggtgagccaaacattgagccgcagttcatggagtgggttggtgaagatacgaagtgtccgtactgtgaaggtcttggctatacagtttgcgatgtctgcgacggcaaaaaaaacttataa

SEQ ID NO: 76 - protein, 387 aa, Arabidopsis thaliana
  misc_feature: PFam Name: PG_binding_1; PFam Description: Putative
MASSSLPLSLPFPLRSLTSTTRSLPFQCSPLFFSIPSSIVCFSTQNPDREEVRWLREEQRWIREEQRWIREEQRWIRERESLLQEISDLQLRIQSLESRNSQLGNSIPDTISNIAALLQVLKEKNRISESGLSATPMVLESTREQIVEEVEEEEKRVIIAEEKVRVSEPVKKIKRRILKVGSEGDDVQALQEALLKLGFYSGEEDMEFSSFSSGTASAVKTWQASLGVREDGVMTAELLQRLFMDEDVETDKDEASTMKKEEAGNGAVFTSVTQVPEKKQSIVKDQSDREVDVTQNRVFLLGENRWEDPSRLIGRNKPVDRSESTNTKTRCITCRGEGRLMCLECDGTGEPNIEPQFMEWVGEDTKCPYCEGLGYTVCDVCDGKKNL

SEQ ID NO: 77 - DNA, 1533 bp, Arabidopsis thaliana
  misc_feature (1)..(1533): Ceres cDNA ID no. 3095119
  misc_feature (1)..(1533): Also known as  Ceres CDNA ID no. 23786979
atggctactatttggtttctcccacttctctttctctcttgtcttcttcttgccgctttaagactcaagaagcggcggcaacatcaacggaaaccaccgtctccaccgggctttccgatcatcggaaacttgcatcagcttggggagctaccacatcaatctctatggagtctctccaaaaaatatggtcctgtaatgcttttgaagtttggaagtatcccaacggttgttgtctcttcttctgaaacagcaaagcaagctctgaaaatccatgacctcaattgttgtagccgtccaagcttagcaggattaaaacaaaagtcatatgattatttaggaccaagagcgctctcttacaactacttggacatagttttctctccttttaatgattactggaaagaattgaggaggatgtgtgtgcaagagcttttcagtcctaaacaagttcatttgattcaacccatcagggaagaggaagtcaagaaactgatgaattcattctcggaatcagctgctcagaaaactccggttaacttgagcgagaagttagcttctttaactgttggcgtgatatgcaaggcagcatttggtgtgagtttccaaggaactgtgcttaatagtgacaacttcgacaagttaatccatgatgcatttttgttcttggggagcttctctgcctcggattattttccaaatgtcggctggatcatcgactggctcacggggttacaagggcagagagagagaagtgtgagaggtcttgacgcattctatgaacaaatgtttgatctacataaacaggggaacaaagaaggagttgaggattttgtggacttgctcttgaagttggagaaagaagaaactgttcttggatatggcaagctcacaagaaaccatatcaaagcagtcttaatgaatgttcttcttggaggcattggaacttcggctataacaatgacatgggcaatgacagaacttatgagaaacccgcgagtaatgaagaaagttcaatccgaaatcagaaatcaaattgggggcaagtcaatgatctgcttggatgacatagaccaactccattacctgaaaatggtgatcaatgaaacatggaggctacatcctccagcaccacttctagttccaagagaagtaatgtctgaatttgaaatcaacggctacacgattccagccaagacaagactttatgtgaatgtatggggtatcgggcgtgatccagatacttggaaagatccagaggagtttcttccagagagatttgttaacagtaacattgatgcaaaaggacaaaactttgagctgttaccatttggaagtggtaggagaatgtgtcctgccatgtacatggggacaacaatggtggagtttggtctagccaatctcttgtaccattttgactggaaattaccagaaggcatggtggtcgaagacattgacatggaagaatctcctggactcaatgccagcaagaaaaatgagcttgtacttgttcctaggaagtatttaaatctgtaa

SEQ ID NO: 78 - protein, 1533 aa, Arabidopsis thaliana
  misc_feature: PFam Name: MFAP1_C; PFam Description:
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
ATGGCTACTATTTGGTTTCTCCCACTTCTCTTTCTCTCTTGTCTTCTTCTTGCCGCTTTAAGACTCAAGAAGCGGCGGCAACATCAACGGAAACCACCGTCTCCACCGGGCTTTCCGATCATCGGAAACTTGCATCAGCTTGGGGAGCTACCACATCAATCTCTATGGAGTCTCTCCAAAAAATATGGTCCTGTAATGCTTTTGAAGTTTGGAAGTATCCCAACGGTTGTTGTCTCTTCTTCTGAAACAGCAAAGCAAGCTCTGAAAATCCATGACCTCAATTGTTGTAGCCGTCCAAGCTTAGCAGGATTAAAACAAAAGTCATATGATTATTTAGGACCAAGAGCGCTCTCTTACAACTACTTGGACATAGTTTTCTCTCCTTTTAATGATTACTGGAAAGAATTGAGGAGGATGTGTGTGCAAGAGCTTTTCAGTCCTAAACAAGTTCATTTGATTCAACCCATCAGGGAAGAGGAAGTCAAGAAACTGATGAATTCATTCTCGGAATCAGCTGCTCAGAAAACTCCGGTTAACTTGAGCGAGAAGTTAGCTTCTTTAACTGTTGGCGTGATATGCAAGGCAGCATTTGGTGTGAGTTTCCAAGGAACTGTGCTTAATAGTGACAACTTCGACAAGTTAATCCATGATGCATTTTTGTTCTTGGGGAGCTTCTCTGCCTCGGATTATTTTCCAAATGTCGGCTGGATCATCGACTGGCTCACGGGGTTACAAGGGCAGAGAGAGAGAAGTGTGAGAGGTCTTGACGCATTCTATGAACAAATGTTTGATCTACATAAACAGGGGAACAAAGAAGGAGTTGAGGATTTTGTGGACTTGCTCTTGAAGTTGGAGAAAGAAGAAACTGTTCTTGGATATGGCAAGCTCACAAGAAACCATATCAAAGCAGTCTTAATGAATGTTCTTCTTGGAGGCATTGGAACTTCGGCTATAACAATGACATGGGCAATGACAGAACTTATGAGAAACCCGCGAGTAATGAAGAAAGTTCAATCCGAAATCAGAAATCAAATTGGGGGCAAGTCAATGATCTGCTTGGATGACATAGACCAACTCCATTACCTGAAAATGGTGATCAATGAAACATGGAGGCTACATCCTCCAGCACCACTTCTAGTTCCAAGAGAAGTAATGTCTGAATTTGAAATCAACGGCTACACGATTCCAGCCAAGACAAGACTTTATGTGAATGTATGGGGTATCGGGCGTGATCCAGATACTTGGAAAGATCCAGAGGAGTTTCTTCCAGAGAGATTTGTTAACAGTAACATTGATGCAAAAGGACAAAACTTTGAGCTGTTACCATTTGGAAGTGGTAGGAGAATGTGTCCTGCCATGTACATGGGGACAACAATGGTGGAGTTTGGTCTAGCCAATCTCTTGTACCATTTTGACTGGAAATTACCAGAAGGCATGGTGGTCGAAGACATTGACATGGAAGAATCTCCTGGACTCAATGCCAGCAAGAAAAATGAGCTTGTACTTGTTCCTAGGAAGTATTTAAATCTGTAA

SEQ ID NO: 79 - DNA, 463 bp, Zea mays
  misc_feature (1)..(463): Ceres cDNA ID no. 3102547
  misc_feature (1)..(463): Ceres CLONE  ID no. 383527
  misc_feature (1)..(463): Also known as  Ceres CDNA ID no. 0
attcacgggcgcagcgacctctcgtctcctctccatctagacaccactttcttctctccgcctcaggcggcgcgcgcgcggctagcttcccggcctcccagcaacatcccgccaccactttctcctcctcctccgctctctccggccgcgcgcgccgacgtttttttttccaacggaggccgccgcgcgctgcctttagtttcggacccatccatccatacatagccaacatcacctatagcaggcggagggacggaggaccgtccgtctcgttcactccgcgccgcgcgtggcccgatccagcccggccctcggatggtcgccgctggcacgtacagcgacgacaccagcggcggcgggtgcgggtccatggagttctggccggagttcctggcctccagcggcgggcgcgagttcgtggccggcggggtgggcggcatggcgggcgtgctggcgggccacc

SEQ ID NO: 80 - protein, 463 aa, Zea mays
ATTCACGGGCGCAGCGACCTCTCGTCTCCTCTCCATCTAGACACCACTTTCTTCTCTCCGCCTCAGGCGGCGCGCGCGCGGCTAGCTTCCCGGCCTCCCAGCAACATCCCGCCACCACTTTCTCCTCCTCCTCCGCTCTCTCCGGCCGCGCGCGCCGACGTTTTTTTTTCCAACGGAGGCCGCCGCGCGCTGCCTTTAGTTTCGGACCCATCCATCCATACATAGCCAACATCACCTATAGCAGGCGGAGGGACGGAGGACCGTCCGTCTCGTTCACTCCGCGCCGCGCGTGGCCCGATCCAGCCCGGCCCTCGGATGGTCGCCGCTGGCACGTACAGCGACGACACCAGCGGCGGCGGGTGCGGGTCCATGGAGTTCTGGCCGGAGTTCCTGGCCTCCAGCGGCGGGCGCGAGTTCGTGGCCGGCGGGGTGGGCGGCATGGCGGGCGTGCTGGCGGGCCACC

SEQ ID NO: 81 - DNA, 486 bp, Zea mays
  misc_feature (1)..(486): Ceres cDNA ID no. 3424439
  misc_feature (1)..(486): Ceres CLONE  ID no. 623196
  misc_feature (1)..(486): Also known as  Ceres CDNA ID no. 23822743
gagtcgagaaggagagcggtgagcagagcccaggcgtgatgatggtcgtcgttccgaggatacgcgtcgacgctgacacgtttgagtacgcgtcgaagatgctcgagactaccaggtctctgatacagcgcctggagaaagtcgacccggtgaagatgacgcacgaggagcagctctgcttttggatcaatatccacaatgctctggtcatgcatgcttttctggcctatggtctgcacgacaagcgcatgaagagcacggacatgattctgaaggctgcgtataatgttggcggccaatcagtaaatgcgcagactattcagaactcgattcttggatgccagtcccatcgtccatcactgtgggtccgcgcgctattcacgccggcgaaaaggtccgcggcgaggcacccgtatgcgctccagcacccagaacccgttgcgcatttcgcgctgtcgaccggagcggttttcggacccacctgtg

SEQ ID NO: 82 - protein, 486 aa, Zea mays
  misc_feature: GI Number: 50947619; NR Description: ternary complex factor-like [Oryza sativa (japonica cultivar-group)] >gi|42408754|dbj|BAD09990.1| ternary complex factor-like [Oryza
  misc_feature: GI Number: 28916180; NR Description: putative ternary complex
  misc_feature: GI Number: 21618245; NR Description: unknown [Arabidopsis thaliana]
  misc_feature: GI Number: 51535341; NR Description: ternary complex factor
  misc_feature: GI Number: 53793306; NR Description: ternary complex factor MIP1-like [Oryza sativa (japonica cultivar-group)] >gi|53792826|dbj|BAD53859.1| ternary complex factor MIP1-like
GAGTCGAGAAGGAGAGCGGTGAGCAGAGCCCAGGCGTGATGATGGTCGTCGTTCCGAGGATACGCGTCGACGCTGACACGTTTGAGTACGCGTCGAAGATGCTCGAGACTACCAGGTCTCTGATACAGCGCCTGGAGAAAGTCGACCCGGTGAAGATGACGCACGAGGAGCAGCTCTGCTTTTGGATCAATATCCACAATGCTCTGGTCATGCATGCTTTTCTGGCCTATGGTCTGCACGACAAGCGCATGAAGAGCACGGACATGATTCTGAAGGCTGCGTATAATGTTGGCGGCCAATCAGTAAATGCGCAGACTATTCAGAACTCGATTCTTGGATGCCAGTCCCATCGTCCATCACTGTGGGTCCGCGCGCTATTCACGCCGGCGAAAAGGTCCGCGGCGAGGCACCCGTATGCGCTCCAGCACCCAGAACCCGTTGCGCATTTCGCGCTGTCGACCGGAGCGGTTTTCGGACCCACCTGTG

SEQ ID NO: 83 - DNA, 1146 bp, Arabidopsis thaliana
  misc_feature (1)..(1146): Ceres cDNA ID no. 3447026
  misc_feature (1)..(1146): Also known as  Ceres CDNA ID no. 23822743
atgagttgtttctcgtgcttctcttcaaaagttctggacaatgaaggttcttcgatgcctgctccttataagcaaccaaactcacctaagagaacaacaggagaagtggtggctaagaacgcaaacggaccatcaaacaatatgggggcacgtattttcacgttccgtgagctagccaccgcgacaaagaattttagacaagagtgcctcattggtgaaggtgggttcgggagggtttacaaaggaaagcttgaaaatccagctcaggtcgtggcagtgaaacaacttgataggaatggattacaaggacaaagagagttcttggtcgaggtcttaatgcttagtcttctacatcataggaatcttgtgaatcttatcggttattgcgctgatggagaccaaagacttcttgtttacgagtatatgcctcttggatctctagaagatcatctcctcgatcttgaaccgggacaaaaaccactagactggaacactcgtattaagattgctttaggagcagcaaaaggaattgagtatctccatgatgaggctgatcctccagtgatttaccgagatcttaaatcgtcaaatatattacttgacccagaatacgttgcgaaattatcggatttcggtttagcaaagctaggtcctgttggagacacactacatgtgtcttcccgagttatgggaacttatggttattgtgctcctgaatatcaaagaactggctatctaacaaataaatcagatgtctacagctttggagttgtgttgttggaacttatatccggaagacgagtcatcgacacaatgagacctagtcatgaacaaaatctcgttacttgggcactaccgatttttagagatccgactagatattggcagctagctgatccattgcttcgaggcgactatccggaaaagagtttgaaccaagctatagctgtagcggcaatgtgcctgcatgaagaaccaacggttagaccactaatgagtgacgttattacagccttgagctttcttggtgcatcctcaaattcctccaataccggctctaaccatttgcaacaaaatcgatccaacaaatatcaggatgcagttcagtgggactcaagtcctagatatgctaattcgcaaatgtag

SEQ ID NO: 84 - protein, 1146 aa, Arabidopsis thaliana
  misc_feature: GI Number: 50947619; NR Description: ternary complex factor-like [Oryza sativa (japonica cultivar-group)] >gi|42408754|dbj|BAD09990.1| ternary complex factor-like [Oryza
  misc_feature: GI Number: 28916180; NR Description: putative ternary complex
  misc_feature: GI Number: 21618245; NR Description: unknown [Arabidopsis thaliana]
  misc_feature: GI Number: 51535341; NR Description: ternary complex factor
  misc_feature: GI Number: 53793306; NR Description: ternary complex factor MIP1-like [Oryza sativa (japonica cultivar-group)] >gi|53792826|dbj|BAD53859.1| ternary complex factor MIP1-like
ATGAGTTGTTTCTCGTGCTTCTCTTCAAAAGTTCTGGACAATGAAGGTTCTTCGATGCCTGCTCCTTATAAGCAACCAAACTCACCTAAGAGAACAACAGGAGAAGTGGTGGCTAAGAACGCAAACGGACCATCAAACAATATGGGGGCACGTATTTTCACGTTCCGTGAGCTAGCCACCGCGACAAAGAATTTTAGACAAGAGTGCCTCATTGGTGAAGGTGGGTTCGGGAGGGTTTACAAAGGAAAGCTTGAAAATCCAGCTCAGGTCGTGGCAGTGAAACAACTTGATAGGAATGGATTACAAGGACAAAGAGAGTTCTTGGTCGAGGTCTTAATGCTTAGTCTTCTACATCATAGGAATCTTGTGAATCTTATCGGTTATTGCGCTGATGGAGACCAAAGACTTCTTGTTTACGAGTATATGCCTCTTGGATCTCTAGAAGATCATCTCCTCGATCTTGAACCGGGACAAAAACCACTAGACTGGAACACTCGTATTAAGATTGCTTTAGGAGCAGCAAAAGGAATTGAGTATCTCCATGATGAGGCTGATCCTCCAGTGATTTACCGAGATCTTAAATCGTCAAATATATTACTTGACCCAGAATACGTTGCGAAATTATCGGATTTCGGTTTAGCAAAGCTAGGTCCTGTTGGAGACACACTACATGTGTCTTCCCGAGTTATGGGAACTTATGGTTATTGTGCTCCTGAATATCAAAGAACTGGCTATCTAACAAATAAATCAGATGTCTACAGCTTTGGAGTTGTGTTGTTGGAACTTATATCCGGAAGACGAGTCATCGACACAATGAGACCTAGTCATGAACAAAATCTCGTTACTTGGGCACTACCGATTTTTAGAGATCCGACTAGATATTGGCAGCTAGCTGATCCATTGCTTCGAGGCGACTATCCGGAAAAGAGTTTGAACCAAGCTATAGCTGTAGCGGCAATGTGCCTGCATGAAGAACCAACGGTTAGACCACTAATGAGTGACGTTATTACAGCCTTGAGCTTTCTTGGTGCATCCTCAAATTCCTCCAATACCGGCTCTAACCATTTGCAACAAAATCGATCCAACAAATATCAGGATGCAGTTCAGTGGGACTCAAGTCCTAGATATGCTAATTCGCAAATGTAG

SEQ ID NO: 85 - DNA, 503 bp, Zea mays
  misc_feature (1)..(503): Ceres cDNA ID no. 3477685
  misc_feature (1)..(503): Ceres CLONE  ID no. 645092
  misc_feature (1)..(503): Also known as  Ceres CDNA ID no. 23820524
actttgttgatcctgagagaattgagcatggtagcccattaaggttacctggccacccagtgaatggtcagccgatggatctggagggctggtcagggattcaaacagaggcttctcagcatatgggggttctacaagcatcatcaatgggctggaatggtgctcctgtacttgctgccactcctgttgtcaagaaagtcatgaggctggatgttccagtagacaagtatcctaactacaactttgttggtcgtttattggggccgcgaggtaactccctgaaaagggttgaagcttcaacccaatgtagagtttacattcgaggacggggttctgtgaaagactctgttaaggaagacaagctgagggataaacctgggtatgaacaccttaatgaacaactgcatgtgcttgtggaagcagagtttccagcagatatggttgatgtgcgtcttaatcaagctgtgtccatcctaraggatcttcttaaaccaattgacgag

SEQ ID NO: 86 - protein, 503 aa, Zea mays
  misc_feature: PFam Name: KH_1; PFam Description: KH domain
  misc_feature: GI Number: 50902256; NR Description: P0408G07.16 [Oryza sativa (japonica cultivar-group)] >gi|20161243|dbj|BAB90170.1| P0408G07.16 [Oryza sativa (japonica cultivar-group)] >gi|21328045|dbj|BAC00630.1| P0434C04.5 [Oryza sativa (japonica
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 19310523; NR Description: At1g09660/F21M12_5 [Arabidopsis thaliana] >gi|16930473|gb|AAL31922.1|
  misc_feature: GI Number: 26452384; NR Description: putative elongation factor [Arabidopsis thaliana] >gi|51971995|dbj|BAD44662.1| putative elongation factor [Arabidopsis thaliana] >gi|51971727|dbj|BAD44528.1| putative elongation factor
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
ACTTTGTTGATCCTGAGAGAATTGAGCATGGTAGCCCATTAAGGTTACCTGGCCACCCAGTGAATGGTCAGCCGATGGATCTGGAGGGCTGGTCAGGGATTCAAACAGAGGCTTCTCAGCATATGGGGGTTCTACAAGCATCATCAATGGGCTGGAATGGTGCTCCTGTACTTGCTGCCACTCCTGTTGTCAAGAAAGTCATGAGGCTGGATGTTCCAGTAGACAAGTATCCTAACTACAACTTTGTTGGTCGTTTATTGGGGCCGCGAGGTAACTCCCTGAAAAGGGTTGAAGCTTCAACCCAATGTAGAGTTTACATTCGAGGACGGGGTTCTGTGAAAGACTCTGTTAAGGAAGACAAGCTGAGGGATAAACCTGGGTATGAACACCTTAATGAACAACTGCATGTGCTTGTGGAAGCAGAGTTTCCAGCAGATATGGTTGATGTGCGTCTTAATCAAGCTGTGTCCATCCTARAGGATCTTCTTAAACCAATTGACGAG

SEQ ID NO: 87 - DNA, 2682 bp, Arabidopsis thaliana
  misc_feature (1)..(2682): Ceres cDNA ID no. 3598389
  misc_feature (1)..(2682): Also known as  Ceres CDNA ID no. 23820524
atgaaatctcttcactggtttttgcatcttttgatcatagcttttaccgttttgagatcagtggaagctcaaaatcaagcaggatttattagtttggattgtgggttggtgcctaaggaaactacttatacagagaagtcgacgaatataacatacaaatcagacgtggattacatcgacagtggattggtcggaaagatcaatgatgcatacaaaactcagtttcagcaacaggtttgggccgtgagaagcttccctgtaggtcaaagaaactgttacaatgtcaacctcacggcaaacaacaaatatttgatcagaggaacctttgtgtatgggaattatgatggcctgaatcagttcccaagttttgatcttcatatcggtcctaacaaatggtcgtctgttaaaatactaggagtaacaaatacttctatgcatgagataatccatgtcgtaccacaagatagtcttgaagtttgtcttgttaagactggaccgacgacaccattcatttcgtcgctggaggttcgtccattgaacaatgaaagttatctcacgcaaagtggatcattgatgttgttcgccagagtatactttccatccagttcatcatctttcattaggtatgatgaggacatacatgaccgtgtttggaattcattcacagatgatgaaaccgtctggataagtacagacctcccgatcgatacaagtaactcctatgacatgcctcaatccgtgatgaagacagctgctgtccctaaaaatgctagtgagccatggctcttatggtggactcttgatgagaacaccgcacaatcatatgtatatatgcatttcgccgaagtccagaatcttacagcaaatgaaaccagagaattcaacattacttacaatggtggtctacgttggttcagctatttgaggcctcctaatctcagcatttcaacgatctttaatccaagggcagtgagttcttcaaatgggatatttaatttcacattcgcaatgacgggtaactcaactctgcctccccttctcaacgccctcgagatttatacagtcgtagacattctacagctagagacaaacaaagatgaaggcaagtgtgtttctgctatgatgaacatcaaagaaacatatggtttaagcaaaaagataagctggcaaggagatccgtgtgctcctcagctttatcggtgggaaggtttaaattgtagttatccggactccgagggatcaagaatcatatccttgaacttgaatgggagcgagttgacaggttctataacatctgacatatccaagctaacactgttgacagtattagatttatcaaataatgatttatcaggagatattccaacattttttgctgagatgaagtcgttgaaactcataaacttaagtggaaacccgaaccttaatctcacagcaattccagactctcttcagcaaagggtaaacagcaaatctttaacactaattttgggtgaaaacctgactctgactcccaaaaaagagagtaaaaaggttcccatggttgctatcgcagcgtcagtggctggcgtgttcgctctgctcgttatcttagccatattttttgtcattaaaaggaaaaatgtgaaagctcataagtctccaggaccacccccattagtcactcccggtatagttaaaagtgagacaagatcatccaatccatcaatcataacaagggaacgcaagatcacgtatccagaggtactgaagatgactaataacttcgagagagttcttggcaaaggaggctttggaacagtgtatcatggaaacttggatggtgctgaagtggcagtgaaaatgctttctcattcatcagctcaaggttataaagagttcaaagcagaggttgaacttcttttaagagttcaccatagacatttggtgggacttgtgggttactgtgatgatggagacaacttggctctgatttatgaatatatggcaaatggagacctgagggagaatatgtcaggaaaacgtggaggcaatgtccttacctgggaaaacaggatgcaaatagctgtagaggctgcacaagggctggagtatctgcacaatggatgtaggcctcctatggtacatagagatgttaaaactactaacattttattgaatgagcggtgtggagcaaaactagccgactttgggctctcgagatctttcccaatcgatggcgaatgtcatgtttcgacagtggttgcgggtacacctggttacctagacccggagtactacagaacaaactggctaagcgagaagagtgacgtgtacagcttcggtgtagtgctattagagatagtcacaaaccagcctgtgatagataaaacccgggagagacctcacatcaatgactgggttgggttcatgctcactaaaggagacatcaagagcatcgttgacccgaaactgatgggggactatgatacaaacggtgcatggaagattgtggagctagctctggcctgtgtgaacccatcttcgaaccggagaccaacaatggcacacgttgtgatggagctaaacgactgtgtggccttagaaaatgcaaggcggcaaggtagtgaagagatgtactcaatgggttctgttgactatagtctctcttctacttctgactttgctcctggagccagataa

SEQ ID NO: 88 - protein, 2682 aa, Arabidopsis thaliana
  misc_feature: PFam Name: KH_1; PFam Description: KH domain
  misc_feature: GI Number: 50902256; NR Description: P0408G07.16 [Oryza sativa (japonica cultivar-group)] >gi|20161243|dbj|BAB90170.1| P0408G07.16 [Oryza sativa (japonica cultivar-group)] >gi|21328045|dbj|BAC00630.1| P0434C04.5 [Oryza sativa (japonica
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 19310523; NR Description: At1g09660/F21M12_5 [Arabidopsis thaliana] >gi|16930473|gb|AAL31922.1|
  misc_feature: GI Number: 26452384; NR Description: putative elongation factor [Arabidopsis thaliana] >gi|51971995|dbj|BAD44662.1| putative elongation factor [Arabidopsis thaliana] >gi|51971727|dbj|BAD44528.1| putative elongation factor
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
ATGAAATCTCTTCACTGGTTTTTGCATCTTTTGATCATAGCTTTTACCGTTTTGAGATCAGTGGAAGCTCAAAATCAAGCAGGATTTATTAGTTTGGATTGTGGGTTGGTGCCTAAGGAAACTACTTATACAGAGAAGTCGACGAATATAACATACAAATCAGACGTGGATTACATCGACAGTGGATTGGTCGGAAAGATCAATGATGCATACAAAACTCAGTTTCAGCAACAGGTTTGGGCCGTGAGAAGCTTCCCTGTAGGTCAAAGAAACTGTTACAATGTCAACCTCACGGCAAACAACAAATATTTGATCAGAGGAACCTTTGTGTATGGGAATTATGATGGCCTGAATCAGTTCCCAAGTTTTGATCTTCATATCGGTCCTAACAAATGGTCGTCTGTTAAAATACTAGGAGTAACAAATACTTCTATGCATGAGATAATCCATGTCGTACCACAAGATAGTCTTGAAGTTTGTCTTGTTAAGACTGGACCGACGACACCATTCATTTCGTCGCTGGAGGTTCGTCCATTGAACAATGAAAGTTATCTCACGCAAAGTGGATCATTGATGTTGTTCGCCAGAGTATACTTTCCATCCAGTTCATCATCTTTCATTAGGTATGATGAGGACATACATGACCGTGTTTGGAATTCATTCACAGATGATGAAACCGTCTGGATAAGTACAGACCTCCCGATCGATACAAGTAACTCCTATGACATGCCTCAATCCGTGATGAAGACAGCTGCTGTCCCTAAAAATGCTAGTGAGCCATGGCTCTTATGGTGGACTCTTGATGAGAACACCGCACAATCATATGTATATATGCATTTCGCCGAAGTCCAGAATCTTACAGCAAATGAAACCAGAGAATTCAACATTACTTACAATGGTGGTCTACGTTGGTTCAGCTATTTGAGGCCTCCTAATCTCAGCATTTCAACGATCTTTAATCCAAGGGCAGTGAGTTCTTCAAATGGGATATTTAATTTCACATTCGCAATGACGGGTAACTCAACTCTGCCTCCCCTTCTCAACGCCCTCGAGATTTATACAGTCGTAGACATTCTACAGCTAGAGACAAACAAAGATGAAGGCAAGTGTGTTTCTGCTATGATGAACATCAAAGAAACATATGGTTTAAGCAAAAAGATAAGCTGGCAAGGAGATCCGTGTGCTCCTCAGCTTTATCGGTGGGAAGGTTTAAATTGTAGTTATCCGGACTCCGAGGGATCAAGAATCATATCCTTGAACTTGAATGGGAGCGAGTTGACAGGTTCTATAACATCTGACATATCCAAGCTAACACTGTTGACAGTATTAGATTTATCAAATAATGATTTATCAGGAGATATTCCAACATTTTTTGCTGAGATGAAGTCGTTGAAACTCATAAACTTAAGTGGAAACCCGAACCTTAATCTCACAGCAATTCCAGACTCTCTTCAGCAAAGGGTAAACAGCAAATCTTTAACACTAATTTTGGGTGAAAACCTGACTCTGACTCCCAAAAAAGAGAGTAAAAAGGTTCCCATGGTTGCTATCGCAGCGTCAGTGGCTGGCGTGTTCGCTCTGCTCGTTATCTTAGCCATATTTTTTGTCATTAAAAGGAAAAATGTGAAAGCTCATAAGTCTCCAGGACCACCCCCATTAGTCACTCCCGGTATAGTTAAAAGTGAGACAAGATCATCCAATCCATCAATCATAACAAGGGAACGCAAGATCACGTATCCAGAGGTACTGAAGATGACTAATAACTTCGAGAGAGTTCTTGGCAAAGGAGGCTTTGGAACAGTGTATCATGGAAACTTGGATGGTGCTGAAGTGGCAGTGAAAATGCTTTCTCATTCATCAGCTCAAGGTTATAAAGAGTTCAAAGCAGAGGTTGAACTTCTTTTAAGAGTTCACCATAGACATTTGGTGGGACTTGTGGGTTACTGTGATGATGGAGACAACTTGGCTCTGATTTATGAATATATGGCAAATGGAGACCTGAGGGAGAATATGTCAGGAAAACGTGGAGGCAATGTCCTTACCTGGGAAAACAGGATGCAAATAGCTGTAGAGGCTGCACAAGGGCTGGAGTATCTGCACAATGGATGTAGGCCTCCTATGGTACATAGAGATGTTAAAACTACTAACATTTTATTGAATGAGCGGTGTGGAGCAAAACTAGCCGACTTTGGGCTCTCGAGATCTTTCCCAATCGATGGCGAATGTCATGTTTCGACAGTGGTTGCGGGTACACCTGGTTACCTAGACCCGGAGTACTACAGAACAAACTGGCTAAGCGAGAAGAGTGACGTGTACAGCTTCGGTGTAGTGCTATTAGAGATAGTCACAAACCAGCCTGTGATAGATAAAACCCGGGAGAGACCTCACATCAATGACTGGGTTGGGTTCATGCTCACTAAAGGAGACATCAAGAGCATCGTTGACCCGAAACTGATGGGGGACTATGATACAAACGGTGCATGGAAGATTGTGGAGCTAGCTCTGGCCTGTGTGAACCCATCTTCGAACCGGAGACCAACAATGGCACACGTTGTGATGGAGCTAAACGACTGTGTGGCCTTAGAAAATGCAAGGCGGCAAGGTAGTGAAGAGATGTACTCAATGGGTTCTGTTGACTATAGTCTCTCTTCTACTTCTGACTTTGCTCCTGGAGCCAGATAA

SEQ ID NO: 89 - DNA, 2568 bp, Arabidopsis thaliana
  misc_feature (1)..(2568): Ceres cDNA ID no. 3598409
  misc_feature (1)..(2568): Also known as  Ceres CDNA ID no. 23820524
atgaagactatgaatgggtttttgcttctctcgactatagcttttgccgtttttcacttagtccaagctcaatctcaatcaggttttatcagcttggattgtggactaattcctaaggacacaacctataccgagcagataacgaacataacatacatatcagacgcggattacatcgatagtggattaaccgaaaggatcagtgattcatacaagtcacagcttcagcaacagacttggaccttaagaagcttccctgaaggtcaaagaaattgttacaacttcaatctcaaagcgaatctcaaatatctgattagaggaacgtttgtgtatgggaattatgatggtttgaatcaaatgcctaagtttgatcttcatattggtcctaataaatggacttctgttatattggaaggagtagcaaatgctaccatcttcgagataattcatgtcttaacacaagaccgtctccaagtttgtcttgtcaaaacaggacaaacgacaccgtttatatcgtcgttggaacttcgtccgttgaacaatgatacttacgtcactcaaggtgggtcgttgatgtcctttgccagaatctactttccaaagactgcatacttcctcaggtattctgatgacttgtatgaccgagtttgggttccattcagccagaatgaaacagtgtcgttaagtaccaatctaccggttgatacaagtagcaattcctacaatgtgcctcaaaatgtggcgaattccgcaattattccggcggaagctactcatcctctcaacatatggtgggatctccaaaacatcaatgcaccgtcatatgtatacatgcattttgcagaaatccaaaatcttaaagctaatgacatcagagaattcaacattacatacaatggtggtcaggtttgggaaagttccattagacctcacaatctcagcatcactacaatctctagtccaacagctttaaattcttcagatgggtttttcaatttcacttttacaatgaccacaacctctactcttcctccacttatcaatgccctcgaggtttatacacttgtagaaaatttactgctcgagacatatcaagatgaagtttctgctatgatgaacatcaagaaaacatatggattgagtaaaaagataagttggcaaggagatccatgttctcctcaaatatatagatgggaaggtctgaattgcctttatttggactctgatcaacctctgatcacatcattagatttatcagataatgatttatccggagagattccagattttcttgctgatatgaagatgttgacactagtaaacttaaaaggaaacccgaagctcaacctcacagttccagattctattaagcataggataaacaacaaatctttaaaactaattatagatgaaaaccagagtagtgaaaaacacggtataaagtttcctttggttgctatcttagcatcagtggctggtgtgatcgcattactagctatctttaccatatgtgtcatttttaaaagagaaaaacagggaagtggtgaagctccaactagggttaatactgagatcagatcatcctatcaatcaatcgaaacaaaggatcgaaaatttacgtattccgagatactaaagatgacgaataactttgagagagttcttggtaaaggaggatatggaagagtgtattatggaaaattggatgatactgaagtagctgtgaaaatgctctttcattcctcagctgaacaagattataaacatttcaaagcagaggttgaactacttttaagagtccaccatagacatttggtgggacttgttggttactgtgatgatggagataactttgccttgatttatgaatacatggcaaatggagacttgaaggagaatatgtctggaaaccgcagtggacatgttctaagttgggaaaacagaatgcaaatagctatggaggcagcacaaggattggagtatctacataatggaagtagaccacctatggtccatagagatgtgaaaactactaacattttattgaatgagctgtatcaagcgaaactagctgattttgggctctctagatcttccccggtggatggtgaatcttatgtatcaacaatcgttgccggaacacctggttacttagaccctgagtactatagaacaaacttgttaagcgagaagactgatgtgtacagctttggggtagttttattagaaatcatcacaaaccagcctgtgattgatacaacccgcgagaaagcgcatattacagattgggttggatttaagctcatggaaggagacattaggaatattattgacccgaaactgattaaggaatttgatacaaacggtgtgtggaaggctgtggagttggctttgtcttgtgtaaaccctacgtcaaaccatagaccgacgatgccacatgttgtgatggagctaaaagagtgtctggactctgagattgccaggaaacaaggtagtcaagacatgttttctagagattctattgaattaaccttctctcctactggattctcacctggaccgaggtga

SEQ ID NO: 90 - protein, 2568 aa, Arabidopsis thaliana
  misc_feature: PFam Name: KH_1; PFam Description: KH domain
  misc_feature: GI Number: 50902256; NR Description: P0408G07.16 [Oryza sativa (japonica cultivar-group)] >gi|20161243|dbj|BAB90170.1| P0408G07.16 [Oryza sativa (japonica cultivar-group)] >gi|21328045|dbj|BAC00630.1| P0434C04.5 [Oryza sativa (japonica
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 19310523; NR Description: At1g09660/F21M12_5 [Arabidopsis thaliana] >gi|16930473|gb|AAL31922.1|
  misc_feature: GI Number: 26452384; NR Description: putative elongation factor [Arabidopsis thaliana] >gi|51971995|dbj|BAD44662.1| putative elongation factor [Arabidopsis thaliana] >gi|51971727|dbj|BAD44528.1| putative elongation factor
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
ATGAAGACTATGAATGGGTTTTTGCTTCTCTCGACTATAGCTTTTGCCGTTTTTCACTTAGTCCAAGCTCAATCTCAATCAGGTTTTATCAGCTTGGATTGTGGACTAATTCCTAAGGACACAACCTATACCGAGCAGATAACGAACATAACATACATATCAGACGCGGATTACATCGATAGTGGATTAACCGAAAGGATCAGTGATTCATACAAGTCACAGCTTCAGCAACAGACTTGGACCTTAAGAAGCTTCCCTGAAGGTCAAAGAAATTGTTACAACTTCAATCTCAAAGCGAATCTCAAATATCTGATTAGAGGAACGTTTGTGTATGGGAATTATGATGGTTTGAATCAAATGCCTAAGTTTGATCTTCATATTGGTCCTAATAAATGGACTTCTGTTATATTGGAAGGAGTAGCAAATGCTACCATCTTCGAGATAATTCATGTCTTAACACAAGACCGTCTCCAAGTTTGTCTTGTCAAAACAGGACAAACGACACCGTTTATATCGTCGTTGGAACTTCGTCCGTTGAACAATGATACTTACGTCACTCAAGGTGGGTCGTTGATGTCCTTTGCCAGAATCTACTTTCCAAAGACTGCATACTTCCTCAGGTATTCTGATGACTTGTATGACCGAGTTTGGGTTCCATTCAGCCAGAATGAAACAGTGTCGTTAAGTACCAATCTACCGGTTGATACAAGTAGCAATTCCTACAATGTGCCTCAAAATGTGGCGAATTCCGCAATTATTCCGGCGGAAGCTACTCATCCTCTCAACATATGGTGGGATCTCCAAAACATCAATGCACCGTCATATGTATACATGCATTTTGCAGAAATCCAAAATCTTAAAGCTAATGACATCAGAGAATTCAACATTACATACAATGGTGGTCAGGTTTGGGAAAGTTCCATTAGACCTCACAATCTCAGCATCACTACAATCTCTAGTCCAACAGCTTTAAATTCTTCAGATGGGTTTTTCAATTTCACTTTTACAATGACCACAACCTCTACTCTTCCTCCACTTATCAATGCCCTCGAGGTTTATACACTTGTAGAAAATTTACTGCTCGAGACATATCAAGATGAAGTTTCTGCTATGATGAACATCAAGAAAACATATGGATTGAGTAAAAAGATAAGTTGGCAAGGAGATCCATGTTCTCCTCAAATATATAGATGGGAAGGTCTGAATTGCCTTTATTTGGACTCTGATCAACCTCTGATCACATCATTAGATTTATCAGATAATGATTTATCCGGAGAGATTCCAGATTTTCTTGCTGATATGAAGATGTTGACACTAGTAAACTTAAAAGGAAACCCGAAGCTCAACCTCACAGTTCCAGATTCTATTAAGCATAGGATAAACAACAAATCTTTAAAACTAATTATAGATGAAAACCAGAGTAGTGAAAAACACGGTATAAAGTTTCCTTTGGTTGCTATCTTAGCATCAGTGGCTGGTGTGATCGCATTACTAGCTATCTTTACCATATGTGTCATTTTTAAAAGAGAAAAACAGGGAAGTGGTGAAGCTCCAACTAGGGTTAATACTGAGATCAGATCATCCTATCAATCAATCGAAACAAAGGATCGAAAATTTACGTATTCCGAGATACTAAAGATGACGAATAACTTTGAGAGAGTTCTTGGTAAAGGAGGATATGGAAGAGTGTATTATGGAAAATTGGATGATACTGAAGTAGCTGTGAAAATGCTCTTTCATTCCTCAGCTGAACAAGATTATAAACATTTCAAAGCAGAGGTTGAACTACTTTTAAGAGTCCACCATAGACATTTGGTGGGACTTGTTGGTTACTGTGATGATGGAGATAACTTTGCCTTGATTTATGAATACATGGCAAATGGAGACTTGAAGGAGAATATGTCTGGAAACCGCAGTGGACATGTTCTAAGTTGGGAAAACAGAATGCAAATAGCTATGGAGGCAGCACAAGGATTGGAGTATCTACATAATGGAAGTAGACCACCTATGGTCCATAGAGATGTGAAAACTACTAACATTTTATTGAATGAGCTGTATCAAGCGAAACTAGCTGATTTTGGGCTCTCTAGATCTTCCCCGGTGGATGGTGAATCTTATGTATCAACAATCGTTGCCGGAACACCTGGTTACTTAGACCCTGAGTACTATAGAACAAACTTGTTAAGCGAGAAGACTGATGTGTACAGCTTTGGGGTAGTTTTATTAGAAATCATCACAAACCAGCCTGTGATTGATACAACCCGCGAGAAAGCGCATATTACAGATTGGGTTGGATTTAAGCTCATGGAAGGAGACATTAGGAATATTATTGACCCGAAACTGATTAAGGAATTTGATACAAACGGTGTGTGGAAGGCTGTGGAGTTGGCTTTGTCTTGTGTAAACCCTACGTCAAACCATAGACCGACGATGCCACATGTTGTGATGGAGCTAAAAGAGTGTCTGGACTCTGAGATTGCCAGGAAACAAGGTAGTCAAGACATGTTTTCTAGAGATTCTATTGAATTAACCTTCTCTCCTACTGGATTCTCACCTGGACCGAGGTGA

SEQ ID NO: 91 - DNA, 1323 bp, Arabidopsis thaliana
  misc_feature (1)..(1323): Ceres cDNA ID no. 3599621
atggcgcttgatcctgagcagcagcaaccaatctcctctgtttccagagagtcatctggtgagatcagcccagaaagggagcctcttattaaagagaatcatgtcccagaaaactactctgtcgttgccgccattctcccgtttttatttccagctctcggaggactgctttatggttatgaaattggtgcaacttcttgtgcaaccatttcacttcaggagcctatgactttgctatcttactatgctgttcccttttctgcagtcgccttcattaagtggaatttcatgaccagtggctcactttacggtgcattatttggctcaattgtggcttttactatcgctgacgttataggaagaagaaaggagctgattttggctgcattattgtatctcgttggagcccttgtgactgcactagccccaacctattccgttctgataattggacgggttatttatggggtctcagttggactggcaatgcatgcggctccgatgtacattgcagagactgctccaagtccgatacgtggacagctggtatcattaaaggaattcttcatagtccttgggatggttggaggttatggaatcggtagtcttacagtcaatgttcattctggttggcgatacatgtatgcaacaagtgtccctttggcagttattatgggaattgggatgtggtggctcccagcatcccctaggtggcttttgttgcgcgtcatacaggggaaagggaatgtggagaaccaacgagaggctgcaatcaaatctctctgctgccttagaggccctgcttttgttgattcagctgctgaacaagtaaatgagattttggctgaactaacttttgtgggcgaggataaagaagtcacatttggtgaattatttcaagggaagtgcttgaaagctctcatcataggaggaggtctagtcttgtttcagcagttgattatgacaggagtagctgttgtagttatcgacagacttggaaggagacctttacttcttggtggagttggtggcatgcgcctcaccagttgttgctgtagttgcactgctgctttatgtgggctgttaccagagatatttccccttaaactaagaggtcgaggtctcagtctagcagtgcttgtgaattttggtgcaaacgcacttgtgacatttgcgttttcacccctaaaggaactgctgggagctgggatactgttttgtgggtttggtgtgatatgtgtattgtctctggtattcatattcttcattgtgccagagacaaagggtctcactcttgaggaaattgaagccaaatgtctctaa

SEQ ID NO: 92 - protein, 440 aa, Arabidopsis thaliana
  misc_feature: PFam Name: Sugar_tr; PFam Description: Sugar (and other)
  misc_feature: PFam Name: MFS_1; PFam Description: Major Facilitator Superfamily
  misc_feature: GI Number: 37537174; NR Description: putative sugar transporter protein [Oryza sativa (japonica cultivar-group)] >gi|12039393|gb|AAG46179.1| putative sugar transporter protein [Oryza sativa] >gi|31433692|gb|AAP55176.1| putative sugar
  misc_feature: GI Number: 34897404; NR Description: putative sugar transporter protein [Oryza sativa (japonica cultivar-group)] >gi|27545039|gb|AAO18445.1| putative sugar transporter protein
  misc_feature: GI Number: 15894624; NR Description: D-xylose-proton symporter [Clostridium acetobutylicum] >gi|25309011|pir||F97065 D-xylose-proton symporter [imported] - Clostridium acetobutylicum >gi|15024278|gb|AAK79313.1|AE007646_2 D-xylose-proton symporter
  misc_feature: GI Number: 42569195; NR Description: mannitol transporter,
  misc_feature: GI Number: 16081032; NR Description: similar to metabolite transport protein [Bacillus subtilis] >gi|7446722|pir||D70073 metabolite transport protein homolog yxcC - Bacillus subtilis >gi|2636527|emb|CAB16017.1| yxcC [Bacillus subtilis subsp.
MALDPEQQQPISSVSRESSGEISPEREPLIKENHVPENYSVVAAILPFLFPALGGLLYGYEIGATSCATISLQEPMTLLSYYAVPFSAVAFIKWNFMTSGSLYGALFGSIVAFTIADVIGRRKELILAALLYLVGALVTALAPTYSVLIIGRVIYGVSVGLAMHAAPMYIAETAPSPIRGQLVSLKEFFIVLGMVGGYGIGSLTVNVHSGWRYMYATSVPLAVIMGIGMWWLPASPRWLLLRVIQGKGNVENQREAAIKSLCCLRGPAFVDSAAEQVNEILAELTFVGEDKEVTFGELFQGKCLKALIIGGGLVLFQQLIMTGVAVVVIDRLGRRPLLLGGVGGMRLTSCCCSCTAALCGLLPEIFPLKLRGRGLSLAVLVNFGANALVTFAFSPLKELLGAGILFCGFGVICVLSLVFIFFIVPETKGLTLEEIEAKCL

SEQ ID NO: 93 - DNA, 535 bp, Zea mays
  misc_feature (1)..(535): Ceres cDNA ID no. 3624314
  misc_feature (1)..(535): Ceres CLONE  ID no. 688007
  misc_feature (1)..(535): Also known as  Ceres CDNA ID no. 24371021
attgatatgactgttaggstagtagtaagctacaatgsyctcagcattggcacagttcgagatgcatttgagaagtctcttggcttccggttgcaaaagatgaatcctaatactgattatggttgcttgaagacatttggttcttgttttagtgaagacattcgtatacctgctggtacaaagattgacttccggcaaacatctgatggccagctaataactgaaattgatggcaaacaaattggcactgtccagagcaaagatctttgcagagccttcttcgatatgtatattggtgaccccccagtttcagtggagaccaaacaagacattgcgcaaaatgtggctggactcataagaagatgctagggaaacgggaaaactaaatcgaagaacctggaattatttcattcatctatacaaggagaggacatataaacagaaaggaagccaggagaggatcgattgtatttatagtggtagactgtctttgtaagctataaacataaagcatatgcttggcaaaggcctccat

SEQ ID NO: 94 - protein, 535 aa, Zea mays
ATTGATATGACTGTTAGGSTAGTAGTAAGCTACAATGSYCTCAGCATTGGCACAGTTCGAGATGCATTTGAGAAGTCTCTTGGCTTCCGGTTGCAAAAGATGAATCCTAATACTGATTATGGTTGCTTGAAGACATTTGGTTCTTGTTTTAGTGAAGACATTCGTATACCTGCTGGTACAAAGATTGACTTCCGGCAAACATCTGATGGCCAGCTAATAACTGAAATTGATGGCAAACAAATTGGCACTGTCCAGAGCAAAGATCTTTGCAGAGCCTTCTTCGATATGTATATTGGTGACCCCCCAGTTTCAGTGGAGACCAAACAAGACATTGCGCAAAATGTGGCTGGACTCATAAGAAGATGCTAGGGAAACGGGAAAACTAAATCGAAGAACCTGGAATTATTTCATTCATCTATACAAGGAGAGGACATATAAACAGAAAGGAAGCCAGGAGAGGATCGATTGTATTTATAGTGGTAGACTGTCTTTGTAAGCTATAAACATAAAGCATATGCTTGGCAAAGGCCTCCAT

SEQ ID NO: 95 - DNA, 2430 bp, Arabidopsis thaliana
  misc_feature (1)..(2430): Ceres cDNA ID no. 4268292
  misc_feature (1)..(2430): Also known as  Ceres CDNA ID no. 24371021
atggagagacgtaacgaagcgttgatgattaggaaatcgaagtggcagtacccacaagtgggttctccgacgccgaggattcttcagttgccacggaggcatagtgttcgacgaaatgcttcaaagggcttgaagacaacagtttcttcgtcgtctcagaaggatcggagagtgaaactggaggttttgtttcatcaagagaggacttttgatcggggggcatcgattgtgatggtgaatgataatggtggtgagaagaaggatgaagaagagggaaggagaagagggaaagttgcagatgggagagagattggtgtgtctgggttgtcttcttcttctgcggttgatgaagttgaggaagctaagtggaggtttcaagcggagatgttgagatcagagtgtaatttgttaagaatagaaaaagagattgctttgaagaagatggagaggaggaagaagcgaatggagcggacgctgagatctgctgttcttactcttctatctgggaaagagagaatctctgaagggacgaaagagagcaaggttttggaagatgagataagctatttggttgagaaactgaatgagttaaagtctccaaaggttaaggacatggaagctagaaacttcaaacataattttgataagcaagcttctgttttaagaagagagctagagaggttcgatgaagcagtttccgaagaggtttgtgtcaaagggattcagaaaatggcagaggctagcttctccgtccattctgatcaaaacgctcttaggaacaataatggaaatatagatacattgagtagtaaaatggaggcgttgtcaaaaggggttttgttggaaagaatggagaaagaatatggatcgagtctcgttgcaccgtcttcaagctctgtacaagacatgtattgtaagggaattaaagcgcatgaggaaaagaaagactgttctagacactgcaaagtagttatgaggaagattgcggatgaagtaagagctgaagcagagcaatggtcacaaatgcaagagatgttgaatcaagtgagaaaagaaatggaggaacttcaatcttgtcgtgatttctggcaaaaccgcgccctcgaagcagattccgagatacaaaatctacattcctctgttgaaggatggcgaagaaaggcgttatcatcagaggcaaagttgaaaaacctacaagcagaggtttgcggattacaagaagagatcaagagactgagaaaggaagataagttagaaccagagaagaacaaattgccatcagagtcagagaaaagggtattgatttgtcggttaaaagaaaaccgacatagcaacaatggagattggtccaagtacagtgaaggaagaacaacaaaaccgtcgagctcgagaccgcctttgagggaagttaagaacagttcagtcatagcaaggcagagaaactccaatatcatgaaaatcgaagaagagaagacagtgtgtgtgacaggagcttcaggttacattgcttcatggatcgttaagcttcttcttctccgtggttacaccgttaaagcctctgttcgtgatccaaatgatccaaggaaaacagagcatttgcttgcattggaaggagcagaggaaaggcttaaattgttcaaagcaaacttgttagaagaaggctctttcgattcagcaatcgatggttgcgaaggagttttccacaccgcatcgccattctatcatgacgtcaaggaccctcaggctgagttacttgatccggcagtgaaaggaacaatcaatgttctaagctcttgtttgaagacttcctcggttaagagagtcgtcttaacctcatcgatagcagctgttgctttcaatggaatgcctcgaacacccgaaaccatagttgacgaaacttggttcgccgatcctgactattgcagagcttccaagctatggtatgtactctcgaagacattagctgaaaacgcagcgtggaaattcgcaaaagagaacaatttacagctggtttcgataaatccggctatggtgattggtcctctcttacagccaacgctaaacactagtgctgctgcagtactaagcttgatcaaaggagcacaaacgtttcctaatgcgacgttcgggtgggttaacgttaaagatgtagcgaacgctcatattcaagcgtttgagaatccagatgctgatgggagatactgtttagtggagagagttgctcattactctgaagttgttaacattttgcatgatctttaccctgattttcaactccctgagaagtgtgcagatgaaaagatatatattccaacatataaagtgtctaaagagaaagcagagtctcttggggttgagtttgtgccattggaagttagcattaaagagactgtagagagcttgagagataaagggttcatcagattttga

SEQ ID NO: 96 - protein, 2430 aa, Arabidopsis thaliana
ATGGAGAGACGTAACGAAGCGTTGATGATTAGGAAATCGAAGTGGCAGTACCCACAAGTGGGTTCTCCGACGCCGAGGATTCTTCAGTTGCCACGGAGGCATAGTGTTCGACGAAATGCTTCAAAGGGCTTGAAGACAACAGTTTCTTCGTCGTCTCAGAAGGATCGGAGAGTGAAACTGGAGGTTTTGTTTCATCAAGAGAGGACTTTTGATCGGGGGGCATCGATTGTGATGGTGAATGATAATGGTGGTGAGAAGAAGGATGAAGAAGAGGGAAGGAGAAGAGGGAAAGTTGCAGATGGGAGAGAGATTGGTGTGTCTGGGTTGTCTTCTTCTTCTGCGGTTGATGAAGTTGAGGAAGCTAAGTGGAGGTTTCAAGCGGAGATGTTGAGATCAGAGTGTAATTTGTTAAGAATAGAAAAAGAGATTGCTTTGAAGAAGATGGAGAGGAGGAAGAAGCGAATGGAGCGGACGCTGAGATCTGCTGTTCTTACTCTTCTATCTGGGAAAGAGAGAATCTCTGAAGGGACGAAAGAGAGCAAGGTTTTGGAAGATGAGATAAGCTATTTGGTTGAGAAACTGAATGAGTTAAAGTCTCCAAAGGTTAAGGACATGGAAGCTAGAAACTTCAAACATAATTTTGATAAGCAAGCTTCTGTTTTAAGAAGAGAGCTAGAGAGGTTCGATGAAGCAGTTTCCGAAGAGGTTTGTGTCAAAGGGATTCAGAAAATGGCAGAGGCTAGCTTCTCCGTCCATTCTGATCAAAACGCTCTTAGGAACAATAATGGAAATATAGATACATTGAGTAGTAAAATGGAGGCGTTGTCAAAAGGGGTTTTGTTGGAAAGAATGGAGAAAGAATATGGATCGAGTCTCGTTGCACCGTCTTCAAGCTCTGTACAAGACATGTATTGTAAGGGAATTAAAGCGCATGAGGAAAAGAAAGACTGTTCTAGACACTGCAAAGTAGTTATGAGGAAGATTGCGGATGAAGTAAGAGCTGAAGCAGAGCAATGGTCACAAATGCAAGAGATGTTGAATCAAGTGAGAAAAGAAATGGAGGAACTTCAATCTTGTCGTGATTTCTGGCAAAACCGCGCCCTCGAAGCAGATTCCGAGATACAAAATCTACATTCCTCTGTTGAAGGATGGCGAAGAAAGGCGTTATCATCAGAGGCAAAGTTGAAAAACCTACAAGCAGAGGTTTGCGGATTACAAGAAGAGATCAAGAGACTGAGAAAGGAAGATAAGTTAGAACCAGAGAAGAACAAATTGCCATCAGAGTCAGAGAAAAGGGTATTGATTTGTCGGTTAAAAGAAAACCGACATAGCAACAATGGAGATTGGTCCAAGTACAGTGAAGGAAGAACAACAAAACCGTCGAGCTCGAGACCGCCTTTGAGGGAAGTTAAGAACAGTTCAGTCATAGCAAGGCAGAGAAACTCCAATATCATGAAAATCGAAGAAGAGAAGACAGTGTGTGTGACAGGAGCTTCAGGTTACATTGCTTCATGGATCGTTAAGCTTCTTCTTCTCCGTGGTTACACCGTTAAAGCCTCTGTTCGTGATCCAAATGATCCAAGGAAAACAGAGCATTTGCTTGCATTGGAAGGAGCAGAGGAAAGGCTTAAATTGTTCAAAGCAAACTTGTTAGAAGAAGGCTCTTTCGATTCAGCAATCGATGGTTGCGAAGGAGTTTTCCACACCGCATCGCCATTCTATCATGACGTCAAGGACCCTCAGGCTGAGTTACTTGATCCGGCAGTGAAAGGAACAATCAATGTTCTAAGCTCTTGTTTGAAGACTTCCTCGGTTAAGAGAGTCGTCTTAACCTCATCGATAGCAGCTGTTGCTTTCAATGGAATGCCTCGAACACCCGAAACCATAGTTGACGAAACTTGGTTCGCCGATCCTGACTATTGCAGAGCTTCCAAGCTATGGTATGTACTCTCGAAGACATTAGCTGAAAACGCAGCGTGGAAATTCGCAAAAGAGAACAATTTACAGCTGGTTTCGATAAATCCGGCTATGGTGATTGGTCCTCTCTTACAGCCAACGCTAAACACTAGTGCTGCTGCAGTACTAAGCTTGATCAAAGGAGCACAAACGTTTCCTAATGCGACGTTCGGGTGGGTTAACGTTAAAGATGTAGCGAACGCTCATATTCAAGCGTTTGAGAATCCAGATGCTGATGGGAGATACTGTTTAGTGGAGAGAGTTGCTCATTACTCTGAAGTTGTTAACATTTTGCATGATCTTTACCCTGATTTTCAACTCCCTGAGAAGTGTGCAGATGAAAAGATATATATTCCAACATATAAAGTGTCTAAAGAGAAAGCAGAGTCTCTTGGGGTTGAGTTTGTGCCATTGGAAGTTAGCATTAAAGAGACTGTAGAGAGCTTGAGAGATAAAGGGTTCATCAGATTTTGA

SEQ ID NO: 97 - DNA, 1242 bp, Arabidopsis thaliana
  misc_feature (1)..(1242): Ceres cDNA ID no. 4269707
  misc_feature (1)..(1242): Also known as  Ceres CDNA ID no. 24371021
atgcagagggagagaatgagcaagaagaagattagtcaagttcattgcattccctctggtgatcatattctcatgacggcttcttcttccaaacacattcctcatatcagattctacaaagcctggaagggtaacaacagattttgctgtggtggtagactaatctttggtcctgatgtatcatctctgtacctaacctccttcttgattggagctcctgcgcttacattctgcataaggatgctcgtgtggatcaaaagaggagatcctttcttcaactataccgttctagcttcaggatttatcctcaccctcttggattttacgtttctaatgttgacatcagctagggatccaggaatcatcccaaggaacaaaacatcaatgattcttgaagatgattcagatagttccttgacacaatctatggaatgggtcaacaacaaaactcctaatctcaagattcctagaaccaaagacgttttcgtcaatggttacactatcaaagtcaagttctgcgatacttgcttgctctatcgtccacctcgagcatcacattgctccatctgcaacaactgtgtccaacgctttgatcaccattgtccatgggttggtcagtgcattgcccgaagaaactacccgttcttcatttgcttcatctcatcttcaacattgctatgcatatatgtttttgtgttctcctggatcaacctgattagacaacctgggaagctatggaggacaatgtctgatgatatagtgtctgtcattcttattgtatatacatttgtcgctgtctggttcgttggtggccttaccattttccacttctatctcatgtctacaaaccagacaacatatgagaatttccggtaccgttatgataagaaagaaaatccttacaagagagggttactgaagaatgttaaagaagtactatttgccaagatcccgccttcgcaactagatctcagagcaatggtcccggaagaagatgacatgactatagcatctaacgattccgagtatgagtcagagtatacctcctccgtgagatacgatacagagatgggaggcaagctcattaaaagggatagccctaggaagcttcctttgccaacacgaaacttagatgatatcaaggacattagtgataactacgacagatctacgacaactagagaggatgcttctgaccgcgatccttcgtttttctcatctcaactagacttgcccaagtaa

SEQ ID NO: 98 - protein, 1242 aa, Arabidopsis thaliana
ATGCAGAGGGAGAGAATGAGCAAGAAGAAGATTAGTCAAGTTCATTGCATTCCCTCTGGTGATCATATTCTCATGACGGCTTCTTCTTCCAAACACATTCCTCATATCAGATTCTACAAAGCCTGGAAGGGTAACAACAGATTTTGCTGTGGTGGTAGACTAATCTTTGGTCCTGATGTATCATCTCTGTACCTAACCTCCTTCTTGATTGGAGCTCCTGCGCTTACATTCTGCATAAGGATGCTCGTGTGGATCAAAAGAGGAGATCCTTTCTTCAACTATACCGTTCTAGCTTCAGGATTTATCCTCACCCTCTTGGATTTTACGTTTCTAATGTTGACATCAGCTAGGGATCCAGGAATCATCCCAAGGAACAAAACATCAATGATTCTTGAAGATGATTCAGATAGTTCCTTGACACAATCTATGGAATGGGTCAACAACAAAACTCCTAATCTCAAGATTCCTAGAACCAAAGACGTTTTCGTCAATGGTTACACTATCAAAGTCAAGTTCTGCGATACTTGCTTGCTCTATCGTCCACCTCGAGCATCACATTGCTCCATCTGCAACAACTGTGTCCAACGCTTTGATCACCATTGTCCATGGGTTGGTCAGTGCATTGCCCGAAGAAACTACCCGTTCTTCATTTGCTTCATCTCATCTTCAACATTGCTATGCATATATGTTTTTGTGTTCTCCTGGATCAACCTGATTAGACAACCTGGGAAGCTATGGAGGACAATGTCTGATGATATAGTGTCTGTCATTCTTATTGTATATACATTTGTCGCTGTCTGGTTCGTTGGTGGCCTTACCATTTTCCACTTCTATCTCATGTCTACAAACCAGACAACATATGAGAATTTCCGGTACCGTTATGATAAGAAAGAAAATCCTTACAAGAGAGGGTTACTGAAGAATGTTAAAGAAGTACTATTTGCCAAGATCCCGCCTTCGCAACTAGATCTCAGAGCAATGGTCCCGGAAGAAGATGACATGACTATAGCATCTAACGATTCCGAGTATGAGTCAGAGTATACCTCCTCCGTGAGATACGATACAGAGATGGGAGGCAAGCTCATTAAAAGGGATAGCCCTAGGAAGCTTCCTTTGCCAACACGAAACTTAGATGATATCAAGGACATTAGTGATAACTACGACAGATCTACGACAACTAGAGAGGATGCTTCTGACCGCGATCCTTCGTTTTTCTCATCTCAACTAGACTTGCCCAAGTAA

SEQ ID NO: 99 - DNA, 1266 bp, Arabidopsis thaliana
  misc_feature (1)..(1266): Ceres cDNA ID no. 4804174
atgagccaaaagaaactgacgaggactcaatcgtcgttactcagatcatctccgacgattcgatcgtcgatccaaagcctttcttcaatcactgaatgtgatgacttcaacgaaacctctcaccaccgccgtgaacaagatctcgaagccggtgagaaagaggaaaaacagaggaggagaaaaccggttaaatcattcgggtcaatgaaccgaattaaaccgggtctcgcattcacactcgcttgtctctctttcctgagtctctcatctttcttactgttcttcgttgatgagattttcacgtcggagaatctcttactaggtttgattttcgtcgctcttgctctgttcttcgcgtcgagaaacatggcggttattaaccaaaccgtaatcgcaatcaagcagattcgtgtaaggtctcgaatcaaacacaaaccgaaaccggttcaatggtacatcggagattcaaaaccggaaccgatcaaagaagaagaaacaagacttgtcgttaaagaaggagttcaattctttagcaatggagatttctacgaaggtgaattcaacagagggaagtgtaacggaagtggagtttattattattacgttaatggaagatatgaaggagattggatcaatggaaggtacgatggttatggaatcgagtgttggtctaaaggaagtaaatataaaggacagtataagcaaggacttagacatggttttggagtttactggttttacaccggagattcttactctggtgaatggtttaacggtcaaagccatggctttggagttcaaacttgtgctgatggaagctcttttgtcggagaattcaaatttggtgtcaaacatggacttggttcttaccatttcaggaatggagataagtatgcaggagagtattttggagacaagattcatggatttggtgtttaccatttcgctaatggtcactattacgaaggagcttggcatgaaggtcgtaaacaaggctatggcacgtatagatttagaaccggtgatatcaaatccggtgaatgggatgatggtaatctcgttaaccatcttcctttagactctgacccggttcgtagggcggttcagagtgcacgagaaagagcaaagaatggagtgaatcagagacggatcgatgagcaggtgatacgagctgtggctgcagctaataaagctgcgacggctgctagagttgcagctgtgaaagcagttcaaaatcaaatggatggtaaaatttgtgacaattaa

SEQ ID NO: 100 - protein, 421 aa, Arabidopsis thaliana
  misc_feature: PFam Name: MORN; PFam Description: MORN repeat
  misc_feature: GI Number: 21593251; NR Description: phosphatidylinositol-4-phosphate 5-kinase, putative [Arabidopsis
  misc_feature: GI Number: 51535948; NR Description: 1-phosphatidylinositol-4-phosphate 5-kinase-like protein [Oryza
  misc_feature: GI Number: 37536922; NR Description: putative phosphatidylinositol-4-phosphate 5-kinase [Oryza sativa (japonica cultivar-group)] >gi|12597886|gb|AAG60194.1| putative phosphatidylinositol-4-phosphate 5-kinase [Oryza sativa]
  misc_feature: GI Number: 21928129; NR Description: AT4g17080/dl4570w [Arabidopsis thaliana] >gi|27764944|gb|AAO23593.1|
  misc_feature: GI Number: 50405042; NR Description: Phosphatidylinositol-4-phosphate-5-kinase, putative [Paramecium tetraurelia] >gi|50057419|emb|CAH03403.1| Phosphatidylinositol-4-phosphate-5-kinase, putative [Paramecium
MSQKKLTRTQSSLLRSSPTIRSSIQSLSSITECDDFNETSHHRREQDLEAGEKEEKQRRRKPVKSFGSMNRIKPGLAFTLACLSFLSLSSFLLFFVDEIFTSENLLLGLIFVALALFFASRNMAVINQTVIAIKQIRVRSRIKHKPKPVQWYIGDSKPEPIKEEETRLVVKEGVQFFSNGDFYEGEFNRGKCNGSGVYYYYVNGRYEGDWINGRYDGYGIECWSKGSKYKGQYKQGLRHGFGVYWFYTGDSYSGEWFNGQSHGFGVQTCADGSSFVGEFKFGVKHGLGSYHFRNGDKYAGEYFGDKIHGFGVYHFANGHYYEGAWHEGRKQGYGTYRFRTGDIKSGEWDDGNLVNHLPLDSDPVRRAVQSARERAKNGVNQRRIDEQVIRAVAAANKAATAARVAAVKAVQNQMDGKICDN

SEQ ID NO: 101 - DNA, 1137 bp, Arabidopsis thaliana
  misc_feature (1)..(1137): Ceres cDNA ID no. 4813440
atggttagtgtctcactcgctgacaacaacgaagagaaatcgactgatctgaagaaattcaaaggaggagtaactgatcactcgattagtaaggcaaatgataatgatcacgacgatgatgatcatgatcaagacgatgataatgatggagatcacgatgacgatgaccatgacgatgataatgatcatgacgatgataataatgatcatgatgatgatgataataatgatgataataatgatggagacgatgaccatgatgatgataataacgatgatggtgatgacgaaaagaagacgttgagggtacacgagctaaagaaggggaatctaacggtcaaatttacaaaccggggtgcttctatcatgtctctccttttccccaatataaatgccagtaaaaaggaaaaggccgctgcaaacgatggcaaaaacacgatccatggtgggacgaaagagtctagcgatgtgatttggagagttaagaaacacaaacataatggcaaaaaaccttatattgttttcacatacacaacaagtcctgatggcgatcaagggaaacttgaagtcactgtgacatataagctggtaggagaaaacagattgaaaatggtgatgcaagcaaaggctaaagagaaaactactccgttgaatttggttcatcgttcttattggaatcttggtggtcataacaatgaagatatcttctctgaagaaattcaaattctcggttccggttatactcatctcgacgataatctcactccaaccgggaaaatcctcgccgttaaaggaacacccttcgattttcgccaactccgacctattaaagacaacatcaatgagcttaagacagggtatggtataaattattgtctagatggtgttgcaaataagatgagaaaagtcgtggagcttgtggacaataaatcgaagataaaaatggagttatctacagaccaatccggtctaaggttgaaaaccactaaaccaaaaaatggatcggttcataaagcttactctggtttatgtctagaatcacatgcaatcaattaccaatatcgttcttcgcagataattgaaccgggggaaacttataagcatactatgctctttaagttttcttttgttccgtaa

SEQ ID NO: 102 - protein, 378 aa, Arabidopsis thaliana
  misc_feature: PFam Name: Aldose_epim; PFam Description: Aldose 1-epimerase
  misc_feature: PFam Name: Mucin; PFam Description: Mucin-like glycoprotein
  misc_feature: PFam Name: Mpp10; PFam Description: Mpp10 protein
  misc_feature: PFam Name: Brix; PFam Description: Brix domain
  misc_feature: PFam Name: Upf2; PFam Description: Up-frameshift suppressor 2
  misc_feature: GI Number: 6094558; NR Description: putative aldose
  misc_feature: GI Number: 26452398; NR Description: putative aldose
  misc_feature: GI Number: 15824567; NR Description: non-cell-autonomous
  misc_feature: GI Number: 15824565; NR Description: non-cell-autonomous
  misc_feature: GI Number: 21537069; NR Description: aldose 1-epimerase-like
MVSVSLADNNEEKSTDLKKFKGGVTDHSISKANDNDHDDDDHDQDDDNDGDHDDDDHDDDNDHDDDNNDHDDDDNNDDNNDGDDDHDDDNNDDGDDEKKTLRVHELKKGNLTVKFTNRGASIMSLLFPNINASKKEKAAANDGKNTIHGGTKESSDVIWRVKKHKHNGKKPYIVFTYTTSPDGDQGKLEVTVTYKLVGENRLKMVMQAKAKEKTTPLNLVHRSYWNLGGHNNEDIFSEEIQILGSGYTHLDDNLTPTGKILAVKGTPFDFRQLRPIKDNINELKTGYGINYCLDGVANKMRKVVELVDNKSKIKMELSTDQSGLRLKTTKPKNGSVHKAYSGLCLESHAINYQYRSSQIIEPGETYKHTMLFKFSFVP

SEQ ID NO: 103 - DNA, 1440 bp, Arabidopsis thaliana
  misc_feature (1)..(1440): Ceres cDNA ID no. 4813961
atggcgggaatcccagatcatatccaagaccaacatcttgtggaggaggtatatgctttttatgattttgttacattgaaaaactttattcttaaagagtttttgttactctacttacaggatcaaccctttgatctggaagattggcttccaatcacagcatcaaggaatgccaattggtattattcagctttccacaacgtcactgccattgttggtgctggcgttctcggtcttccttacgccatgtcagagcttggatggggacctggggttgtggtgttgatcctgtcatgggtgatcacgttatacaccctctggcaaatgattgagatgcatgagatgtttgaagggcaacggttcgataggtaccatgagctgggtcaggcagcctttggtaaaaagcttggtttgtacatcatcgtgcccctacaactacttgtcgagatcagtgtgtgcatagtctatatggtcactggaggtaaatccctgaagaatgtacatgaccttgctttgggagatggtgacaagtgcacaaagcttagaattcaacacttcattttgatctttgcctcttcacagttcgtgctctcccttcttaagaacttcaactccatttctggtgtctccttggtagctgctgtcatgtctgtcagctattctacaattgcttgggtagcctcgctgaggaagggtgccaccaccgggagtgtagagtacggctatagaaaaagaacaacctcagtgccattagccttcttaagtgcactgggtgaaatggcttttgcgtacgcaggtcataacgttgttttggaaattcaagcaacgatcccatcaacaccagagaacccatcaaaacgacccatgtggaagggagcggttgtagcctatatcattgtagctttctgctacttccctgtggcacttgtaggtttcaagacctttggaaacagtgttgaagagagcatcctcgaatcactaacaaaaccaacggcacttgtcattgtggccaacatgtttgtggtcatacatctcttgggaagctaccaggtgtatgcgatgcccgtgtttgacatgatcgaatctgtaatgataaggatatggcacttcagtccaacaagagttctacggtttaccatccgatggacttttgtggccgccacgatgggaatagcggtcggtttaccgtattacagcgcattgctgtcattttttgggggatttgtgttcgccccgaccacatactttatcccatgcatcatgtggctgatcctaaagaaaccaaagagatttagtctctcatggtgtatgaactggttttgcatcatttttgggcttgtgctgatgatcatagcacctattgggggactggccaaactaatctataatattcaaaagggcactctacctaattcaagatgcaacttacctaaacactga

SEQ ID NO: 104 - protein, 479 aa, Arabidopsis thaliana
  misc_feature: PFam Name: Aa_trans; PFam Description: Transmembrane amino
  misc_feature: PFam Name: Trp_Tyr_perm; PFam Description:
  misc_feature: GI Number: 2443875; NR Description: amino acid permease
  misc_feature: GI Number: 30409136; NR Description: histidine amino acid
  misc_feature: GI Number: 2576361; NR Description: lysine and histidine
  misc_feature: GI Number: 12597815; NR Description: lysine and histidine
  misc_feature: GI Number: 30693666; NR Description: lysine and histidine
  misc_feature: Phenotype: Useful for making shorter plants
  misc_feature: Phenotype: Useful for sterility, genetic confinement systems
  misc_feature: Utility: Useful for making plants with increased tolerance to
MAGIPDHIQDQHLVEEVYAFYDFVTLKNFILKEFLLLYLQDQPFDLEDWLPITASRNANWYYSAFHNVTAIVGAGVLGLPYAMSELGWGPGVVVLILSWVITLYTLWQMIEMHEMFEGQRFDRYHELGQAAFGKKLGLYIIVPLQLLVEISVCIVYMVTGGKSLKNVHDLALGDGDKCTKLRIQHFILIFASSQFVLSLLKNFNSISGVSLVAAVMSVSYSTIAWVASLRKGATTGSVEYGYRKRTTSVPLAFLSALGEMAFAYAGHNVVLEIQATIPSTPENPSKRPMWKGAVVAYIIVAFCYFPVALVGFKTFGNSVEESILESLTKPTALVIVANMFVVIHLLGSYQVYAMPVFDMIESVMIRIWHFSPTRVLRFTIRWTFVAATMGIAVGLPYYSALLSFFGGFVFAPTTYFIPCIMWLILKKPKRFSLSWCMNWFCIIFGLVLMIIAPIGGLAKLIYNIQKGTLPNSRCNLPKH

SEQ ID NO: 105 - DNA, 1281 bp, Arabidopsis thaliana
  misc_feature (1)..(1281): Ceres cDNA ID no. 4815194
  misc_feature (1)..(1281): Also known as  Ceres CDNA ID no. 24371021
atggttaggatttcagttttagtgtgtttggttcttttggttacaataggagtcatggttagtgtctcactcgctgacaacaacgaagagaaatcgactgatctgaagaaattcaaaggaggagtaactgatcactcgattagtaaggcaaatgataatgatcacgacgatgatgatcatgatcaagacgatgataatgatggagatcacgatgacgatgaccatgacgatgataatgatcatgacgatgataataatgatcatgatgatgatgataataatgatgataataatgatggagacgatgaccatgatgatgataataacgatgatggtgatgacgaaaagaagacgttgagggtacacgagctaaagaaggggaatctaacggtcaaatttacaaaccggggtgcttctatcatgtctctccttttccccaatataaatggaaaattagaggacattgttctgggatatgacagcgtcaatgaccacatgattgacacggtattttgtggagtgacgttggcacgtgtagccagtaaaaaggaaaaggccgctgcaaacgatggcaaaaacacgatccatggtgggacgaaagagtctagcgatgtgatttggagagttaagaaacacaaacataatggcaaaaaaccttatattgttttcacatacacaacaagtcctgatggcgatcaagggaaacttgaagtcactgtgacatataagctggtaggagaaaacagattgaaaatggtgatgcaagcaaaggctaaagagaaaactactccgttgaatttggttcatcgttcttattggaatcttggtggtcataacaatgaagatatcttctctgaagaaattcaaattctcggttccggttatactcatctcgacgataatctcactccaaccgggaaaatcctcgccgttaaaggaacacccttcgattttcgccaactccgacctattaaagacaacatcaatgagcttaagacagggtatggtataaattattgtctagatggtgttgcaaataagatgagaaaagtcgtggagcttgtggacaataaatcgaagataaaaatggagttatctacagaccaatccggtctaaggttgaaaaccactaaaccaaaaaatggatcggttcataaagcttactctggtttatgtctagaatcacatgcaatcaattaccaatatcgttcttcgcagataattgaaccgggggaaacttataagcatactatgctctttaagttttcttttgttccgtaa

SEQ ID NO: 106 - protein, 1281 aa, Arabidopsis thaliana
ATGGTTAGGATTTCAGTTTTAGTGTGTTTGGTTCTTTTGGTTACAATAGGAGTCATGGTTAGTGTCTCACTCGCTGACAACAACGAAGAGAAATCGACTGATCTGAAGAAATTCAAAGGAGGAGTAACTGATCACTCGATTAGTAAGGCAAATGATAATGATCACGACGATGATGATCATGATCAAGACGATGATAATGATGGAGATCACGATGACGATGACCATGACGATGATAATGATCATGACGATGATAATAATGATCATGATGATGATGATAATAATGATGATAATAATGATGGAGACGATGACCATGATGATGATAATAACGATGATGGTGATGACGAAAAGAAGACGTTGAGGGTACACGAGCTAAAGAAGGGGAATCTAACGGTCAAATTTACAAACCGGGGTGCTTCTATCATGTCTCTCCTTTTCCCCAATATAAATGGAAAATTAGAGGACATTGTTCTGGGATATGACAGCGTCAATGACCACATGATTGACACGGTATTTTGTGGAGTGACGTTGGCACGTGTAGCCAGTAAAAAGGAAAAGGCCGCTGCAAACGATGGCAAAAACACGATCCATGGTGGGACGAAAGAGTCTAGCGATGTGATTTGGAGAGTTAAGAAACACAAACATAATGGCAAAAAACCTTATATTGTTTTCACATACACAACAAGTCCTGATGGCGATCAAGGGAAACTTGAAGTCACTGTGACATATAAGCTGGTAGGAGAAAACAGATTGAAAATGGTGATGCAAGCAAAGGCTAAAGAGAAAACTACTCCGTTGAATTTGGTTCATCGTTCTTATTGGAATCTTGGTGGTCATAACAATGAAGATATCTTCTCTGAAGAAATTCAAATTCTCGGTTCCGGTTATACTCATCTCGACGATAATCTCACTCCAACCGGGAAAATCCTCGCCGTTAAAGGAACACCCTTCGATTTTCGCCAACTCCGACCTATTAAAGACAACATCAATGAGCTTAAGACAGGGTATGGTATAAATTATTGTCTAGATGGTGTTGCAAATAAGATGAGAAAAGTCGTGGAGCTTGTGGACAATAAATCGAAGATAAAAATGGAGTTATCTACAGACCAATCCGGTCTAAGGTTGAAAACCACTAAACCAAAAAATGGATCGGTTCATAAAGCTTACTCTGGTTTATGTCTAGAATCACATGCAATCAATTACCAATATCGTTCTTCGCAGATAATTGAACCGGGGGAAACTTATAAGCATACTATGCTCTTTAAGTTTTCTTTTGTTCCGTAA

SEQ ID NO: 107 - DNA, 1486 bp, Arabidopsis thaliana
  misc_feature (1)..(1486): Ceres cDNA ID no. 4905414
acggttcaatttgatttggataataattctctttttctctggaaagttcgaatttttttttgtttggaagcttggagaaaatattatactcttctcattgaatgatcaatttacaaatcctcatttgatcgatcttgtcaatttttgaaaaaaaaaatctgaactttgagaaaagttattgagtttcgatatctgtcggtcatggtttgattgtggctgttgggtaagacaacaaattagggtttttgaatagtttgtgtattgaagattgtctgaaatggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaaatgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaattgctatcgaggccttcgagcaagttctgagctttctagagaaagaagaaactatggagatcccagacggcgacctctaatttcccagccttcttttctccgtctcttcatttatctgtttaatcaactaaacgaagcaatcactcatcaccaggccattgagcaagttcagagacaaagaagacctctagttactggttccgggtcattggagcttacacgagcctaattttgactggaactatggtttattgaaagaagattcaatacatgtatatataaaatatatacttttttttttgtttcagtatcatccttcttctcttttccttacaataagaattaagaaaaagtagccgtgtttgttaacatgggcc

SEQ ID NO: 108 - protein, 303 aa, Arabidopsis thaliana
  misc_feature: PFam Name: SKI; PFam Description: Shikimate kinase
  misc_feature: GI Number: 39104605; NR Description: putative shikimate
  misc_feature: GI Number: 42570867; NR Description: shikimate kinase,
  misc_feature: GI Number: 30681570; NR Description: shikimate kinase, putative [Arabidopsis thaliana] >gi|26452806|dbj|BAC43483.1|
  misc_feature: GI Number: 7270938; NR Description: shikimate kinase-like protein [Arabidopsis thaliana] gi|5042170|emb|CAB44689.1| shikimate kinase-like protein [Arabidopsis thaliana] gi|7434489|pir||T09370
  misc_feature: GI Number: 56805577; NR Description: shikimate kinase 1
MEAAITQRIQYPSWVDCRKVECKPQRGSLRYSQQVKVDRRFRGLSLARLQPERRNDQRRAVSPAVSCSDNNSSALLETGSVYPFDEDILKRKAEEVKPYLNGRSMYLVGMMGSGKTTVGKLMSKVLGYTFFDCDTLIEQAMNGTSVAEIFVHHGENFFRGKETDALKKLSSRYQVVVSTGGGAVIRPINWKYMHKGISIWLDVPLEALAHRIAAVGTDSRPLLHDESGDAYSVAFKRLSAIWDERGEAYTNANARVSLENIAAKRGYKNVSDLTPTEIAIEAFEQVLSFLEKEETMEIPDGDL

SEQ ID NO: 109 - DNA, 1387 bp, Arabidopsis thaliana
  misc_feature (1)..(1387): Ceres cDNA ID no. 4908231
tcgttagctctctcaatgaggagcccgatttagggtttcctccattggttatatcaattcgatcatctccacaaagctctcgaagactctttcggtgatctcatcttcttcttcttgtttagcctcctggaggttactttgtttgttactagttccaaaacatgccgaaagagaggaaagaacggtccgtatctcttgataagtataaacgatcgccactgtgttgtgaggcaagccttgctttgaagccgagtgagaaacaagttaaggaatgggaagaggctcgttgtcctgtttgtatggaacatcctcacaatgggattcttctcatttgttcttcttatgaaaatggttgtcgaccttacatgtgcgacactagccatcggcattctaactgtttcgatcagttccgcaaagcttctaaagagaaaccttctttgtctttacttcgtgaggaagaggaaagtaatgaaccaactgagatggaagatgtggattcagactcaactgctgtaaatctattaggagaagctgcatctgagataacagttgtggatttaagtgatggtgagagaggagaagaagaagtagaagaagatcaagaaaaaaacaaaccacaaaagcttacttgtccgttatgtcgtggacatataaaagaatgggtagttgttaaagcagctcgatgtttcatgaactcaaaacatagaagctgttcttgtgagacttgtgatttcagtggaagctattccgatctgagaaagcacgcaaggcttctacatccaggagttaggccatcagaagcagatccagagagacagagaagctggaggaggctagaaaggcagagcgatttaggggatttacttagcacactccaatcttcttttggaggagatgaaataagtaacgatgatgggtttctatttgctgatactcgcttgcttacagtgtactttctcatccgcgtgtttagaccagaatcgagtggctcaaggagtagtagctggtctggtacatctagagctaggacacatacaagtgggagaagaagatcttcaagacctgcaagtctttggggagagagctatgaaggtaatacaggaacatcacctagagatgaggagaataatcaatcttctgatgaacaagtgtctggaactcggagacgtcgttctagaagaagaactgtcattgatgatgatgatgaagaagaagaaccgtgatgctctgcagtttggaaatttggtctttggagtttatgataaaatgggggaaaccttgtagtaataaccccacttatgaaaccctattatgtaaaatttctttggagattgaaaaaagtttctactattgggaaacaaaatgttcaatatttcattaccgttta

SEQ ID NO: 110 - protein, 353 aa, Arabidopsis thaliana
  misc_feature: GI Number: 34912600; NR Description: P0046B10.17 [Oryza sativa (japonica cultivar-group)] >gi|11034559|dbj|BAB17083.1| P0410E01.4 [Oryza sativa (japonica cultivar-group)] >gi|21104687|dbj|BAB93277.1| P0046B10.17 [Oryza sativa (japonica
  misc_feature: GI Number: 5103842; NR Description: F9L1.39 [Arabidopsis thaliana]
MPKERKERSVSLDKYKRSPLCCEASLALKPSEKQVKEWEEARCPVCMEHPHNGILLICSSYENGCRPYMCDTSHRHSNCFDQFRKASKEKPSLSLLREEEESNEPTEMEDVDSDSTAVNLLGEAASEITVVDLSDGERGEEEVEEDQEKNKPQKLTCPLCRGHIKEWVVVKAARCFMNSKHRSCSCETCDFSGSYSDLRKHARLLHPGVRPSEADPERQRSWRRLERQSDLGDLLSTLQSSFGGDEISNDDGFLFADTRLLTVYFLIRVFRPESSGSRSSSWSGTSRARTHTSGRRRSSRPASLWGESYEGNTGTSPRDEENNQSSDEQVSGTRRRRSRRRTVIDDDDEEEEP

SEQ ID NO: 111 - DNA, 1300 bp, Arabidopsis thaliana
  misc_feature (1)..(1300): Ceres cDNA ID no. 4909806
  misc_feature (1)..(1300): Also known as  Ceres CDNA ID no. 24371021
gtcttggcatcctcgtcctcttcagcaaaactcgtctctcttgcactccaaaaagcaaccatgtctgcttttgtcggcaaatacgcagatgagctgataaagacggctaagtacattgccacaccgggaaagggcattttggcagcagacgagagcacgggaactattgggaaacgattcgccagcatcaatgttgagaacattgagtccaaccgccaagctctccgtgagctcctcttcacgtcccctggcactttcccttgcctctccggtgttatcctcttcgaggaaaccctctaccagaaaaccacggatggcaaacccttcgttgagctcctcatggaaaacggagttatccctggaatcaaagtggacaagggtgtggttgatctagcaggaaccaatggcgagaccactactcagggtctagattcacttggtgcacgttgccaggagtattacaaggcaggagctcggtttgcaaaatggcgtgcagtcctcaagattggggccaccgagccaagcgagctctctatccaagagaacgccaaggggctagcccgctatgccatcatctgccaggagaatggactcgtcccaatcgtcgagccagaggtactgaccgacgggagccatgacatcaagaaatgtgcagcggtgaccgagaccgttcttgctgccgtgtacaaggccttgaacgaccaccatgtcctcctcgaaggcactctgcttaaaccgaacatggtcactcccggctctgacagcccaaaggttgcaccggaagtgatagcggaatacacagtgactgctctgcgccgcacagtcccacctgcagttccaggaatcgtgttcctctcaggcggacagagtgaagaggaagcaacactaaatctgaacgcaatgaacaagctcgatgtgttgaagccatggactctcactttctcatttggccgagccctccaacaaagcactctcaaggcttgggcaggtaagacagagaatgtagccaaagctcaggccactttcctgaccaggtgcaagggtaactcggacgctaccctcgggaaatacaccggcggggcttctggtgactcggccgcctctgagagcttgtatgaggaaggatacaagtattaggagcgtttaaatacgggtgtcgccttttatacgatttgaatatatgtcaaatgtttcgtaggcgtttaactgtttaaatttttatcgatttggtttagcgtctgtgtaatgttcttaaactgtgttgtgttttttgtgatggtttctataatattttcgcgcc

SEQ ID NO: 112 - protein, 1300 aa, Arabidopsis thaliana
GTCTTGGCATCCTCGTCCTCTTCAGCAAAACTCGTCTCTCTTGCACTCCAAAAAGCAACCATGTCTGCTTTTGTCGGCAAATACGCAGATGAGCTGATAAAGACGGCTAAGTACATTGCCACACCGGGAAAGGGCATTTTGGCAGCAGACGAGAGCACGGGAACTATTGGGAAACGATTCGCCAGCATCAATGTTGAGAACATTGAGTCCAACCGCCAAGCTCTCCGTGAGCTCCTCTTCACGTCCCCTGGCACTTTCCCTTGCCTCTCCGGTGTTATCCTCTTCGAGGAAACCCTCTACCAGAAAACCACGGATGGCAAACCCTTCGTTGAGCTCCTCATGGAAAACGGAGTTATCCCTGGAATCAAAGTGGACAAGGGTGTGGTTGATCTAGCAGGAACCAATGGCGAGACCACTACTCAGGGTCTAGATTCACTTGGTGCACGTTGCCAGGAGTATTACAAGGCAGGAGCTCGGTTTGCAAAATGGCGTGCAGTCCTCAAGATTGGGGCCACCGAGCCAAGCGAGCTCTCTATCCAAGAGAACGCCAAGGGGCTAGCCCGCTATGCCATCATCTGCCAGGAGAATGGACTCGTCCCAATCGTCGAGCCAGAGGTACTGACCGACGGGAGCCATGACATCAAGAAATGTGCAGCGGTGACCGAGACCGTTCTTGCTGCCGTGTACAAGGCCTTGAACGACCACCATGTCCTCCTCGAAGGCACTCTGCTTAAACCGAACATGGTCACTCCCGGCTCTGACAGCCCAAAGGTTGCACCGGAAGTGATAGCGGAATACACAGTGACTGCTCTGCGCCGCACAGTCCCACCTGCAGTTCCAGGAATCGTGTTCCTCTCAGGCGGACAGAGTGAAGAGGAAGCAACACTAAATCTGAACGCAATGAACAAGCTCGATGTGTTGAAGCCATGGACTCTCACTTTCTCATTTGGCCGAGCCCTCCAACAAAGCACTCTCAAGGCTTGGGCAGGTAAGACAGAGAATGTAGCCAAAGCTCAGGCCACTTTCCTGACCAGGTGCAAGGGTAACTCGGACGCTACCCTCGGGAAATACACCGGCGGGGCTTCTGGTGACTCGGCCGCCTCTGAGAGCTTGTATGAGGAAGGATACAAGTATTAGGAGCGTTTAAATACGGGTGTCGCCTTTTATACGATTTGAATATATGTCAAATGTTTCGTAGGCGTTTAACTGTTTAAATTTTTATCGATTTGGTTTAGCGTCTGTGTAATGTTCTTAAACTGTGTTGTGTTTTTTGTGATGGTTTCTATAATATTTTCGCGCC

SEQ ID NO: 113 - DNA, 1140 bp, Arabidopsis thaliana
  misc_feature (1)..(1140): Ceres cDNA ID no. 4917757
  misc_feature (1)..(1140): Also known as  Ceres CDNA ID no. 24371021
atgggcaagattatcttggttgtttctcttactgctttatgcatttttatgctcaagcacgcaccgagtttcacatcaccaaccgcgttctctcgtagcgaggaaggtgtgactcatgtgttagtcactggtggtgctggatatatcggatcacatgctgcgttgaggctcttaaaagattcataccgtgtaaccattgtggacaatctttctcggggaaatcttggtgccgtcaaggttttacaaggattgttcccagaacccgggaggcttcaatttatttatgctgacttaggagatgccaaagctgttgataaaatcttctcagagaacgcgtttgatgctgttatgcattttgctgcagtagcatatgttggagagagcactctagatcctctaaagtattaccacaacattacatcaaacacattagtagttcttgaagctgtggctagacataaagtgaagaagttgatatattcaagcacatgtgccacttatggagaacctgacaagatgcctattgttgaagttactccacaggtccccattaacccttatggaaaagctaagaagatggctgaagatatgatcctggatttctctaaaaactctgacatggcagtcatgatcctaagatactttaacgtgataggttcagatccagaaggtagactaggagaagctccaaagcccgagctacgtgaacacggacggatttcgggtgcctgtttcgatgcagctcgtggcgtgattccaggccttcaggtcaaaggaacagactacaaaacaggagatggaacttgtgttcgtgactacatagatgttactgaccttgtagatgctcacgtaaaagctctcgagaaagctaagcctagaaatgtgggaatatacaatgtaggtacaggaaaaggaagatcggtgaaagagtttgtggaagcatgtaagaaagcgacaggagtagatatcaaagtagattttttgcctcgaagacctggagattacgcagaggtttacagtgatccagcaaagattctgagagatcttaattggtctgctcgttacactaatcttcaagaaagtcttgaggttgcttggaagtggcaaaagactcatccccatggatatgcttcttcttaa

SEQ ID NO: 114 - protein, 1140 aa, Arabidopsis thaliana
ATGGGCAAGATTATCTTGGTTGTTTCTCTTACTGCTTTATGCATTTTTATGCTCAAGCACGCACCGAGTTTCACATCACCAACCGCGTTCTCTCGTAGCGAGGAAGGTGTGACTCATGTGTTAGTCACTGGTGGTGCTGGATATATCGGATCACATGCTGCGTTGAGGCTCTTAAAAGATTCATACCGTGTAACCATTGTGGACAATCTTTCTCGGGGAAATCTTGGTGCCGTCAAGGTTTTACAAGGATTGTTCCCAGAACCCGGGAGGCTTCAATTTATTTATGCTGACTTAGGAGATGCCAAAGCTGTTGATAAAATCTTCTCAGAGAACGCGTTTGATGCTGTTATGCATTTTGCTGCAGTAGCATATGTTGGAGAGAGCACTCTAGATCCTCTAAAGTATTACCACAACATTACATCAAACACATTAGTAGTTCTTGAAGCTGTGGCTAGACATAAAGTGAAGAAGTTGATATATTCAAGCACATGTGCCACTTATGGAGAACCTGACAAGATGCCTATTGTTGAAGTTACTCCACAGGTCCCCATTAACCCTTATGGAAAAGCTAAGAAGATGGCTGAAGATATGATCCTGGATTTCTCTAAAAACTCTGACATGGCAGTCATGATCCTAAGATACTTTAACGTGATAGGTTCAGATCCAGAAGGTAGACTAGGAGAAGCTCCAAAGCCCGAGCTACGTGAACACGGACGGATTTCGGGTGCCTGTTTCGATGCAGCTCGTGGCGTGATTCCAGGCCTTCAGGTCAAAGGAACAGACTACAAAACAGGAGATGGAACTTGTGTTCGTGACTACATAGATGTTACTGACCTTGTAGATGCTCACGTAAAAGCTCTCGAGAAAGCTAAGCCTAGAAATGTGGGAATATACAATGTAGGTACAGGAAAAGGAAGATCGGTGAAAGAGTTTGTGGAAGCATGTAAGAAAGCGACAGGAGTAGATATCAAAGTAGATTTTTTGCCTCGAAGACCTGGAGATTACGCAGAGGTTTACAGTGATCCAGCAAAGATTCTGAGAGATCTTAATTGGTCTGCTCGTTACACTAATCTTCAAGAAAGTCTTGAGGTTGCTTGGAAGTGGCAAAAGACTCATCCCCATGGATATGCTTCTTCTTAA

SEQ ID NO: 115 - DNA, 1368 bp, Arabidopsis thaliana
  misc_feature (1)..(1368): Ceres cDNA ID no. 4920703
  misc_feature (1)..(1368): Also known as  Ceres CDNA ID no. 24371021
atggcgggaatcccagatcatatccaagaccaacatcttgtggaggaggatcaaccctttgatctggaagattggcttccaatcacagcatcaaggaatgccaattggtattattcagctttccacaacgtcactgccattgttggtgctggcgttctcggtcttccttacgccatgtcagagcttggatggggacctggggttgtggtgttgatcctgtcatgggtgatcacgttatacaccctctggcaaatgattgagatgcatgagatgtttgaagggcaacggttcgataggtaccatgagctgggtcaggcagcctttggtaaaaagcttggtttgtacatcatcgtgcccctacaactacttgtcgagatcagtgtgtgcatagtctatatggtcactggaggtaaatccctgaagaatgtacatgaccttgctttgggagatggtgacaagtgcacaaagcttagaattcaacacttcattttgatctttgcctcttcacagttcgtgctctcccttcttaagaacttcaactccatttctggtgtctccttggtagctgctgtcatgtctgtcagctattctacaattgcttgggtagcctcgctgaggaagggtgccaccaccgggagtgtagagtacggctatagaaaaagaacaacctcagtgccattagccttcttaagtgcactgggtgaaatggcttttgcgtacgcaggtcataacgttgttttggaaattcaagcaacgatcccatcaacaccagagaacccatcaaaacgacccatgtggaagggagcggttgtagcctatatcattgtagctttctgctacttccctgtggcacttgtaggtttcaagacctttggaaacagtgttgaagagagcatcctcgaatcactaacaaaaccaacggcacttgtcattgtggccaacatgtttgtggtcatacatctcttgggaagctaccaggtgtatgcgatgcccgtgtttgacatgatcgaatctgtaatgataaggatatggcacttcagtccaacaagagttctacggtttaccatccgatggacttttgtggccgccacgatgggaatagcggtcggtttaccgtattacagcgcattgctgtcattttttgggggatttgtgttcgccccgaccacatactttatcccatgcatcatgtggctgatcctaaagaaaccaaagagatttagtctctcatggtgtatgaactggttttgcatcatttttgggcttgtgctgatgatcatagcacctattgggggactggccaaactaatctataatattcaaaagggcactctacctaattcaagatgcaacttacctaaacactga

SEQ ID NO: 116 - protein, 1368 aa, Arabidopsis thaliana
ATGGCGGGAATCCCAGATCATATCCAAGACCAACATCTTGTGGAGGAGGATCAACCCTTTGATCTGGAAGATTGGCTTCCAATCACAGCATCAAGGAATGCCAATTGGTATTATTCAGCTTTCCACAACGTCACTGCCATTGTTGGTGCTGGCGTTCTCGGTCTTCCTTACGCCATGTCAGAGCTTGGATGGGGACCTGGGGTTGTGGTGTTGATCCTGTCATGGGTGATCACGTTATACACCCTCTGGCAAATGATTGAGATGCATGAGATGTTTGAAGGGCAACGGTTCGATAGGTACCATGAGCTGGGTCAGGCAGCCTTTGGTAAAAAGCTTGGTTTGTACATCATCGTGCCCCTACAACTACTTGTCGAGATCAGTGTGTGCATAGTCTATATGGTCACTGGAGGTAAATCCCTGAAGAATGTACATGACCTTGCTTTGGGAGATGGTGACAAGTGCACAAAGCTTAGAATTCAACACTTCATTTTGATCTTTGCCTCTTCACAGTTCGTGCTCTCCCTTCTTAAGAACTTCAACTCCATTTCTGGTGTCTCCTTGGTAGCTGCTGTCATGTCTGTCAGCTATTCTACAATTGCTTGGGTAGCCTCGCTGAGGAAGGGTGCCACCACCGGGAGTGTAGAGTACGGCTATAGAAAAAGAACAACCTCAGTGCCATTAGCCTTCTTAAGTGCACTGGGTGAAATGGCTTTTGCGTACGCAGGTCATAACGTTGTTTTGGAAATTCAAGCAACGATCCCATCAACACCAGAGAACCCATCAAAACGACCCATGTGGAAGGGAGCGGTTGTAGCCTATATCATTGTAGCTTTCTGCTACTTCCCTGTGGCACTTGTAGGTTTCAAGACCTTTGGAAACAGTGTTGAAGAGAGCATCCTCGAATCACTAACAAAACCAACGGCACTTGTCATTGTGGCCAACATGTTTGTGGTCATACATCTCTTGGGAAGCTACCAGGTGTATGCGATGCCCGTGTTTGACATGATCGAATCTGTAATGATAAGGATATGGCACTTCAGTCCAACAAGAGTTCTACGGTTTACCATCCGATGGACTTTTGTGGCCGCCACGATGGGAATAGCGGTCGGTTTACCGTATTACAGCGCATTGCTGTCATTTTTTGGGGGATTTGTGTTCGCCCCGACCACATACTTTATCCCATGCATCATGTGGCTGATCCTAAAGAAACCAAAGAGATTTAGTCTCTCATGGTGTATGAACTGGTTTTGCATCATTTTTGGGCTTGTGCTGATGATCATAGCACCTATTGGGGGACTGGCCAAACTAATCTATAATATTCAAAAGGGCACTCTACCTAATTCAAGATGCAACTTACCTAAACACTGA

SEQ ID NO: 117 - DNA, 1065 bp, Arabidopsis thaliana
  misc_feature (1)..(1065): Ceres cDNA ID no. 4926010
  misc_feature (1)..(1065): Also known as  Ceres CDNA ID no. 24371021
atggaagtggagaaaaaaatccgcaaagtcgtcaaatttcacagcttgattctctctcaacccaaccacacaatcgcaatctctcttctagacacgctcgctcgtcgtctaggtctcggcttcaagcaacacgaaccaggtgcttttctcctcaagttcccacacgtgtttgagatatacgagcacccagttcaaagaatcctctattgtcgattaacccgtaaagctttggatcaaatccgtcacgaacacgaagctgttctcgaccaaatacccgacgccgtgacccggttgaggaaactcgttatgatgtcgaatacgggtcggatccgtcttgaacatgtcaggattgctcggactgagtttggactccctgaagatttcgagtactctgtgattctgaaacatccacagttctttagactcattgatggtgaagagactcgagataagtacattgagattgtggaaaaggatcctaatttatcgatttgtgcaatagagagagttagagagattgagtatagaacaaaaggaattgatgcagaggatgttcgattctcattcgttgtgaattttcctcctggatttaagattggaaagtattttcgaattgctgtttggaaatggcagaggcttccttattggtcaccgtatgaggatatatcgggttacgatttgagatcgatggaagcgcagaatcgattagagaagagatctgttgcttgtattcatgaattgctgtctttgactgtggagaagaagatcacgcttgagagaattgctcattttaggaatgtgatgaatttgcctaagaaattgaaagagtttcttttgcaacatcaggggatattttacatatcgactcgaggaaattacgggaagcttcatacggtgtttcttagagaggggtataagagaggggaattggtagaaccgaatgatgtttatttagctaggaggagattagctgagcttgttttgatgagtcctagaaaggctaaggttgatgcagagttggttcgctacagagatggattggatgatgaagatgatgtcgaatga

SEQ ID NO: 118 - protein, 1065 aa, Arabidopsis thaliana
ATGGAAGTGGAGAAAAAAATCCGCAAAGTCGTCAAATTTCACAGCTTGATTCTCTCTCAACCCAACCACACAATCGCAATCTCTCTTCTAGACACGCTCGCTCGTCGTCTAGGTCTCGGCTTCAAGCAACACGAACCAGGTGCTTTTCTCCTCAAGTTCCCACACGTGTTTGAGATATACGAGCACCCAGTTCAAAGAATCCTCTATTGTCGATTAACCCGTAAAGCTTTGGATCAAATCCGTCACGAACACGAAGCTGTTCTCGACCAAATACCCGACGCCGTGACCCGGTTGAGGAAACTCGTTATGATGTCGAATACGGGTCGGATCCGTCTTGAACATGTCAGGATTGCTCGGACTGAGTTTGGACTCCCTGAAGATTTCGAGTACTCTGTGATTCTGAAACATCCACAGTTCTTTAGACTCATTGATGGTGAAGAGACTCGAGATAAGTACATTGAGATTGTGGAAAAGGATCCTAATTTATCGATTTGTGCAATAGAGAGAGTTAGAGAGATTGAGTATAGAACAAAAGGAATTGATGCAGAGGATGTTCGATTCTCATTCGTTGTGAATTTTCCTCCTGGATTTAAGATTGGAAAGTATTTTCGAATTGCTGTTTGGAAATGGCAGAGGCTTCCTTATTGGTCACCGTATGAGGATATATCGGGTTACGATTTGAGATCGATGGAAGCGCAGAATCGATTAGAGAAGAGATCTGTTGCTTGTATTCATGAATTGCTGTCTTTGACTGTGGAGAAGAAGATCACGCTTGAGAGAATTGCTCATTTTAGGAATGTGATGAATTTGCCTAAGAAATTGAAAGAGTTTCTTTTGCAACATCAGGGGATATTTTACATATCGACTCGAGGAAATTACGGGAAGCTTCATACGGTGTTTCTTAGAGAGGGGTATAAGAGAGGGGAATTGGTAGAACCGAATGATGTTTATTTAGCTAGGAGGAGATTAGCTGAGCTTGTTTTGATGAGTCCTAGAAAGGCTAAGGTTGATGCAGAGTTGGTTCGCTACAGAGATGGATTGGATGATGAAGATGATGTCGAATGA

SEQ ID NO: 119 - DNA, 978 bp, Arabidopsis thaliana
  misc_feature (1)..(978): Ceres cDNA ID no. 4927536
  misc_feature (1)..(978): Also known as  Ceres CDNA ID no. 24371021
atggtggttggaggcgtcagtctcttcccggagacggcagaagcgatcgtgatgggaccgtcgatgcagaagctgacgtggcattactataaagtttacaacacttgcgagaatgcagagaattttgtgaggcaccaagttgagatattttacaagaacgataaaagtattgctcctaagctccttcgtctcctctactcagactgctttgtttccggatgcgatgcatcagttcttctagaaggtccaaactcagagaaaatggcgccacaaaacagaggacttggaggattcgttctcatagacaaaatcaaaatagtcttggaacagagatgtcctggtgttgtctcttgcgccgacattcttaatcttgcaactcgtgatgctgttcatttggcgggtgcaccatcttatcctgtgttcacaggcaggagagatggtttgacgtctgataagcaaaccgtggacctaccatcgccatccatctcatgggaccaagccatgtcttatttcaaatccagaggcttgaatgttcttgacatggctacacttctaggatcacattcaatggggagaacacattgcagctatgttgttgatcgactctacaattacaacaagaccggtaaaccaagccctactatgaacaagtatttcctatctgaaatggcaaagcaatgtcctccaagaacgaggaaaggccagaccgatccgctcgtgtacctaaacccggactcaggctcaaaccacagcttcacaagctcattttactcaagaattctatcaaacaaatctgtacttgaagtagatcaacaactgctttacaatgatgacaccaagcaaatatctaaggaattctcagagggtttcgaggattttcggaaatcatttgctctttcgatgagcaagatgggagcgataaatgtgttaactaaaacggaaggtgagatacgaaaagattgcaggcatataaactaa

SEQ ID NO: 120 - protein, 978 aa, Arabidopsis thaliana
ATGGTGGTTGGAGGCGTCAGTCTCTTCCCGGAGACGGCAGAAGCGATCGTGATGGGACCGTCGATGCAGAAGCTGACGTGGCATTACTATAAAGTTTACAACACTTGCGAGAATGCAGAGAATTTTGTGAGGCACCAAGTTGAGATATTTTACAAGAACGATAAAAGTATTGCTCCTAAGCTCCTTCGTCTCCTCTACTCAGACTGCTTTGTTTCCGGATGCGATGCATCAGTTCTTCTAGAAGGTCCAAACTCAGAGAAAATGGCGCCACAAAACAGAGGACTTGGAGGATTCGTTCTCATAGACAAAATCAAAATAGTCTTGGAACAGAGATGTCCTGGTGTTGTCTCTTGCGCCGACATTCTTAATCTTGCAACTCGTGATGCTGTTCATTTGGCGGGTGCACCATCTTATCCTGTGTTCACAGGCAGGAGAGATGGTTTGACGTCTGATAAGCAAACCGTGGACCTACCATCGCCATCCATCTCATGGGACCAAGCCATGTCTTATTTCAAATCCAGAGGCTTGAATGTTCTTGACATGGCTACACTTCTAGGATCACATTCAATGGGGAGAACACATTGCAGCTATGTTGTTGATCGACTCTACAATTACAACAAGACCGGTAAACCAAGCCCTACTATGAACAAGTATTTCCTATCTGAAATGGCAAAGCAATGTCCTCCAAGAACGAGGAAAGGCCAGACCGATCCGCTCGTGTACCTAAACCCGGACTCAGGCTCAAACCACAGCTTCACAAGCTCATTTTACTCAAGAATTCTATCAAACAAATCTGTACTTGAAGTAGATCAACAACTGCTTTACAATGATGACACCAAGCAAATATCTAAGGAATTCTCAGAGGGTTTCGAGGATTTTCGGAAATCATTTGCTCTTTCGATGAGCAAGATGGGAGCGATAAATGTGTTAACTAAAACGGAAGGTGAGATACGAAAAGATTGCAGGCATATAAACTAA

SEQ ID NO: 121 - DNA, 1407 bp, Arabidopsis thaliana
  misc_feature (1)..(1407): Ceres cDNA ID no. 4928798
  misc_feature (1)..(1407): Also known as  Ceres CDNA ID no. 24371021
atgcggaagttaacggcggttaattcactactgaaacggaacaattatcttcttccgcgccatggctcctcacaaacagcagctcagagaacatcctccgtccgcgagaccgagaccgaaacaaaacttccgaaaatgcccccgttcaattattctccgccgccttacgacggtccatctacggcagagatcatcgcaaagcggcgagagttcctcagccccgctctttttcacttctacaacacacccttaaacattgtggaggcaaagatgcagtatgtgttcgacgagaatggacgtcgatatttagatgcctttggaggaatagcgacggtttcgtgcggccattgccacccggaagtagttaactccgtcgtcaaacagttgaaacttattaaccactccaccatcctttaccttaaccacaccatctccgatttcgctgaagcccttgtctccactcttccgggagatctcaaggtggtgtttttcacgaattcgggtacggaggcgaatgaacttgcgatgatgatggctagactgtatacaggatgtaacgacatcgtttcgcttaggaactcttatcatggaaacgcagctgctactatgggtgccactgctcagtccaactggaaattcaacgtcgttcagagtggagttcatcacgccataaatccagatccttacagaggaatatttggatccgacggtgaaaagtacgcgagtgatgtacacgatcttatccaattcggaacgtccggtcaagtcgccggtttcattggcgaatcaatccagggtgttggaggaatcgtagagcttgctcccggatacttaccggcggcttacgacatcgtgaggaaagccggaggagtttgcatcgccgatgaagtccaatccggttttgctcgtaccggaacccatttctgggggtttcaatcccatggtgttatccctgacatcgtcaccatggccaaggggatcggtaacggtataccacttggagcggttgtgacgacaccggagattgccggcgttttaagccgtcggagttactttaatactttcggcggaaatccaatgtgcacggccgcaggacacgcagtacttagagtccttcacgaagagaagctccaagagaatgctaacctcgttggctcacatcttaaacgtagacttacgctactcaaaaacaaatacgaactcattggagacgtgagagggagaggattgatgctaggagttgagtttgtcaaagaccgcgacttaaaaactcctgcaaaagcagagacccttcatttaatggatcaaatgaaagaaatgggagtgttggtggggaaaggtggattctatgggaatgtcttcagaatcactcctcctctctgcttcaccctctccgacgctggttag

SEQ ID NO: 122 - protein, 1407 aa, Arabidopsis thaliana
ATGCGGAAGTTAACGGCGGTTAATTCACTACTGAAACGGAACAATTATCTTCTTCCGCGCCATGGCTCCTCACAAACAGCAGCTCAGAGAACATCCTCCGTCCGCGAGACCGAGACCGAAACAAAACTTCCGAAAATGCCCCCGTTCAATTATTCTCCGCCGCCTTACGACGGTCCATCTACGGCAGAGATCATCGCAAAGCGGCGAGAGTTCCTCAGCCCCGCTCTTTTTCACTTCTACAACACACCCTTAAACATTGTGGAGGCAAAGATGCAGTATGTGTTCGACGAGAATGGACGTCGATATTTAGATGCCTTTGGAGGAATAGCGACGGTTTCGTGCGGCCATTGCCACCCGGAAGTAGTTAACTCCGTCGTCAAACAGTTGAAACTTATTAACCACTCCACCATCCTTTACCTTAACCACACCATCTCCGATTTCGCTGAAGCCCTTGTCTCCACTCTTCCGGGAGATCTCAAGGTGGTGTTTTTCACGAATTCGGGTACGGAGGCGAATGAACTTGCGATGATGATGGCTAGACTGTATACAGGATGTAACGACATCGTTTCGCTTAGGAACTCTTATCATGGAAACGCAGCTGCTACTATGGGTGCCACTGCTCAGTCCAACTGGAAATTCAACGTCGTTCAGAGTGGAGTTCATCACGCCATAAATCCAGATCCTTACAGAGGAATATTTGGATCCGACGGTGAAAAGTACGCGAGTGATGTACACGATCTTATCCAATTCGGAACGTCCGGTCAAGTCGCCGGTTTCATTGGCGAATCAATCCAGGGTGTTGGAGGAATCGTAGAGCTTGCTCCCGGATACTTACCGGCGGCTTACGACATCGTGAGGAAAGCCGGAGGAGTTTGCATCGCCGATGAAGTCCAATCCGGTTTTGCTCGTACCGGAACCCATTTCTGGGGGTTTCAATCCCATGGTGTTATCCCTGACATCGTCACCATGGCCAAGGGGATCGGTAACGGTATACCACTTGGAGCGGTTGTGACGACACCGGAGATTGCCGGCGTTTTAAGCCGTCGGAGTTACTTTAATACTTTCGGCGGAAATCCAATGTGCACGGCCGCAGGACACGCAGTACTTAGAGTCCTTCACGAAGAGAAGCTCCAAGAGAATGCTAACCTCGTTGGCTCACATCTTAAACGTAGACTTACGCTACTCAAAAACAAATACGAACTCATTGGAGACGTGAGAGGGAGAGGATTGATGCTAGGAGTTGAGTTTGTCAAAGACCGCGACTTAAAAACTCCTGCAAAAGCAGAGACCCTTCATTTAATGGATCAAATGAAAGAAATGGGAGTGTTGGTGGGGAAAGGTGGATTCTATGGGAATGTCTTCAGAATCACTCCTCCTCTCTGCTTCACCCTCTCCGACGCTGGTTAG

SEQ ID NO: 123 - DNA, 1140 bp, Arabidopsis thaliana
  misc_feature (1)..(1140): Ceres cDNA ID no. 4931036
atgaaggttcttcgatgcctgctccttataagcaaccaaactcacctagtaagctctcgtcaatattcttggaaatgtgcacagagaacaacaggagaagtggtggctaagaacgcaaacggaccatcaaacaatatgggggcacgtattttcacgttccgtgagctagccaccgcgacaaagaattttagacaagagtgcctcattggtgaaggtgggttcgggagggtttacaaaggaaagcttgaaaatccagctcaggtcgtggcagtgaaacaacttgataggaatggattacaaggacaaagagagttcttggtcgaggtcttaatgcttagtcttctacatcataggaatcttgtgaatcttatcggttattgcgctgatggagaccaaagacttcttgtttacgagtatatgcctcttggatctctagaagatcatctcctcgatcttgaaccgggacaaaaaccactagactggaacactcgtattaagattgctttaggagcagcaaaaggaattgagtatctccatgatgaggctgatcctccagtgatttaccgagatcttaaatcgtcaaatatattacttgacccagaatacgttgcgaaattatcggatttcggtttagcaaagctaggtcctgttggagacacactacatgtgtcttcccgagttatgggaacttatggttattgtgctcctgaatatcaaagaactggctatctaacaaataaatcagatgtctacagctttggagttgtgttgttggaacttatatccggaagacgagtcatcgacacaatgagacctagtcatgaacaaaatctcgttacttgggcactaccgatttttagagatccgactagatattggcagctagctgatccattgcttcgaggcgactatccggaaaagagtttgaaccaagctatagctgtagcggcaatgtgcctgcatgaagaaccaacggttagaccactaatgagtgacgttattacagccttgagctttcttggtgcatcctcaaattcctccaataccggctctaaccatttgcaacaaaatcgatccaacaaatatcaggatgcagttcagtgggactcaagtcctagatatgctaattcgcaaatgtag

SEQ ID NO: 124 - protein, 379 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15230190; NR Description: protein kinase,
  misc_feature: GI Number: 11994661; NR Description: receptor protein
  misc_feature: GI Number: 28416685; NR Description: At3g07070 [Arabidopsis
  misc_feature: GI Number: 34907210; NR Description: putative serine/threonine kinase PBS1 protein [Oryza sativa (japonica cultivar-group)] >gi|15408807|dbj|BAB64203.1| putative serine/threonine kinase PBS1 protein [Oryza sativa (japonica
  misc_feature: GI Number: 30679773; NR Description: protein kinase family
MKVLRCLLLISNQTHLVSSRQYSWKCAQRTTGEVVAKNANGPSNNMGARIFTFRELATATKNFRQECLIGEGGFGRVYKGKLENPAQVVAVKQLDRNGLQGQREFLVEVLMLSLLHHRNLVNLIGYCADGDQRLLVYEYMPLGSLEDHLLDLEPGQKPLDWNTRIKIALGAAKGIEYLHDEADPPVIYRDLKSSNILLDPEYVAKLSDFGLAKLGPVGDTLHVSSRVMGTYGYCAPEYQRTGYLTNKSDVYSFGVVLLELISGRRVIDTMRPSHEQNLVTWALPIFRDPTRYWQLADPLLRGDYPEKSLNQAIAVAAMCLHEEPTVRPLMSDVITALSFLGASSNSSNTGSNHLQQNRSNKYQDAVQWDSSPRYANSQM

SEQ ID NO: 125 - DNA, 1806 bp, Arabidopsis thaliana
  misc_feature (1)..(1806): Ceres cDNA ID no. 4931261
atggtacagacaaaacatttctgcatgttacatcggactctcctgtgtccgaaacgcatcaaatttctgcaatccatttctaaactcaagcggcacatcactcagatccacgcttttgtaatcagtactggtaatttacttaatggaagctctattagtcgagatctcatcgcttcatgtggacgaatcggtgagatctcttatgcacgtaaggtgttcgacgaattgccgcagaggggtgtttctgtttataattccatgattgtggtttattctcgtggaaaaaatccagatgaggttttgcgactttatgatcagatgatagctgaaaaaattcaaccagatagctcaacgttcactatgacgatcaaagcgtgcttaagtggtttggttttagagaaaggagaggctgtgtggtgtaaagcagtggactttgggtataaaaatgatgtctttgtttgttcatctgtcttgaatctgtatatgaagtgtgggaaaatggatgaagcagaggttttgtttggaaagatggcgaaaagagatgttatttgctggacaacaatggtgacagggtttgcacaggctggtaagtcgttgaaggctgttgagttttacagagaaatgcagaatgaagggtttggtagggatagggttgtgatgttgggtctcttacaagcttctggtgatctcggggatacgaaaatgggccgttcggttcacgggtatttgtatagaacaggtcttcctatgaatgtagtggttgaaaccagcctggttgatatgtatgcaaaagttgggtttatagaggttgcttctagggtgtttagtaggatgatgtttaaaaccgcagtttcgtgggggtcgttgatctctggatttgctcaaaatggattagctaataaagcatttgaagctgttgtggaaatgcagagccttgggtttcaaccggatttagtgacgcttgttggagtacttgtggcgtgttcgcaagtcgggtcattaaagactggtagattagtacattgttatattttgaaaaggcacgttcttgatcgagtaaccgcaactgctttgatggacatgtactcaaaatgtggcgctctttcaagttcaagagaaatctttgaacatgtaggaaggaaagacttggtttgttggaacacaatgatatcttgttatggaattcatggaaacggtcaagaagttgtatcgttgtttctcaaaatgacggaatcaaacatagaacccgaccacgccacgtttgcatcacttctctctgctcttagccactcgggtctcgtagaacaaggccaacattggttcagcgtcatgataaacaaatataagatccaaccgagtgaaaagcattacgtttgtttgattgatcttcttgcacgtgcagggagagtcgaagaagctcttgatatgataaactctgagaaacttgacaatgctttaccaatatgggttgctcttctttcaggatgcattaatcacaggaatctatcagtcggggacattgcggctaataagattctccagttgaatccggatagtattgggatccaaacactggtttctaacttctttgcaactgccaataagtggaaagaagtggccaaagtgaggaagttgatgagaaatggggccatggagaaggtaccaggctacagcgcgatcgaagtaaatggggagcttcgaacttttctcatggaagatctgagtcaccatgaacattatcacatgttgcaagtgttgaggaacttgaaaactgagataagagatgtatgttccggagtcgaatag

SEQ ID NO: 126 - protein, 601 aa, Arabidopsis thaliana
  misc_feature: PFam Name: PPR; PFam Description: PPR repeat
  misc_feature: GI Number: 11994419; NR Description: selenium-binding
  misc_feature: GI Number: 18483237; NR Description: putative vegetative
  misc_feature: GI Number: 34897884; NR Description: Similar to Arabidopsis thaliana DNA chromosome 4, BAC clone F4I10; vegetative storage protein. (AL035525) [Oryza sativa (japonica cultivar-group)] >gi|7363286|dbj|BAA93030.1| Similar to storage protein.
  misc_feature: GI Number: 37536800; NR Description: putative PPR-repeat protein [Oryza sativa (japonica cultivar-group)] >gi|14165320|gb|AAK55452.1| putative PPR repeat protein [Oryza sativa (japonica cultivar-group)] >gi|31433484|gb|AAP54989.1|
  misc_feature: GI Number: 9279668; NR Description: selenium-binding
MVQTKHFCMLHRTLLCPKRIKFLQSISKLKRHITQIHAFVISTGNLLNGSSISRDLIASCGRIGEISYARKVFDELPQRGVSVYNSMIVVYSRGKNPDEVLRLYDQMIAEKIQPDSSTFTMTIKACLSGLVLEKGEAVWCKAVDFGYKNDVFVCSSVLNLYMKCGKMDEAEVLFGKMAKRDVICWTTMVTGFAQAGKSLKAVEFYREMQNEGFGRDRVVMLGLLQASGDLGDTKMGRSVHGYLYRTGLPMNVVVETSLVDMYAKVGFIEVASRVFSRMMFKTAVSWGSLISGFAQNGLANKAFEAVVEMQSLGFQPDLVTLVGVLVACSQVGSLKTGRLVHCYILKRHVLDRVTATALMDMYSKCGALSSSREIFEHVGRKDLVCWNTMISCYGIHGNGQEVVSLFLKMTESNIEPDHATFASLLSALSHSGLVEQGQHWFSVMINKYKIQPSEKHYVCLIDLLARAGRVEEALDMINSEKLDNALPIWVALLSGCINHRNLSVGDIAANKILQLNPDSIGIQTLVSNFFATANKWKEVAKVRKLMRNGAMEKVPGYSAIEVNGELRTFLMEDLSHHEHYHMLQVLRNLKTEIRDVCSGVE

SEQ ID NO: 127 - DNA, 1503 bp, Arabidopsis thaliana
  misc_feature (1)..(1503): Ceres cDNA ID no. 4931385
atggctactatttggtttctcccacttctctttctctcttgtcttcttcttgccgctttaagactcaagaagcggcggcaacatcaacggaaaccaccgtctccaccgggctttccgatcatcggaaacttgcatcagcttggggagctaccacatcaatctctatggagtctctccaaaaaatatggtcctgtaatgcttttgaagtttggaagtatcccaacggttgttgtctcttcttctgaaacagcaaagcaagctctgaaaatccatgacctcaattgttgtagccgtccaagcttagcaggaccaagagcgctctcttacaactacttggacatagttttctctccttttaatgattactggaaagaattgaggaggatgtgtgtgcaagagcttttcagtcctaaacaagttcatttgattcaacccatcagggaagaggaagtcaagaaactgatgaattcattctcggaatcagctgctcagaaaactccggttaacttgagcgagaagttagcttctttaactgttggcgtgatatgcaaggcagcatttggtgtgagtttccaaggaactgtgcttaatagtgacaacttcgacaagttaatccatgatgcatttttgttcttggggagcttctctgcctcggattattttccaaatgtcggctggatcatcgactggctcacggggttacaagggcagagagagagaagtgtgagaggtcttgacgcattctatgaacaaatgtttgatctacataaacaggggaacaaagaaggagttgaggattttgtggacttgctcttgaagttggagaaagaagaaactgttcttggatatggcaagctcacaagaaaccatatcaaagcagtcttaatgaatgttcttcttggaggcattggaacttcggctataacaatgacatgggcaatgacagaacttatgagaaacccgcgagtaatgaagaaagttcaatccgaaatcagaaatcaaattgggggcaagtcaatgatctgcttggatgacatagaccaactccattacctgaaaatggtgatcaatgaaacatggaggctacatcctccagcaccacttctagttccaagagaagtaatgtctgaatttgaaatcaacggctacacgattccagccaagacaagactttatgtgaatgtatggggtatcgggcgtgatccagatacttggaaagatccagaggagtttcttccagagagatttgttaacagtaacattgatgcaaaaggacaaaactttgagctgttaccatttggaagtggtaggagaatgtgtcctgccatgtacatggggacaacaatggtggagtttggtctagccaatctcttgtaccattttgactggaaattaccagaaggcatggtggtcgaagacattgacatggaagaatctcctggactcaatgccagcaagaaaaatgagcttgtacttgttcctaggaagtatttaaatctgtaa

SEQ ID NO: 128 - protein, 500 aa, Arabidopsis thaliana
  misc_feature: PFam Name: p450; PFam Description: Cytochrome P450
  misc_feature: GI Number: 30696845; NR Description: cytochrome P450 71B10
  misc_feature: GI Number: 9294291; NR Description: cytochrome p450
  misc_feature: GI Number: 7430672; NR Description: probable cytochrome P450
  misc_feature: GI Number: 18175891; NR Description: putative cytochrome P450
  misc_feature: GI Number: 30923413; NR Description: Cytochrome P450 71B38
  misc_feature: Phenotype: Useful for increasing chlorophyll and
  misc_feature: Phenotype: Useful for making ornamental plants with modified
  misc_feature: Phenotype: Useful for making stronger plants
  misc_feature: Phenotype: Useful for sterility, genetic confinement systems
MATIWFLPLLFLSCLLLAALRLKKRRQHQRKPPSPPGFPIIGNLHQLGELPHQSLWSLSKKYGPVMLLKFGSIPTVVVSSSETAKQALKIHDLNCCSRPSLAGPRALSYNYLDIVFSPFNDYWKELRRMCVQELFSPKQVHLIQPIREEEVKKLMNSFSESAAQKTPVNLSEKLASLTVGVICKAAFGVSFQGTVLNSDNFDKLIHDAFLFLGSFSASDYFPNVGWIIDWLTGLQGQRERSVRGLDAFYEQMFDLHKQGNKEGVEDFVDLLLKLEKEETVLGYGKLTRNHIKAVLMNVLLGGIGTSAITMTWAMTELMRNPRVMKKVQSEIRNQIGGKSMICLDDIDQLHYLKMVINETWRLHPPAPLLVPREVMSEFEINGYTIPAKTRLYVNVWGIGRDPDTWKDPEEFLPERFVNSNIDAKGQNFELLPFGSGRRMCPAMYMGTTMVEFGLANLLYHFDWKLPEGMVVEDIDMEESPGLNASKKNELVLVPRKYLNL

SEQ ID NO: 129 - DNA, 1503 bp, Arabidopsis thaliana
  misc_feature (1)..(1503): Ceres cDNA ID no. 4931393
  misc_feature (1)..(1503): Also known as  Ceres CDNA ID no. 24371021
atgacaaacatttggcttctgtcacttatcttcgtcatttgtattcttgtagccgtgttcaaccacaagaatcggaggaattatcaacggacaccaccgtctcctcctggctgtcctatcatcggaaacttgcatcaactcggagaattaccacatcaatctctatggaaactctccaaaaagtatggccctgtgatgcttttaaagcttggaagagtaccaacagtcatagtttcttcctctgaaacagcaaaacaagctttgaaaatccatgacctccattgttgtagtcgtccaggctttgcaggggcaagagagctctcttacaactatctagacattgctttttctccttatgatgattattggaaagaagtaaggaagctcgctgttcaagaacttttcagtagtaaacaagttcactctatacaaccgataaaggacgaggaggtcaagaaactgatcgattcaatctccgaatcagctgctcagaagactccgatcaacttgaacaagacattgctggctttaactgttagtgtggtctgcaggacagcgtttagtgtgaattttgagggaactgtgctcaacagtgaacgattcaataacatagtccgtgaggcgctcgagatgttgggaagcttttctgcctcagatttcattccgtatgtcggaaggatcatcgacttgttgacgggtttgcaaggacggcgagagagaagcatgagagatctcgatgctttctatgaacaaatgtttgatctgcataaacagaaaaaggaagaaggtagtgaagactttgtggacttgctgttgaggttggagaaagaagaagctgttcttggaaatgacaagctcactagaaaccatatcaaagcgatattgatggatgttcttctagcaggaatggatacttctgcaataaccatgacatgggcaatggcagaactcgcaaagaatccacgagtgatgaaaaaagttcaatccgaaatcagaagtcaaatcaagaacaaagaaagaatcagctttgatgacactgataagcttgagtacctcaaaatggttatcaaagaaacatggaggttacatcctacaacacctcttctaatcccaagggaagcaatgtctgaatttgagatcaacggctacacgattccagttaagacacggcttcacgtgaatgtatgggctattggtcgtgatcccgatacctggaaagaccctgaagtgtttctcccggagaggtttacggataataatattgatgcaaaaggacagcattttgagctgttaccgtttggaggcggccggagaatgtgtcctgcagtttatatggggacaacaatggtcgagtttggtttggctaatcttttgtatcattttgattggaagttaccagaaggcatgaaggttgacgatattgacatggaagaagctcccggactcactgtcaacaagaaaaacgagcttatacttgtgccaacgaagtttctagatccttaa

SEQ ID NO: 130 - protein, 1503 aa, Arabidopsis thaliana
ATGACAAACATTTGGCTTCTGTCACTTATCTTCGTCATTTGTATTCTTGTAGCCGTGTTCAACCACAAGAATCGGAGGAATTATCAACGGACACCACCGTCTCCTCCTGGCTGTCCTATCATCGGAAACTTGCATCAACTCGGAGAATTACCACATCAATCTCTATGGAAACTCTCCAAAAAGTATGGCCCTGTGATGCTTTTAAAGCTTGGAAGAGTACCAACAGTCATAGTTTCTTCCTCTGAAACAGCAAAACAAGCTTTGAAAATCCATGACCTCCATTGTTGTAGTCGTCCAGGCTTTGCAGGGGCAAGAGAGCTCTCTTACAACTATCTAGACATTGCTTTTTCTCCTTATGATGATTATTGGAAAGAAGTAAGGAAGCTCGCTGTTCAAGAACTTTTCAGTAGTAAACAAGTTCACTCTATACAACCGATAAAGGACGAGGAGGTCAAGAAACTGATCGATTCAATCTCCGAATCAGCTGCTCAGAAGACTCCGATCAACTTGAACAAGACATTGCTGGCTTTAACTGTTAGTGTGGTCTGCAGGACAGCGTTTAGTGTGAATTTTGAGGGAACTGTGCTCAACAGTGAACGATTCAATAACATAGTCCGTGAGGCGCTCGAGATGTTGGGAAGCTTTTCTGCCTCAGATTTCATTCCGTATGTCGGAAGGATCATCGACTTGTTGACGGGTTTGCAAGGACGGCGAGAGAGAAGCATGAGAGATCTCGATGCTTTCTATGAACAAATGTTTGATCTGCATAAACAGAAAAAGGAAGAAGGTAGTGAAGACTTTGTGGACTTGCTGTTGAGGTTGGAGAAAGAAGAAGCTGTTCTTGGAAATGACAAGCTCACTAGAAACCATATCAAAGCGATATTGATGGATGTTCTTCTAGCAGGAATGGATACTTCTGCAATAACCATGACATGGGCAATGGCAGAACTCGCAAAGAATCCACGAGTGATGAAAAAAGTTCAATCCGAAATCAGAAGTCAAATCAAGAACAAAGAAAGAATCAGCTTTGATGACACTGATAAGCTTGAGTACCTCAAAATGGTTATCAAAGAAACATGGAGGTTACATCCTACAACACCTCTTCTAATCCCAAGGGAAGCAATGTCTGAATTTGAGATCAACGGCTACACGATTCCAGTTAAGACACGGCTTCACGTGAATGTATGGGCTATTGGTCGTGATCCCGATACCTGGAAAGACCCTGAAGTGTTTCTCCCGGAGAGGTTTACGGATAATAATATTGATGCAAAAGGACAGCATTTTGAGCTGTTACCGTTTGGAGGCGGCCGGAGAATGTGTCCTGCAGTTTATATGGGGACAACAATGGTCGAGTTTGGTTTGGCTAATCTTTTGTATCATTTTGATTGGAAGTTACCAGAAGGCATGAAGGTTGACGATATTGACATGGAAGAAGCTCCCGGACTCACTGTCAACAAGAAAAACGAGCTTATACTTGTGCCAACGAAGTTTCTAGATCCTTAA

SEQ ID NO: 131 - DNA, 1419 bp, Arabidopsis thaliana
  misc_feature (1)..(1419): Ceres cDNA ID no. 4932153
  misc_feature (1)..(1419): Also known as  Ceres CDNA ID no. 24371021
atggagccatggattgacgaattaaccgacgacttacagagtgtaagctttacatcagccggaaccaccgtgaatcgaagcacaagctccggttctcgctcttcctcctccgccgcagctttaacaccagcaccatcagctcacggttcattctcatcttcgaaactccctccttcactccgatcatctctctcactctccgatctcagattccgtctccgtctcggttccggcgacatcggctctgttttcttagccgaattcaaatccctaaccgccgtaacagaaaccaccgccgttaaattacctctgttagcagcgaaagttatggataaaaaggagctcgcgagcagaagcaaagaaggtagagctaagacggagagagagattctcgaatctcttgatcatccgtttcttccgacgctttacgccgccattgattctccgaaatggctctgtttattaacggagttttgtcccggcggtgaccttcacgttctccgtcaaaaacagactcataaacgtttccatgaatccgccgtcagattctatgtatcggaagtgatcgtagcgattgaatatcttcacatgttggggattgtgtaccgcgatttgaagcctgagaacgtgctggttcgatcagatggtcacatcatgttaactgattttgatctctccttaaaatgtgatgaatcgacttccacaccacagatagtgctgaaccggaacaatcttcctaatggctcgtctgaccagaacgagaaccaaggcatggaccaccgtcaaaccacatcatcctcttgcatgatccctaactgtattgtccctgctgtctcttgcttccacccgagaatccgaaggcgtaagaagaaaactgatcaccgtaacaacggtcctgagcttgtggctgaacctgtagatgtccggtccatgtcattcgttgggacgcatgagtacttggctcctgagattgtttcagtttatataatgtataattttccgatgtggtatcctaacatgaaacgtaaaatgtggatggcaggagaaggacatggtagtgcagtggactggtggacattagggatattcatgttcgagctgttctacggaacaacaccgttcaaaggaatggaccacgagctaacccttgccaatatcgtggctcgagcactcgaattcccgaaagaaccaacgattccaagcgcggccaaggatctgatctctcagctacttgccaaggatcctagccgacggttagggtcatctctaggtgcaacggccgtgaaacgtcatccatttttccaaggagtgaattgggcattgctcatgtgtactcgtcctccttttcttcctccgcctttccgcaaagaacttttgtcagatgacatttgtccggaaacccatgtcgactattattaa

SEQ ID NO: 132 - protein, 1419 aa, Arabidopsis thaliana
ATGGAGCCATGGATTGACGAATTAACCGACGACTTACAGAGTGTAAGCTTTACATCAGCCGGAACCACCGTGAATCGAAGCACAAGCTCCGGTTCTCGCTCTTCCTCCTCCGCCGCAGCTTTAACACCAGCACCATCAGCTCACGGTTCATTCTCATCTTCGAAACTCCCTCCTTCACTCCGATCATCTCTCTCACTCTCCGATCTCAGATTCCGTCTCCGTCTCGGTTCCGGCGACATCGGCTCTGTTTTCTTAGCCGAATTCAAATCCCTAACCGCCGTAACAGAAACCACCGCCGTTAAATTACCTCTGTTAGCAGCGAAAGTTATGGATAAAAAGGAGCTCGCGAGCAGAAGCAAAGAAGGTAGAGCTAAGACGGAGAGAGAGATTCTCGAATCTCTTGATCATCCGTTTCTTCCGACGCTTTACGCCGCCATTGATTCTCCGAAATGGCTCTGTTTATTAACGGAGTTTTGTCCCGGCGGTGACCTTCACGTTCTCCGTCAAAAACAGACTCATAAACGTTTCCATGAATCCGCCGTCAGATTCTATGTATCGGAAGTGATCGTAGCGATTGAATATCTTCACATGTTGGGGATTGTGTACCGCGATTTGAAGCCTGAGAACGTGCTGGTTCGATCAGATGGTCACATCATGTTAACTGATTTTGATCTCTCCTTAAAATGTGATGAATCGACTTCCACACCACAGATAGTGCTGAACCGGAACAATCTTCCTAATGGCTCGTCTGACCAGAACGAGAACCAAGGCATGGACCACCGTCAAACCACATCATCCTCTTGCATGATCCCTAACTGTATTGTCCCTGCTGTCTCTTGCTTCCACCCGAGAATCCGAAGGCGTAAGAAGAAAACTGATCACCGTAACAACGGTCCTGAGCTTGTGGCTGAACCTGTAGATGTCCGGTCCATGTCATTCGTTGGGACGCATGAGTACTTGGCTCCTGAGATTGTTTCAGTTTATATAATGTATAATTTTCCGATGTGGTATCCTAACATGAAACGTAAAATGTGGATGGCAGGAGAAGGACATGGTAGTGCAGTGGACTGGTGGACATTAGGGATATTCATGTTCGAGCTGTTCTACGGAACAACACCGTTCAAAGGAATGGACCACGAGCTAACCCTTGCCAATATCGTGGCTCGAGCACTCGAATTCCCGAAAGAACCAACGATTCCAAGCGCGGCCAAGGATCTGATCTCTCAGCTACTTGCCAAGGATCCTAGCCGACGGTTAGGGTCATCTCTAGGTGCAACGGCCGTGAAACGTCATCCATTTTTCCAAGGAGTGAATTGGGCATTGCTCATGTGTACTCGTCCTCCTTTTCTTCCTCCGCCTTTCCGCAAAGAACTTTTGTCAGATGACATTTGTCCGGAAACCCATGTCGACTATTATTAA

SEQ ID NO: 133 - DNA, 1449 bp, Arabidopsis thaliana
  misc_feature (1)..(1449): Ceres cDNA ID no. 4933244
  misc_feature (1)..(1449): Also known as  Ceres CDNA ID no. 24371021
atatttttgtgattagaaattaggatcttacagaaatctttcaaaaaaaaattcataacagttccattttttttggtaagattcataaaaaaattcaagttaaatgcattttataaaaatgtaggaaaaactttcatcaaaaatcgttgagaagaacatacagtatatcttatccactctcttcctcatccacgcggcaaaggcacaaacctctttagaaaaatgtcgtcagcttattgttcctccgccgtggctgtatccgccgcagccaccgcttcctccgccgctacctttaatccattactctcctcccactccaattcccaactcttctatcgctttacaccaaaatccttcaaactcgttgccaattgccctaatccactaatcctccactcaaatatccgccgccaccgcttcttctgcgccgccgaaaccgaagctagttccgccgatgatgaaatccaggcatcagtagaagaagaagaagaggtagaagaagaaggagatgaaggtgaagaagaagtagaggaagaaaaacagacgacgcaagcgagtggtgaagaagggaggctttacgttgggaatttaccttacacaatcacttcttctgagctctctcagatttttggagaagctggaactgtcgtcgatgttcagattgtttatgataaagttactgatagaagcagaggatttggatttgtaacaatgggaagcattgaagaagctaaagaagcgatgcagatgtttaacagctctcaaattggtggtagaacggtgaaagtgaacttcccggaggtgccgagaggcggtgagaacgaagtaatgagaaccaaaatccgtgataataaccggagttatgttgatagtcctcataaggtatatgcaggaaaccttggttggaatctaacctcacaaggtttaaaggatgcatttggtgatcaacctggtgtgcttggtgctaaagttatctatgaaagaaatactgggaggtctagggggtttggtttcatctcgttcgagtcagcggaaaatgttcagtctgctttggctacaatgaatggcgtggaagttgaaggacgagcgctgaggctaaatttggcttcagagagagagaaacccactgtgtctcctccttccgtagaagaaggagaaaccgaggaggccagtctagagagtaacgaggtgctttcgaatgttagtgcatgaagcagcaaaagcacaatagattccggataagtttcagactgatctgctcgaggtgccaaaaatgaaaattttgttgtctttataaatgtgttgttttgttctagtgaggctgaagaagaagacaatatatgagatagaaaacaagagattgtttgtaatttttattgagaatgtttttaatccataaatggtgtaatgtaacaacatatcttgattccagtaaactgcaaatttctg

SEQ ID NO: 134 - protein, 1449 aa, Arabidopsis thaliana
ATATTTTTGTGATTAGAAATTAGGATCTTACAGAAATCTTTCAAAAAAAAATTCATAACAGTTCCATTTTTTTTGGTAAGATTCATAAAAAAATTCAAGTTAAATGCATTTTATAAAAATGTAGGAAAAACTTTCATCAAAAATCGTTGAGAAGAACATACAGTATATCTTATCCACTCTCTTCCTCATCCACGCGGCAAAGGCACAAACCTCTTTAGAAAAATGTCGTCAGCTTATTGTTCCTCCGCCGTGGCTGTATCCGCCGCAGCCACCGCTTCCTCCGCCGCTACCTTTAATCCATTACTCTCCTCCCACTCCAATTCCCAACTCTTCTATCGCTTTACACCAAAATCCTTCAAACTCGTTGCCAATTGCCCTAATCCACTAATCCTCCACTCAAATATCCGCCGCCACCGCTTCTTCTGCGCCGCCGAAACCGAAGCTAGTTCCGCCGATGATGAAATCCAGGCATCAGTAGAAGAAGAAGAAGAGGTAGAAGAAGAAGGAGATGAAGGTGAAGAAGAAGTAGAGGAAGAAAAACAGACGACGCAAGCGAGTGGTGAAGAAGGGAGGCTTTACGTTGGGAATTTACCTTACACAATCACTTCTTCTGAGCTCTCTCAGATTTTTGGAGAAGCTGGAACTGTCGTCGATGTTCAGATTGTTTATGATAAAGTTACTGATAGAAGCAGAGGATTTGGATTTGTAACAATGGGAAGCATTGAAGAAGCTAAAGAAGCGATGCAGATGTTTAACAGCTCTCAAATTGGTGGTAGAACGGTGAAAGTGAACTTCCCGGAGGTGCCGAGAGGCGGTGAGAACGAAGTAATGAGAACCAAAATCCGTGATAATAACCGGAGTTATGTTGATAGTCCTCATAAGGTATATGCAGGAAACCTTGGTTGGAATCTAACCTCACAAGGTTTAAAGGATGCATTTGGTGATCAACCTGGTGTGCTTGGTGCTAAAGTTATCTATGAAAGAAATACTGGGAGGTCTAGGGGGTTTGGTTTCATCTCGTTCGAGTCAGCGGAAAATGTTCAGTCTGCTTTGGCTACAATGAATGGCGTGGAAGTTGAAGGACGAGCGCTGAGGCTAAATTTGGCTTCAGAGAGAGAGAAACCCACTGTGTCTCCTCCTTCCGTAGAAGAAGGAGAAACCGAGGAGGCCAGTCTAGAGAGTAACGAGGTGCTTTCGAATGTTAGTGCATGAAGCAGCAAAAGCACAATAGATTCCGGATAAGTTTCAGACTGATCTGCTCGAGGTGCCAAAAATGAAAATTTTGTTGTCTTTATAAATGTGTTGTTTTGTTCTAGTGAGGCTGAAGAAGAAGACAATATATGAGATAGAAAACAAGAGATTGTTTGTAATTTTTATTGAGAATGTTTTTAATCCATAAATGGTGTAATGTAACAACATATCTTGATTCCAGTAAACTGCAAATTTCTG

SEQ ID NO: 135 - DNA, 2412 bp, Arabidopsis thaliana
  misc_feature (1)..(2412): Ceres cDNA ID no. 4933882
  misc_feature (1)..(2412): Also known as  Ceres CDNA ID no. 24371021
atgattgttttgggtataaaacccgataattatgcgttccctgctttgctaaaggctgtagcagatcttcaggacatggaactggggaaacagattcatgcccatgtgtataaatttgggtacggtgtggattccgtgactgtggctaatacccttgtgaatttgtatagaaagtgtggagatttcggagctgtctataaggtgttcgatagaatatctgagagaaaccaagtctcttggaattctttaatttcttctttgtgtagttttgagaagtgggaaatggcgttagaggcatttcggtgtatgttggatgaaaatgtggaacctagttcgtttaccttggtgagtgtggttactgcttgttcgaatttgcctatgcctgagggattaatgatgggtaagcaggttcacgcctatggtttgagaaagggtgaattgaattcgtttataatcaacacattggtggctatgtatggtaaactgggaaaattagcatcttctaaagtcttacttggttcttttggaggccgtgacttggtcacatggaacactgtgttgagctcgttatgtcagaacgagcagttgcttgaagcattggaatatttgcgtgaaatggtgcttgaaggtgttgaaccagatgagttcactatttcaagtgttcttcctgcttgttcacacttggagatgcttcgcacagggaaagaattgcatgcttatgctttgaaaaatggctctttggatgagaattcctttgttggtagtgctttggttgacatgtattgcaattgcaagcaagtgttgagtggtcgtcgagtatttgatggaatgtttgatagaaagattggtctgtggaatgctatgatcgctgggtattcccagaatgagcatgacaaggaagcgttgttgcttttcattggaatggaagaaagtgctgggcttctggctaactctaccacaatggcaggtgttgttcctgcttgtgtccgttctggtgcgttctctagaaaggaagctatccatggatttgttgtgaagagaggtttagatagagacaggtttgtgcagaatacactgatggatatgtattctaggctgggaaagatcgatatcgccatgcggatattcggtaaaatggaagatagagatttagttacgtggaacacgatgattacgggttatgtattctcagaacaccatgaggacgcacttctcctgctacacaagatgcaaaaccttgaaagaaaagtgagcaagggggctagccgagttagtcttaaacctaattccatcactctgatgacaatccttcccagttgtgctgcactatcagcattagcaaaaggaaaagaaattcatgcttatgccatcaagaacaatttggcaactgatgtggctgtcggaagcgctttagttgacatgtacgcaaaatgcgggtgcctacagatgtcgagaaaagtgtttgatcagattccacaaaaaaatgttattacttggaatgtgattataatggcttacgggatgcatggaaacggtcaagaagccatagatctgctaagaatgatgatggttcagggagtaaaaccaaacgaggttacattcatctcagtatttgcagcttgtagccactcaggcatggtggatgaaggattaaggatattctatgttatgaaacccgactacggggttgaaccaagctcagatcattatgcttgtgttgtagatttgcttggaagggctggtagaattaaagaagcatatcaactcatgaatatgatgcctcgtgatttcaacaaagctggagcatggagtagcctccttggtgccagtcggattcacaataacctagaaattggagaaattgctgctcaaaatctcattcaactggaaccaaatgtagctagtcactatgtgttacttgccaatatttattcatcagcaggcctctgggataaagcaacagaggtaagaagaaatatgaaagagcaaggcgtgagaaaagaacctggatgtagctggattgagcatggcgatgaagtacataaatttgtagccggtgactcatctcacccgcaaagcgaaaagctcagtggatatctcgagacattgtgggagagaatgagaaaagaaggatatgtacctgacacatcttgtgtactccacaatgtagaggaagatgaaaaagagattctgctttgtggacacagtgagaagctagcaattgcgtttgggatacttaacacatcacccggtacaattattagggtggctaaaaacctcagggtttgtaatgattgtcatcttgcaaccaagtttatctcaaagattgttgatagagaaatcatcttgagagatgttaggaggtttcatcgtttcaagaatggaacttgctcctgtggagactattggtga

SEQ ID NO: 136 - protein, 2412 aa, Arabidopsis thaliana
ATGATTGTTTTGGGTATAAAACCCGATAATTATGCGTTCCCTGCTTTGCTAAAGGCTGTAGCAGATCTTCAGGACATGGAACTGGGGAAACAGATTCATGCCCATGTGTATAAATTTGGGTACGGTGTGGATTCCGTGACTGTGGCTAATACCCTTGTGAATTTGTATAGAAAGTGTGGAGATTTCGGAGCTGTCTATAAGGTGTTCGATAGAATATCTGAGAGAAACCAAGTCTCTTGGAATTCTTTAATTTCTTCTTTGTGTAGTTTTGAGAAGTGGGAAATGGCGTTAGAGGCATTTCGGTGTATGTTGGATGAAAATGTGGAACCTAGTTCGTTTACCTTGGTGAGTGTGGTTACTGCTTGTTCGAATTTGCCTATGCCTGAGGGATTAATGATGGGTAAGCAGGTTCACGCCTATGGTTTGAGAAAGGGTGAATTGAATTCGTTTATAATCAACACATTGGTGGCTATGTATGGTAAACTGGGAAAATTAGCATCTTCTAAAGTCTTACTTGGTTCTTTTGGAGGCCGTGACTTGGTCACATGGAACACTGTGTTGAGCTCGTTATGTCAGAACGAGCAGTTGCTTGAAGCATTGGAATATTTGCGTGAAATGGTGCTTGAAGGTGTTGAACCAGATGAGTTCACTATTTCAAGTGTTCTTCCTGCTTGTTCACACTTGGAGATGCTTCGCACAGGGAAAGAATTGCATGCTTATGCTTTGAAAAATGGCTCTTTGGATGAGAATTCCTTTGTTGGTAGTGCTTTGGTTGACATGTATTGCAATTGCAAGCAAGTGTTGAGTGGTCGTCGAGTATTTGATGGAATGTTTGATAGAAAGATTGGTCTGTGGAATGCTATGATCGCTGGGTATTCCCAGAATGAGCATGACAAGGAAGCGTTGTTGCTTTTCATTGGAATGGAAGAAAGTGCTGGGCTTCTGGCTAACTCTACCACAATGGCAGGTGTTGTTCCTGCTTGTGTCCGTTCTGGTGCGTTCTCTAGAAAGGAAGCTATCCATGGATTTGTTGTGAAGAGAGGTTTAGATAGAGACAGGTTTGTGCAGAATACACTGATGGATATGTATTCTAGGCTGGGAAAGATCGATATCGCCATGCGGATATTCGGTAAAATGGAAGATAGAGATTTAGTTACGTGGAACACGATGATTACGGGTTATGTATTCTCAGAACACCATGAGGACGCACTTCTCCTGCTACACAAGATGCAAAACCTTGAAAGAAAAGTGAGCAAGGGGGCTAGCCGAGTTAGTCTTAAACCTAATTCCATCACTCTGATGACAATCCTTCCCAGTTGTGCTGCACTATCAGCATTAGCAAAAGGAAAAGAAATTCATGCTTATGCCATCAAGAACAATTTGGCAACTGATGTGGCTGTCGGAAGCGCTTTAGTTGACATGTACGCAAAATGCGGGTGCCTACAGATGTCGAGAAAAGTGTTTGATCAGATTCCACAAAAAAATGTTATTACTTGGAATGTGATTATAATGGCTTACGGGATGCATGGAAACGGTCAAGAAGCCATAGATCTGCTAAGAATGATGATGGTTCAGGGAGTAAAACCAAACGAGGTTACATTCATCTCAGTATTTGCAGCTTGTAGCCACTCAGGCATGGTGGATGAAGGATTAAGGATATTCTATGTTATGAAACCCGACTACGGGGTTGAACCAAGCTCAGATCATTATGCTTGTGTTGTAGATTTGCTTGGAAGGGCTGGTAGAATTAAAGAAGCATATCAACTCATGAATATGATGCCTCGTGATTTCAACAAAGCTGGAGCATGGAGTAGCCTCCTTGGTGCCAGTCGGATTCACAATAACCTAGAAATTGGAGAAATTGCTGCTCAAAATCTCATTCAACTGGAACCAAATGTAGCTAGTCACTATGTGTTACTTGCCAATATTTATTCATCAGCAGGCCTCTGGGATAAAGCAACAGAGGTAAGAAGAAATATGAAAGAGCAAGGCGTGAGAAAAGAACCTGGATGTAGCTGGATTGAGCATGGCGATGAAGTACATAAATTTGTAGCCGGTGACTCATCTCACCCGCAAAGCGAAAAGCTCAGTGGATATCTCGAGACATTGTGGGAGAGAATGAGAAAAGAAGGATATGTACCTGACACATCTTGTGTACTCCACAATGTAGAGGAAGATGAAAAAGAGATTCTGCTTTGTGGACACAGTGAGAAGCTAGCAATTGCGTTTGGGATACTTAACACATCACCCGGTACAATTATTAGGGTGGCTAAAAACCTCAGGGTTTGTAATGATTGTCATCTTGCAACCAAGTTTATCTCAAAGATTGTTGATAGAGAAATCATCTTGAGAGATGTTAGGAGGTTTCATCGTTTCAAGAATGGAACTTGCTCCTGTGGAGACTATTGGTGA

SEQ ID NO: 137 - DNA, 2499 bp, Arabidopsis thaliana
  misc_feature (1)..(2499): Ceres cDNA ID no. 4937095
  misc_feature (1)..(2499): Also known as  Ceres CDNA ID no. 24371021
atggccgatcccgcagctgaatctattgatgcaagttcgtcgcggtttgggagagtcgtatgttataaccaaacggcaatgcatggaagcaacaccatttcagccgcagctcctttctttatgacgcaactgtctgtcgctaatcttacctaccgcatactctactattttcttaagcctctatgtcttcctcctttcgtcgctcaaatactttgcggattactgttcagcccgactgtgctcggcaataacgaagtggtccttaaacttatattcccttataaatatacaatgcttcttgagacattcgcaaacttagctctcgtttacaacgttttcctcctcggtctcggcttggacttgaggatgataaagatcaaagacatcaaaccagtgatcatagccattgttggcctccttgcggctttacttgccggtgctggcttatactaccttcccagtaacggagaggccgacaaaatcctagcaggttgtatgtactggtcgatcgcatttggctgtacaaatttccctgatcttgctaggattcttgcggatctcaagctcttgcgtacggatatgggacatactgcaatgtgtgcagccgttgttactgatttgtgcacttggattctcttcatttttggaatggcgattttttccaaatctggtgtacgcaacgaaatgttgccatactcattagcatcaaccatagcttttgtccttctctgctactttgtgatccaacctggagtggcttggatcttcaacaacaccgtcgaaggaggtcaagtgggagacactcacgtatggtacactctcgctggagtcattatttgcagcttaatcaccgaagtatgtggggttcactcaattaccggagcattcttgttcggtctatcgatccctcatgaccacatcattcgaaaaatgatcgaagagaagctccacgatttcctctcgggaatgctaatgcctcttttctacatcatctgcggtttaagagctgatattggttacatgaacaggaccgtgagcgttggaatgatggcggttgtgacttctgcgtcggttatggtgaagattttgtcaacgatgttttgctccattttcttgcgtatacctttgcgtgatggtttagccattggtgcacttatgaataccaagggaacaatggcactagtcattctcaatgctggacgagacaccaaggcattggacgttattatgtacactcatctgacgttggcgtttctagtgatgtcaatggtggtgcagccactattagccattgcttacaaaccaaagaagaagttgattttctataaaaaccgaaccattcaaaaacacaaaggagagtcagagctttgtgtattgacatgcgtccatgtcctccctaacgtctctggcataaccaatctattacaactctctaacccgaccaagaaatctcctcttaacgtttttgctatccacctagtcgagctaacgggtcgcaccacggcttcgttgctcattatgaacgatgaggccaaaccgaaagctaactttgctgaccgagttagagcggaatctgaccagatcgctgagatgttcacagctctcgaagtgaacaacgacggggtaatggttcagaccattaccgcggtttcaccttacgcaacgatggacgaagatatttgtttgttggccgaggataaacaagcctgcttcattttattgccttaccacaagaatatgacgtcagacggtcggttaaatgaaggtaacgcagtgcacgctgaaatcaaccaaaacgttatgagccacgcgccttgttcggttgggattttggttgaccgtggcatgacgactgtccggtttgaatcttttatgttccaaggcgaaaccacaaagaaagaaatcgccatgctattcctaggaggtcgagacgacagagaggctttggcttacgcttggaggatggtgggacaagaaatggttcaactcacggtcgttagattcgtcccaagccaggaagctttagtctcagccggggaagccgcggacgagtacgagaaggataaacatgtcgatgaagagtccatctacgagtttaacttcaagactatgaatgatccatcagtgacttatgtagagaaagtggttaagaatggccaagaaacgatcacagcgattttagaactggaagataacaattcttacgatctttacattgtgggaagaggatatcaagtagaaacacctgtgacctcagggttgacagattggaatagtactccggatttagggattataggcgatacattaatttcatcaaacttcacaatgcaagcttcggttcttgtggtccaacaatactcttctgctaacagacaaaccgcagaaaacaacaatcaagaacctgtccaaggtaaagccaagaccgatcatgaggctacgccttttatggaagacgaggatgatgaagtagaacatcagtacagtatgcgcagatga

SEQ ID NO: 138 - protein, 2499 aa, Arabidopsis thaliana
ATGGCCGATCCCGCAGCTGAATCTATTGATGCAAGTTCGTCGCGGTTTGGGAGAGTCGTATGTTATAACCAAACGGCAATGCATGGAAGCAACACCATTTCAGCCGCAGCTCCTTTCTTTATGACGCAACTGTCTGTCGCTAATCTTACCTACCGCATACTCTACTATTTTCTTAAGCCTCTATGTCTTCCTCCTTTCGTCGCTCAAATACTTTGCGGATTACTGTTCAGCCCGACTGTGCTCGGCAATAACGAAGTGGTCCTTAAACTTATATTCCCTTATAAATATACAATGCTTCTTGAGACATTCGCAAACTTAGCTCTCGTTTACAACGTTTTCCTCCTCGGTCTCGGCTTGGACTTGAGGATGATAAAGATCAAAGACATCAAACCAGTGATCATAGCCATTGTTGGCCTCCTTGCGGCTTTACTTGCCGGTGCTGGCTTATACTACCTTCCCAGTAACGGAGAGGCCGACAAAATCCTAGCAGGTTGTATGTACTGGTCGATCGCATTTGGCTGTACAAATTTCCCTGATCTTGCTAGGATTCTTGCGGATCTCAAGCTCTTGCGTACGGATATGGGACATACTGCAATGTGTGCAGCCGTTGTTACTGATTTGTGCACTTGGATTCTCTTCATTTTTGGAATGGCGATTTTTTCCAAATCTGGTGTACGCAACGAAATGTTGCCATACTCATTAGCATCAACCATAGCTTTTGTCCTTCTCTGCTACTTTGTGATCCAACCTGGAGTGGCTTGGATCTTCAACAACACCGTCGAAGGAGGTCAAGTGGGAGACACTCACGTATGGTACACTCTCGCTGGAGTCATTATTTGCAGCTTAATCACCGAAGTATGTGGGGTTCACTCAATTACCGGAGCATTCTTGTTCGGTCTATCGATCCCTCATGACCACATCATTCGAAAAATGATCGAAGAGAAGCTCCACGATTTCCTCTCGGGAATGCTAATGCCTCTTTTCTACATCATCTGCGGTTTAAGAGCTGATATTGGTTACATGAACAGGACCGTGAGCGTTGGAATGATGGCGGTTGTGACTTCTGCGTCGGTTATGGTGAAGATTTTGTCAACGATGTTTTGCTCCATTTTCTTGCGTATACCTTTGCGTGATGGTTTAGCCATTGGTGCACTTATGAATACCAAGGGAACAATGGCACTAGTCATTCTCAATGCTGGACGAGACACCAAGGCATTGGACGTTATTATGTACACTCATCTGACGTTGGCGTTTCTAGTGATGTCAATGGTGGTGCAGCCACTATTAGCCATTGCTTACAAACCAAAGAAGAAGTTGATTTTCTATAAAAACCGAACCATTCAAAAACACAAAGGAGAGTCAGAGCTTTGTGTATTGACATGCGTCCATGTCCTCCCTAACGTCTCTGGCATAACCAATCTATTACAACTCTCTAACCCGACCAAGAAATCTCCTCTTAACGTTTTTGCTATCCACCTAGTCGAGCTAACGGGTCGCACCACGGCTTCGTTGCTCATTATGAACGATGAGGCCAAACCGAAAGCTAACTTTGCTGACCGAGTTAGAGCGGAATCTGACCAGATCGCTGAGATGTTCACAGCTCTCGAAGTGAACAACGACGGGGTAATGGTTCAGACCATTACCGCGGTTTCACCTTACGCAACGATGGACGAAGATATTTGTTTGTTGGCCGAGGATAAACAAGCCTGCTTCATTTTATTGCCTTACCACAAGAATATGACGTCAGACGGTCGGTTAAATGAAGGTAACGCAGTGCACGCTGAAATCAACCAAAACGTTATGAGCCACGCGCCTTGTTCGGTTGGGATTTTGGTTGACCGTGGCATGACGACTGTCCGGTTTGAATCTTTTATGTTCCAAGGCGAAACCACAAAGAAAGAAATCGCCATGCTATTCCTAGGAGGTCGAGACGACAGAGAGGCTTTGGCTTACGCTTGGAGGATGGTGGGACAAGAAATGGTTCAACTCACGGTCGTTAGATTCGTCCCAAGCCAGGAAGCTTTAGTCTCAGCCGGGGAAGCCGCGGACGAGTACGAGAAGGATAAACATGTCGATGAAGAGTCCATCTACGAGTTTAACTTCAAGACTATGAATGATCCATCAGTGACTTATGTAGAGAAAGTGGTTAAGAATGGCCAAGAAACGATCACAGCGATTTTAGAACTGGAAGATAACAATTCTTACGATCTTTACATTGTGGGAAGAGGATATCAAGTAGAAACACCTGTGACCTCAGGGTTGACAGATTGGAATAGTACTCCGGATTTAGGGATTATAGGCGATACATTAATTTCATCAAACTTCACAATGCAAGCTTCGGTTCTTGTGGTCCAACAATACTCTTCTGCTAACAGACAAACCGCAGAAAACAACAATCAAGAACCTGTCCAAGGTAAAGCCAAGACCGATCATGAGGCTACGCCTTTTATGGAAGACGAGGATGATGAAGTAGAACATCAGTACAGTATGCGCAGATGA

SEQ ID NO: 139 - DNA, 1899 bp, Arabidopsis thaliana
  misc_feature (1)..(1899): Ceres cDNA ID no. 4939446
atgatgcttcttcttcaccatcattcttcatactgtttctctcaatttctatctgtttcaggatatacttgctcatcagattttatagagatagactacgcctttaagctgttaagaaatctcgtatatagagaagggactgtgacacctggcaatgatgaaacagcacatgttatagaggagcttgaaaacgaaaatgttgtggaagattttgcaaatataacttcgcctgctgggaagtcgtttcttatgggagagagtgtgggatctacacattctgtgagtaacaaaaagacagtcttcaccgattatagttataagttagaccgtgtctggattcaagtgccatctggaggtctctcccctgatgggtcaagatcctcaggaagtggcagaggactgtcgacaacggctgtatcaaatggtggatggagaacccgtgggtttttgcgcggttggcagatccagaataccttatttaacaacatcaagttcatgattctctgctgcttcgtgaccattctcatcctacttggcacaatccgtgttgggaaccttggaagctccaacgccgactctgttaatcagagtttcatcaaggaaaccattccgattctcgcggagatcccctctgattcgcattcgacggacttggctgagcctcctaaagctgatgttagtcccaatgcaacgtatactctagagccaagaatcgcggagatcccatctgatgtgcattcaacggacttggttgagctgcctaaagctgatattagtcccaatgcaacgtatactctaggccccagaatcgcggagatcccatctgattcgcatttgacagacttgcttgagccgcctaaagctgatattagtcccaatgcgacatatactctagggcccaaaatcaccaactgggatagtcaacgcaaggtatggctgaatcagaaccctgagtttcctaatattgtcaatggcaaagctcgaatattgcttctcacagggtcttcccccggaccctgtgataaaccaattggaaactattatctattgaaagctgtgaagaacaagattgattactgtagactccacgggatagagattgtgtataacatggcgaatttggatgaggaactctcagggtattggacgaaattacctatgattaggacattaatgctgtctcatccagaagtagaatggatttggtggatggatagtgatgctttgttcactgatatactgtttgagatcccgttgcctcggtacgaaaatcataatctggtgatacacggttatccagacttgctgttcaaccaaaaatcatgggttgcattgaacacgggtatctttctgttgagaaattgtcagtggtcattggatttattagatgcttgggccccaatgggaccaaaagggaagatccgtgacgaaactgggaagatactgacagcttatctgaaaggcaggccagcatttgaggccgatgatcaatcggcgttgatatatctcttgctttcgcagaaggaaaaatggatagagaaggtttatgtggagaatcaatactacttgcacgggttttgggaaggtttggttgacaggtatgaagagatgatagagaagtatcatccaggattgggcgatgagagatggccctttgtgacacattttgtagggtgcaaaccgtgtggcagctatgctgattacgcagtcgatagatgcttcaagagcatggagagggcttttaattttgcagataatcaagtgctgaagctgtatgggtttagccacaggggactgttgagtcccaagattaaaaggatcagaaatgagacagtctctcctctggagtcagtagacaagtttgatattcgaagaatgcacatggaaaccaaaccatag

SEQ ID NO: 140 - protein, 632 aa, Arabidopsis thaliana
  misc_feature: PFam Name: Glyco_transf_34; PFam Description: galactosyl
  misc_feature: GI Number: 15221850; NR Description: alpha galactosyltransferase, putative; protein id: At1g18690.1
  misc_feature: GI Number: 55956974; NR Description:
  misc_feature: GI Number: 55956972; NR Description:
  misc_feature: GI Number: 55956970; NR Description:
  misc_feature: GI Number: 50909173; NR Description: putative galactomannan galactosyltransferase [Oryza sativa (japonica cultivar-group)] >gi|49388322|dbj|BAD25434.1| putative galactomannan
  misc_feature: Utility: Useful for making plants tolerant to high pH or low
MMLLLHHHSSYCFSQFLSVSGYTCSSDFIEIDYAFKLLRNLVYREGTVTPGNDETAHVIEELENENVVEDFANITSPAGKSFLMGESVGSTHSVSNKKTVFTDYSYKLDRVWIQVPSGGLSPDGSRSSGSGRGLSTTAVSNGGWRTRGFLRGWQIQNTLFNNIKFMILCCFVTILILLGTIRVGNLGSSNADSVNQSFIKETIPILAEIPSDSHSTDLAEPPKADVSPNATYTLEPRIAEIPSDVHSTDLVELPKADISPNATYTLGPRIAEIPSDSHLTDLLEPPKADISPNATYTLGPKITNWDSQRKVWLNQNPEFPNIVNGKARILLLTGSSPGPCDKPIGNYYLLKAVKNKIDYCRLHGIEIVYNMANLDEELSGYWTKLPMIRTLMLSHPEVEWIWWMDSDALFTDILFEIPLPRYENHNLVIHGYPDLLFNQKSWVALNTGIFLLRNCQWSLDLLDAWAPMGPKGKIRDETGKILTAYLKGRPAFEADDQSALIYLLLSQKEKWIEKVYVENQYYLHGFWEGLVDRYEEMIEKYHPGLGDERWPFVTHFVGCKPCGSYADYAVDRCFKSMERAFNFADNQVLKLYGFSHRGLLSPKIKRIRNETVSPLESVDKFDIRRMHMETKP

SEQ ID NO: 141 - DNA, 1182 bp, Arabidopsis thaliana
  misc_feature (1)..(1182): Ceres cDNA ID no. 4952653
  misc_feature (1)..(1182): Also known as  Ceres CDNA ID no. 24371021
atggcggctttacttctcctcaatcgtgtttctcgaagtactagctcaatctctctccaccgggtcgcaggaactctgggtttcaattccttcaatgctcaaattcacggtgacagaatctccggaacactctttcgagtgagatcattagctactcttgctgaaggagcttctcattttaatgagatggtatctgtgaatcagcggaagtattatcttctgggtggtaaaggaggtgttgggaaaacgagctgtgctgcttctcttgcggttaagtttgctagccacggtcatcctaccattgtggtttctactgaccctgctcactccttgagcgattctttttcccaggacttgtcaggaggagtcctaaagcccgttcaaggtgttgattctccacttcttgctcttgagatcacacctgagataatgaaggacgagataaaacgtcagacgggcgataaaagtgtgaaaaatatgatggatagcatggggctcggaatgtttgccggcgagttaggggacttaaatcttgaagatatgctcaacgctgcctctcctggtattgacgaaatagcagctatttccaaggcacttatccctctcagaattcccctgaaaaaatacagtaggttcactcgtatagtttttgatactgctcccacggggcatactctgcggcttctttccctcccagacttctatgattcatccattagcaaaataactaagctcaagaagaaaatcactgcagcagcttcagcctttaagttggtctttggcaaaaaagagatacaacaaaaagaacttcctaacgagttagatcaactgaaagagaggatggagaaagttcgaaatgttttccgtgatgtggacactaccgagtttgttattgtaaccatcccaacggttatggcaataaacgagtcttcaaggttacatgcatctttaagaaaagaaaatgtgccagtccaccggcttattgttaatcagcttctacctcaatctgaatccgattgcaaattttgctcaataagacgaaaggaacaaacgcgtgtgcttggacttattcagaatgatacagaactttcggggttaaaattgatccaatcgccattgctagacgcagagataagaggggttcccgcacttaagttcatgggtgatctcatttggaaataa

SEQ ID NO: 142 - protein, 1182 aa, Arabidopsis thaliana
ATGGCGGCTTTACTTCTCCTCAATCGTGTTTCTCGAAGTACTAGCTCAATCTCTCTCCACCGGGTCGCAGGAACTCTGGGTTTCAATTCCTTCAATGCTCAAATTCACGGTGACAGAATCTCCGGAACACTCTTTCGAGTGAGATCATTAGCTACTCTTGCTGAAGGAGCTTCTCATTTTAATGAGATGGTATCTGTGAATCAGCGGAAGTATTATCTTCTGGGTGGTAAAGGAGGTGTTGGGAAAACGAGCTGTGCTGCTTCTCTTGCGGTTAAGTTTGCTAGCCACGGTCATCCTACCATTGTGGTTTCTACTGACCCTGCTCACTCCTTGAGCGATTCTTTTTCCCAGGACTTGTCAGGAGGAGTCCTAAAGCCCGTTCAAGGTGTTGATTCTCCACTTCTTGCTCTTGAGATCACACCTGAGATAATGAAGGACGAGATAAAACGTCAGACGGGCGATAAAAGTGTGAAAAATATGATGGATAGCATGGGGCTCGGAATGTTTGCCGGCGAGTTAGGGGACTTAAATCTTGAAGATATGCTCAACGCTGCCTCTCCTGGTATTGACGAAATAGCAGCTATTTCCAAGGCACTTATCCCTCTCAGAATTCCCCTGAAAAAATACAGTAGGTTCACTCGTATAGTTTTTGATACTGCTCCCACGGGGCATACTCTGCGGCTTCTTTCCCTCCCAGACTTCTATGATTCATCCATTAGCAAAATAACTAAGCTCAAGAAGAAAATCACTGCAGCAGCTTCAGCCTTTAAGTTGGTCTTTGGCAAAAAAGAGATACAACAAAAAGAACTTCCTAACGAGTTAGATCAACTGAAAGAGAGGATGGAGAAAGTTCGAAATGTTTTCCGTGATGTGGACACTACCGAGTTTGTTATTGTAACCATCCCAACGGTTATGGCAATAAACGAGTCTTCAAGGTTACATGCATCTTTAAGAAAAGAAAATGTGCCAGTCCACCGGCTTATTGTTAATCAGCTTCTACCTCAATCTGAATCCGATTGCAAATTTTGCTCAATAAGACGAAAGGAACAAACGCGTGTGCTTGGACTTATTCAGAATGATACAGAACTTTCGGGGTTAAAATTGATCCAATCGCCATTGCTAGACGCAGAGATAAGAGGGGTTCCCGCACTTAAGTTCATGGGTGATCTCATTTGGAAATAA

SEQ ID NO: 143 - DNA, 876 bp, Arabidopsis thaliana
  misc_feature (1)..(876): Ceres cDNA ID no. 4952989
  misc_feature (1)..(876): Also known as  Ceres CDNA ID no. 24371021
atgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaa

SEQ ID NO: 144 - protein, 876 aa, Arabidopsis thaliana
ATGATTACCGGAGAATCATCGTCACAAAGATCTATCCCAACGCCGTTTCTCACAAAAACGTTTAACCTCGTTGAAGATAGTTCCATCGACGATGTTATCTCATGGAACGAAGATGGTTCCTCTTTCATCGTATGGAATCCGACAGATTTCGCTAAAGATTTGCTTCCTAAACACTTCAAACACAACAATTTCTCTAGTTTCGTTCGTCAGCTCAACACTTACGGATTCAAAAAAGTTGTACCGGATCGATGGGAGTTTTCAAACGATTTCTTTAAGAGAGGAGAAAAACGTCTTCTCCGTGAGATCCAACGTCGGAAAATAACAACGACGCATCAAACAGTTGTTGCTCCTTCGTCGGAACAACGAAACCAGACGATGGTTGTATCACCGTCAAATTCCGGGGAAGATAATAATAATAATCAGGTGATGTCTTCGTCTCCGTCGTCGTGGTATTGTCATCAAACGAAGACGACTGGGAATGGTGGTTTATCAGTGGAGTTATTGGAAGAGAACGAGAAGCTTCGGAGTCAAAACATTCAGCTAAACCGTGAGCTTACTCAGATGAAATCTATCTGCGATAATATCTATAGTCTCATGTCGAATTACGTCGGATCTCAGCCCACTGATCGGAGTTATTCTCCCGGAGGTAGTAGTAGTCAACCGATGGAGTTTTTACCGGCGAAGCGGTTTTCGGAGATGGAGATTGAAGAAGAAGAAGAAGCGAGTCCGAGGTTGTTTGGTGTTCCGATTGGGTTAAAACGGACGAGAAGTGAAGGTGTTCAGGTGAAGACGACGGCGGTGGTTGGGGAAAATTCCGATGAGGAGACGCCGTGGTTGAGACATTATAATCGAACCAATCAGAGAGTTTGTAATTAA

SEQ ID NO: 145 - DNA, 1485 bp, Arabidopsis thaliana
  misc_feature (1)..(1485): Ceres cDNA ID no. 4953117
atgatgatggcgcttactcaactggttccttcttctccagagaagctgttctgtttctccagcttcttcctcccttcaattcctctggagattcgtagaagtaacgtaactacgaaaaccagttccaagaaactcggaagtctgtctttgaacatctcatgttcagctcacaagattgttcggagtccatctttagacagacatgtagtgaagcagaacagagttcgctttgtgcagaagttgaacactttgcttctctctaaaccaaagcattacattccaattgaaatcctctataaatgtcgttcttacctctgcatcgaaaatccattggccattctctcaatgatccgtcggtatcctacaatctttgaactttttacgacacctacgccacatttgcctatgaatgccactaagccgttatctcaactctgtgttcgtttgacatcggctgcatcatcccttgcaatgcaagaattgaatctgaagtctgagatctctgataaattggctactaagctccagaagctactaatgttgtcatctcaccgcaggttgcttttgtctaaactggttcacattgccccagattttggcttccctcctaatttcaggtctcggctctgcaatgactatccggacaagttcaagactgtggatacttcctatggaagagcactggagcttgtctcgtcggatcccgaattggcgaaccaaatgccatctcctgaagttgataggggtttgattgttgatcgtcctttgaagttcaagcgcttgaatcttcggagaggtttaaatttgaagagacggcaccaaggtttcttgataaagttcagagaatcacctgacgtgtgtccttacaaaatgtcatctgactatctggcaagtgagtcaattgaggcggagaagcgagcttgcgcagttgtaagagaggtgttggggttaacggttgagaaaaggaccttgattgatcatttgacacatttcaggaaggagttttctttaccaaataagttaagagacttgattgtgagacatccagagctattctatgtgagtataaaaggcatgagagactctgtgtttctcgttgaagcatacaatgacaatggtgatcttctagataaagatgagagattggtgataagagaacgtttgatagatcttattcaagaaggaaagagaattagacgtgaacgaagaagaaaaggcgccacacttggtgataaaagcgtggaagagaaaaggaaagatgatgaaacaattgatgattatgatagtgatctggatgatgaatatgaagatgggtttgagaatttgtttgactcagaagatttaggtgtggaatatcatttcgacgaagaagatgatgatgatgaggcaggggttaatggtgaaagtgtagagtattggagtagaaagctttcgtcttcaggtagtagcagtgatgaagcaaatagtgctgtggaatcatggtga

SEQ ID NO: 146 - protein, 494 aa, Arabidopsis thaliana
  misc_feature: GI Number: 21593983; NR Description: unknown [Arabidopsis thaliana]
  misc_feature: GI Number: 50908051; NR Description: tyrosine-specific protein phosphatase-like [Oryza sativa (japonica cultivar-group)] >gi|47496868|dbj|BAD19832.1| tyrosine-specific protein
  misc_feature: GI Number: 34912696; NR Description: P0686E09.18 [Oryza sativa (japonica cultivar-group)] >gi|13365580|dbj|BAB39125.1|
MMMALTQLVPSSPEKLFCFSSFFLPSIPLEIRRSNVTTKTSSKKLGSLSLNISCSAHKIVRSPSLDRHVVKQNRVRFVQKLNTLLLSKPKHYIPIEILYKCRSYLCIENPLAILSMIRRYPTIFELFTTPTPHLPMNATKPLSQLCVRLTSAASSLAMQELNLKSEISDKLATKLQKLLMLSSHRRLLLSKLVHIAPDFGFPPNFRSRLCNDYPDKFKTVDTSYGRALELVSSDPELANQMPSPEVDRGLIVDRPLKFKRLNLRRGLNLKRRHQGFLIKFRESPDVCPYKMSSDYLASESIEAEKRACAVVREVLGLTVEKRTLIDHLTHFRKEFSLPNKLRDLIVRHPELFYVSIKGMRDSVFLVEAYNDNGDLLDKDERLVIRERLIDLIQEGKRIRRERRRKGATLGDKSVEEKRKDDETIDDYDSDLDDEYEDGFENLFDSEDLGVEYHFDEEDDDDEAGVNGESVEYWSRKLSSSGSSSDEANSAVESW

SEQ ID NO: 147 - DNA, 2097 bp, Arabidopsis thaliana
  misc_feature (1)..(2097): Ceres cDNA ID no. 4957791
  misc_feature (1)..(2097): Also known as  Ceres CDNA ID no. 24371021
atggaatctgaaatcgcctccgagtttcttcctttctgccggatttacaaagacggtcgtgtagaacgactcatcggcaccgataccatcccggcctctctagatccaacatacgacgtcgtttcaaaagacgttatatactcaccggagaataacctctccgttcgtctcttcctccctcacaaatcaacaaaactcaccgccggtaacaagctccctctacttatctacatccacggcggagcttggatcatcgagtcacctttctccccactctaccacaattacctcactgaagtagtcaaatccgctaactgcctcgctgtctctgttcagtatcgccgtgcaccggaagatcctgttccggcggcttatgaagatgtatggtccgcgattcagtggatttttgctcattctaatggatctggtcctgtagattggattaacaaacacgccgatttcggtaaagttttcctcggcggagatagcgcaggcggtaacatatcgcatcacatggcgatgaaagctggtaaagagaagaagctagatctcaaaatcaaaggtattgctgttgttcatccagctttctggggaacagatccggttgatgaatacgatgtgcaagataaagaaacgagaagcggaatcgcggaaatttgggagaagattgcgagtccgaatagtgttaatgggacggatgatccgttgtttaatgtaaacggatccgggtcggatttttctgggttgggatgtgataaggttttggttgcggtagctgggaaagatgtgtttgttaggcaaggattggcttatgcggcgaagctggagaagtgtgagtgggaaggtactgttgaggtggttgaggaagaaggtgaggaccatgtgtttcatttgcagaatcctaaatctgataaggctttgaaattcttgaagaagtttgtcgagtttattattgaaaatattccgggaaccatgctccgaagaatcacttgttcttcttcacttgcttcaccctctctcttcctccgcttctttcgccaactccctcgctcttactcctcaccgaccaccatcgccgtctcaggccgcaacattcgccgactatcaactccaaccactcttcgttgcatttgttcacactcttcatctgaaatcatctccgagcatcctccgttcgtcagggtttacaaagacggtcgtatcgaacgtctttccggcaccgaaacagtcccggcttctctaaacccacgaaacgacgtcgtttcaaaagacgttgtctactcaccggggcataacctctccgttcgtctctttctccctcacaaatcaacacaactcgccgccggtaacaaactccctctacttatctacttccacggcggagcttggataaacgaatcccctttctccccaatctaccacaatttcctcacggaggtagttaaatccgctaactgcctcgccgtctcggttcaataccgccgtgcaccggaagatccggttccggctgcctatgaagatacatggtctgctattcaatggattttctcacattcctgtggatctggtgaagaagattggattaacaaatacgctgatttcgaaagagtttttctcgccggagatagtgccggtggtaatatatctcatcacatggctatgagagctggtaaagagaagcttaagcctagaatcaaagggactgtgattgtgcatccagcgatttgggggaaagatccggtcgatgagcacgatgtgcaagatagagagatcagagacggagttgcagaagtttgggagaaaattgtgagtccgaatagtgttgatggagcggatgatccgtggtttaatgtggttggatccgggtcgaatttttccgggatgggatgtgacaaggttttggttgaggtggctgggaaagatgtgttttggcggcaaggattagcttacgcggcgaagctaaagaagagtgggtggaaaggagaggtggaggtgattgaggaagaagatgaagagcattgcttccatctcttaaatccaagttctgaaaatgctcccagcttcatgaagagatttgtggagtttatcactggttaa

SEQ ID NO: 148 - protein, 2097 aa, Arabidopsis thaliana
ATGGAATCTGAAATCGCCTCCGAGTTTCTTCCTTTCTGCCGGATTTACAAAGACGGTCGTGTAGAACGACTCATCGGCACCGATACCATCCCGGCCTCTCTAGATCCAACATACGACGTCGTTTCAAAAGACGTTATATACTCACCGGAGAATAACCTCTCCGTTCGTCTCTTCCTCCCTCACAAATCAACAAAACTCACCGCCGGTAACAAGCTCCCTCTACTTATCTACATCCACGGCGGAGCTTGGATCATCGAGTCACCTTTCTCCCCACTCTACCACAATTACCTCACTGAAGTAGTCAAATCCGCTAACTGCCTCGCTGTCTCTGTTCAGTATCGCCGTGCACCGGAAGATCCTGTTCCGGCGGCTTATGAAGATGTATGGTCCGCGATTCAGTGGATTTTTGCTCATTCTAATGGATCTGGTCCTGTAGATTGGATTAACAAACACGCCGATTTCGGTAAAGTTTTCCTCGGCGGAGATAGCGCAGGCGGTAACATATCGCATCACATGGCGATGAAAGCTGGTAAAGAGAAGAAGCTAGATCTCAAAATCAAAGGTATTGCTGTTGTTCATCCAGCTTTCTGGGGAACAGATCCGGTTGATGAATACGATGTGCAAGATAAAGAAACGAGAAGCGGAATCGCGGAAATTTGGGAGAAGATTGCGAGTCCGAATAGTGTTAATGGGACGGATGATCCGTTGTTTAATGTAAACGGATCCGGGTCGGATTTTTCTGGGTTGGGATGTGATAAGGTTTTGGTTGCGGTAGCTGGGAAAGATGTGTTTGTTAGGCAAGGATTGGCTTATGCGGCGAAGCTGGAGAAGTGTGAGTGGGAAGGTACTGTTGAGGTGGTTGAGGAAGAAGGTGAGGACCATGTGTTTCATTTGCAGAATCCTAAATCTGATAAGGCTTTGAAATTCTTGAAGAAGTTTGTCGAGTTTATTATTGAAAATATTCCGGGAACCATGCTCCGAAGAATCACTTGTTCTTCTTCACTTGCTTCACCCTCTCTCTTCCTCCGCTTCTTTCGCCAACTCCCTCGCTCTTACTCCTCACCGACCACCATCGCCGTCTCAGGCCGCAACATTCGCCGACTATCAACTCCAACCACTCTTCGTTGCATTTGTTCACACTCTTCATCTGAAATCATCTCCGAGCATCCTCCGTTCGTCAGGGTTTACAAAGACGGTCGTATCGAACGTCTTTCCGGCACCGAAACAGTCCCGGCTTCTCTAAACCCACGAAACGACGTCGTTTCAAAAGACGTTGTCTACTCACCGGGGCATAACCTCTCCGTTCGTCTCTTTCTCCCTCACAAATCAACACAACTCGCCGCCGGTAACAAACTCCCTCTACTTATCTACTTCCACGGCGGAGCTTGGATAAACGAATCCCCTTTCTCCCCAATCTACCACAATTTCCTCACGGAGGTAGTTAAATCCGCTAACTGCCTCGCCGTCTCGGTTCAATACCGCCGTGCACCGGAAGATCCGGTTCCGGCTGCCTATGAAGATACATGGTCTGCTATTCAATGGATTTTCTCACATTCCTGTGGATCTGGTGAAGAAGATTGGATTAACAAATACGCTGATTTCGAAAGAGTTTTTCTCGCCGGAGATAGTGCCGGTGGTAATATATCTCATCACATGGCTATGAGAGCTGGTAAAGAGAAGCTTAAGCCTAGAATCAAAGGGACTGTGATTGTGCATCCAGCGATTTGGGGGAAAGATCCGGTCGATGAGCACGATGTGCAAGATAGAGAGATCAGAGACGGAGTTGCAGAAGTTTGGGAGAAAATTGTGAGTCCGAATAGTGTTGATGGAGCGGATGATCCGTGGTTTAATGTGGTTGGATCCGGGTCGAATTTTTCCGGGATGGGATGTGACAAGGTTTTGGTTGAGGTGGCTGGGAAAGATGTGTTTTGGCGGCAAGGATTAGCTTACGCGGCGAAGCTAAAGAAGAGTGGGTGGAAAGGAGAGGTGGAGGTGATTGAGGAAGAAGATGAAGAGCATTGCTTCCATCTCTTAAATCCAAGTTCTGAAAATGCTCCCAGCTTCATGAAGAGATTTGTGGAGTTTATCACTGGTTAA

SEQ ID NO: 149 - DNA, 1378 bp, Arabidopsis thaliana
  misc_feature (1)..(1378): Ceres cDNA ID no. 4957818
gtttcttcttcacactctgattctcttactatttgactctgttgttgttgttattgttgtgatatcaagagagtgggtttgagatcatgccaaattctggaaaaagtttgagtttttaattcgaatcgagaaaaaataaaaatgggttctttaggtgatgagcttagtttgggatcgatctttgggagaggagtttcgatgaatgttgtggcggttgagaaagttgatgaacatgttaagaagcttgaagaagagaagagaaagctcgaaagttgtcaacttgagcttcctctgtctttgcagattttaaacgatgcgattttgtatctgaaggataagagatgttcagagatggagactcaaccattgttgaaagatttcatttctgttaataaacctattcaaggagaaagaggaatagaattgctgaaaagagaggagctaatgagggagaagaagtttcagcaatggaaagctaatgatgatcacactagtaagatcaagagcaagcttgagattaagagaaatgaggagaaatctcctatgttgttgattccaaaggtggaaactggtttaggcctcggtttaagttcgagttcgataagaagaaaagggattgttgcctcatgtggctttacttctaactctatgccacaaccaccaacaccagcagtaccacaacaaccagcatttcttaagcagcaagctttacggaagcaaagaaggtgttggaatccagagttgcatcgccgatttgtcgatgcattgcaacagctaggtggaccgggagtggcaactcctaaacaaattagagaacatatgcaagaagaaggcttaaccaatgatgaagtcaagagtcatttacagaaatacaggttacacatcaggaagccaaattcgaatgcggagaaacaatcagcagttgttttagggtttaacttgtggaattcttcagcacaagatgaagaagagacatgtgaaggaggagaatcattgaagagaagcaatgcgcaatcagattctcctcaaggtcctttgcagttaccgtctacaacaacaacaactggtggagatagtagcatggaagatgttgaagatgctaagtctgagagctttcaactggagagattgagatcaccataaatctcaagaaaccaaactcttgatcacggttttgttattttggattcattactatatctattagtagtgaatgagaacaataattatagaaaggtttatagatatatatatagagaaaaagagagagtgaggatggttcaaattatttgcagagattatacttagccttgtttttgtaaacggctttttttggttgggtttttatttttcttgaggcattatccaatattcaagt

SEQ ID NO: 150 - protein, 333 aa, Arabidopsis thaliana
  misc_feature: PFam Name: Myb_DNA-binding; PFam Description: Myb-like
  misc_feature: GI Number: 21554992; NR Description: unknown [Arabidopsis thaliana]
  misc_feature: GI Number: 21593572; NR Description: unknown [Arabidopsis thaliana]
  misc_feature: GI Number: 18419989; NR Description: putative cytoskeletal
  misc_feature: GI Number: 21553699; NR Description: unknown [Arabidopsis thaliana]
  misc_feature: GI Number: 50933785; NR Description: putative cytoskeletal protein-like protein [Oryza sativa (japonica cultivar-group)] >gi|33146555|dbj|BAC79732.1| putative cytoskeletal protein-like
MGSLGDELSLGSIFGRGVSMNVVAVEKVDEHVKKLEEEKRKLESCQLELPLSLQILNDAILYLKDKRCSEMETQPLLKDFISVNKPIQGERGIELLKREELMREKKFQQWKANDDHTSKIKSKLEIKRNEEKSPMLLIPKVETGLGLGLSSSSIRRKGIVASCGFTSNSMPQPPTPAVPQQPAFLKQQALRKQRRCWNPELHRRFVDALQQLGGPGVATPKQIREHMQEEGLTNDEVKSHLQKYRLHIRKPNSNAEKQSAVVLGFNLWNSSAQDEEETCEGGESLKRSNAQSDSPQGPLQLPSTTTTTGGDSSMEDVEDAKSESFQLERLRSP

SEQ ID NO: 151 - DNA, 1311 bp, Arabidopsis thaliana
  misc_feature (1)..(1311): Ceres cDNA ID no. 4963751
atgctaaattcgtctggagtaagaactcaacgaagaagcccaagacctttgtctctaggaggtagaaagattattactccaacaaaatttgcttatgatcatcataatcctgataaagttttggattttgtagaaatggattgcttagaacccaaaacaaagaacaatctcactggaaagcttctcttagtagcttcactcttaattttagccattattgtgatcagtcaatcttcaagtttcacatctccaagcgcgttttctcaaagagaggaaggagtgactcatgtgttagtcactggtggtgctggttatatcgggtcacatgcggctttaagacttcttagagattcataccgcgtaaccattgtggacaatctttcgcgtggaaatcttggtgcggttaagactttacagcaattattcccgcagacaggaagacttcagttcatttatgctgacttaggagatcccttagcggtcgagaaaatcttctcggagaatgcttttgacgctgtaatgcattttgctgcggtagcttatgtcggagaaagcactctttatcctctaaaatattaccataacattacatcaaacacgttaggagttcttgaagctatggctagacataaagtaaagaaactgatatattctagcacttgtgctacatatggagagcctgaaaaaatgccgattactgaagacactccacaggtaccgattaatccatacggaaaagctaaaaagatggcagaggatatgatcttggatttctcaaagaactctgacatggcggttatgatcttaagatacttcaatgtgattggttcagatccaggaggtagattaggagaagcgccaagacccgaacttcgtgagcaaggaaggatttctggtgcttgtttcgatgcagctcgtggtttcattcccggactacaagtgaaaggaacggattacaaaacatcggacggtacttgcattagagactatatagatgttactgacctcgtggatgctcacgtgaaggctctcgagaaagctcagcctcgaaaagtcggtatctacaatgttggaaccggaaaagggagatcggttaaagaattcgttgaggcatgtaagaaggcgacaggagttgagatcaaagtagatttcttgcctcgacgaccgggagattacgcagaggtttacagtgatccaacaaagattttgaaagatttgaattggactgctcgattcactaatcttcaagatagtcttcaagttgcttggagatggcaaaaaattcatcctcatggatataattcttattaa

SEQ ID NO: 152 - protein, 436 aa, Arabidopsis thaliana
  misc_feature: PFam Name: Epimerase; PFam Description: NAD dependent
  misc_feature: GI Number: 51978946; NR Description: PREDICTED P0495H05.61 gene product [Oryza sativa (japonica cultivar-group)] >gi|51963258|ref|XP_506159.1| PREDICTED P0495H05.61 gene product
  misc_feature: GI Number: 51964664; NR Description: PREDICTED P0582D05.120 gene product [Oryza sativa (japonica cultivar-group)] >gi|27529690|dbj|BAC53786.1| UDP-galactose 4-epimerase-like protein
  misc_feature: GI Number: 25553524; NR Description: UDP-galactose
  misc_feature: GI Number: 50934141; NR Description: putative UDP-glucose 4-epimerase [Oryza sativa (japonica cultivar-group)] >gi|27260937|dbj|BAC45055.1| putative UDP-glucose 4-epimerase [Oryza sativa (japonica cultivar-group)]
  misc_feature: GI Number: 24417398; NR Description: unknown [Arabidopsis thaliana]
MLNSSGVRTQRRSPRPLSLGGRKIITPTKFAYDHHNPDKVLDFVEMDCLEPKTKNNLTGKLLLVASLLILAIIVISQSSSFTSPSAFSQREEGVTHVLVTGGAGYIGSHAALRLLRDSYRVTIVDNLSRGNLGAVKTLQQLFPQTGRLQFIYADLGDPLAVEKIFSENAFDAVMHFAAVAYVGESTLYPLKYYHNITSNTLGVLEAMARHKVKKLIYSSTCATYGEPEKMPITEDTPQVPINPYGKAKKMAEDMILDFSKNSDMAVMILRYFNVIGSDPGGRLGEAPRPELREQGRISGACFDAARGFIPGLQVKGTDYKTSDGTCIRDYIDVTDLVDAHVKALEKAQPRKVGIYNVGTGKGRSVKEFVEACKKATGVEIKVDFLPRRPGDYAEVYSDPTKILKDLNWTARFTNLQDSLQVAWRWQKIHPHGYNSY

SEQ ID NO: 153 - DNA, 687 bp, Arabidopsis thaliana
  misc_feature (1)..(687): Ceres cDNA ID no. 4965037
  misc_feature (1)..(687): Also known as  Ceres CDNA ID no. 24371021
atgtcttactcaaacgcctacgcaccgtcggcaccggagctaccagaatcgttcgttcagcagcagcacgatggtgaaagtagatacacttacgcgtatccatcatatcaaccaactcagcaattcagctcttactccgggatgttttccccggaaacgcatccggagattgtgaggagctttgagtcggcggatagaaaccggagcggatttctcgaagaatcggagctccggcaagcgttgtcgttatctgggtacgatggaattagtaacagaacgattaggttgctgttgtttatttacaagattcctgtagattctctgcttcggcttggtcctaaggagtatgttgagttatggaactgccttgcgcaatggcgtgcaatatttaacaggtacgatagagataggagtggaaagatgaattctacccagctcagagacgctttctataatctcgggtgcgtgcttccaacctcggttcaccagcttatcgtatctcagtttgatgatgggactggcaaaactgttgacctatgtttcgacagcttcctcgagtgtgggatgattgtgaagggattgacagagaagttcagggagaacgaccctggttacacaggctacgcaacgctctcttacgatgtcttcatgttgatggtcattccgttcatcgccacctatgattaa

SEQ ID NO: 154 - protein, 687 aa, Arabidopsis thaliana
ATGTCTTACTCAAACGCCTACGCACCGTCGGCACCGGAGCTACCAGAATCGTTCGTTCAGCAGCAGCACGATGGTGAAAGTAGATACACTTACGCGTATCCATCATATCAACCAACTCAGCAATTCAGCTCTTACTCCGGGATGTTTTCCCCGGAAACGCATCCGGAGATTGTGAGGAGCTTTGAGTCGGCGGATAGAAACCGGAGCGGATTTCTCGAAGAATCGGAGCTCCGGCAAGCGTTGTCGTTATCTGGGTACGATGGAATTAGTAACAGAACGATTAGGTTGCTGTTGTTTATTTACAAGATTCCTGTAGATTCTCTGCTTCGGCTTGGTCCTAAGGAGTATGTTGAGTTATGGAACTGCCTTGCGCAATGGCGTGCAATATTTAACAGGTACGATAGAGATAGGAGTGGAAAGATGAATTCTACCCAGCTCAGAGACGCTTTCTATAATCTCGGGTGCGTGCTTCCAACCTCGGTTCACCAGCTTATCGTATCTCAGTTTGATGATGGGACTGGCAAAACTGTTGACCTATGTTTCGACAGCTTCCTCGAGTGTGGGATGATTGTGAAGGGATTGACAGAGAAGTTCAGGGAGAACGACCCTGGTTACACAGGCTACGCAACGCTCTCTTACGATGTCTTCATGTTGATGGTCATTCCGTTCATCGCCACCTATGATTAA

SEQ ID NO: 155 - DNA, 858 bp, Arabidopsis thaliana
  misc_feature (1)..(858): Ceres cDNA ID no. 4965975
  misc_feature (1)..(858): Also known as  Ceres CDNA ID no. 24371021
atgtcagaccaagaggctcctctgcgtaatggagtagaacacaagattttcgaagtacttccgtttgtggatgatgattacggtggagtcatcgtggagatgaaaactcctatggatactaagaatttcgttgcagcgcttagagattcattcgagcagtggcgcttacagggtaaaaagggagtctggttgaacttgcctctctcacacgtaaacctcgtggaacccgcggttaaggaaggtttccggtatcaccatgctgagccaacttacctgatgctagtttattggattccggaagccgagagtactattcctttgaatgcttcccatcgtgttcgtgtaggtgctgttgtcttgaaccataacaaagaggaaaaatacggttcattatgcggatcaggtatctggaagatcccaacaggagttgttgacgagggtgaggagattttcgccgcagccattagagaagtaaaagaagaaacaggcgtaagaagatccatatatcttaatatcgacactgagtttttggagattctagctttctgccaaacccacgagtcattttttgcaaagtcagatttattcttcgtttgtctcttgagacctacctccttcgatattcaaaaacaggacttagagatcgaagcagctcaatggatgcggttcgaggactctgcctctcaacctatcacacacaagaacgatctcttcaaagatattcaccacatttgctcaatgaaaatggagaagagctatagtggtttttcaaaaaaacctattacaactttctttgacgacaagttaggttatctctacttgaataaacaagaagatatggaacaacctatttcttaa

SEQ ID NO: 156 - protein, 858 aa, Arabidopsis thaliana
ATGTCAGACCAAGAGGCTCCTCTGCGTAATGGAGTAGAACACAAGATTTTCGAAGTACTTCCGTTTGTGGATGATGATTACGGTGGAGTCATCGTGGAGATGAAAACTCCTATGGATACTAAGAATTTCGTTGCAGCGCTTAGAGATTCATTCGAGCAGTGGCGCTTACAGGGTAAAAAGGGAGTCTGGTTGAACTTGCCTCTCTCACACGTAAACCTCGTGGAACCCGCGGTTAAGGAAGGTTTCCGGTATCACCATGCTGAGCCAACTTACCTGATGCTAGTTTATTGGATTCCGGAAGCCGAGAGTACTATTCCTTTGAATGCTTCCCATCGTGTTCGTGTAGGTGCTGTTGTCTTGAACCATAACAAAGAGGAAAAATACGGTTCATTATGCGGATCAGGTATCTGGAAGATCCCAACAGGAGTTGTTGACGAGGGTGAGGAGATTTTCGCCGCAGCCATTAGAGAAGTAAAAGAAGAAACAGGCGTAAGAAGATCCATATATCTTAATATCGACACTGAGTTTTTGGAGATTCTAGCTTTCTGCCAAACCCACGAGTCATTTTTTGCAAAGTCAGATTTATTCTTCGTTTGTCTCTTGAGACCTACCTCCTTCGATATTCAAAAACAGGACTTAGAGATCGAAGCAGCTCAATGGATGCGGTTCGAGGACTCTGCCTCTCAACCTATCACACACAAGAACGATCTCTTCAAAGATATTCACCACATTTGCTCAATGAAAATGGAGAAGAGCTATAGTGGTTTTTCAAAAAAACCTATTACAACTTTCTTTGACGACAAGTTAGGTTATCTCTACTTGAATAAACAAGAAGATATGGAACAACCTATTTCTTAA

SEQ ID NO: 157 - DNA, 4167 bp, Arabidopsis thaliana
  misc_feature (1)..(4167): Ceres cDNA ID no. 4974769
atgtccaccgttaatcatcactgcctcctcaattttcctcatatcccaccttcaattcctccgaatcatcgtcccaaacttctttcttctctctccctctatcgaaaaccagaacgcctctttgctctctctgcgtctctgtctctttcaccagcaacaatccatgaatgttcttcttcctcatcttcttcttcttcatcgttcgataaagaagaaacggaagacattgaatctgttattgatgggtttttctatctgcttcgattgtctgctcaataccacgacgtcgaggtaacaaaagctgtgcacgcttcgtttcttaagctcagagaagaaaaaacccgtcttggaaatgcccttatctctacttatctcaaacttggtttccctcgtgaagctattctcgtcttcgtgtctctgtcttcgccaacggtggtttcttacacagctcttatctcgggtttctcaaggttaaaccttgaaattgaggctcttaaggttttcttcaggatgagaaaagcaggtcttgttcagccgaatgagtatacttttgtagcgattttgactgcttgcgtgagagtttcccgattctcgcttgggattcagattcatggattgatagttaaatcagggtttttgaattctgtgtttgttagtaattcgctgatgagtttgtatgataaggattctgggtcttcgtgtgatgatgtgcttaagttgttcgatgaaattcctcagagagatgtggcgtcttggaacactgtggtttcgagtttagtgaaagagggcaagtctcataaagctttcgatttgttttatgagatgaatagagtcgaaggatttggagttgatagttttacgctttcaacgcttttgagctcttgtactgattctagtgtcttattgagaggtagagaactccatggtcgtgcaattaggatagggttgatgcaggagttgagtgtgaacaacgctctgattgggttttattctaaattttgggatatgaaaaaggtagagagtttatacgagatgatgatggcgcaagatgctgttactttcacggagatgatcacagcttacatgtcatttggaatggtggattccgctgttgagatattcgcgaatgtaactgaaaaaaacactattacgtataatgcgctcatggctgggttctgtagaaatggccatggcttgaaggcactaaaattattcactgatatgctgcagagaggtgttgagttgacggattttagtttaacaagcgctgttgatgcttgtggtttagtttcagagaagaaagtaagcgaacagattcacgggttttgtattaagtttggaactgctttcaacccttgtatccagactgcattgcttgatatgtgcacaaggtgtgaaaggatggcagatgctgaggagatgtttgaccaatggccttctaatctcgatagctcgaaagcaacgacgtctataatcggtggttacgctcggaatggcttacctgataaggctgtatcgctattccatcgcactctctgtgaacagaagttgtttttagatgaagtttcgttgactttgattcttgcggtctgcgggacattaggttttcgggaaatgggttatcagatccattgctatgctcttaaagctgggtacttttctgatataagcttgggaaattctttgattagcatgtacgcgaaatgttgtgactcagatgatgccataaagattttcaacactatgcgagaacatgatgttatttcttggaacagcttgatttcttgctacatccttcaaagaaatggtgatgaggcactggctctatggtcgaggatgaatgagaaagagatcaagcctgacataatcaccctcactcttgttatttctgcatttcggtatacagagtcaaataagcttagtagctgccgtgatctgtttctctccatgaagactatctatgacattgaaccaacgactgaacattacactgcattcgtccgtgttcttggtcattggggtcttcttgaagaagcggaagacacaataaactcaatgccggttcagcccgaggtctctgttttgagagctctgcttgatagctgcagaatacattcaaacacaagcgttgcgaaacgagtagcaaagcttatactatctacaaagccagaaaccccgtctgagtacatcctcaaatccaacatctactcagcttccggattctggcatcgctctgaaatgataagagaggaaatgcgggaaagaggttaccggaaacatcctgctaaaagctggataatccatgagaacaaaatacattcctttcacgcgcgtgacacatcccacccgcaagagaaagacatatacaggggattggagatactgataatggaatgtctgaaagttggatacgaaccaaacacagagtatgttcttcaggaggttgatgagtttatgaagaagagtttcttgtttcaccacagcgcgaaactcgcagtgacttatggaattctctcgagcaatactcggggcaagccggttcgggttatgaagaacgtaatgctctgtggtgattgccacgagttcttcaagtatatttcagttgtgatcatgggagatgaagatgttgatgggaagtgtaaaaacatgtctgcatgttcctcaacgacgtcgtattcaactaaactctttctattcatggttcctcttgttgtcatttctggtttcgtctttgtaaatattggtcctaaagattcaacttctttattaacctctctgtccactactacttctcatcttcctcctccgtttctgtctacggctccggcaccggcgccatctcctctgctaccggagatacttccctcgttgccagcatcatctttatcgactaaagtggaatctattcagggtgattataatcgcacaattcaactgaatatgatcaacgttactgcaacgagtaataacgtctcttctacggcatcattggaaccaaagaaaagaagagttcttagcaatttagagaagatagaattcaagctacaaaaagctcgagcctccattaaagccgcttcgatggatgatcccgtggacgacccggactatgttcctcttggtcctatgtattggaacgctaaggtctttcatcggagttacttggagatggagaaacaattcaagatatatgtatacaaagaaggcgagccaccgttgttccatgacggtccatgcaaaagcatctactctatggaaggaagtttcatctatgagatagaaaccgatacacgttttcggaccaataatcccgacaaggctcatgttttttatctaccatttagtgtcgtcaagatggtaagatacgtgtatgaacgaaattcccgcgatttcagccccatccgaaatacagtcaaggattacatcaatcttgtgggtgataaatacccatattggaaccgcagcatcggagccgatcatttcatactttcttgtcacgattggggtcctgaggcaagcttctctcatccacatctaggacataattcgattagagctttgtgcaatgccaacacgtcagagagattcaaaccaagaaaagatgtgtcgataccggagatcaatctaaggacgggatccttaactggattggtcggtggaccgtcaccttccagccgtcccatcctcgccttctttgcagggggtgtacacggaccggtaaggccagtcttgctccagcattgggagaacaaagataatgacattagagtccacaagtatctccctagaggaacgtcttattctgacatgatgcggaacagcaagttctgcatttgtcctagcggttatgaggttgcgagcccgaggatcgtggaggcactctactcgggttgcgtcccggttttgataaactcaggatatgttcctccgttcagcgatgtactgaactggagatcgttctcggtgatcgtttcagtggaagacataccgaatttgaaaacgatattgacatctatatcgccgagacagtacttaaggatgtacagaagagtgttgaaggtaaggagacattttgaggtgaattctccggctaagaggtttgatgtgtttcatatgattcttcattcgatttgggtgaggagattgaatgtgaagattcgtgaagtctaa

SEQ ID NO: 158 - protein, 1388 aa, Arabidopsis thaliana
  misc_feature: PFam Name: Exostosin; PFam Description: Exostosin family
  misc_feature: PFam Name: PPR; PFam Description: PPR repeat
  misc_feature: GI Number: 9758008; NR Description: contains similarity to
  misc_feature: GI Number: 50934821; NR Description: putative pectin-glucuronyltransferase [Oryza sativa (japonica cultivar-group)] >gi|34394611|dbj|BAC83913.1| putative pectin-glucuronyltransferase [Oryza sativa (japonica
  misc_feature: GI Number: 50934497; NR Description: selenium-binding protein-like [Oryza sativa (japonica cultivar-group)] >gi|34394447|dbj|BAC83621.1| selenium-binding protein-like [Oryza
  misc_feature: GI Number: 51477380; NR Description: EXO [Cucumis melo]
  misc_feature: GI Number: 42565357; NR Description: exostosin family protein
MSTVNHHCLLNFPHIPPSIPPNHRPKLLSSLSLYRKPERLFALSASLSLSPATIHECSSSSSSSSSSFDKEETEDIESVIDGFFYLLRLSAQYHDVEVTKAVHASFLKLREEKTRLGNALISTYLKLGFPREAILVFVSLSSPTVVSYTALISGFSRLNLEIEALKVFFRMRKAGLVQPNEYTFVAILTACVRVSRFSLGIQIHGLIVKSGFLNSVFVSNSLMSLYDKDSGSSCDDVLKLFDEIPQRDVASWNTVVSSLVKEGKSHKAFDLFYEMNRVEGFGVDSFTLSTLLSSCTDSSVLLRGRELHGRAIRIGLMQELSVNNALIGFYSKFWDMKKVESLYEMMMAQDAVTFTEMITAYMSFGMVDSAVEIFANVTEKNTITYNALMAGFCRNGHGLKALKLFTDMLQRGVELTDFSLTSAVDACGLVSEKKVSEQIHGFCIKFGTAFNPCIQTALLDMCTRCERMADAEEMFDQWPSNLDSSKATTSIIGGYARNGLPDKAVSLFHRTLCEQKLFLDEVSLTLILAVCGTLGFREMGYQIHCYALKAGYFSDISLGNSLISMYAKCCDSDDAIKIFNTMREHDVISWNSLISCYILQRNGDEALALWSRMNEKEIKPDIITLTLVISAFRYTESNKLSSCRDLFLSMKTIYDIEPTTEHYTAFVRVLGHWGLLEEAEDTINSMPVQPEVSVLRALLDSCRIHSNTSVAKRVAKLILSTKPETPSEYILKSNIYSASGFWHRSEMIREEMRERGYRKHPAKSWIIHENKIHSFHARDTSHPQEKDIYRGLEILIMECLKVGYEPNTEYVLQEVDEFMKKSFLFHHSAKLAVTYGILSSNTRGKPVRVMKNVMLCGDCHEFFKYISVVIMGDEDVDGKCKNMSACSSTTSYSTKLFLFMVPLVVISGFVFVNIGPKDSTSLLTSLSTTTSHLPPPFLSTAPAPAPSPLLPEILPSLPASSLSTKVESIQGDYNRTIQLNMINVTATSNNVSSTASLEPKKRRVLSNLEKIEFKLQKARASIKAASMDDPVDDPDYVPLGPMYWNAKVFHRSYLEMEKQFKIYVYKEGEPPLFHDGPCKSIYSMEGSFIYEIETDTRFRTNNPDKAHVFYLPFSVVKMVRYVYERNSRDFSPIRNTVKDYINLVGDKYPYWNRSIGADHFILSCHDWGPEASFSHPHLGHNSIRALCNANTSERFKPRKDVSIPEINLRTGSLTGLVGGPSPSSRPILAFFAGGVHGPVRPVLLQHWENKDNDIRVHKYLPRGTSYSDMMRNSKFCICPSGYEVASPRIVEALYSGCVPVLINSGYVPPFSDVLNWRSFSVIVSVEDIPNLKTILTSISPRQYLRMYRRVLKVRRHFEVNSPAKRFDVFHMILHSIWVRRLNVKIREV

SEQ ID NO: 159 - DNA, 1428 bp, Arabidopsis thaliana
  misc_feature (1)..(1428): Ceres cDNA ID no. 4978521
atgggaaatacatttggttcaagtttggcgagtttattcttcttgtgggcaactattcaacaaatcttcccaaaccatctcagaatcgccattaaagagtttcttatctccacaatacaacaactctcatttgtccagagattttccgacagattcatcaacttcttttcgccttatgtcgaaatcagcttctctcaatacgaagattatcaattcaatcacgcatttgcagccattgagacttaccttggggcaaaagcaactgataaagccaagcatctaagagcaagccaagttaaagagagtaaaggtttggtcttgaaacgagacgagactaaagtccgagatgagtatgaaggaggtactgtctggtgggagatggaaaccgactccacaggatatagaacattcaaactcactttccatagacgctcgcgagatattgtaaccgactcttacataaaatatgtttttgaagaaggcaaatcgattcaagccaagagcaagcagatgaagttgttcacaaataatccgagttctcactggggcactagcaagaagagtttttggagatatattgattttgagcatcccgcaagttttcacacgctagctatggatacaaagaagaaagaggagatcttgaatgatcttgctgcgtttagcaatggtaaagagtattacaagaaaataggtaaagcttggaagaggggttacttgctacatggaccaccagggaccggtaaatcaacaatgatcgctgcaatggcgaatcatttaaactatagtatctatgatcttgaactcacggctatacgtaacaactcggagttgaggaagctactcactgctacttctagcaagtcgatcatcgtgattgaagatatagattgttctttggatcttacgggaaagagaaagaaagagaaaaacttgatgacctcgagagaagatggagaacaaggtaccgaagaagacaagagttttgtaacactctcggggcttttgaacttcattgatggcatttggtctgcttgtggacaagagaggattattatcttcactacgaatcactttgagaaacttgacccggctttgatcaggagagggagaatggacatgcatattgagttgtcatactgttctttcgaggcgtttaagattctcgccaagaactatcttgatcttgatactcatcctctattcaagaagatcgaatcattattgaaggaaacgaagatcgcaccagctgatgttgctgagaacttgatgaagaagaatactgaaatagatgctgatggatctcttaaagatctaattcaagctctggaggggaagaagaagattcatggagctcaagtagatgaaccgaaggacaaatataccaagaagttttataaagcattttgcatgtcatctaaagcctga

SEQ ID NO: 160 - protein, 475 aa, Arabidopsis thaliana
  misc_feature: PFam Name: AAA; PFam Description: ATPase family associated
  misc_feature: GI Number: 10176992; NR Description: contains similarity to
  misc_feature: GI Number: 9294271; NR Description: mitochondrial
  misc_feature: GI Number: 9294274; NR Description: mitochondrial
  misc_feature: GI Number: 61656802; NR Description: Cell Division Protein
  misc_feature: GI Number: 45735466; NR Description: putative ATPase
MGNTFGSSLASLFFLWATIQQIFPNHLRIAIKEFLISTIQQLSFVQRFSDRFINFFSPYVEISFSQYEDYQFNHAFAAIETYLGAKATDKAKHLRASQVKESKGLVLKRDETKVRDEYEGGTVWWEMETDSTGYRTFKLTFHRRSRDIVTDSYIKYVFEEGKSIQAKSKQMKLFTNNPSSHWGTSKKSFWRYIDFEHPASFHTLAMDTKKKEEILNDLAAFSNGKEYYKKIGKAWKRGYLLHGPPGTGKSTMIAAMANHLNYSIYDLELTAIRNNSELRKLLTATSSKSIIVIEDIDCSLDLTGKRKKEKNLMTSREDGEQGTEEDKSFVTLSGLLNFIDGIWSACGQERIIIFTTNHFEKLDPALIRRGRMDMHIELSYCSFEAFKILAKNYLDLDTHPLFKKIESLLKETKIAPADVAENLMKKNTEIDADGSLKDLIQALEGKKKIHGAQVDEPKDKYTKKFYKAFCMSSKA

SEQ ID NO: 161 - DNA, 1110 bp, Arabidopsis thaliana
  misc_feature (1)..(1110): Ceres cDNA ID no. 4982905
atgatgcatgaaatggcatacaaagtgtgtgtggagaaagtgaagagtttgggaattgagttcactactcctatagaagaaaccctcagagacactattgttagccttatggaggattataaagagaggtcaaaggagattatgaacggcggaggaaagttggtctgcgtcaccggagcttccggttacatagcgtcttggattgtcaagcttttgctcctccgtggctacaccgtcaaggccactgttcgagatctaacggacaggaagaaaacagaacatcttcttgcacttgatggtgcaaaagaaagactcaaattgttcaaagcagatcttttggaagaatcttctttcgaacaagctattgaaggatgtgacgctgtcttccacaccgcatctccagttttcttcaccgtcaaagatcctcagactgagctgattgatccagccttaaagggtactatgaacgtccttaatacatgcaaagaaactccctctgtcagaagggtcattctgacatcatccacggctgcggttctctttcgtcagccacctgtggaggcaagcgatgtggtggacgagactttcttctccgatccaagtctatgcagggagacaaagaattggtatccactctccaaaattttggcagagaatgcagcgtgggaatttgccaaagacaacggaatcgacatggtcgtgttgaatccaggatttatattcggaccactcttgcaaccaactctgaacttttcggtagagctaattgtggatttcataaatggtaagaatcctttcaatagtagattctacaggttcgtggacgtaagagatgttgccttagctcatatcaaagctctggagactccttcagccaatggcagatacatcattgatggtccaattatgagtgtaagtgacattatagatattctgcgggagctacttccagacttgtgtattgctgatacgaatgaagaaagtgtgatgaatgaaatgttatgcaaagtgtgtgtggagaaagtgaagaatttgggagttgagttcactccaatgaaatcgagccttagagacactattgttagcctcaaggagaaatgtcttttatga

SEQ ID NO: 162 - protein, 369 aa, Arabidopsis thaliana
  misc_feature: PFam Name: Epimerase; PFam Description: NAD dependent
  misc_feature: PFam Name: 3Beta_HSD; PFam Description: 3-beta
  misc_feature: GI Number: 15217528; NR Description: putative cinnamyl alcohol dehydrogenase; protein id: At1g09480.1 [Arabidopsis
  misc_feature: GI Number: 56121906; NR Description: At1g09510 [Arabidopsis thaliana] gi|42561864|ref|NP_172422.2| cinnamyl-alcohol dehydrogenase family / CAD family [Arabidopsis thaliana]
  misc_feature: GI Number: 30697406; NR Description: cinnamyl-alcohol
  misc_feature: GI Number: 12597772; NR Description: cinnamyl alcohol
  misc_feature: GI Number: 30681183; NR Description: cinnamyl-alcohol
MMHEMAYKVCVEKVKSLGIEFTTPIEETLRDTIVSLMEDYKERSKEIMNGGGKLVCVTGASGYIASWIVKLLLLRGYTVKATVRDLTDRKKTEHLLALDGAKERLKLFKADLLEESSFEQAIEGCDAVFHTASPVFFTVKDPQTELIDPALKGTMNVLNTCKETPSVRRVILTSSTAAVLFRQPPVEASDVVDETFFSDPSLCRETKNWYPLSKILAENAAWEFAKDNGIDMVVLNPGFIFGPLLQPTLNFSVELIVDFINGKNPFNSRFYRFVDVRDVALAHIKALETPSANGRYIIDGPIMSVSDIIDILRELLPDLCIADTNEESVMNEMLCKVCVEKVKNLGVEFTPMKSSLRDTIVSLKEKCLL

SEQ ID NO: 163 - DNA, 1269 bp, Arabidopsis thaliana
  misc_feature (1)..(1269): Ceres cDNA ID no. 4983857
  misc_feature (1)..(1269): Also known as  Ceres CDNA ID no. 24371021
atgggtggagaagagagatcaggagatggagaaaaaagaggggaagaagtagttgatgctggttctctcttcgtccttaaatccaaaggatgggctgccgggatatcttgtctggtcggaggagcagccgttactttctactcgtacactcttctttctcttactctcgaacaccacgcttctctcggcaaccgttacctccgcttccgtgacatggctcatcacatcctcagtccgaaatggggaaggtactacgttggaccaatacaaatggcggtgtgctatggtgtggttattgccaatgcgctcttgggagggcaatgcctaaaggcaatgtacttggtagtgcagccaaatggggaaatgaaactctttgagtttgtgattatttttggatgcttacttttggttttggcacaattcccatcctttcactctctacgatacatcaactcactgtctctcctcctctgcctcctctacagtgcttctgccgctgctgcatccatctacattggaaaagaaccaaatgcaccagagaaggactatactatagttggtgatccagaaactagagtgtttggaatctttaatgctatggctattattgctactacatacggcaatggcattatacctgaaattcaggcaacaatatcggcaccagtgaaaggaaaaatgatgaaagggttgtgtatgtgttaccttgtagtaataatgacatttttcacagtagccatcacaggatattgggcattcggtaaaaaagccaatggacttatcttcaccaatttcttaaatgccgagacaaaccattactttgtccctacttggtttatttttctcgtcaatctcttcactgtccttcaactttcggccgttgctgtggtatacctacaacctataaacgatattttggaaagtgtgatcagcgatccaacaaagaaagaattctctatccgcaatgtcatccctcgactagttgtgcgttccctcttcgtcgtgatggctacaatcgttgcggcaatgcttccattttttggagatgtaaactccttgttaggcgctttcggttttatacctctagacttcgttcttcctgtagttttcttcaactttactttcaagccgtctaaaaaaagtttcattttttggatcaacactgtgatcgccgtggttttttcgtgtttaggggtgattgctatggtagcggcggttagacagattataatagatgccaatacgtataagttgtttgcggatgtataa

SEQ ID NO: 164 - protein, 1269 aa, Arabidopsis thaliana
ATGGGTGGAGAAGAGAGATCAGGAGATGGAGAAAAAAGAGGGGAAGAAGTAGTTGATGCTGGTTCTCTCTTCGTCCTTAAATCCAAAGGATGGGCTGCCGGGATATCTTGTCTGGTCGGAGGAGCAGCCGTTACTTTCTACTCGTACACTCTTCTTTCTCTTACTCTCGAACACCACGCTTCTCTCGGCAACCGTTACCTCCGCTTCCGTGACATGGCTCATCACATCCTCAGTCCGAAATGGGGAAGGTACTACGTTGGACCAATACAAATGGCGGTGTGCTATGGTGTGGTTATTGCCAATGCGCTCTTGGGAGGGCAATGCCTAAAGGCAATGTACTTGGTAGTGCAGCCAAATGGGGAAATGAAACTCTTTGAGTTTGTGATTATTTTTGGATGCTTACTTTTGGTTTTGGCACAATTCCCATCCTTTCACTCTCTACGATACATCAACTCACTGTCTCTCCTCCTCTGCCTCCTCTACAGTGCTTCTGCCGCTGCTGCATCCATCTACATTGGAAAAGAACCAAATGCACCAGAGAAGGACTATACTATAGTTGGTGATCCAGAAACTAGAGTGTTTGGAATCTTTAATGCTATGGCTATTATTGCTACTACATACGGCAATGGCATTATACCTGAAATTCAGGCAACAATATCGGCACCAGTGAAAGGAAAAATGATGAAAGGGTTGTGTATGTGTTACCTTGTAGTAATAATGACATTTTTCACAGTAGCCATCACAGGATATTGGGCATTCGGTAAAAAAGCCAATGGACTTATCTTCACCAATTTCTTAAATGCCGAGACAAACCATTACTTTGTCCCTACTTGGTTTATTTTTCTCGTCAATCTCTTCACTGTCCTTCAACTTTCGGCCGTTGCTGTGGTATACCTACAACCTATAAACGATATTTTGGAAAGTGTGATCAGCGATCCAACAAAGAAAGAATTCTCTATCCGCAATGTCATCCCTCGACTAGTTGTGCGTTCCCTCTTCGTCGTGATGGCTACAATCGTTGCGGCAATGCTTCCATTTTTTGGAGATGTAAACTCCTTGTTAGGCGCTTTCGGTTTTATACCTCTAGACTTCGTTCTTCCTGTAGTTTTCTTCAACTTTACTTTCAAGCCGTCTAAAAAAAGTTTCATTTTTTGGATCAACACTGTGATCGCCGTGGTTTTTTCGTGTTTAGGGGTGATTGCTATGGTAGCGGCGGTTAGACAGATTATAATAGATGCCAATACGTATAAGTTGTTTGCGGATGTATAA

SEQ ID NO: 165 - DNA, 887 bp, Arabidopsis thaliana
  misc_feature (1)..(887): Ceres cDNA ID no. 4992853
aaaggttccttgtttttccagacaaagaaaacacaaattcattccctcctcctcttcatctcttttgcagatatggatggttattattctctgtctcccatctctgtcctccaccggattaaagattccttccatttcgccgtctctgcccttctcgccaacctcttctccgctctcttcaccttcttcttcgctttaggggctttgatcggccaagaaacagagagcggtttcatcagaggagccgccgttggtgctatctcaggcgccgtcttctccatcgaagtctttgaatcttccctcctcctttggcaatccgatgagtctggaattggatgccttctctacttgccttttgagcgggaggcttgttcgtgagcgtatcggtcctgcaatgctaagtgccgtccagagtcagatgggagctgtggagtcccagttccaagatcatacagacatctttgacactgccatttcaaagggtctcactggggactctctcaacaggatccctaaggtccgaatcacagacacctctccggagattgtctcttgctctgtctgccttcaggactttcaggtgggagagacagttagaagtttgccgcactgccatcatatgttccacctaccatgcatcgacaaatggcttcgcaggcatgcttcttgtcccttgtgcagaagacatctttgaattgattttgaactcttctttcttctcttctttgtacatgaggtataggcatacacacacacacatatatacacactagtagtcttccttgattttttttagattacacgttacacagattttgatgcaccaatcattgtaacttcactcatctcttggagatcctgtttatttatgctacttattcttggct

SEQ ID NO: 166 - protein, 101 aa, Arabidopsis thaliana
  misc_feature: PFam Name: zf-C3HC4; PFam Description: Zinc finger, C3HC4
  misc_feature: GI Number: 27524904; NR Description: NEP1-interacting protein 2 [Arabidopsis thaliana] gi|30680091|ref|NP_179364.2| zinc finger
  misc_feature: GI Number: 27524902; NR Description: NEP1-interacting protein
  misc_feature: GI Number: 38228693; NR Description: zinc finger protein
  misc_feature: GI Number: 18855037; NR Description: putative zinc finger
  misc_feature: GI Number: 51964362; NR Description: PREDICTED OJ1734_E02.21-2 gene product [Oryza sativa (japonica cultivar-group)] >gi|50912677|ref|XP_467746.1| putative NEP1-interacting protein [Oryza sativa (japonica cultivar-group)]
MDGYYSLSPISVLHRIKDSFHFAVSALLANLFSALFTFFFALGALIGQETESGFIRGAAVGAISGAVFSIEVFESSLLLWQSDESGIGCLLYLPFEREACS

SEQ ID NO: 167 - DNA, 1251 bp, Arabidopsis thaliana
  misc_feature (1)..(1251): Ceres cDNA ID no. 4993070
atgggaactggaagctcagagaattatctcaatttcgacataaagaatgctcctttcgatgtttatagaacagaacgtggtggtgaagttacttatcatggtcctggtcagcttgaggaagtagttattcgtgttctttcttcggctttcgccatcaatgcttctcgtctcgacggttttactggagtttgggttggcaacaaaaaaatggcggcgataggtattcgtgtgtcgaaatggatgacatatcatggtctagctcttaatgttacaacagatttaacaccctttaactccatagttccatgtgggataaggaaccgtggggttggaagcgtaaagggtttgattgaggatggagaacattataataagcttgaagatttgcagttgttagatatagctcatgagtcgttactaaaggaattctctgaagtttttcagcttcagatggaaaagcaaacaagatttgatttctctatttctctctccaaagaaagcttatctgcttcttggattgaccacaaagggatggctctggaagctgctttctccatgagtttttgctccttctctgtccctaaagcaatcttctgtgagagagaaacttcatcttttcaacgaatcacctcgagagcaaagggaattgcgggtgagagtcaagttcaaagctctgatggagttgagactcaagtcaaggaaacttctcccaaagtatttgataaactgcctgaaagaaatttagatacttggagcggtggcagagaaacagcaagaggactttcaggttcagtagtaagaaacactgtacgaaaagatactactttacgacatatctcaccttctagtcattcaacaaaggttagaggagataagccagagatttcagggggtgagaagaaagctattgtagatagaagcaaggcctacgtaaagctgaaatctttagggaaagaagtgagagacgcaggctatgtaccagagactaagtatgttcttcacgacattgatgaagaagctaaagagaaagccttgatgcatcatagtgaacggttagctattgctttcgggattataaacactcctccagggacgacaataagggtgatgaagaatctgaggatatgtggagattgccataacttcataaagatattatcgagtatcgaagatagagagatcattgtaagagataacaagaggttccatcattttagagatggtaactgctcttgtggagattattggtag

SEQ ID NO: 168 - protein, 416 aa, Arabidopsis thaliana
  misc_feature: PFam Name: BPL_LipA_LipB; PFam Description: Biotin/lipoate
  misc_feature: PFam Name: FBA_1; PFam Description: F-box associated
  misc_feature: GI Number: 9279668; NR Description: selenium-binding
  misc_feature: GI Number: 22328738; NR Description: similar to putative selenium-binding protein; protein id: At4g16835.1 [Arabidopsis
  misc_feature: GI Number: 20197649; NR Description: putative
  misc_feature: GI Number: 30683021; NR Description: pentatricopeptide (PPR)
  misc_feature: GI Number: 30694644; NR Description: pentatricopeptide (PPR)
MGTGSSENYLNFDIKNAPFDVYRTERGGEVTYHGPGQLEEVVIRVLSSAFAINASRLDGFTGVWVGNKKMAAIGIRVSKWMTYHGLALNVTTDLTPFNSIVPCGIRNRGVGSVKGLIEDGEHYNKLEDLQLLDIAHESLLKEFSEVFQLQMEKQTRFDFSISLSKESLSASWIDHKGMALEAAFSMSFCSFSVPKAIFCERETSSFQRITSRAKGIAGESQVQSSDGVETQVKETSPKVFDKLPERNLDTWSGGRETARGLSGSVVRNTVRKDTTLRHISPSSHSTKVRGDKPEISGGEKKAIVDRSKAYVKLKSLGKEVRDAGYVPETKYVLHDIDEEAKEKALMHHSERLAIAFGIINTPPGTTIRVMKNLRICGDCHNFIKILSSIEDREIIVRDNKRFHHFRDGNCSCGDYW

SEQ ID NO: 169 - DNA, 1531 bp, Arabidopsis thaliana
  misc_feature (1)..(1531): Ceres cDNA ID no. 4996658
  misc_feature (1)..(1531): Also known as  Ceres CDNA ID no. 24371021
atcgtcgtcttctattttttcttctttcttcgatttcataccaaaacaagaactctctgttttcgacaaaaacgaaaccttgagatctattttgattgacttttaagaaagagagagatctttcttagaagattttgtctcgtcggcattgaagatccagggtttgtctttcgaaattcagagagaaaatgggtgatgaggcagagatcaaggaacatttaaagccacaagcttcatctgaaacaatggacaagaaacataatgtgaaagggaagaggttatggcagaaagtcaagtatcaattggtggagtttcattcattgcctgcttatttaagagacaatgagtacatcattggtcattaccgatccgaatggccgatcaaacagattcttctcagcatctttaccattcataatgagactttgaatgtttggacgcacttgattgggtttttcctgtttttggcgctcactatatacactgcaacgaaagtaccgagtgtcgtggatcttcattcgcttcaacaccgtttacccgatttgttgaggaaaacagatctccacaaacttcattctgagctcatggctcgccttccttctagtccatctagttggcatgtgatggaccttctttataactgtttgcctgaaagattttctcatggcaactacactgacatgtgtgttctgcattctgtgagggaagatcttgcaaacttgatagctcctttgatcttcaggccaattactcgatggccgttttatgcatttctaggtggtgctatgttctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcccggagtttcgggtggtgagggcgtctctgttctttggaatgggattctctggcttagctccgattcttcacaagctgataatcttttgggaccaacctgaagcccttcacacgacaggttatgagattttgatgggtttgctttatgggttaggagctctggtttatgcaactaggatcccagagagatggatgccgggtaaattcgatatagcaggacatagccatcagttgtttcatgttctggttgttgctggtgcgttcacgcactatagagctgggctagtgtatcttaagtggagagatattgaaggatgttgaagatgaagattgaagattagatggaatctttgaatcttgtttgtagtagcttcatataaaagttggattatgtaaagtcttatatgtaatcaaacgtttaattgtttcctttattcaacaaaggatttatattgttaatccacatatgtattactggttaaagaagctgaaggattcatattttt

SEQ ID NO: 170 - protein, 1531 aa, Arabidopsis thaliana
ATCGTCGTCTTCTATTTTTTCTTCTTTCTTCGATTTCATACCAAAACAAGAACTCTCTGTTTTCGACAAAAACGAAACCTTGAGATCTATTTTGATTGACTTTTAAGAAAGAGAGAGATCTTTCTTAGAAGATTTTGTCTCGTCGGCATTGAAGATCCAGGGTTTGTCTTTCGAAATTCAGAGAGAAAATGGGTGATGAGGCAGAGATCAAGGAACATTTAAAGCCACAAGCTTCATCTGAAACAATGGACAAGAAACATAATGTGAAAGGGAAGAGGTTATGGCAGAAAGTCAAGTATCAATTGGTGGAGTTTCATTCATTGCCTGCTTATTTAAGAGACAATGAGTACATCATTGGTCATTACCGATCCGAATGGCCGATCAAACAGATTCTTCTCAGCATCTTTACCATTCATAATGAGACTTTGAATGTTTGGACGCACTTGATTGGGTTTTTCCTGTTTTTGGCGCTCACTATATACACTGCAACGAAAGTACCGAGTGTCGTGGATCTTCATTCGCTTCAACACCGTTTACCCGATTTGTTGAGGAAAACAGATCTCCACAAACTTCATTCTGAGCTCATGGCTCGCCTTCCTTCTAGTCCATCTAGTTGGCATGTGATGGACCTTCTTTATAACTGTTTGCCTGAAAGATTTTCTCATGGCAACTACACTGACATGTGTGTTCTGCATTCTGTGAGGGAAGATCTTGCAAACTTGATAGCTCCTTTGATCTTCAGGCCAATTACTCGATGGCCGTTTTATGCATTTCTAGGTGGTGCTATGTTCTGTCTATTAGCAAGCAGCACGTGCCACCTCCTCTCATGTCACTCCGAGCGAGTCTCCTACATAATGCTTAGGCTTGATTACGCCGGCATCGCAGCTCTAATAGCGACTTCCTTCTACCCTCCGGTTTATTACTCCTTCATGTGTGATCCTTTCTTCTGCAACCTCTACTTAGGATTCATAACCATCTTAGGAATCGCCACTGTGCTTGTTTCTCTCCTCCCGGTTTTCCAAAGCCCGGAGTTTCGGGTGGTGAGGGCGTCTCTGTTCTTTGGAATGGGATTCTCTGGCTTAGCTCCGATTCTTCACAAGCTGATAATCTTTTGGGACCAACCTGAAGCCCTTCACACGACAGGTTATGAGATTTTGATGGGTTTGCTTTATGGGTTAGGAGCTCTGGTTTATGCAACTAGGATCCCAGAGAGATGGATGCCGGGTAAATTCGATATAGCAGGACATAGCCATCAGTTGTTTCATGTTCTGGTTGTTGCTGGTGCGTTCACGCACTATAGAGCTGGGCTAGTGTATCTTAAGTGGAGAGATATTGAAGGATGTTGAAGATGAAGATTGAAGATTAGATGGAATCTTTGAATCTTGTTTGTAGTAGCTTCATATAAAAGTTGGATTATGTAAAGTCTTATATGTAATCAAACGTTTAATTGTTTCCTTTATTCAACAAAGGATTTATATTGTTAATCCACATATGTATTACTGGTTAAAGAAGCTGAAGGATTCATATTTTT

SEQ ID NO: 171 - DNA, 1173 bp, Arabidopsis thaliana
  misc_feature (1)..(1173): Ceres cDNA ID no. 4997839
atgtcgagcttattacactgtagaaatgtcgtagattgtgcgtttacttcttccactgttcgtcgcattgtcaatttagggtttttagtgggtagaataagaacgttgtgttcagtgtcacaagtgaaatcagagaatctcgaaaagcaaaaaccatgtttggaatcttttacagtttcttatctcgtggattcttgtggactgtctttggaatctgctaaatcgaattccagattcgtcaaattggtttcgtccaagaaaccagactctgttcttgctctcttcaaggaccatggcttcaccaatgaccagatcaccagtgtcatcaaatcctttcctcgtgttctgtcactgagcccggaagatgtaatctcgcccaagctcatgtttttcagttctatcgggttttcgacctcggatactgcgaaaatgatctcttcttccccgaaaatgctatcatatagcttgcacaaaagattgatcccttgctatgattccctcaagagcatactcgttgaggaagaaagtgttgtcaagtgtctcaagcgtggaatcagatgtttctcattgaagattacacattgtgtgtctcttcgtgtctccatttgtagagagcttggagttcctgacaaaagcatcaagtggttggttcaagcgtctccattcacttttttctctcgtgagagaagattcaacgaggtcttaaacagagtttgcagctacggttttgacccgaaaaaggcgggttttgttcacgctatggtagcctttgattgcacgagtgaatcagcaatggagcggaaatttaagttgttccaatgttttggttggtctaaagaagatttcgtcgcagcgatcatgagattcccaaactgtgtgacggtttcagatgagaagataatgtacacattggagtaccttgtaaacaacattggtctgcaagctcgtgacattgttgcaagaccggtggtgttatctctgagcatggagaagagaatcaaaccgaggaaccaggtcatctctttgcttctctccaaaggacttgtgaagaaggaagacatcaactatttcactatactaaagctgaaaagctccgagttcatggataagtttgtgctgaaatatcaggatgagatgccacaacttgtacaaccctttacaagtaatcgatga

SEQ ID NO: 172 - protein, 390 aa, Arabidopsis thaliana
  misc_feature: PFam Name: mTERF; PFam Description: mTERF
  misc_feature: GI Number: 25511650; NR Description: T22I11.2 protein - Arabidopsis thaliana >gi|8886986|gb|AAF80646.1|AC012190_2 Contains similarity to F28O16.19 a putative translation initiation factor IF-2 gi|6143896 from Arabidopsis thaliana
  misc_feature: GI Number: 21553423; NR Description: unknown [Arabidopsis thaliana]
  misc_feature: GI Number: 51536067; NR Description: mitochondrial transcription termination factor-like [Oryza sativa (japonica
  misc_feature: GI Number: 51536073; NR Description: mitochondrial transcription termination factor-like [Oryza sativa (japonica cultivar-group)] >gi|51535003|dbj|BAD37287.1| mitochondrial transcription termination factor-like [Oryza sativa (japonica
  misc_feature: GI Number: 51536063; NR Description: mitochondrial transcription termination factor-like [Oryza sativa (japonica
MSSLLHCRNVVDCAFTSSTVRRIVNLGFLVGRIRTLCSVSQVKSENLEKQKPCLESFTVSYLVDSCGLSLESAKSNSRFVKLVSSKKPDSVLALFKDHGFTNDQITSVIKSFPRVLSLSPEDVISPKLMFFSSIGFSTSDTAKMISSSPKMLSYSLHKRLIPCYDSLKSILVEEESVVKCLKRGIRCFSLKITHCVSLRVSICRELGVPDKSIKWLVQASPFTFFSRERRFNEVLNRVCSYGFDPKKAGFVHAMVAFDCTSESAMERKFKLFQCFGWSKEDFVAAIMRFPNCVTVSDEKIMYTLEYLVNNIGLQARDIVARPVVLSLSMEKRIKPRNQVISLLLSKGLVKKEDINYFTILKLKSSEFMDKFVLKYQDEMPQLVQPFTSNR

SEQ ID NO: 173 - DNA, 558 bp, Zea mays
  misc_feature (1)..(558): Ceres cDNA ID no. 5006399
  misc_feature (1)..(558): Ceres CLONE  ID no. 701916
  misc_feature (1)..(558): Also known as  Ceres CDNA ID no. 0
aaacacaacgttttgatgattgctgatgagatccaaactggcatagctagaactggtaaaatgctggcatgtgactgggaaaacatacggcctgacatggtgattctaggcaaagcactcggtgctggagttgttccagtcagtgcagttcttgcagacaaggatgtcatgctgtgtatcagaccaggggaacatggaagtacattcggtgggaatccgttagctagcgctgtggcagttgcatcactgaaagtggtcagagacgaaggtcttgttgaaagggctgcaaagttaggacaggagtttagggaccagttacagaaggtccagcagaaattccctcaaatcctaagagaagtgcgcgggaggggtttgctgaacgcagtggatctaaacaacgacgcgctatctcctgcttctgcatatgacatctgcatcaagttgaaggagagaggcattttagcgaaacccacacatgacactataatccgacttgctcctcccctcacaatcagtcctgaggagcttgcaraagcatccaaggcgcttagtgacgtg

SEQ ID NO: 174 - protein, 558 aa, Zea mays
AAACACAACGTTTTGATGATTGCTGATGAGATCCAAACTGGCATAGCTAGAACTGGTAAAATGCTGGCATGTGACTGGGAAAACATACGGCCTGACATGGTGATTCTAGGCAAAGCACTCGGTGCTGGAGTTGTTCCAGTCAGTGCAGTTCTTGCAGACAAGGATGTCATGCTGTGTATCAGACCAGGGGAACATGGAAGTACATTCGGTGGGAATCCGTTAGCTAGCGCTGTGGCAGTTGCATCACTGAAAGTGGTCAGAGACGAAGGTCTTGTTGAAAGGGCTGCAAAGTTAGGACAGGAGTTTAGGGACCAGTTACAGAAGGTCCAGCAGAAATTCCCTCAAATCCTAAGAGAAGTGCGCGGGAGGGGTTTGCTGAACGCAGTGGATCTAAACAACGACGCGCTATCTCCTGCTTCTGCATATGACATCTGCATCAAGTTGAAGGAGAGAGGCATTTTAGCGAAACCCACACATGACACTATAATCCGACTTGCTCCTCCCCTCACAATCAGTCCTGAGGAGCTTGCARAAGCATCCAAGGCGCTTAGTGACGTG

SEQ ID NO: 175 - DNA, 1120 bp, Arabidopsis thaliana
  misc_feature (1)..(1120): Ceres cDNA ID no. 5672880
accaccttcgtgtttctctctctattacagaaaaaaagattcaaaaaccctagatttcacaaaatcgattggctgtcaaatttctctccggcgattttcctcgagtgaaattcggctcaaggtgattatagcgatcatcgaatcaaattgattgaagaggtacaaaggttagttactttgagctgaaagatgaacacgtcagaggtgagagtacctcgaggaaatcgacggaggaaagctgtgattgatctgaatgcggtacctgttgatcaagaagggacctctgcttctgttagaactcttacggtgcctattacaccgtctcagcctgctcctacgatgattgatgtcgatgctattgaggatgatgttattgaatcatccgctagtgcttttgctgaagctaaaagcaaatcaagaaatgcacgtcggagacctttgatggttgatgtagagtcaggaggtacgactagattccctgccaacataagcaacaaacgcagaaggattccttctagtgaatctgtcatcgactgtgagcatgcctctgtaaatgatgaagtcaacatgtcttcgagagtgtctagatcaaaggctccagctcctccaccagaagagccaaagtttacatgtccaatctgcatgtgtccctttacggaggagatgtcaaccaagtgcggtcacatcttctgcaagggatgtataaagatggcaatatctcgccagggcaaatgccctacttgtaggaaaaaggttactgcaaaagagctgattcgagttttccttccaaccactagatgagtggtccggcaacatcaccagccaccctgtaggtctaatggtttatcagactatcctcctattcactttggaacattgaagggacttcgttgacttggtatttttgaatattttgctttgttggaagagaaatattcagtgatcaagaagccagaaggccctatcattcgatggatatcattggtaataactctttgtttttagttgttgttctatgtaatttaggtctctgcaaacctctcagtcgatactcttctctcttgatagatgataagatatatggaaaaaaaaattaatattgaatctttactaaaattct

SEQ ID NO: 176 - protein, 203 aa, Arabidopsis thaliana
  misc_feature: PFam Name: zf-C3HC4; PFam Description: Zinc finger, C3HC4
  misc_feature: GI Number: 21537318; NR Description: unknown [Arabidopsis thaliana]
  misc_feature: GI Number: 61097975; NR Description: similar to RING finger
  misc_feature: GI Number: 41617082; NR Description: TPA: HDC06237
MNTSEVRVPRGNRRRKAVIDLNAVPVDQEGTSASVRTLTVPITPSQPAPTMIDVDAIEDDVIESSASAFAEAKSKSRNARRRPLMVDVESGGTTRFPANISNKRRRIPSSESVIDCEHASVNDEVNMSSRVSRSKAPAPPPEEPKFTCPICMCPFTEEMSTKCGHIFCKGCIKMAISRQGKCPTCRKKVTAKELIRVFLPTTR

SEQ ID NO: 177 - DNA, 1131 bp, Arabidopsis thaliana
  misc_feature (1)..(1131): Ceres cDNA ID no. 5678106
acattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacgtgagtttatatattttctttaggagttttaagtgattttggatttggtttttatattgagacttcatcttgacatttttgtgtatttgcagctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttatagcttgtctattatgtccgagaatttctttttctgtttttgattcttttcgttgtatatctttgtccaataaaggaaatgatgtgtctttac

SEQ ID NO: 178 - protein, 163 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 21553999; NR Description: xyloglucan
  misc_feature: GI Number: 19911573; NR Description: syringolide-induced
  misc_feature: GI Number: 4539299; NR Description: xyloglucan endo-1, 4-beta-D-glucanase (XTR-6) [Arabidopsis thaliana] gi|7269432|emb|CAB79436.1| xyloglucan endo-1, 4-beta-D-glucanase (XTR-6) [Arabidopsis thaliana] gi|15235997|ref|NP_194311.1|
  misc_feature: GI Number: 8886867; NR Description: xyloglucan
  misc_feature: GI Number: 42795462; NR Description: xyloglucan
MSGDPYTLHTNVYTQGKGDKEQQFHLWFDPTANFHTYSILWNPQRIILTVDDTPIREFKNYESLGVLFPKNKPMRMYASLWNADDWATRGGLVKTDWSKAPFMASYRNIKIDSKPNSNWYTQEMDSTSQARLKWVQKNYMIYNYCTDHRRFPQGAPKECTTSS

SEQ ID NO: 179 - DNA, 1675 bp, Arabidopsis thaliana
  misc_feature (1)..(1675): Ceres cDNA ID no. 5678877
agatgtaatttgtataattttagtaactcttcagtttttttttgttttaaaaatatattttctctctctctgtcttcctgcaatctatcgccggccgattcaataatttcgctttactctgccaaaaaagtttgttcttttgttttctgggattatccaaagagaagaaacagaggaaatcaatctcttttttagtttcagaccctaaatcctaggttttgaagttttgtttctttagtaattttgtcaggttttgtgtctggtgttgggatttttcggagcttggtttcttgaaccagctccattttctaaaaattccttctttaaatccccattgttgtaagtcttaaagaaaaaagaagatgacttgttgtttctcttgtttgaatcctcgaaccaaggacataagagtcgacattgataacgctcgatgcaactctcgttaccaaaccgattcatcagttcatggaagtgatacaacaggaacagagtcgatttcgggtatcttagtaaatggtaaagtgaatagtccgatacctggtggtggagctcggagcttcacgttcaaggagttagctgcagctacaagaaacttccgggaagttaatttgctcggagaaggaggttttggcagagtttataagggacgtttagattcaggacaagtagtggctattaagcaattgaatccagatgggcttcaagggaaccgagagtttatagtagaagttcttatgcttagcttattgcatcatcccaatctcgttacattgatcggttactgtacttctggtgatcaaagacttcttgtctatgaatacatgccaatgggaagcttagaagatcacctttttgatcttgagtctaatcaagaaccattaagctggaatactcgaatgaaaatcgcggttggtgcagctcgaggaatagagtatcttcactgcacagctaacccgccagtgatttaccgtgatttgaaatccgcaaacatattgttagataaagagttcagtccaaaactctcggatttcggattggcgaaactcggtccagttggtgatcgaactcatgtatcgactcgtgtcatgggaacttacggttactgtgctcctgaatacgcaatgagcgggaaattaactgttaaatcggatatctactgcttcggtgtagtgttgcttgagctgattactgggagaaaagctattgatttaggtcaaaagcaaggcgagcagaatcttgttacttggtcacgtccatacctcaaggatcagaagaagtttggacatttagtggatccgtctctacgaggaaaatacccaagacggtgtttaaactatgcgattgcgattattgcaatgtgtcttaatgaagaagctcattatcgaccgttcataggtgacatagttgtggcactagagtacttagccgcacagagcagatctcatgaagctcgaaacgtctcatcaccgtcaccagagatttcaagaacgccgcgacgagacttgtaaaaactcaaaaacagcttttaagaatttcagtttggtgttgtgtaaaaatggttttttttgtttctttctcagaaaacaatatatgtttggtaaatgtttcgttattagtctcttttacttgatgtatatggcaattatggaaacaattaaagttcttttatatgtgt

SEQ ID NO: 180 - protein, 381 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 8778594; NR Description: F5M15.3 [Arabidopsis thaliana] >gi|8886951|gb|AAF80637.1|AC069251_30 F2D10.13
  misc_feature: GI Number: 15217992; NR Description: protein kinase,
  misc_feature: GI Number: 34907210; NR Description: putative serine/threonine kinase PBS1 protein [Oryza sativa (japonica cultivar-group)] >gi|15408807|dbj|BAB64203.1| putative serine/threonine kinase PBS1 protein [Oryza sativa (japonica
  misc_feature: GI Number: 15238886; NR Description: protein kinase -like
  misc_feature: GI Number: 50931229; NR Description: putative serine/threonine protein kinase [Oryza sativa (japonica cultivar-group)] >gi|49328131|gb|AAT58829.1| putative serine/threonine protein kinase [Oryza sativa (japonica
  misc_feature: Utility: Useful for making plants with increased tolerance to
MTCCFSCLNPRTKDIRVDIDNARCNSRYQTDSSVHGSDTTGTESISGILVNGKVNSPIPGGGARSFTFKELAAATRNFREVNLLGEGGFGRVYKGRLDSGQVVAIKQLNPDGLQGNREFIVEVLMLSLLHHPNLVTLIGYCTSGDQRLLVYEYMPMGSLEDHLFDLESNQEPLSWNTRMKIAVGAARGIEYLHCTANPPVIYRDLKSANILLDKEFSPKLSDFGLAKLGPVGDRTHVSTRVMGTYGYCAPEYAMSGKLTVKSDIYCFGVVLLELITGRKAIDLGQKQGEQNLVTWSRPYLKDQKKFGHLVDPSLRGKYPRRCLNYAIAIIAMCLNEEAHYRPFIGDIVVALEYLAAQSRSHEARNVSSPSPEISRTPRRDL

SEQ ID NO: 181 - DNA, 1537 bp, Arabidopsis thaliana
  misc_feature (1)..(1537): Ceres cDNA ID no. 5679887
ttctctctctctctctcgcttttgagatcatcgaacacaatcgaaacgaagaatcatttgaagaagaagaagatcgtgagaagcttaatgggttggatcccgtgttctgggaaatcgagtgggaggaataagacaaggaggaacggtgaccacaaactcgacaggaagtcttctgattgttctgtgtctacttcagagaaatctagggccaagtcgtccttgagtgaatccaaaagtaaaggctctgatcacattgtggcacaaacgtttacattctctgagttagctactgccactagaaacttcagaaaagaatgtcttataggagaaggaggatttggtagagtttacaaaggatacttggccagcactagccagacagcggctatcaagcaacttgatcataatggtttacaaggaaacagggagttcctcgtcgaggttctcatgttgagtcttcttcatcacccgaatcttgttaacttaataggatattgtgctgatggagatcaaaggcttctagtctacgagtacatgcccctaggttcacttgaagatcatttgcacgacatttcacctggtaagcagccacttgactggaacaccagaatgaaaatagctgccggtgctgcaaaaggtttggagtatctgcatgacaaaaccatgcctccagtgatctatcgagatttgaaatgctcaaatattttgctcgatgatgattactttccaaagctatccgacttcgggttggctaaacttggcccagttggggacaagtctcatgtgtccactcgggttatgggaacatacggatactgtgctcccgagtatgcaatgacaggccagctaacactcaaatcagacgtttacagcttcggtgttgttctgttggagattataactggtcggaaagcaatagacagttcaagatctactggagaacagaatctagtcgcatgggcaaggcctttgtttaaagacaggaggaaattctctcagatggctgatccaatgcttcaaggtcaataccctccgcgagggttataccaagcactcgctgtagcagcgatgtgcgtacaagagcagccaaatcttagacctctcattgctgacgtcgtcactgcactttcttacctcgcctcccaaaagtttgatcctctggctcagccagtccaaggatcccttttcgctccagggactccacctagatcaaagagggtctgaaaataatcccgagaaccgcaatgctgtgtaagttatgtagcttaaacccattccgtgctgtctttcttggagaggaaaggtggatgattttcagactaagtgtgaatgtatggcttaagagctacttgtagatatgtgtaagaagagatagattcatatagaggccggtttataatgttgttataggtgatgttgtttaatgtaatgtttattgagcgcttgctttcaaatgtgacaatttctcattattgtactgaggatgtctgcttcgattccaaagttattgtataaatattaaagtactatagttttc

SEQ ID NO: 182 - protein, 378 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15238886; NR Description: protein kinase -like
  misc_feature: GI Number: 7573596; NR Description: protein kinase 1 [Populus
  misc_feature: GI Number: 30679773; NR Description: protein kinase family
  misc_feature: GI Number: 7413555; NR Description: protein kinase-like [Arabidopsis thaliana] gi|11259782|pir||T48301 protein kinase-like
  misc_feature: GI Number: 10445209; NR Description: protein serine/threonine
MGWIPCSGKSSGRNKTRRNGDHKLDRKSSDCSVSTSEKSRAKSSLSESKSKGSDHIVAQTFTFSELATATRNFRKECLIGEGGFGRVYKGYLASTSQTAAIKQLDHNGLQGNREFLVEVLMLSLLHHPNLVNLIGYCADGDQRLLVYEYMPLGSLEDHLHDISPGKQPLDWNTRMKIAAGAAKGLEYLHDKTMPPVIYRDLKCSNILLDDDYFPKLSDFGLAKLGPVGDKSHVSTRVMGTYGYCAPEYAMTGQLTLKSDVYSFGVVLLEIITGRKAIDSSRSTGEQNLVAWARPLFKDRRKFSQMADPMLQGQYPPRGLYQALAVAAMCVQEQPNLRPLIADVVTALSYLASQKFDPLAQPVQGSLFAPGTPPRSKRV

SEQ ID NO: 183 - DNA, 1269 bp, Arabidopsis thaliana
  misc_feature (1)..(1269): Ceres cDNA ID no. 5680073
cttttgatccaagtttggttgcccagaaatatcaaagaaaaaaaaacaaagctttgttgtttctggcagtagaatcattcatggctttctttgcgtgttaaacattcactaacctaaaaactaaaacttcgttttcagcaatcatgagattcaacaagggaactaaagtcgaagtgttgagcaaatcatcggttccatctggcgcctggcggtctgcagagatcatatcaggaaatgggcattactacactgtcatgtatgatcataatgatggtacagagagggtaccgaggaagagtatgaggcctgagcctcctcgtttacaagttcttgatgcttggtgtcctggtgacattcttgaggttttccaaagttgttcgtggaagatggcaatcgtttccaaggttttaggaaacggttgtttcttggttagattacttggttcctcactgaagttcaaggtgactaaatccgatattcgggttagacaatcttggcaagataacgagtggatcatgattggacagggtacatcaagattaagcgcacagacttcaacaggagaactaaggagaaaggtgaatccgaaaggcgactacatttcatctgagagcaaagacaagcttgatgagtctgatgtacctttgtcagtaggtctaaagaaacggacttactctttggttgaacctcacaatcaaactagagctttagctgcttatcctccaaggtttcgtgaagaagtgaaagaagaagaagaagatagagagagtgttgcttcttctgttggtagttgttgcatggatactgatggtctcagtgctgtttcattcaatcccattgaaaccggtaactctagtgacacagagtcatcgtcttgtggctacgggaaggtcaagaagttggtggttccaagaaaaggctcagaggctgctgatgttcataggttagagctggatgcataccgaagcagtatcgagagattgcacgcatccggaccaatcataacatgggaacaagaaacgtggattacaaatctccgtctcaaattgaacatttcgaatgaggaacatctgatgcagataagaaaccttatctctgacgataacagtactatatacagatagcagcagcagcagcattgagaactacagtttgtgttacatagaataaaaactgagtgtagattgtacaaatgtcattttatttttcattcaggttttttgatttaattccaaacttgtgaaagaaaatttgatcatctttactctt

SEQ ID NO: 184 - protein, 326 aa, Arabidopsis thaliana
  misc_feature: PFam Name: Agenet; PFam Description: Agenet domain
  misc_feature: PFam Name: ENT; PFam Description: ENT domain
  misc_feature: GI Number: 50906127; NR Description: putative agenet domain-containing protein [Oryza sativa (japonica cultivar-group)] >gi|46390520|dbj|BAD16008.1| putative agenet domain-containing
  misc_feature: GI Number: 42573127; NR Description: agenet domain-containing
MRFNKGTKVEVLSKSSVPSGAWRSAEIISGNGHYYTVMYDHNDGTERVPRKSMRPEPPRLQVLDAWCPGDILEVFQSCSWKMAIVSKVLGNGCFLVRLLGSSLKFKVTKSDIRVRQSWQDNEWIMIGQGTSRLSAQTSTGELRRKVNPKGDYISSESKDKLDESDVPLSVGLKKRTYSLVEPHNQTRALAAYPPRFREEVKEEEEDRESVASSVGSCCMDTDGLSAVSFNPIETGNSSDTESSSCGYGKVKKLVVPRKGSEAADVHRLELDAYRSSIERLHASGPIITWEQETWITNLRLKLNISNEEHLMQIRNLISDDNSTIYR

SEQ ID NO: 185 - DNA, 1370 bp, Arabidopsis thaliana
  misc_feature (1)..(1370): Ceres cDNA ID no. 5680788
cttcccctttccttccgaaattagggcttccgtgtttcgcagtgctctccttcaatccccagcttgacaatgcctcgctatgatgatcgctatgggaacactcgtctttacgttggccgattatcatcgagaactaggacccgagaccttgaacgtctttttagcagatacggaaggtctctgggattttgcctaacctggaggtgtttgatgagtgggtggacttggtggaaattctcgccaagtgtttaggggacagggcgccttggcgattctgtttgtagaattttttaatgtgttttgatggaaatggagactcagtctcaaaaatggtgtttagaagtaccttaaagtaatgatggccttacttttctgccaacaatttcttccgcagagtgcgagatgtggatatgaagcgagattatgctttcgttgaatttggtgatccccgtgatgctgatgatgcaagacattacctggacggacgagactttgatggaagtcgcatcactgtggagttttcacgaggggcacctcgtggttctcgggattttgatagcagaggcccaccacctggagctggtcgctgttttaactgtggtgtagatggtcattgggctcgtgactgcacagcaggggactggaagaacaagtgttaccgttgtggagagagaggacacattgagagaaactgcaaaaacagccccaagaagcttaggcgcagtggaagctactccaggtcacctgtaagatcccgttctcctcgtcgtagaagaagcccaagccggagtcttagccgtagccgaagctacagccgatcacgatccccggtgagaagaagagagaggagtgtggaggagagatcacgcagtccaaagcggatggatgactctctatcgccaagagccagagatcgtagtccggttcttgatgatgaaggcagcccaaagatcatagacgggagcccaccaccatcaccaaagcttcaaaaggaagtcggatctgaccgtgacggtggtagcccccaagacaatggcagaaactctgttgtcagtcctgttgtaggagccggtggtgacagttcgaaagaggaccggagccctgttgatgatgattacgagccaaaccgcacttcccctagaggaagtgagtctccttaactttgatggctcatggccacggcttgcaggcattgtagcatgtatactattggatcgactgttcctttctcttttaagtgtgtttgctttagaaccttttaagtttcatgttaccaagagttttttcatttgagacataatgttgttgcgtttcttttggacaagttttcgaagattgttataaggatttataaaagtttcaatctgagg

SEQ ID NO: 186 - protein, 249 aa, Arabidopsis thaliana
  misc_feature: PFam Name: RRM_1; PFam Description: RNA recognition motif.
  misc_feature: PFam Name: zf-CCHC; PFam Description: Zinc knuckle
  misc_feature: GI Number: 42571091; NR Description: splicing factor RSZ33
  misc_feature: GI Number: 9843663; NR Description: splicing factor RSZ33
  misc_feature: GI Number: 11346381; NR Description: splicing factor-like
  misc_feature: GI Number: 34895952; NR Description: putative splicing factor-like protein [Oryza sativa (japonica cultivar-group)] >gi|15528625|dbj|BAB64646.1| putative splicing factor-like protein
  misc_feature: GI Number: 30584739; NR Description: Homo sapiens splicing
MKRDYAFVEFGDPRDADDARHYLDGRDFDGSRITVEFSRGAPRGSRDFDSRGPPPGAGRCFNCGVDGHWARDCTAGDWKNKCYRCGERGHIERNCKNSPKKLRRSGSYSRSPVRSRSPRRRRSPSRSLSRSRSYSRSRSPVRRRERSVEERSRSPKRMDDSLSPRARDRSPVLDDEGSPKIIDGSPPPSPKLQKEVGSDRDGGSPQDNGRNSVVSPVVGAGGDSSKEDRSPVDDDYEPNRTSPRGSESP

SEQ ID NO: 187 - DNA, 457 bp, Zea mays
  misc_feature (1)..(457): Ceres cDNA ID no. 5682376
  misc_feature (1)..(457): Also known as  Ceres CDNA ID no. 0
magtggcaggatcgacatgtcagaactgcscgmtgctcttctcagtctcggatattctgtgtctccaactgtcctcgatctgcttgtgtctaaattcgacaagactgggggcaagagcaaagcaatcgaatatgacaacttcattgaatgctgcctcactgttaaggggctgactgagaagttcaaggagaaggacaccgcctactctgggtcggcgactttcacctacgaggccttcatgctgaccgtgctgcctttcctcattscgtagtggcagttcactccgyygctcaamacaagcytttataagcttttccaatagtactgtaatattatgcctgctgtaaagagatttatgttcgcggagttgtttttagacgagttgtttcgattctggatttaacttgtgttgtatatcataaagttactctgaaatggagaatgtacctgttggttg

SEQ ID NO: 188 - protein, 457 aa, Zea mays
MAGTGGCAGGATCGACATGTCAGAACTGCSCGMTGCTCTTCTCAGTCTCGGATATTCTGTGTCTCCAACTGTCCTCGATCTGCTTGTGTCTAAATTCGACAAGACTGGGGGCAAGAGCAAAGCAATCGAATATGACAACTTCATTGAATGCTGCCTCACTGTTAAGGGGCTGACTGAGAAGTTCAAGGAGAAGGACACCGCCTACTCTGGGTCGGCGACTTTCACCTACGAGGCCTTCATGCTGACCGTGCTGCCTTTCCTCATTSCGTAGTGGCAGTTCACTCCGYYGCTCAAMACAAGCYTTTATAAGCTTTTCCAATAGTACTGTAATATTATGCCTGCTGTAAAGAGATTTATGTTCGCGGAGTTGTTTTTAGACGAGTTGTTTCGATTCTGGATTTAACTTGTGTTGTATATCATAAAGTTACTCTGAAATGGAGAATGTACCTGTTGGTTG

SEQ ID NO: 189 - DNA, 533 bp, Zea mays
  misc_feature (1)..(533): Ceres cDNA ID no. 5682783
  misc_feature (1)..(533): Also known as  Ceres CDNA ID no. 0
ytggtgggtcgccgacctcatgcggtggatgtcgcgtgcgaagcgtcgatcggccaaraggcagcacgccgccacgtttkccgtggggcccaratggaggccgccgcggacccggaggagcgagagcggaaggcggcgtttgadcggctggacaatytaggacggtgcatcgcggacgtggaragcagcggcgagaaggtgttcagagccctcgtcaacaccagagtytccctcctcaacattttcagcccagccttttgattcccgaatcatcagaacccagcaaactsgactgcattttgcaaccttgaatccattgtaaaaacctagattcttttgaaacgtytaaggattttttccttttgaaacgaacattaaaaaaatccttttgaaacgaacatytaagctttggaatttggatgcgtgtgcatcacatttctagaatcggtagctaattaaagggccattttcctcccccttgtacttgtgcctaaatttagacaacatcctcaaacttaaatatgggacagctc

SEQ ID NO: 190 - protein, 533 aa, Zea mays
YTGGTGGGTCGCCGACCTCATGCGGTGGATGTCGCGTGCGAAGCGTCGATCGGCCAARAGGCAGCACGCCGCCACGTTTKCCGTGGGGCCCARATGGAGGCCGCCGCGGACCCGGAGGAGCGAGAGCGGAAGGCGGCGTTTGADCGGCTGGACAATYTAGGACGGTGCATCGCGGACGTGGARAGCAGCGGCGAGAAGGTGTTCAGAGCCCTCGTCAACACCAGAGTYTCCCTCCTCAACATTTTCAGCCCAGCCTTTTGATTCCCGAATCATCAGAACCCAGCAAACTSGACTGCATTTTGCAACCTTGAATCCATTGTAAAAACCTAGATTCTTTTGAAACGTYTAAGGATTTTTTCCTTTTGAAACGAACATTAAAAAAATCCTTTTGAAACGAACATYTAAGCTTTGGAATTTGGATGCGTGTGCATCACATTTCTAGAATCGGTAGCTAATTAAAGGGCCATTTTCCTCCCCCTTGTACTTGTGCCTAAATTTAGACAACATCCTCAAACTTAAATATGGGACAGCTC

SEQ ID NO: 191 - DNA, 552 bp, Zea mays
  misc_feature (1)..(552): Ceres cDNA ID no. 5685287
  misc_feature (1)..(552): Also known as  Ceres CDNA ID no. 0
  misc_feature (212)..(212): n is a, c, t, g, unknown, or other
  misc_feature (330)..(330): n is a, c, t, g, unknown, or other
tccacgtcgttcgtgggcacgcacgagtacctggctcccgagatcgtggccggggaagggcacggcagcsccgtggactggtggacgctgggggtcttcgtyttcgagctgctgtacggggctacgcccttcaagggccacgacaacgagatgacgctggccaacatcgtggcccgcgcgctcgagttcccccgggaccgcgacccgcccgngtcgcccgccgcccgcgacctygtcaccgcgctcctcgccaaggaccccgcccgccgcctcggcgccaccgtcggcgccgccgccatcaagcgccaccccttyttcgccggcgtcaantgggccctgctccgctgcgccccgccgccttacgtgccgccgccgttcagcatcgccaaggcggcggctgctgctggtggaggcggcgggaaagacgacgacgacgacgacgtgtcggacgacagttgtccctggctgcagcacgcatgtcataacctggcggccgccgtgccattggctccggctcctgtcctgccttggtcagtacaacccccctgtytc

SEQ ID NO: 192 - protein, 552 aa, Zea mays
TCCACGTCGTTCGTGGGCACGCACGAGTACCTGGCTCCCGAGATCGTGGCCGGGGAAGGGCACGGCAGCSCCGTGGACTGGTGGACGCTGGGGGTCTTCGTYTTCGAGCTGCTGTACGGGGCTACGCCCTTCAAGGGCCACGACAACGAGATGACGCTGGCCAACATCGTGGCCCGCGCGCTCGAGTTCCCCCGGGACCGCGACCCGCCCGNGTCGCCCGCCGCCCGCGACCTYGTCACCGCGCTCCTCGCCAAGGACCCCGCCCGCCGCCTCGGCGCCACCGTCGGCGCCGCCGCCATCAAGCGCCACCCCTTYTTCGCCGGCGTCAANTGGGCCCTGCTCCGCTGCGCCCCGCCGCCTTACGTGCCGCCGCCGTTCAGCATCGCCAAGGCGGCGGCTGCTGCTGGTGGAGGCGGCGGGAAAGACGACGACGACGACGACGTGTCGGACGACAGTTGTCCCTGGCTGCAGCACGCATGTCATAACCTGGCGGCCGCCGTGCCATTGGCTCCGGCTCCTGTCCTGCCTTGGTCAGTACAACCCCCCTGTYTC

SEQ ID NO: 193 - DNA, 619 bp, Zea mays
  misc_feature (1)..(619): Ceres cDNA ID no. 5687045
  misc_feature (1)..(619): Also known as  Ceres CDNA ID no. 0
tgttggagcttttataatgaatgmcaaaagagaggtyttggctgtmcaaraaaagagtggtgtacttcgaggactaggtgtgtggaaatttccaactggcgtagtagaaccgggggaagatattaacgttggasccgtccgagaagtaaaagaagagacagggattgatgcagaattcgttgaagtgctggccttcaggcagagccacaaatccttttttgataaatcagatctatttttcgtgtgcctgctacgacccctttcatacgacattacgaagcaagactcggaaatagaggcatgccagtggatgccagtagaggaatttgcagcacaaccatttgtccagaaacatgagcttgtgaagtacatcctcgaagtcggcctggctaaagttgacaaggaatacgcaggcttttcgccaatctccataaaatcggcatttacagacaaattgtccttattttacatgaaccggagggatytggatagggcctcagggtagagtatatatgtaatgacatgggcaattcaggatagttaaattttcactttggtgtgtgaaagcgggctaaatcttgttagacctaatcttgattgtctagtaatttttagagcc

SEQ ID NO: 194 - protein, 619 aa, Zea mays
TGTTGGAGCTTTTATAATGAATGMCAAAAGAGAGGTYTTGGCTGTMCAARAAAAGAGTGGTGTACTTCGAGGACTAGGTGTGTGGAAATTTCCAACTGGCGTAGTAGAACCGGGGGAAGATATTAACGTTGGASCCGTCCGAGAAGTAAAAGAAGAGACAGGGATTGATGCAGAATTCGTTGAAGTGCTGGCCTTCAGGCAGAGCCACAAATCCTTTTTTGATAAATCAGATCTATTTTTCGTGTGCCTGCTACGACCCCTTTCATACGACATTACGAAGCAAGACTCGGAAATAGAGGCATGCCAGTGGATGCCAGTAGAGGAATTTGCAGCACAACCATTTGTCCAGAAACATGAGCTTGTGAAGTACATCCTCGAAGTCGGCCTGGCTAAAGTTGACAAGGAATACGCAGGCTTTTCGCCAATCTCCATAAAATCGGCATTTACAGACAAATTGTCCTTATTTTACATGAACCGGAGGGATYTGGATAGGGCCTCAGGGTAGAGTATATATGTAATGACATGGGCAATTCAGGATAGTTAAATTTTCACTTTGGTGTGTGAAAGCGGGCTAAATCTTGTTAGACCTAATCTTGATTGTCTAGTAATTTTTAGAGCC

SEQ ID NO: 195 - DNA, 444 bp, Zea mays
  misc_feature (1)..(444): Ceres cDNA ID no. 5708788
  misc_feature (1)..(444): Also known as  Ceres CDNA ID no. 0
ggcacgtggatccggaacaacctcgaccscggcaggctygacctcttytactgratgctggccctgctcggcgtcgccaacttcgccgtyttcgtcgtyttcgccaggcggcaccagtacaaggccaccagcttgccgtcgtcggtggcgcccgacggcgccgggcacaaggagatggacgacttcgtcgcagtcacggaggccgtggaaggagtggacgtgtagggcgcgcatgtcagactcacacttcatcggtgggtgtgggtggcctctgctgtttaattttgcctttgggtagtgtgtatgtgtatggcgaagttttctttctcttgccagtttccagtttgctgctgcttcggcctgctctcctgtaaataacataggagacatgctaattgaggccaagtctttatccagttagatcaacaagatattgaattgggc

SEQ ID NO: 196 - protein, 444 aa, Zea mays
GGCACGTGGATCCGGAACAACCTCGACCSCGGCAGGCTYGACCTCTTYTACTGRATGCTGGCCCTGCTCGGCGTCGCCAACTTCGCCGTYTTCGTCGTYTTCGCCAGGCGGCACCAGTACAAGGCCACCAGCTTGCCGTCGTCGGTGGCGCCCGACGGCGCCGGGCACAAGGAGATGGACGACTTCGTCGCAGTCACGGAGGCCGTGGAAGGAGTGGACGTGTAGGGCGCGCATGTCAGACTCACACTTCATCGGTGGGTGTGGGTGGCCTCTGCTGTTTAATTTTGCCTTTGGGTAGTGTGTATGTGTATGGCGAAGTTTTCTTTCTCTTGCCAGTTTCCAGTTTGCTGCTGCTTCGGCCTGCTCTCCTGTAAATAACATAGGAGACATGCTAATTGAGGCCAAGTCTTTATCCAGTTAGATCAACAAGATATTGAATTGGGC

SEQ ID NO: 197 - DNA, 430 bp, Zea mays
  misc_feature (1)..(430): Ceres cDNA ID no. 5724757
  misc_feature (1)..(430): Also known as  Ceres CDNA ID no. 0
gcccgggttcgtgcttcgttcagtaaagcaagcagccaagcaggaaggtaccctcctacccacgccacgaggtgctctgccttcgtgtaccatatctgtgtgtaatccmcggaaacaatctgtataataatctgtctccgttttcgatttcccaaagtsgaaataaaaccgcmccgttcaaacctccttcgagctcgggcagtactgcatttgttttctggcggcggggtgcgtcgctgtcggggaccggacgccatcttttcctcagtttggccttgacctgaaacccgctggtccaagctgcgcattaatggsgcgtgtaatttgcgaccmcctgttgtgcttgggtggtttggagtgacgacaatgggtttggcaccttgttctatacttccaatatagagagagaggtcactgtccttcccmtgcc

SEQ ID NO: 198 - protein, 430 aa, Zea mays
GCCCGGGTTCGTGCTTCGTTCAGTAAAGCAAGCAGCCAAGCAGGAAGGTACCCTCCTACCCACGCCACGAGGTGCTCTGCCTTCGTGTACCATATCTGTGTGTAATCCMCGGAAACAATCTGTATAATAATCTGTCTCCGTTTTCGATTTCCCAAAGTSGAAATAAAACCGCMCCGTTCAAACCTCCTTCGAGCTCGGGCAGTACTGCATTTGTTTTCTGGCGGCGGGGTGCGTCGCTGTCGGGGACCGGACGCCATCTTTTCCTCAGTTTGGCCTTGACCTGAAACCCGCTGGTCCAAGCTGCGCATTAATGGSGCGTGTAATTTGCGACCMCCTGTTGTGCTTGGGTGGTTTGGAGTGACGACAATGGGTTTGGCACCTTGTTCTATACTTCCAATATAGAGAGAGAGGTCACTGTCCTTCCCMTGCC

SEQ ID NO: 199 - DNA, 569 bp, Zea mays
  misc_feature (1)..(569): Ceres cDNA ID no. 5725390
  misc_feature (1)..(569): Also known as  Ceres CDNA ID no. 0
gtgtacctgaccagcctccgcggcgtccgcaagacgtacgaggactgctggtccaccaggtccgtcctccagagctacggcgtgcgcgtcgacgagcgagacctgtcgatgcacgcggggttcaaggacgagctccacgccgcgctgggctccagcgcgggcaggctcccgcaggtgttcgcggacggcaggcacctgggcggcgccgaggagatccgccggatgcacgaggccggcgagctgtcggaggcgctcgaggcctgcgagatggcgcccccgccgagctgcccgggcggcaagggcgttgccctggaggcgtgctccggctgcggcggcgtgcggttcgtgccctgcgaggagtgctccggcagctgcaaggtgttcgtcgaggaggcgggcacattcaggcggtgccccgagtgcaacgagaacgggctggtgcggtgtcctctctgctccttgtgaaaaatctcagagctgctctgctattgctatgggttatgagatttgtagtgtgccgtgtgggttactgggtttgtaagattttgctgaggagtaattttcgttct

SEQ ID NO: 200 - protein, 569 aa, Zea mays
GTGTACCTGACCAGCCTCCGCGGCGTCCGCAAGACGTACGAGGACTGCTGGTCCACCAGGTCCGTCCTCCAGAGCTACGGCGTGCGCGTCGACGAGCGAGACCTGTCGATGCACGCGGGGTTCAAGGACGAGCTCCACGCCGCGCTGGGCTCCAGCGCGGGCAGGCTCCCGCAGGTGTTCGCGGACGGCAGGCACCTGGGCGGCGCCGAGGAGATCCGCCGGATGCACGAGGCCGGCGAGCTGTCGGAGGCGCTCGAGGCCTGCGAGATGGCGCCCCCGCCGAGCTGCCCGGGCGGCAAGGGCGTTGCCCTGGAGGCGTGCTCCGGCTGCGGCGGCGTGCGGTTCGTGCCCTGCGAGGAGTGCTCCGGCAGCTGCAAGGTGTTCGTCGAGGAGGCGGGCACATTCAGGCGGTGCCCCGAGTGCAACGAGAACGGGCTGGTGCGGTGTCCTCTCTGCTCCTTGTGAAAAATCTCAGAGCTGCTCTGCTATTGCTATGGGTTATGAGATTTGTAGTGTGCCGTGTGGGTTACTGGGTTTGTAAGATTTTGCTGAGGAGTAATTTTCGTTCT

SEQ ID NO: 201 - DNA, 1150 bp, Arabidopsis thaliana
  misc_feature (1)..(1150): Ceres cDNA ID no. 6408091
atcatccgcggttcacttccttcgtttcgaaattattagggttactgcgtatttgcactctccttcttcgtctctccagcttgacaatgcctcgctatgatgatcgctatggaaacactcgcctctatgttggtcgcttatcatctagaactcgtaccagagaccttgagcgtctctttagcagatacggaagagtacgagatgtggatatgaagcgtgattatgcctttgttgaatttagtgatcctcgtgatgctgatgacgcaagatattacttggatggacgggatttcgatggaagtcgcatcactgtggaggcatcaagaggggctcctcgtggttcgcgggacaatggtagcagaggcccacctcctggttctggtcgctgttttaattgtggtgtcgatggccactgggcccgagactgcacagcaggagactggaagaataaatgttaccgctgtggtgaaagaggacacattgagagaaactgcaaaaacagtcctagtccaaagaaggccaggcagggtggaagctattccaggtcaccagtcaaatcccgctcccctcgtcgccgaaggagcccaagccgtagccgtagttacagtcgaggtcgcagctacagtcgatcgcgatccccagtgagaagagagaaaagcgtggaggacagatcacgcagtcctaaggcaatggagcgatctgtatctcccaaaggtagggaccaaagcctgagtccagaccgaaaagtgatagatgcaagcccaaagcgtggatcagactatgatggtagcccaaaagagaatggtaatggcaggaactctgcgagtcccattgttggaggtggtgaaagtcctgttggacttaatggtcaagacaggagcccgattgatgatgaggctgagcttagccgtccttcccctaaaggcagtgagtcaccttgatggttcacaggttaaaagctctatgtagcattctgtactgaaggatgttgtttcctttccctttctttctgcgtgatacttttcttttcgttgcgtgacaatcctggatgttactttgccttctctcttgatgactcttggtttgttttccgacaactttcaaactctgcgatgttacttttcattgtttagtaagaatcatgcattta

SEQ ID NO: 202 - protein, 312 aa, Arabidopsis thaliana
  misc_feature: PFam Name: RRM_1; PFam Description: RNA recognition motif.
  misc_feature: PFam Name: zf-CCHC; PFam Description: Zinc knuckle
  misc_feature: GI Number: 11346381; NR Description: splicing factor-like
  misc_feature: GI Number: 9843663; NR Description: splicing factor RSZ33
  misc_feature: GI Number: 42571091; NR Description: splicing factor RSZ33
  misc_feature: GI Number: 34895952; NR Description: putative splicing factor-like protein [Oryza sativa (japonica cultivar-group)] >gi|15528625|dbj|BAB64646.1| putative splicing factor-like protein
  misc_feature: GI Number: 62650252; NR Description: PREDICTED: similar to
HPRFTSFVSKLLGLLRICTLLLRLSSLTMPRYDDRYGNTRLYVGRLSSRTRTRDLERLFSRYGRVRDVDMKRDYAFVEFSDPRDADDARYYLDGRDFDGSRITVEASRGAPRGSRDNGSRGPPPGSGRCFNCGVDGHWARDCTAGDWKNKCYRCGERGHIERNCKNSPSPKKARQGGSYSRSPVKSRSPRRRRSPSRSRSYSRGRSYSRSRSPVRREKSVEDRSRSPKAMERSVSPKGRDQSLSPDRKVIDASPKRGSDYDGSPKENGNGRNSASPIVGGGESPVGLNGQDRSPIDDEAELSRPSPKGSESP

SEQ ID NO: 203 - DNA, 1758 bp, Arabidopsis thaliana
  misc_feature (1)..(1758): Ceres cDNA ID no. 6430069
atgaccaaatcaaagtttggagtctttggcgagcatcaagttctcacattcggaactggaaaagaactctcatggaggaagatcaaatgtgacatggcacattatcctgatgttgtggattatgaagctagtggttatcctcggcctctatatgatgggatatgcatcaatggtgttttgtattacctaggccgagttcatgatgacttagacgggtttcctgatatagtttgctttgacattaaatttgagaagtttagttatataaagaaagctaatggcatgaaacgtaactcaggagttaatcttcaaccaactcttgtaaaccacaagggtaaaatagctaaactccaggcaaatattggtcctggctcaatacgatatacaggaattcaactatgggttttagaagatgccgagaaacatcaatggtcgagttatatctacgttttgcctcctccttggaagaatataattgaggagaccaagttacgatttgttggaacgagtgacacgggggatattgtgttgtcgccatgcaatatctccaactctttctaccttctctactacaaccccgagaggaacgctatcacgagagttgaaatccaaggagtggaagccttcaagtctcataaatcttacgcctttctagactatgcagaaaacattgttaagcctaagccaactctatttttctttgtggtttcagttcatggaagtgatacaacaggaacagagtcgatttcgggtatcttagtaaatggtaaagtgaatagtccgatacctggtggtggagctcggagcttcacgttcaaggagttagctgcagctacaagaaacttccgggaagttaatttgctcggagaaggaggttttggcagagtttataagggacgtttagattcaggacaagtagtggctattaagcaattgaatccagatgggcttcaagggaaccgagagtttatagtagaagttcttatgcttagcttattgcatcatcccaatctcgttacattgatcggttactgtacttctggtgatcaaagacttcttgtctatgaatacatgccaatgggaagcttagaagatcacctttttgatcttgagtctaatcaagaaccattaagctggaatactcgaatgaaaatcgcggttggtgcagctcgaggaatagagtatcttcactgcacagctaacccgccagtgatttaccgtgatttgaaatccgcaaacatattgttagataaagagttcagtccaaaactctcggatttcggattggcgaaactcggtccagttggtgatcgaactcatgtatcgactcgtgtcatgggaacttacggttactgtgctcctgaatacgcaatgagcgggaaattaactgttaaatcggatatctactgcttcggtgtagtgttgcttgagctgattactgggagaaaagctattgatttaggtcaaaagcaaggcgagcagaatcttgttacttggtcacgtccatacctcaaggatcagaagaagtttggacatttagtggatccgtctctacgaggaaaatacccaagacggtgtttaaactatgcgattgcgattattgcaatgtgtcttaatgaagaagctcattatcgaccgttcataggtgacatagttgtggcactagagtacttagccgcacagagcagatctcatgaagctcgaaacgtctcatcaccgtcaccagagatttcaagaacgccgcgacgagacttgtaa

SEQ ID NO: 204 - protein, 585 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 8778594; NR Description: F5M15.3 [Arabidopsis thaliana] >gi|8886951|gb|AAF80637.1|AC069251_30 F2D10.13
  misc_feature: GI Number: 15217992; NR Description: protein kinase,
  misc_feature: GI Number: 8778593; NR Description: F5M15.2 [Arabidopsis thaliana]
  misc_feature: GI Number: 25344949; NR Description: protein F2D10.14 [imported] - Arabidopsis thaliana >gi|8886950|gb|AAF80636.1|AC069251_29 F2D10.14 [Arabidopsis
  misc_feature: GI Number: 34907210; NR Description: putative serine/threonine kinase PBS1 protein [Oryza sativa (japonica cultivar-group)] >gi|15408807|dbj|BAB64203.1| putative serine/threonine kinase PBS1 protein [Oryza sativa (japonica
  misc_feature: Utility: Useful for making plants with increased tolerance to
MTKSKFGVFGEHQVLTFGTGKELSWRKIKCDMAHYPDVVDYEASGYPRPLYDGICINGVLYYLGRVHDDLDGFPDIVCFDIKFEKFSYIKKANGMKRNSGVNLQPTLVNHKGKIAKLQANIGPGSIRYTGIQLWVLEDAEKHQWSSYIYVLPPPWKNIIEETKLRFVGTSDTGDIVLSPCNISNSFYLLYYNPERNAITRVEIQGVEAFKSHKSYAFLDYAENIVKPKPTLFFFVVSVHGSDTTGTESISGILVNGKVNSPIPGGGARSFTFKELAAATRNFREVNLLGEGGFGRVYKGRLDSGQVVAIKQLNPDGLQGNREFIVEVLMLSLLHHPNLVTLIGYCTSGDQRLLVYEYMPMGSLEDHLFDLESNQEPLSWNTRMKIAVGAARGIEYLHCTANPPVIYRDLKSANILLDKEFSPKLSDFGLAKLGPVGDRTHVSTRVMGTYGYCAPEYAMSGKLTVKSDIYCFGVVLLELITGRKAIDLGQKQGEQNLVTWSRPYLKDQKKFGHLVDPSLRGKYPRRCLNYAIAIIAMCLNEEAHYRPFIGDIVVALEYLAAQSRSHEARNVSSPSPEISRTPRRDL

SEQ ID NO: 205 - DNA, 2673 bp, Arabidopsis thaliana
  misc_feature (1)..(2673): Ceres cDNA ID no. 6430683
atgaaatctcttcactggtttttgcatcttttgatcatagcttttaccgttttgagatcagtggaagctcaaaatcaagcaggatttattagtttggattgtgggttggtgcctaaggaaactacttatacagagaagtcgacgaatataacatacaaatcagacgtggattacatcgacagtggattggtcggaaagatcaatgatgcatacaaaactcagtttcagcaacaggtttgggccgtgagaagcttccctgtaggtcaaagaaactgttacaatgtcaacctcacggcaaacaacaaatatttgatcagaggaacctttgtgtatgggaattatgatggcctgaatcagttcccaagttttgatcttcatatcggtcctaacaaatggtcgtctgttaaaatactaggagtaacaaatacttctatgcatgagataatccatgtcgtaccacaagatagtcttgaagtttgtcttgttaagactggaccgacgacaccattcatttcgtcgctggaggttcgtccattgaacaatgaaagttatctcacgcaaagtggatcattgatgttgttcgccagagtatactttccatccagttcatcatctttcattaggtatgatgaggacatacatgaccgtgtttggaattcattcacagatgatgaaaccgtctggataagtacagacctcccgatcgatacaagtaactcctatgacatgcctcaatccgtgatgaagacagctgctgtccctaaaaatgctagtgagccatggctcttatggtggactcttgatgagaacaccgcacaatcatatgtatatatgcatttcgccgaagtccagaatcttacagcaaatgaaaccagagaattcaacattacttacaatggtggtctacgttggttcagctatttgaggcctcctaatctcagcatttcaacgatctttaatccaagggcagtgagttcttcaaatgggatatttaatttcacattcgcaatgacgggtaactcaactctgcctccccttctcaacgccctcgagatttatacagtcgtagacattctacagctagagacaaacaaagatgaagtttctgctatgatgaacatcaaagaaacatatggtttaagcaaaaagataagctggcaaggagatccgtgtgctcctcagctttatcggtgggaaggtttaaattgtagttatccggactccgagggatcaagaatcatatccttgaacttgaatgggagcgagttgacaggttctataacatctgacatatccaagctaacactgttgacagtattagatttatcaaataatgatttatcaggagatattccaacattttttgctgagatgaagtcgttgaaactcataaacttaagtggaaacccgaaccttaatctcacagcaattccagactctcttcagcaaagggtaaacagcaaatctttaacactaattttgggtgaaaacctgactctgactcccaaaaaagagagtaaaaaggttcccatggttgctatcgcagcgtcagtggctggcgtgttcgctctgctcgttatcttagccatattttttgtcattaaaaggaaaaatgtgaaagctcataagtctccaggaccacccccattagtcactcccggtatagttaaaagtgagacaagatcatccaatccatcaatcataacaagggaacgcaagatcacgtatccagaggtactgaagatgactaataacttcgagagagttcttggcaaaggaggctttggaacagtgtatcatggaaacttggatggtgctgaagtggcagtgaaaatgctttctcattcatcagctcaaggttataaagagttcaaagcagaggttgaacttcttttaagagttcaccatagacatttggtgggacttgtgggttactgtgatgatggagacaacttggctctgatttatgaatatatggcaaatggagacctgagggagaatatgtcaggaaaacgtggaggcaatgtccttacctgggaaaacaggatgcaaatagctgtagaggctgcacaagggctggagtatctgcacaatggatgtaggcctcctatggtacatagagatgttaaaactactaacattttattgaatgagcggtgtggagcaaaactagccgactttgggctctcgagatctttcccaatcgatggcgaatgtcatgtttcgacagtggttgcgggtacacctggttacctagacccggagtactacagaacaaactggctaagcgagaagagtgacgtgtacagcttcggtgtagtgctattagagatagtcacaaaccagcctgtgatagataaaacccgggagagacctcacatcaatgactgggttgggttcatgctcactaaaggagacatcaagagcatcgttgacccgaaactgatgggggactatgatacaaacggtgcatggaagattgtggagctagctctggcctgtgtgaacccatcttcgaaccggagaccaacaatggcacacgttgtgatggagctaaacgactgtgtggccttagaaaatgcaaggcggcaaggtagtgaagagatgtactcaatgggttctgttgactatagtctctcttctacttctgactttgctcctggagccagataa

SEQ ID NO: 206 - protein, 890 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 8778538; NR Description: F22G5.7 [Arabidopsis thaliana]
  misc_feature: GI Number: 42562692; NR Description: leucine-rich repeat
  misc_feature: GI Number: 42565658; NR Description: leucine-rich repeat
  misc_feature: GI Number: 42566995; NR Description: leucine-rich repeat
  misc_feature: GI Number: 42567897; NR Description: leucine-rich repeat
MKSLHWFLHLLIIAFTVLRSVEAQNQAGFISLDCGLVPKETTYTEKSTNITYKSDVDYIDSGLVGKINDAYKTQFQQQVWAVRSFPVGQRNCYNVNLTANNKYLIRGTFVYGNYDGLNQFPSFDLHIGPNKWSSVKILGVTNTSMHEIIHVVPQDSLEVCLVKTGPTTPFISSLEVRPLNNESYLTQSGSLMLFARVYFPSSSSSFIRYDEDIHDRVWNSFTDDETVWISTDLPIDTSNSYDMPQSVMKTAAVPKNASEPWLLWWTLDENTAQSYVYMHFAEVQNLTANETREFNITYNGGLRWFSYLRPPNLSISTIFNPRAVSSSNGIFNFTFAMTGNSTLPPLLNALEIYTVVDILQLETNKDEVSAMMNIKETYGLSKKISWQGDPCAPQLYRWEGLNCSYPDSEGSRIISLNLNGSELTGSITSDISKLTLLTVLDLSNNDLSGDIPTFFAEMKSLKLINLSGNPNLNLTAIPDSLQQRVNSKSLTLILGENLTLTPKKESKKVPMVAIAASVAGVFALLVILAIFFVIKRKNVKAHKSPGPPPLVTPGIVKSETRSSNPSIITRERKITYPEVLKMTNNFERVLGKGGFGTVYHGNLDGAEVAVKMLSHSSAQGYKEFKAEVELLLRVHHRHLVGLVGYCDDGDNLALIYEYMANGDLRENMSGKRGGNVLTWENRMQIAVEAAQGLEYLHNGCRPPMVHRDVKTTNILLNERCGAKLADFGLSRSFPIDGECHVSTVVAGTPGYLDPEYYRTNWLSEKSDVYSFGVVLLEIVTNQPVIDKTRERPHINDWVGFMLTKGDIKSIVDPKLMGDYDTNGAWKIVELALACVNPSSNRRPTMAHVVMELNDCVALENARRQGSEEMYSMGSVDYSLSSTSDFAPGAR

SEQ ID NO: 207 - DNA, 2316 bp, Arabidopsis thaliana
  misc_feature (1)..(2316): Ceres cDNA ID no. 6430699
atgaagactatgaatgggtttttgcttctctcgactatagcttttgccgtttttcacttagtccaagctcaatctcaatcaggttttatcagcttggattgtggactaattcctaaggacacaacctataccgagcagataacgaacataacatacatatcagacgcggattacatcgatagtggattaaccgaaaggatcagtgattcatacaagtcacagcttcagcaacagacttggaccttaagaagcttccctgaaggtcaaagaaattgttacaacttcaatctcaaagcgaatctcaaatatctgattagaggaacgtttgtgtatgggaattatgatggtttgaatcaaatgcctaagtttgatcttcatattggtcctaataaatggacttctgttatattggaaggagtagcaaatgctaccatcttcgagataattcatgtcttaacacaagaccgtctccaagtttgtcttgtcaaaacaggacaaacgacaccgtttatatcgtcgttggaacttcgtccgttgaacaatgatacttacgtcactcaaggtgggtcgttgatgtcctttgccagaatctactttccaaagactgcatacttcctcaggtattctgatgacttgtatgaccgagtttgggttccattcagccagaatgaaacagtgtcgttaagtaccaatctaccggttgatacaagtagcaattcctacaatgtgcctcaaaatgtggcgaattccgcaattattccggcggaagctactcatcctctcaacatatggtgggatctccaaaacatcaatgcaccgtcatatgtatacatgcattttgcagaaatccaaaatcttaaagctaatgacatcagagaattcaacattacatacaatggtggtcaggtttgggaaagttccattagacctcacaatctcagcatcactacaatctctagtccaacagctttaaattcttcagatgggtttttcaatttcacttttacaatgaccacaacctctactcttcctccacttatcaatgccctcgagattctgtcgatcgcctatcgcagaaacttaaaaggaaacccgaagctcaacctcacagttccagattctattaagcataggataaacaacaaatctttaaaactaattatagatgaaaaccagagtagtgaaaaacacggtataaagtttcctttggttgctatcttagcatcagtggctggtgtgatcgcattactagctatctttaccatatgtgtcatttttaaaagagaaaaacagggaagtggtgaagctccaactagggttaatactgagatcagatcatcctatcaatcaatcgaaacaaaggatcgaaaatttacgtattccgagatactaaagatgacgaataactttgagagagttcttggtaaaggaggatatggaagagtgtattatggaaaattggatgatactgaagtagctgtgaaaatgctctttcattcctcagctgaacaagattataaacatttcaaagcagaggttgaactacttttaagagtccaccatagacatttggtgggacttgttggttactgtgatgatggagataactttgccttgatttatgaatacatggcaaatggagacttgaaggagaatatgtctggaaaccgcagtggacatgttctaagttgggaaaacagaatgcaaatagctatggaggcagcacaaggattggagtatctacataatggaagtagaccacctatggtccatagagatgtgaaaactactaacattttattgaatgagctgtatcaagcgaaactagctgattttgggctctctagatcttccccggtggatggtgaatcttatgtatcaacaatcgttgccggaacacctggttacttagaccctgaaacaaacttgttaagcgagaagactgatgtgtacagctttggggtagttttattagaaatcatcacaaaccagcctgtgattgatacaacccgcgagaaagcgcatattacagattgggttggatttaagctcatggaaggagacattaggaatattattgacccgaaactgattaaggaatttgatacaaacggtgtgtggaaggctgtggagttggctttgtcttgtgtaaaccctacgtcaaaccatagaccgacgatgccacatgttgtgatggagctaaaagagtgtctggactctgagattgccaggaaacaaggtagtcaagacatgttttctagagattctattgaattaaccttctctcctactggattctcacctggaccgaggtga

SEQ ID NO: 208 - protein, 771 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 8778538; NR Description: F22G5.7 [Arabidopsis thaliana]
  misc_feature: GI Number: 42561786; NR Description: leucine-rich repeat
  misc_feature: GI Number: 42562692; NR Description: leucine-rich repeat
  misc_feature: GI Number: 42565658; NR Description: leucine-rich repeat
  misc_feature: GI Number: 15218059; NR Description: light repressible receptor protein kinase, putative; protein id: At1g51890.1
MKTMNGFLLLSTIAFAVFHLVQAQSQSGFISLDCGLIPKDTTYTEQITNITYISDADYIDSGLTERISDSYKSQLQQQTWTLRSFPEGQRNCYNFNLKANLKYLIRGTFVYGNYDGLNQMPKFDLHIGPNKWTSVILEGVANATIFEIIHVLTQDRLQVCLVKTGQTTPFISSLELRPLNNDTYVTQGGSLMSFARIYFPKTAYFLRYSDDLYDRVWVPFSQNETVSLSTNLPVDTSSNSYNVPQNVANSAIIPAEATHPLNIWWDLQNINAPSYVYMHFAEIQNLKANDIREFNITYNGGQVWESSIRPHNLSITTISSPTALNSSDGFFNFTFTMTTTSTLPPLINALEILSIAYRRNLKGNPKLNLTVPDSIKHRINNKSLKLIIDENQSSEKHGIKFPLVAILASVAGVIALLAIFTICVIFKREKQGSGEAPTRVNTEIRSSYQSIETKDRKFTYSEILKMTNNFERVLGKGGYGRVYYGKLDDTEVAVKMLFHSSAEQDYKHFKAEVELLLRVHHRHLVGLVGYCDDGDNFALIYEYMANGDLKENMSGNRSGHVLSWENRMQIAMEAAQGLEYLHNGSRPPMVHRDVKTTNILLNELYQAKLADFGLSRSSPVDGESYVSTIVAGTPGYLDPETNLLSEKTDVYSFGVVLLEIITNQPVIDTTREKAHITDWVGFKLMEGDIRNIIDPKLIKEFDTNGVWKAVELALSCVNPTSNHRPTMPHVVMELKECLDSEIARKQGSQDMFSRDSIELTFSPTGFSPGPR

SEQ ID NO: 209 - DNA, 1146 bp, Arabidopsis thaliana
  misc_feature (1)..(1146): Ceres cDNA ID no. 6430712
atggagaagaagaaggtgacgattccacaagtgtgtcatggccattcaagacctgttgttgatttgttctacagtccaattactcctgacggtttcttcctcatcagcgctagcaaagaatactcatgtcttgatggtttagattcgcatccaatgttgagaaatggggaaactggagactggattggtacatttgaagggcataaaggtgcagtttggagttcttgtctggataacaatgcattacgtgctgcatctgcttctgccgatttttcagccaaactttgggatgcgttaacaggggatgtgctgcattcttttgagcacaagcatattgtccgagcatgcgccttctcagaggatacaaaatcgttgctcacaggagggtttgagaaaattcttcgtgtttttgacatgaatcggttggatgcacctcctacagaagttgataaatctcctggttctatcagaaccctcacatggcttcacagtgatcaaacaatattaagttcatgtactgatattggcggtgtaaggttatgggatgtgaggagtgggaaaattgtgcaaacgttagaaactaagtctcctgtcaccagtgctgaagtgagccaagatggacggtatataacaactgctgatgggtcaactgttaaattctgggacgctaaccattttggactagtgaagagttacgacatgccctgcaatattgaatctgcatcgttggagccaaagtctggtgaaaaatttgttgctggtggagaggatatgtgggtccgagtgtttgatttctacactggcgaagagattgttaaattccagatagcttcaagcttaattggagtttctgactctgttataaactccatgagtgaagagcttaatagatctttgaagcatggatgcaacaagggacatcacggtccagtacactgcgttaggtttactcccactggtttatcctatgcctcgggatctgaagacgggacaatcagaatctggcaaacaacaccagcaaatcccgaagagaacgaaactagctcgaggagagtgaagcatagcgtggatgaagtttcaaagaagattgaaggctttcacatcaacaaagaaggaaaaaccgcagagaaaccatctgatacttaa

SEQ ID NO: 210 - protein, 381 aa, Arabidopsis thaliana
  misc_feature: PFam Name: WD40; PFam Description: WD domain, G-beta repeat
  misc_feature: GI Number: 50906147; NR Description: putative serine-threonine kinase receptor-associated protein [Oryza sativa (japonica cultivar-group)] >gi|46390530|dbj|BAD16018.1| putative serine-threonine kinase receptor-associated protein [Oryza sativa
  misc_feature: GI Number: 12667270; NR Description: serine-threonine kinase
  misc_feature: GI Number: 4519417; NR Description: WD-40 repeat protein
  misc_feature: GI Number: 31209853; NR Description: ENSANGP00000003345 [Anopheles gambiae] >gi|30176603|gb|EAA09548.2| ENSANGP00000003345
  misc_feature: GI Number: 31209851; NR Description: ENSANGP00000021722 [Anopheles gambiae] >gi|30176604|gb|EAA09322.2| ENSANGP00000021722
MEKKKVTIPQVCHGHSRPVVDLFYSPITPDGFFLISASKEYSCLDGLDSHPMLRNGETGDWIGTFEGHKGAVWSSCLDNNALRAASASADFSAKLWDALTGDVLHSFEHKHIVRACAFSEDTKSLLTGGFEKILRVFDMNRLDAPPTEVDKSPGSIRTLTWLHSDQTILSSCTDIGGVRLWDVRSGKIVQTLETKSPVTSAEVSQDGRYITTADGSTVKFWDANHFGLVKSYDMPCNIESASLEPKSGEKFVAGGEDMWVRVFDFYTGEEIVKFQIASSLIGVSDSVINSMSEELNRSLKHGCNKGHHGPVHCVRFTPTGLSYASGSEDGTIRIWQTTPANPEENETSSRRVKHSVDEVSKKIEGFHINKEGKTAEKPSDT

SEQ ID NO: 211 - DNA, 771 bp, Arabidopsis thaliana
  misc_feature (1)..(771): Ceres cDNA ID no. 6431901
atgacaactggccgaccaaataatattttagcattgaaaatttctactagatcaagctctctcactgtcggagagcaattctgcgccgtctttatacctttctttgccattatcgatgtcctagtttcctccgtcggacaatgcttcgattgccgcagcacatcgcctcggacatgtcagcacgcggatctggaacgtcttgctcgtgaatctcaattttcagtcaatgaagttgaagctttgtatgagctattcaagaaattgagctgttcaattattgatgacggcttgattcacaaggaagagcttagactggcgctgttccaagctccatatggtgagaacctctttcttgatagggtttttgatttgttcgatgaaaagaagaatggggttattgagtttgaggaattcatccatgcactcagtgtctttcatccctatgcatcaatccaggagaagaccgattttgcatttaggctctatgatctaagacaaactggattcattgagcgagaagaggtgcaacaaatggtttctgctattctcttggaatctgatatgatgctatccgatgaacttctgaccatgattattgataaaacatttgctgatgcagattctgacaaagacggtaaaattagtaaggatgaatggaatgtctatgtgcataaacatcctagcttgttgaagaatatgactcttccttacctaaaggatgtgacgacagcattcccaagttttatattcaacactgaggttgaagactga

SEQ ID NO: 212 - protein, 256 aa, Arabidopsis thaliana
  misc_feature: PFam Name: efhand; PFam Description: EF hand
  misc_feature: GI Number: 56785307; NR Description: calcineurin B-like [Oryza sativa (japonica cultivar-group)] gi|56784147|dbj|BAD81532.1| calcineurin B-like [Oryza sativa
  misc_feature: GI Number: 34913062; NR Description: putative calcium sensor protein [Oryza sativa (japonica cultivar-group)] >gi|13161354|dbj|BAB32945.1| putative calcium sensor protein [Oryza sativa (japonica cultivar-group)]
  misc_feature: GI Number: 22137326; NR Description: calcineurin B [Pisum sativum]
  misc_feature: GI Number: 22655046; NR Description: At5g55990/MDA7_3 [Arabidopsis thaliana] >gi|9758619|dbj|BAB09281.1| calcineurin B-like protein 2 [Arabidopsis thaliana] >gi|15450407|gb|AAK96497.1| AT5g55990/MDA7_3 [Arabidopsis
  misc_feature: GI Number: 37536918; NR Description: putative calcineurin [Oryza sativa (japonica cultivar-group)] >gi|12597890|gb|AAG60198.1| putative calcineurin [Oryza sativa] >gi|31433550|gb|AAP55048.1| putative calcineurin [Oryza sativa
MTTGRPNNILALKISTRSSSLTVGEQFCAVFIPFFAIIDVLVSSVGQCFDCRSTSPRTCQHADLERLARESQFSVNEVEALYELFKKLSCSIIDDGLIHKEELRLALFQAPYGENLFLDRVFDLFDEKKNGVIEFEEFIHALSVFHPYASIQEKTDFAFRLYDLRQTGFIEREEVQQMVSAILLESDMMLSDELLTMIIDKTFADADSDKDGKISKDEWNVYVHKHPSLLKNMTLPYLKDVTTAFPSFIFNTEVED

SEQ ID NO: 213 - DNA, 1169 bp, Arabidopsis thaliana
  misc_feature (1)..(1169): Ceres cDNA ID no. 6432908
aagtcttggaatcttcgggacgtttcttgttgctctctttgactttcttgaagtatttgtttatgttttcccatttctctttgcatctctttgagttcctgttgaatcctaaccttctcattcccgctgatatctcttcccacaatggtccttttggtccgttttcttgatatttcgaatcaagattcgtcctcagctttatcaatgcttctatctccactttcggccaccgcgacgagctcgctgaagctgcaggagtcatattctgatcaccaccattgtccgttttcgttgtgtctaacgtcgacacaaccgcttgaattggctgcggaagcggagcaggaggttgcggtggaggagaccgttgaggcggttgctgctgattgttgttattaagctgcattgatggtcgaacttgttgcggctgaggctgcggttgtggctgattcggttgtttctctgacagtttttgaagaaaggccataacagcagcgtcttttgcagcggacatagagcgttcttgagctaagatctcgtgctcgcggttgattctggcaatctcttgaactctccaagactcttctctaaccaatctctcgtgttctcgcttttcaacagcttccaagaatttgcgttgaagctcttcctgtttatcaactacttgtttcatcaaccgctcgaaaaacaccttccatttcctcttccttttcttccttgtagtcgcagttccaccacccatctccatgtcagaagaagtcgaataagaagacgaagacgatgtagaattatccgatagaaaatcaccggagatgtttggaaacgaaggtacattaatctgctgagtatacggaggaattgatgaagaaggaagcgtcggcataactgtcgttaccggaggaggagttgaaaatatggagctgttgttgttgttgttgttgttgttgttgttgttttgctgtggtcgaagaggcgtttgttgttgatgatggtggagtgaggttgtagattgagactcgagagcttctaattgatcaaagaagcgataagttttgccttcggattttccggtacgaccttctttggttcgtttgtggtatttgtaaacgttctcgaatttctctttgcatttctttgcgtttcttatgtaaccatgctccgccattttccta

SEQ ID NO: 214 - protein, 83 aa, Arabidopsis thaliana
MVLLVRFLDISNQDSSSALSMLLSPLSATATSSLKLQESYSDHHHCPFSLCLTSTQPLELAAEAEQEVAVEETVEAVAADCCY

SEQ ID NO: 215 - DNA, 978 bp, Arabidopsis thaliana
  misc_feature (1)..(978): Ceres cDNA ID no. 6437138
atgagcagcgaagaagagaagacagtgtgtgtgacaggagcttcaggttacattgcttcatggatcgttaagcttcttcttctccgtggttacaccgttaaagcctctgttcgtgatccaaatgatccaaggaaaacagagcatttgcttgcattggaaggagcagaggaaaggcttaaattgttcaaagcaaacttgttagaagaaggctctttcgattcagcaatcgatggttgcgaaggagttttccacaccgcatcgccattctatcatgacgtcaaggaccctcaggctgagttacttgatccggcagtgaaaggaacaatcaatgttctaagctcttgtttgaagacttcctcggttaagagagtcgtcttaacctcatcgatagcagctgttgctttcaatggaatgcctcgaacacccgaaaccatagttgacgaaacttggttcgccgatcctgactattgcagagcttccaagctatggtatgtactctcgaagacattagctgaaaacgcagcgtggaaattcgcaaaagagaacaatttacagctggtttcgataaatccggctatggtgattggtcctctcttacagccaacgctaaacactagtgctgctgcagtactaagcttgatcaaaggagcacaaacgtttcctaatgcgacgttcgggtgggttaacgttaaagatgtagcgaacgctcatattcaagcgtttgagaatccagatgctgatgggagatactgtttagtggagagagttgctcattactctgaagttgttaacattttgcatgatctttaccctgattttcaactccctgagaagtgtgcagatgaaaagatatatattccaacatataaagtgtctaaagagaaagcagagtctcttggggttgagtttgtgccattggaagttagcattaaagagactgtagagagcttgagagataaagggttcatcagattttga

SEQ ID NO: 216 - protein, 325 aa, Arabidopsis thaliana
  misc_feature: PFam Name: Epimerase; PFam Description: NAD dependent
  misc_feature: PFam Name: 3Beta_HSD; PFam Description: 3-beta
  misc_feature: GI Number: 1143445; NR Description: cinnamyl alcohol dehydrogenase [Eucalyptus gunnii] gi|7431409|pir||T10736
  misc_feature: GI Number: 30694964; NR Description: cinnamyl-alcohol
  misc_feature: GI Number: 15239741; NR Description: cinnamyl-alcohol dehydrogenase - like protein; protein id: At5g19440.1, supported by
  misc_feature: GI Number: 21594240; NR Description: cinnamyl-alcohol
  misc_feature: GI Number: 37029996; NR Description: NADPH-dependent cinnamyl
MSSEEEKTVCVTGASGYIASWIVKLLLLRGYTVKASVRDPNDPRKTEHLLALEGAEERLKLFKANLLEEGSFDSAIDGCEGVFHTASPFYHDVKDPQAELLDPAVKGTINVLSSCLKTSSVKRVVLTSSIAAVAFNGMPRTPETIVDETWFADPDYCRASKLWYVLSKTLAENAAWKFAKENNLQLVSINPAMVIGPLLQPTLNTSAAAVLSLIKGAQTFPNATFGWVNVKDVANAHIQAFENPDADGRYCLVERVAHYSEVVNILHDLYPDFQLPEKCADEKIYIPTYKVSKEKAESLGVEFVPLEVSIKETVESLRDKGFIRF

SEQ ID NO: 217 - DNA, 1038 bp, Arabidopsis thaliana
  misc_feature (1)..(1038): Ceres cDNA ID no. 6442528
  misc_feature (1)..(1038): Also known as  Ceres CDNA ID no. 0
atgaagacagttcttgtaatcataaactgtatattcttggccattggaaactgtggaggccctctaatgatgcgtctctacttccaaaatggtggcgaaaggatctggtttccaagcttccttcaaaccgttggttgtccactcattttcttccctcttctcttatctttcctccgccgtcgtcgttgccttgaagaacaagaaacgactccatttttcctcatgaaacctcctctctttatcgccgctatcgttgttggtttgctcgtgggatttgacaattacctctactcttacgggttagcttatatccctgtttctactgcgtctttgatcatctccgcgcaattaggcttcactgctctctttgcattttttatggtgaagcaaaagttcacacctttcactataaacgctatcgttttgctcactggtggtgccgtagtccttgcccttaactctgatagtgacaagcttgcaaacgagacacacaaggaatatgttgttgggttcatcatgactcttggtgcagctcttctctatgggtttatattgccacttgtcgagctttcttacaagaaatctggtcagcgaatcacgtatacgctcgcgctcgagttccagatggtcttatgctttgctgccacttgtgtctgcctcgtggggatgctagccgctggcgatttcaaggtgatagcaggagaagcaagagattttaagcttggagagtctttgtactatgtggtgattgtgttcacggccataatctggcaagcattttttgtgggagctattgggttgatcttctgtgcatcgtctctggtctctggaattatggtcagtgctctgcttccggtgacggtgatcttggccgtcatttgcttccaggagaagtttcaggcggggaaaggtgtcgctttggctctctccctctggggatcagtctcttatttctatggacaggttaaatccgaggagaagactaaggctcaggatacacaactgtctcagcttccagttactgattatgtagcttaa

SEQ ID NO: 218 - protein, 1038 aa, Arabidopsis thaliana
ATGAAGACAGTTCTTGTAATCATAAACTGTATATTCTTGGCCATTGGAAACTGTGGAGGCCCTCTAATGATGCGTCTCTACTTCCAAAATGGTGGCGAAAGGATCTGGTTTCCAAGCTTCCTTCAAACCGTTGGTTGTCCACTCATTTTCTTCCCTCTTCTCTTATCTTTCCTCCGCCGTCGTCGTTGCCTTGAAGAACAAGAAACGACTCCATTTTTCCTCATGAAACCTCCTCTCTTTATCGCCGCTATCGTTGTTGGTTTGCTCGTGGGATTTGACAATTACCTCTACTCTTACGGGTTAGCTTATATCCCTGTTTCTACTGCGTCTTTGATCATCTCCGCGCAATTAGGCTTCACTGCTCTCTTTGCATTTTTTATGGTGAAGCAAAAGTTCACACCTTTCACTATAAACGCTATCGTTTTGCTCACTGGTGGTGCCGTAGTCCTTGCCCTTAACTCTGATAGTGACAAGCTTGCAAACGAGACACACAAGGAATATGTTGTTGGGTTCATCATGACTCTTGGTGCAGCTCTTCTCTATGGGTTTATATTGCCACTTGTCGAGCTTTCTTACAAGAAATCTGGTCAGCGAATCACGTATACGCTCGCGCTCGAGTTCCAGATGGTCTTATGCTTTGCTGCCACTTGTGTCTGCCTCGTGGGGATGCTAGCCGCTGGCGATTTCAAGGTGATAGCAGGAGAAGCAAGAGATTTTAAGCTTGGAGAGTCTTTGTACTATGTGGTGATTGTGTTCACGGCCATAATCTGGCAAGCATTTTTTGTGGGAGCTATTGGGTTGATCTTCTGTGCATCGTCTCTGGTCTCTGGAATTATGGTCAGTGCTCTGCTTCCGGTGACGGTGATCTTGGCCGTCATTTGCTTCCAGGAGAAGTTTCAGGCGGGGAAAGGTGTCGCTTTGGCTCTCTCCCTCTGGGGATCAGTCTCTTATTTCTATGGACAGGTTAAATCCGAGGAGAAGACTAAGGCTCAGGATACACAACTGTCTCAGCTTCCAGTTACTGATTATGTAGCTTAA

SEQ ID NO: 219 - DNA, 810 bp, Arabidopsis thaliana
  misc_feature (1)..(810): Ceres cDNA ID no. 6442850
  misc_feature (1)..(810): Also known as  Ceres CDNA ID no. 0
atgtcggggaaactttggatcccgagatttattctcatcactctactgtttattagctcacgagttaactctcaatgtgaattcagtttcactggacgcaacaaggtctttcatttcaacctagcatcttcgattcggaattatcctcacggtgtgctcagcgaagatgggttttataaagtggaagcgaacagttccgtgttatggtttcagctttgtgacgtgctgattttcaatcatgatccccctcgatgtgttggttgcgaagattgtggaggtccatctcactgcggaacgtcatgtagtgcacttgtgtcagaaaatgtaagagggtatgatgtatgcacttctctagggcatgcctcaagcacaaaagttgatattattgataaagaggatcctggcaaaggcgtcattgttcagatgtcaactggaaataggaaccaaaattgctcgctttcagtttctgttatttgccagaaaactaaagttgatggaccactcactttggcgaaatctggtacctgtcagtatgctactcagctgcgacatcctgccggttgtgcagcagctatatccggccatagtagtggatggggctgtatcttgtgcctgtttggagcttatctggtgggtggtgcagtatatcggtatttctcccttggaattcgtggcatagatgtaatcccgaatatggattactgggccactgtacctcacagtatacagagctgttttggctcactattttcaagattcggggggtctattcgtggtcagcaaacctcatattctcaggtcaacttctga

SEQ ID NO: 220 - protein, 810 aa, Arabidopsis thaliana
ATGTCGGGGAAACTTTGGATCCCGAGATTTATTCTCATCACTCTACTGTTTATTAGCTCACGAGTTAACTCTCAATGTGAATTCAGTTTCACTGGACGCAACAAGGTCTTTCATTTCAACCTAGCATCTTCGATTCGGAATTATCCTCACGGTGTGCTCAGCGAAGATGGGTTTTATAAAGTGGAAGCGAACAGTTCCGTGTTATGGTTTCAGCTTTGTGACGTGCTGATTTTCAATCATGATCCCCCTCGATGTGTTGGTTGCGAAGATTGTGGAGGTCCATCTCACTGCGGAACGTCATGTAGTGCACTTGTGTCAGAAAATGTAAGAGGGTATGATGTATGCACTTCTCTAGGGCATGCCTCAAGCACAAAAGTTGATATTATTGATAAAGAGGATCCTGGCAAAGGCGTCATTGTTCAGATGTCAACTGGAAATAGGAACCAAAATTGCTCGCTTTCAGTTTCTGTTATTTGCCAGAAAACTAAAGTTGATGGACCACTCACTTTGGCGAAATCTGGTACCTGTCAGTATGCTACTCAGCTGCGACATCCTGCCGGTTGTGCAGCAGCTATATCCGGCCATAGTAGTGGATGGGGCTGTATCTTGTGCCTGTTTGGAGCTTATCTGGTGGGTGGTGCAGTATATCGGTATTTCTCCCTTGGAATTCGTGGCATAGATGTAATCCCGAATATGGATTACTGGGCCACTGTACCTCACAGTATACAGAGCTGTTTTGGCTCACTATTTTCAAGATTCGGGGGGTCTATTCGTGGTCAGCAAACCTCATATTCTCAGGTCAACTTCTGA

SEQ ID NO: 221 - DNA, 1566 bp, Arabidopsis thaliana
  misc_feature (1)..(1566): Ceres cDNA ID no. 6443376
  misc_feature (1)..(1566): Also known as  Ceres CDNA ID no. 0
atggaagctgctaatgagcctgttaatggcggatccgtacagatccgaacagagaacaacgaaagacgaaagcttcctaatttcttacaaagcgtcaacatgaaatacgtcaagctaggttatcattacctcattactcatctcttcaagctctgtttggttccattaatggcggttttagtcacagagatctctcgattaacaacagacgatctttaccagatttggcttcatctccaatacaatctcgttgctttcatctttctctctgctttagctatctttggctccaccgtttacatcatgagtcgtcccagatctgtttatctcgttgattactcttgttatcttcctccggagagtcttcaggttaagtatcagaagtttatggatcattctaagttgattgaagatttcaatgagtcatctttagagtttcagaggaagattcttgaacgttctggtttaggagaagagacttatctccctgaagctttacattgtatccctccgaggcctacgatgatggcggctcgtgaggaatctgagcaggtaatgtttggtgctcttgataagcttttcgagaataccaagattaaccctagggatattggtgtgttggttgtgaattgtagcttgtttaatcctacaccttcgttgtcagctatgattgttaacaagtataagcttagagggaatgttaagagttttaaccttggtggaatggggtgtagtgctggtgttatctctatcgatttagctaaagatatgttgcaagttcataggaatacttatgctgttgtggttagtactgagaacattactcagaattggtattttgggaataagaaggctatgttgattccgaattgtttgtttcgtgttggtggttcggcgattttgttgtcgaacaaggggaaagatcgtagacggtctaagtataagcttgttcataccgttaggactcataaaggagctgttgagaaggctttcaactgtgtttaccaagagcaagatgataatgggaagaccggggtttcgttgtcgaaagatcttatggctatagctggggaagctcttaaggcgaatatcactactttaggtcctttggttcttcctataagtgagcagattctgtttttcatgactttggttacgaagaaactgtttaactcgaagctgaagccgtatattccggatttcaagcttgcgtttgatcatttctgtatccatgctggtggtagagctgtgattgatgagcttgagaagaatctgcagctttcgcagactcatgtcgaggcatccagaatgacactgcacagatttggaaacacttcttcgagctcgatttggtatgaactggcttacatagaggctaaaggtaggatgaagaaaggaaaccgggtttggcagattgcttttggaagtgggtttaagtgtaacagtgcagtttgggtggctctaaacaatgtcaagccttcggttagtatccgtgggaacactgcatcgaccgatatccggttaagctcgacttctgatttaatgaaaaaccatttgtttggttag

SEQ ID NO: 222 - protein, 1566 aa, Arabidopsis thaliana
ATGGAAGCTGCTAATGAGCCTGTTAATGGCGGATCCGTACAGATCCGAACAGAGAACAACGAAAGACGAAAGCTTCCTAATTTCTTACAAAGCGTCAACATGAAATACGTCAAGCTAGGTTATCATTACCTCATTACTCATCTCTTCAAGCTCTGTTTGGTTCCATTAATGGCGGTTTTAGTCACAGAGATCTCTCGATTAACAACAGACGATCTTTACCAGATTTGGCTTCATCTCCAATACAATCTCGTTGCTTTCATCTTTCTCTCTGCTTTAGCTATCTTTGGCTCCACCGTTTACATCATGAGTCGTCCCAGATCTGTTTATCTCGTTGATTACTCTTGTTATCTTCCTCCGGAGAGTCTTCAGGTTAAGTATCAGAAGTTTATGGATCATTCTAAGTTGATTGAAGATTTCAATGAGTCATCTTTAGAGTTTCAGAGGAAGATTCTTGAACGTTCTGGTTTAGGAGAAGAGACTTATCTCCCTGAAGCTTTACATTGTATCCCTCCGAGGCCTACGATGATGGCGGCTCGTGAGGAATCTGAGCAGGTAATGTTTGGTGCTCTTGATAAGCTTTTCGAGAATACCAAGATTAACCCTAGGGATATTGGTGTGTTGGTTGTGAATTGTAGCTTGTTTAATCCTACACCTTCGTTGTCAGCTATGATTGTTAACAAGTATAAGCTTAGAGGGAATGTTAAGAGTTTTAACCTTGGTGGAATGGGGTGTAGTGCTGGTGTTATCTCTATCGATTTAGCTAAAGATATGTTGCAAGTTCATAGGAATACTTATGCTGTTGTGGTTAGTACTGAGAACATTACTCAGAATTGGTATTTTGGGAATAAGAAGGCTATGTTGATTCCGAATTGTTTGTTTCGTGTTGGTGGTTCGGCGATTTTGTTGTCGAACAAGGGGAAAGATCGTAGACGGTCTAAGTATAAGCTTGTTCATACCGTTAGGACTCATAAAGGAGCTGTTGAGAAGGCTTTCAACTGTGTTTACCAAGAGCAAGATGATAATGGGAAGACCGGGGTTTCGTTGTCGAAAGATCTTATGGCTATAGCTGGGGAAGCTCTTAAGGCGAATATCACTACTTTAGGTCCTTTGGTTCTTCCTATAAGTGAGCAGATTCTGTTTTTCATGACTTTGGTTACGAAGAAACTGTTTAACTCGAAGCTGAAGCCGTATATTCCGGATTTCAAGCTTGCGTTTGATCATTTCTGTATCCATGCTGGTGGTAGAGCTGTGATTGATGAGCTTGAGAAGAATCTGCAGCTTTCGCAGACTCATGTCGAGGCATCCAGAATGACACTGCACAGATTTGGAAACACTTCTTCGAGCTCGATTTGGTATGAACTGGCTTACATAGAGGCTAAAGGTAGGATGAAGAAAGGAAACCGGGTTTGGCAGATTGCTTTTGGAAGTGGGTTTAAGTGTAACAGTGCAGTTTGGGTGGCTCTAAACAATGTCAAGCCTTCGGTTAGTATCCGTGGGAACACTGCATCGACCGATATCCGGTTAAGCTCGACTTCTGATTTAATGAAAAACCATTTGTTTGGTTAG

SEQ ID NO: 223 - DNA, 1303 bp, Arabidopsis thaliana
  misc_feature (1)..(1303): Ceres cDNA ID no. 6443848
attctttgtcgtgttcttttaattaaccttttgcaatttgtcttgtgtttctcacaacacaaaaacttgtaaaagtgttaaaaaatcaagatctgaaaaatcttatcaccgcttctaggtttttcagttttttttcttccttttcctgatctaaattaacttatatttcttagggtttcacttcttgaaacatttaatcagaattaattaacctctctagggctttcatggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaacgtgcgttaaaatggtttttaatttacagaagttaacaataagattataatgatgtttattatgatgatgaaaaccagtcagttgctacttgttactagtgagctatatagtttgtggacattatatt

SEQ ID NO: 224 - protein, 315 aa, Arabidopsis thaliana
  misc_feature: PFam Name: GRP; PFam Description: Glycine rich protein family
  misc_feature: PFam Name: Bindin; PFam Description: Bindin
  misc_feature: GI Number: 21593180; NR Description: putative DNA-binding
  misc_feature: GI Number: 50915952; NR Description: DNA-binding protein-like [Oryza sativa (japonica cultivar-group)] >gi|48716263|dbj|BAD22878.1| DNA-binding protein-like [Oryza sativa (japonica cultivar-group)] >gi|48716505|dbj|BAD23110.1|
  misc_feature: GI Number: 50948561; NR Description: putative SAP1 protein [Oryza sativa (japonica cultivar-group)] >gi|42408442|dbj|BAD09624.1| putative SAP1 protein [Oryza sativa
  misc_feature: GI Number: 56121926; NR Description: At2g45430 [Arabidopsis thaliana] gi|50198795|gb|AAT70431.1| At2g45430 [Arabidopsis thaliana] gi|2583112|gb|AAB82621.1| putative AT-hook DNA-binding protein [Arabidopsis thaliana] gi|25348246|pir||D84890 probable
  misc_feature: GI Number: 55296989; NR Description: putative AT-hook protein
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 225 - DNA, 1279 bp, Arabidopsis thaliana
  misc_feature (1)..(1279): Ceres cDNA ID no. 6443868
atcaccattgctttgttttgttcgtcaaatataatcaattttaaatttcttctcttctcttcaaacgaatcgcctttttcgataatctctttgcatcgatttcatcatggctactcaaacggatctcgctcagcccaagcttgatatgaccaaggaggagaaagagaggttgaagtatttgcaattcgtgcaagctgctgctgtggaagctctgcttcgctttgctcttatttacgctaaggcaaaggacaagtctggtcctttgaaacctggtgttgaatctgttgaaggagctgtcaagactgtcgttggtcctgtctacgagaaataccacgacgtccctgttgaggtccttaaatacatggaccagaaggtacaattttgactctttccctatctttggatcttgctgaaagtgcctttgttgatgaacaatgaatgaatctgtgttgttgattgtatatctacttcatcgaacatatgtgattaaaaaagtacagttaaagttgtgatgatttcatatcatctctttggtagaaggttcaggtaaacgggtcaatgtcattatgttctgtagagtccctctttttgaagctgacaagtttgttttgcgttgttgcaggttgatatgtctgtgactgagcttgaccgtcgtgtcccaccagtcgtcaagcaagtgtctgcccaagccatctccgctgctcagatagcacccattgtggcacgtgcgttggcctctgaggttcgacgtgctggtgttgttgaaaccgcttctggaatggctaaatccgtctactccaagtacgagcctgctgctaaggagttgtatgcaaactatgagccaaaagcagagcagtgtgccgtttcagcttggaagaagcttaaccagcttcctctattcccaaggctggctcaagttgctgtaccaacagctgctttctgctctgagaagtacaatgatactgtggttaaggctgcagagaaagggtacagagtcacatcgtacatgccattggttccaacagagaggatctcaaaaatcttcgctgaggagaaagctgagaccgagcctttggagttccatccacttgattgatatgggtgttttgttagtgtgattttttgttttgttgggattaaggtgaaccggatcttggttagcgattgatctctggttctcgttcttttttttctttgtcatgaacttttgttgtttcgtttaataatcaaaagttgtataatctaagtttgggattaccaccctattgagtattgagtg

SEQ ID NO: 226 - protein, 155 aa, Arabidopsis thaliana
  misc_feature: PFam Name: REF; PFam Description: Rubber elongation factor
  misc_feature: GI Number: 29367349; NR Description: stress-related
  misc_feature: GI Number: 37622210; NR Description: small rubber particle
  misc_feature: GI Number: 33332330; NR Description: rubber synthesis protein
  misc_feature: GI Number: 38122474; NR Description: rubber elongation factor
MSVTELDRRVPPVVKQVSAQAISAAQIAPIVARALASEVRRAGVVETASGMAKSVYSKYEPAAKELYANYEPKAEQCAVSAWKKLNQLPLFPRLAQVAVPTAAFCSEKYNDTVVKAAEKGYRVTSYMPLVPTERISKIFAEEKAETEPLEFHPLD

SEQ ID NO: 227 - DNA, 3003 bp, Arabidopsis thaliana
  misc_feature (1)..(3003): Ceres cDNA ID no. 6446020
  misc_feature (1)..(3003): Also known as  Ceres CDNA ID no. 0
atggctcacatttggcttctaccacttatctttctcgtctgtattcttctggccgttttcaaccacaagaaacatccgaaatatcgacagtttccatgtcctcctggcttcccgatcataggaaacttacatcagatcggagaattaccgcatcagactctatggaaactctcaaagaagtatggtccggtgatgcatttgatgcttggaagagtcccaacagtcgtagtttcttcttcggatacagcaagacaagttttgagagttcatgacctccattgttgtactcgtccaagcttgtcagggccaagagagctttcgtacaactatctggacattgctttctctccttatgatgattattggaaagaagttaggaagctctgtgttcaagaacttttcagtactaaacaagttcactcgattcaacctattaaggacgaggaggtcaagaaaatgatcgattcaattgcggaatcagcctctcagaagaatccggttaacttgaacaataagtgtcttgaattaacagtaagtgtagtatgcaggacagcttttggggttagttttgagggaactgtgctcaacagtgacagattcaacaaaatagtccgcgaggcgctcgagatgttgggaagcttttctgccgcggattttattccgtatgtcggatggatcatcgatgtgttgacgggtttgcaaggaaggagagaaagaagcaagagagatctcaatgcattctttgaacaaatgtttgatttgcataaagagggaaagaaagaagggaatgaagattttgtggacttgctcttaaggttggagaaagaagaggcagttcttggaaatgataaacttacaagaaaccatatcaaagcaatcttgctggatgttctacttgcgggaatcgatacttctgcaataacaatgacatgggcaatgacagaacttgcaagaaatccacgagtgatgaagaaagttcaatctgaaataagaactcaaatggggaacagatcaatgataagtttcgaagacatggatcagctagagtatctgaaaatggtgatcaaagaaacatggaggctacatcctacaacacctcttttgcttccaagagaagcaatgtctgaatttgatatcaacggctacactattcctgtcaagacacggcttcatgtgaatgtttgggctattggtcgtgatcctgatacttggaaagaccctgaagtgtttctcccggagaggtttatggataataacattgatgcaaaaggacaacattttgagctgttaccgtttgggggcggtcggagaatctgtcctgcaatatacatggggacaacaatggttgagtttggtctagctaatctcttgtatcattttgactggaagttaccagaaggcgtggaggttaaagatatcgacgtggaagaagctcctggactcactgtaaacaagaaaaacgagctcctacttgtgccagagatgagaagatcgtgtgaaatgacaaacatttggcttctgtcacttatcttcgtcatttgtattcttgtagccgtgttcaaccacaagaatcggaggaattatcaacggacaccaccgtctcctcctggctgtcctatcatcggaaacttgcatcaactcggagaattaccacatcaatctctatggaaactctccaaaaagtatggccctgtgatgcttttaaagcttggaagagtaccaacagtcatagtttcttcctctgaaacagcaaaacaagctttgaaaatccatgacctccattgttgtagtcgtccaggctttgcaggggcaagagagctctcttacaactatctagacattgctttttctccttatgatgattattggaaagaagtaaggaagctcgctgttcaagaacttttcagtagtaaacaagttcactctatacaaccgataaaggacgaggaggtcaagaaactgatcgattcaatctccgaatcagctgctcagaagactccgatcaacttgaacaagacattgctggctttaactgttagtgtggtctgcaggacagcgtttagtgtgaattttgagggaactgtgctcaacagtgaacgattcaataacatagtccgtgaggcgctcgagatgttgggaagcttttctgcctcagatttcattccgtatgtcggaaggatcatcgacttgttgacgggtttgcaaggacggcgagagagaagcatgagagatctcgatgctttctatgaacaaatgtttgatctgcataaacagaaaaaggaagaaggtagtgaagactttgtggacttgctgttgaggttggagaaagaagaagctgttcttggaaatgacaagctcactagaaaccatatcaaagcgatattgatggatgttcttctagcaggaatggatacttctgcaataaccatgacatgggcaatggcagaactcgcaaagaatccacgagtgatgaaaaaagttcaatccgaaatcagaagtcaaatcaagaacaaagaaagaatcagctttgatgacactgataagcttgagtacctcaaaatggttatcaaagaaacatggaggttacatcctacaacacctcttctaatcccaagggaagcaatgtctgaatttgagatcaacggctacacgattccagttaagacacggcttcacgtgaatgtatgggctattggtcgtgatcccgatacctggaaagaccctgaagtgtttctcccggagaggtttacggataataatattgatgcaaaaggacagcattttgagctgttaccgtttggaggcggccggagaatgtgtcctgcagtttatatggggacaacaatggtcgagtttggtttggctaatcttttgtatcattttgattggaagttaccagaaggcatgaaggttgacgatattgacatggaagaagctcccggactcactgtcaacaagaaaaacgagcttatacttgtgccaacgaagtttctagatccttaa

SEQ ID NO: 228 - protein, 3003 aa, Arabidopsis thaliana
ATGGCTCACATTTGGCTTCTACCACTTATCTTTCTCGTCTGTATTCTTCTGGCCGTTTTCAACCACAAGAAACATCCGAAATATCGACAGTTTCCATGTCCTCCTGGCTTCCCGATCATAGGAAACTTACATCAGATCGGAGAATTACCGCATCAGACTCTATGGAAACTCTCAAAGAAGTATGGTCCGGTGATGCATTTGATGCTTGGAAGAGTCCCAACAGTCGTAGTTTCTTCTTCGGATACAGCAAGACAAGTTTTGAGAGTTCATGACCTCCATTGTTGTACTCGTCCAAGCTTGTCAGGGCCAAGAGAGCTTTCGTACAACTATCTGGACATTGCTTTCTCTCCTTATGATGATTATTGGAAAGAAGTTAGGAAGCTCTGTGTTCAAGAACTTTTCAGTACTAAACAAGTTCACTCGATTCAACCTATTAAGGACGAGGAGGTCAAGAAAATGATCGATTCAATTGCGGAATCAGCCTCTCAGAAGAATCCGGTTAACTTGAACAATAAGTGTCTTGAATTAACAGTAAGTGTAGTATGCAGGACAGCTTTTGGGGTTAGTTTTGAGGGAACTGTGCTCAACAGTGACAGATTCAACAAAATAGTCCGCGAGGCGCTCGAGATGTTGGGAAGCTTTTCTGCCGCGGATTTTATTCCGTATGTCGGATGGATCATCGATGTGTTGACGGGTTTGCAAGGAAGGAGAGAAAGAAGCAAGAGAGATCTCAATGCATTCTTTGAACAAATGTTTGATTTGCATAAAGAGGGAAAGAAAGAAGGGAATGAAGATTTTGTGGACTTGCTCTTAAGGTTGGAGAAAGAAGAGGCAGTTCTTGGAAATGATAAACTTACAAGAAACCATATCAAAGCAATCTTGCTGGATGTTCTACTTGCGGGAATCGATACTTCTGCAATAACAATGACATGGGCAATGACAGAACTTGCAAGAAATCCACGAGTGATGAAGAAAGTTCAATCTGAAATAAGAACTCAAATGGGGAACAGATCAATGATAAGTTTCGAAGACATGGATCAGCTAGAGTATCTGAAAATGGTGATCAAAGAAACATGGAGGCTACATCCTACAACACCTCTTTTGCTTCCAAGAGAAGCAATGTCTGAATTTGATATCAACGGCTACACTATTCCTGTCAAGACACGGCTTCATGTGAATGTTTGGGCTATTGGTCGTGATCCTGATACTTGGAAAGACCCTGAAGTGTTTCTCCCGGAGAGGTTTATGGATAATAACATTGATGCAAAAGGACAACATTTTGAGCTGTTACCGTTTGGGGGCGGTCGGAGAATCTGTCCTGCAATATACATGGGGACAACAATGGTTGAGTTTGGTCTAGCTAATCTCTTGTATCATTTTGACTGGAAGTTACCAGAAGGCGTGGAGGTTAAAGATATCGACGTGGAAGAAGCTCCTGGACTCACTGTAAACAAGAAAAACGAGCTCCTACTTGTGCCAGAGATGAGAAGATCGTGTGAAATGACAAACATTTGGCTTCTGTCACTTATCTTCGTCATTTGTATTCTTGTAGCCGTGTTCAACCACAAGAATCGGAGGAATTATCAACGGACACCACCGTCTCCTCCTGGCTGTCCTATCATCGGAAACTTGCATCAACTCGGAGAATTACCACATCAATCTCTATGGAAACTCTCCAAAAAGTATGGCCCTGTGATGCTTTTAAAGCTTGGAAGAGTACCAACAGTCATAGTTTCTTCCTCTGAAACAGCAAAACAAGCTTTGAAAATCCATGACCTCCATTGTTGTAGTCGTCCAGGCTTTGCAGGGGCAAGAGAGCTCTCTTACAACTATCTAGACATTGCTTTTTCTCCTTATGATGATTATTGGAAAGAAGTAAGGAAGCTCGCTGTTCAAGAACTTTTCAGTAGTAAACAAGTTCACTCTATACAACCGATAAAGGACGAGGAGGTCAAGAAACTGATCGATTCAATCTCCGAATCAGCTGCTCAGAAGACTCCGATCAACTTGAACAAGACATTGCTGGCTTTAACTGTTAGTGTGGTCTGCAGGACAGCGTTTAGTGTGAATTTTGAGGGAACTGTGCTCAACAGTGAACGATTCAATAACATAGTCCGTGAGGCGCTCGAGATGTTGGGAAGCTTTTCTGCCTCAGATTTCATTCCGTATGTCGGAAGGATCATCGACTTGTTGACGGGTTTGCAAGGACGGCGAGAGAGAAGCATGAGAGATCTCGATGCTTTCTATGAACAAATGTTTGATCTGCATAAACAGAAAAAGGAAGAAGGTAGTGAAGACTTTGTGGACTTGCTGTTGAGGTTGGAGAAAGAAGAAGCTGTTCTTGGAAATGACAAGCTCACTAGAAACCATATCAAAGCGATATTGATGGATGTTCTTCTAGCAGGAATGGATACTTCTGCAATAACCATGACATGGGCAATGGCAGAACTCGCAAAGAATCCACGAGTGATGAAAAAAGTTCAATCCGAAATCAGAAGTCAAATCAAGAACAAAGAAAGAATCAGCTTTGATGACACTGATAAGCTTGAGTACCTCAAAATGGTTATCAAAGAAACATGGAGGTTACATCCTACAACACCTCTTCTAATCCCAAGGGAAGCAATGTCTGAATTTGAGATCAACGGCTACACGATTCCAGTTAAGACACGGCTTCACGTGAATGTATGGGCTATTGGTCGTGATCCCGATACCTGGAAAGACCCTGAAGTGTTTCTCCCGGAGAGGTTTACGGATAATAATATTGATGCAAAAGGACAGCATTTTGAGCTGTTACCGTTTGGAGGCGGCCGGAGAATGTGTCCTGCAGTTTATATGGGGACAACAATGGTCGAGTTTGGTTTGGCTAATCTTTTGTATCATTTTGATTGGAAGTTACCAGAAGGCATGAAGGTTGACGATATTGACATGGAAGAAGCTCCCGGACTCACTGTCAACAAGAAAAACGAGCTTATACTTGTGCCAACGAAGTTTCTAGATCCTTAA

SEQ ID NO: 229 - DNA, 729 bp, Arabidopsis thaliana
  misc_feature (1)..(729): Ceres cDNA ID no. 6453354
  misc_feature (1)..(729): Also known as  Ceres CDNA ID no. 0
atgacaactggccgaccaaataatattttagcattgaaaatttctactagatcaagctctctcactgtcggagagcaattctgcgccgtctttatacctttctttgccattatcgatgtcctagtttcctccgtcggacaatgcttcgattgccgcagcacatcgcctcggacattttcagtcaatgaagttgaagctttgtatgagctattcaagaaattgagctgttcaattattgatgacggcttgattcacaaggaagagcttagactggcgctgttccaagctccatatggtgagaacctctttcttgatagggtttttgatttgttcgatgaaaagaagaatggggttattgagtttgaggaattcatccatgcactcagtgtctttcatccctatgcatcaatccaggagaagaccgattttgcatttaggctctatgatctaagacaaactggattcattgagcgagaagaggtgcaacaaatggtttctgctattctcttggaatctgatatgatgctatccgatgaacttctgaccatgattattgataaaacatttgctgatgcagattctgacaaagacggtaaaattagtaaggatgaatggaatgtctatgtgcataaacatcctagcttgttgaagaatatgactcttccttacctaaaggatgtgacgacagcattcccaagttttatattcaacactgaggttgaagactga

SEQ ID NO: 230 - protein, 729 aa, Arabidopsis thaliana
ATGACAACTGGCCGACCAAATAATATTTTAGCATTGAAAATTTCTACTAGATCAAGCTCTCTCACTGTCGGAGAGCAATTCTGCGCCGTCTTTATACCTTTCTTTGCCATTATCGATGTCCTAGTTTCCTCCGTCGGACAATGCTTCGATTGCCGCAGCACATCGCCTCGGACATTTTCAGTCAATGAAGTTGAAGCTTTGTATGAGCTATTCAAGAAATTGAGCTGTTCAATTATTGATGACGGCTTGATTCACAAGGAAGAGCTTAGACTGGCGCTGTTCCAAGCTCCATATGGTGAGAACCTCTTTCTTGATAGGGTTTTTGATTTGTTCGATGAAAAGAAGAATGGGGTTATTGAGTTTGAGGAATTCATCCATGCACTCAGTGTCTTTCATCCCTATGCATCAATCCAGGAGAAGACCGATTTTGCATTTAGGCTCTATGATCTAAGACAAACTGGATTCATTGAGCGAGAAGAGGTGCAACAAATGGTTTCTGCTATTCTCTTGGAATCTGATATGATGCTATCCGATGAACTTCTGACCATGATTATTGATAAAACATTTGCTGATGCAGATTCTGACAAAGACGGTAAAATTAGTAAGGATGAATGGAATGTCTATGTGCATAAACATCCTAGCTTGTTGAAGAATATGACTCTTCCTTACCTAAAGGATGTGACGACAGCATTCCCAAGTTTTATATTCAACACTGAGGTTGAAGACTGA

SEQ ID NO: 231 - DNA, 1269 bp, Arabidopsis thaliana
  misc_feature (1)..(1269): Ceres cDNA ID no. 6454655
  misc_feature (1)..(1269): Also known as  Ceres CDNA ID no. 0
atgattgaacagggtgattataatcgcacaattcaactgaatatgatcaacgttactgcaacgagtaataacgtctcttctacggcatcattggaaccaaagaaaagaagagttcttagcaatttagagaagatagaattcaagctacaaaaagctcgagcctccattaaagccgcttcgatggatgatcccgtggacgacccggactatgttcctcttggtcctatgtattggaacgctaaggtctttcatcggagttacttggagatggagaaacaattcaagatatatgtatacaaagaaggcgagccaccgttgttccatgacggtccatgcaaaagcatctactctatggaaggaagtttcatctatgagatagaaaccgatacacgttttcggaccaataatcccgacaaggctcatgttttttatctaccatttagtgtcgtcaagatggtaagatacgtgtatgaacgaaattcccgcgatttcagccccatccgaaatacagtcaaggattacatcaatcttgtgggtgataaatacccatattggaaccgcagcatcggagccgatcatttcatactttcttgtcacgattggggtcctgaggcaagcttctctcatccacatctaggacataattcgattagagctttgtgcaatgccaacacgtcagagagattcaaaccaagaaaagatgtgtcgataccggagatcaatctaaggacgggatccttaactggattggtcggtggaccgtcaccttccagccgtcccatcctcgccttctttgcagggggtgtacacggaccggtaaggccagtcttgctccagcattgggagaacaaagataatgacattagagtccacaagtatctccctagaggaacgtcttattctgacatgatgcggaacagcaagttctgcatttgtcctagcggttatgaggttgcgagcccgaggatcgtggaggcactctactcgggttgcgtcccggttttgataaactcaggatatgttcctccgttcagcgatgtactgaactggagatcgttctcggtgatcgtttcagtggaagacataccgaatttgaaaacgatattgacatctatatcgccgagacagtacttaaggatgtacagaagagtgttgaaggtaaggagacattttgaggtgaattctccggctaagaggtttgatgtgtttcatatgattcttcattcgatttgggtgaggagattgaatgtgaagattcgtgaagtctaa

SEQ ID NO: 232 - protein, 1269 aa, Arabidopsis thaliana
ATGATTGAACAGGGTGATTATAATCGCACAATTCAACTGAATATGATCAACGTTACTGCAACGAGTAATAACGTCTCTTCTACGGCATCATTGGAACCAAAGAAAAGAAGAGTTCTTAGCAATTTAGAGAAGATAGAATTCAAGCTACAAAAAGCTCGAGCCTCCATTAAAGCCGCTTCGATGGATGATCCCGTGGACGACCCGGACTATGTTCCTCTTGGTCCTATGTATTGGAACGCTAAGGTCTTTCATCGGAGTTACTTGGAGATGGAGAAACAATTCAAGATATATGTATACAAAGAAGGCGAGCCACCGTTGTTCCATGACGGTCCATGCAAAAGCATCTACTCTATGGAAGGAAGTTTCATCTATGAGATAGAAACCGATACACGTTTTCGGACCAATAATCCCGACAAGGCTCATGTTTTTTATCTACCATTTAGTGTCGTCAAGATGGTAAGATACGTGTATGAACGAAATTCCCGCGATTTCAGCCCCATCCGAAATACAGTCAAGGATTACATCAATCTTGTGGGTGATAAATACCCATATTGGAACCGCAGCATCGGAGCCGATCATTTCATACTTTCTTGTCACGATTGGGGTCCTGAGGCAAGCTTCTCTCATCCACATCTAGGACATAATTCGATTAGAGCTTTGTGCAATGCCAACACGTCAGAGAGATTCAAACCAAGAAAAGATGTGTCGATACCGGAGATCAATCTAAGGACGGGATCCTTAACTGGATTGGTCGGTGGACCGTCACCTTCCAGCCGTCCCATCCTCGCCTTCTTTGCAGGGGGTGTACACGGACCGGTAAGGCCAGTCTTGCTCCAGCATTGGGAGAACAAAGATAATGACATTAGAGTCCACAAGTATCTCCCTAGAGGAACGTCTTATTCTGACATGATGCGGAACAGCAAGTTCTGCATTTGTCCTAGCGGTTATGAGGTTGCGAGCCCGAGGATCGTGGAGGCACTCTACTCGGGTTGCGTCCCGGTTTTGATAAACTCAGGATATGTTCCTCCGTTCAGCGATGTACTGAACTGGAGATCGTTCTCGGTGATCGTTTCAGTGGAAGACATACCGAATTTGAAAACGATATTGACATCTATATCGCCGAGACAGTACTTAAGGATGTACAGAAGAGTGTTGAAGGTAAGGAGACATTTTGAGGTGAATTCTCCGGCTAAGAGGTTTGATGTGTTTCATATGATTCTTCATTCGATTTGGGTGAGGAGATTGAATGTGAAGATTCGTGAAGTCTAA

SEQ ID NO: 233 - DNA, 1884 bp, Arabidopsis thaliana
  misc_feature (1)..(1884): Ceres cDNA ID no. 6454783
  misc_feature (1)..(1884): Also known as  Ceres CDNA ID no. 0
atgaacattcttggtttcacggtgaacttcttgatccgatgcaaagtcttacccagaagaagcaatacgagttctctctcccgaaacatctccgtactcgccagttatgatcaggaggaagtatcaccgggacgatatagcaatgagttttcgaatcgtaacttggtgcacgaaattttacagctttgtgctagaaacggagctgttatggaagcaaaagcttgccatgggaagattattcgtattgatttggagggagatgttactctgttgaatgttcttattaatgcttattccaagtgtggttttgtggagcttgcccgccaagtgtttgatggaatgcttgagagaagcttggtttcttggaacaccatgattggtttgtatacacggaatagaatggagtcagaagcattggatattttcttggagatgcgaaacgaagggtttaagtttagtgaattcactatatcgagtgttctttctgcttgtggggtaaattgtgatgccttggaatgcaaaaaattgcattgtttgtcagtgaagacatgtattgacttgaacttgtatgttggtactgctttgcttgatctttacgcaaaatgtgggatgatcaaggatgcagtgcaggttttcgagtctatgcaggacaagagttcagttacatggagttctatggtggcaggttatgttcagaacaagaattatgaagaggcactccttctttaccgtcgagctcagagaatgagtttagagcagaatcagttcacattatcttcagtaatttgcgcttgttcaaatctggcagctttaatagaagggaaacagatgcatgctgttatatgtaagtccgggtttggttctaatgtctttgtggcatcctctgcagtagatatgtatgctaaatgtggaagcttgagagagtcttatattattttctcggaagtgcaagagaagaatcttgagctttggaacacgatcatctcggggtttgcaaagcatgctcgtcctaaggaagtgatgatcttgtttgagaaaatgcaacaagatggaatgcacccaaatgaggttacttttagttccttgttatcggtttgtggtcacacgggtttggtcgaggaaggaaggagatttttcaaactcatgagaaccacttacggtctgtcgcctaatgtggttcattactcatgtatggttgatattcttggtcgtgctggtctattgtctgaagcgtacgagttgataaagtctattcctttcgatcctacagcttccatttggggttctcttctagcttcttgtcgagtctacaaaaatctcgagctggcagaagttgcagccgagaaactattcgaattagaaccagaaaacgccggtaatcacgtcttactatccaatatatacgcggcaaacaaacagtgggaggaaatcgccaagtcaaggaagcttttaagggactgcgacgtgaagaaagtaagaggaaaaagttggattgacattaaagacaaggtccatactttcagtgttggagagagcggtcatccgagaatccgtgagatctgttcgacgctagacaatctagtaatcaaattcagaaagtttggatataaaccaagcgtagaacacgagctgcacgatgtggagataggaaagaaagaggagcttttgatgcagcatagtgagaagctggcattggtttttgggttaatgtgtttaccagagagttctccagtgaggattatgaagaatctgaggatttgtgtggattgccatgagttcatgaaggctgcatcaatggctacaagaagatttatcattgttagagatgttaataggtttcaccatttcagtgatggtcattgttcttgtggcgatttttggtga

SEQ ID NO: 234 - protein, 1884 aa, Arabidopsis thaliana
ATGAACATTCTTGGTTTCACGGTGAACTTCTTGATCCGATGCAAAGTCTTACCCAGAAGAAGCAATACGAGTTCTCTCTCCCGAAACATCTCCGTACTCGCCAGTTATGATCAGGAGGAAGTATCACCGGGACGATATAGCAATGAGTTTTCGAATCGTAACTTGGTGCACGAAATTTTACAGCTTTGTGCTAGAAACGGAGCTGTTATGGAAGCAAAAGCTTGCCATGGGAAGATTATTCGTATTGATTTGGAGGGAGATGTTACTCTGTTGAATGTTCTTATTAATGCTTATTCCAAGTGTGGTTTTGTGGAGCTTGCCCGCCAAGTGTTTGATGGAATGCTTGAGAGAAGCTTGGTTTCTTGGAACACCATGATTGGTTTGTATACACGGAATAGAATGGAGTCAGAAGCATTGGATATTTTCTTGGAGATGCGAAACGAAGGGTTTAAGTTTAGTGAATTCACTATATCGAGTGTTCTTTCTGCTTGTGGGGTAAATTGTGATGCCTTGGAATGCAAAAAATTGCATTGTTTGTCAGTGAAGACATGTATTGACTTGAACTTGTATGTTGGTACTGCTTTGCTTGATCTTTACGCAAAATGTGGGATGATCAAGGATGCAGTGCAGGTTTTCGAGTCTATGCAGGACAAGAGTTCAGTTACATGGAGTTCTATGGTGGCAGGTTATGTTCAGAACAAGAATTATGAAGAGGCACTCCTTCTTTACCGTCGAGCTCAGAGAATGAGTTTAGAGCAGAATCAGTTCACATTATCTTCAGTAATTTGCGCTTGTTCAAATCTGGCAGCTTTAATAGAAGGGAAACAGATGCATGCTGTTATATGTAAGTCCGGGTTTGGTTCTAATGTCTTTGTGGCATCCTCTGCAGTAGATATGTATGCTAAATGTGGAAGCTTGAGAGAGTCTTATATTATTTTCTCGGAAGTGCAAGAGAAGAATCTTGAGCTTTGGAACACGATCATCTCGGGGTTTGCAAAGCATGCTCGTCCTAAGGAAGTGATGATCTTGTTTGAGAAAATGCAACAAGATGGAATGCACCCAAATGAGGTTACTTTTAGTTCCTTGTTATCGGTTTGTGGTCACACGGGTTTGGTCGAGGAAGGAAGGAGATTTTTCAAACTCATGAGAACCACTTACGGTCTGTCGCCTAATGTGGTTCATTACTCATGTATGGTTGATATTCTTGGTCGTGCTGGTCTATTGTCTGAAGCGTACGAGTTGATAAAGTCTATTCCTTTCGATCCTACAGCTTCCATTTGGGGTTCTCTTCTAGCTTCTTGTCGAGTCTACAAAAATCTCGAGCTGGCAGAAGTTGCAGCCGAGAAACTATTCGAATTAGAACCAGAAAACGCCGGTAATCACGTCTTACTATCCAATATATACGCGGCAAACAAACAGTGGGAGGAAATCGCCAAGTCAAGGAAGCTTTTAAGGGACTGCGACGTGAAGAAAGTAAGAGGAAAAAGTTGGATTGACATTAAAGACAAGGTCCATACTTTCAGTGTTGGAGAGAGCGGTCATCCGAGAATCCGTGAGATCTGTTCGACGCTAGACAATCTAGTAATCAAATTCAGAAAGTTTGGATATAAACCAAGCGTAGAACACGAGCTGCACGATGTGGAGATAGGAAAGAAAGAGGAGCTTTTGATGCAGCATAGTGAGAAGCTGGCATTGGTTTTTGGGTTAATGTGTTTACCAGAGAGTTCTCCAGTGAGGATTATGAAGAATCTGAGGATTTGTGTGGATTGCCATGAGTTCATGAAGGCTGCATCAATGGCTACAAGAAGATTTATCATTGTTAGAGATGTTAATAGGTTTCACCATTTCAGTGATGGTCATTGTTCTTGTGGCGATTTTTGGTGA

SEQ ID NO: 235 - DNA, 987 bp, Arabidopsis thaliana
  misc_feature (1)..(987): Ceres cDNA ID no. 6455496
  misc_feature (1)..(987): Also known as  Ceres CDNA ID no. 0
atggtccccttttggactacagtttctcgaaatggctcatcagactcagagacgactctccaatctgcttcaaaagccacaaaacagtataaatatccttctcttcgtccctctcatcgcctgtctctcctcttcctcttcccgttccatttatccgcaaacggagcttgttttcggtgcacctgcttcagccacttcaaacttgaactgagaaggatgggaaacgaatcatatgaagacgccatcgaagctctcaagaatgagaaggatgatctgaaggatgtagctgcggccaaggtgaagaagatcacggcggagcttcaggcagcctcgtcatcggacagcaaatcttttgatcccgtcgaacgaattaaggaaggcttcgtcaccttcaagaaggagaaatacgagaccaatcctgctttgtatggtgagctcgccaaaggtcaaagcccaaagtacatggtgtttgcttgttcggactcacgagtgtgcccatcacacgtactagacttccatcctggagatgccttcgtggttcgtaatatcgccaatatggttcctccttttgacaaggtcaaatatgcaggagttggagccgccattgaatacgctgtcttgcaccttaaggtggaaaacattgtggtgatagggcacagtgcatgtggtggcatcaaggggcttatgtcatttcctcttgacggaaacaactctactgacttcatagaggattgggtcaaaatctgtttaccagcaaagtcaaaagttttggcagaaagtgaaagttcagcatttgaagaccaatgtggccgatgcgaaagggaggcagtgaatgtgtcactagcaaacctattgacatatccatttgtgagagaaggagttgtgaaaggaacacttgctttgaagggaggctactatgactttgttaatggctcctttgagctttgggagctccagtttggaatttcccccgttcattctatatga

SEQ ID NO: 236 - protein, 987 aa, Arabidopsis thaliana
ATGGTCCCCTTTTGGACTACAGTTTCTCGAAATGGCTCATCAGACTCAGAGACGACTCTCCAATCTGCTTCAAAAGCCACAAAACAGTATAAATATCCTTCTCTTCGTCCCTCTCATCGCCTGTCTCTCCTCTTCCTCTTCCCGTTCCATTTATCCGCAAACGGAGCTTGTTTTCGGTGCACCTGCTTCAGCCACTTCAAACTTGAACTGAGAAGGATGGGAAACGAATCATATGAAGACGCCATCGAAGCTCTCAAGAATGAGAAGGATGATCTGAAGGATGTAGCTGCGGCCAAGGTGAAGAAGATCACGGCGGAGCTTCAGGCAGCCTCGTCATCGGACAGCAAATCTTTTGATCCCGTCGAACGAATTAAGGAAGGCTTCGTCACCTTCAAGAAGGAGAAATACGAGACCAATCCTGCTTTGTATGGTGAGCTCGCCAAAGGTCAAAGCCCAAAGTACATGGTGTTTGCTTGTTCGGACTCACGAGTGTGCCCATCACACGTACTAGACTTCCATCCTGGAGATGCCTTCGTGGTTCGTAATATCGCCAATATGGTTCCTCCTTTTGACAAGGTCAAATATGCAGGAGTTGGAGCCGCCATTGAATACGCTGTCTTGCACCTTAAGGTGGAAAACATTGTGGTGATAGGGCACAGTGCATGTGGTGGCATCAAGGGGCTTATGTCATTTCCTCTTGACGGAAACAACTCTACTGACTTCATAGAGGATTGGGTCAAAATCTGTTTACCAGCAAAGTCAAAAGTTTTGGCAGAAAGTGAAAGTTCAGCATTTGAAGACCAATGTGGCCGATGCGAAAGGGAGGCAGTGAATGTGTCACTAGCAAACCTATTGACATATCCATTTGTGAGAGAAGGAGTTGTGAAAGGAACACTTGCTTTGAAGGGAGGCTACTATGACTTTGTTAATGGCTCCTTTGAGCTTTGGGAGCTCCAGTTTGGAATTTCCCCCGTTCATTCTATATGA

SEQ ID NO: 237 - DNA, 1176 bp, Arabidopsis thaliana
  misc_feature (1)..(1176): Ceres cDNA ID no. 6459576
atggcggctttacttctcctcaatcgtgtttctcgaagtactagctcaatctctctccaccgggtcgcaggaactctgggtttcaattccttcaatgctcaaattcacggtgacagaatctccggaacactctttcgagtgagatcattagctactcttgctgaaggagcttctcattttaatgagatggtatctgtgaatcagcggaagtattatcttctgggtggtaaaggaggtgttgggaaaacgagctgtgctgcttctcttgcggttaagtttgctagccacggtcatcctaccattgtggtttctactgaccctgctcactccttgagcgattctttttcccaggacttgtcaggaggagtcctaaagcccgttcaaggtgttgattctccacttcttgctcttgagatcacacctgagataatgaaggacgagataaaacgtcagacgggcgataaaagtgtgaaaaatatgatggatagcatggggctcggaatgtttgccggcgagttaggggacttaaatcttgaagatatgctcaacgctgcctctcctggtattgacgaaatagcagctatttccaaggttcttcaatttatggaggcaccagaatacagtaggttcactcgtatagtttttgatactgctcccacggggcatactctgcggcttctttccctcccagacttctatgattcatccattagcaaaataactaagctcaagaagaaaatcactgcagcagcttcagcctttaagttggtctttggcaaaaaagagatacaacaaaaagaacttcctaacgagttagatcaactgaaagagaggatggagaaagttcgaaatgttttccgtgatgtggacactaccgagtttgttattgtaaccatcccaacggttatggcaataaacgagtcttcaaggttacatgcatctttaagaaaagaaaatgtgccagtccaccggcttattgttaatcagcttctacctcaatctgaatccgattgcaaattttgctcaataagacgaaaggaacaaacgcgtgtgcttggacttattcagaatgatacagaactttcggggttaaaattgatccaatcgccattgctagacgcagagataagaggggttcccgcacttaagttcatgggtgatctcatttggaaataa

SEQ ID NO: 238 - protein, 391 aa, Arabidopsis thaliana
  misc_feature: PFam Name: ArsA_ATPase; PFam Description: Anion-transporting
  misc_feature: GI Number: 9759337; NR Description: arsenite translocating
  misc_feature: GI Number: 30681260; NR Description: ATPase -related
  misc_feature: GI Number: 50912707; NR Description: putative ATPase [Oryza sativa (japonica cultivar-group)] >gi|46390107|dbj|BAD15543.1| putative ATPase [Oryza sativa (japonica cultivar-group)] >gi|46390644|dbj|BAD16127.1| putative ATPase [Oryza sativa
  misc_feature: GI Number: 5824321; NR Description: ATPase [Solanum tuberosum]
  misc_feature: GI Number: 6056208; NR Description: putative ATPase
MAALLLLNRVSRSTSSISLHRVAGTLGFNSFNAQIHGDRISGTLFRVRSLATLAEGASHFNEMVSVNQRKYYLLGGKGGVGKTSCAASLAVKFASHGHPTIVVSTDPAHSLSDSFSQDLSGGVLKPVQGVDSPLLALEITPEIMKDEIKRQTGDKSVKNMMDSMGLGMFAGELGDLNLEDMLNAASPGIDEIAAISKVLQFMEAPEYSRFTRIVFDTAPTGHTLRLLSLPDFYDSSISKITKLKKKITAAASAFKLVFGKKEIQQKELPNELDQLKERMEKVRNVFRDVDTTEFVIVTIPTVMAINESSRLHASLRKENVPVHRLIVNQLLPQSESDCKFCSIRRKEQTRVLGLIQNDTELSGLKLIQSPLLDAEIRGVPALKFMGDLIWK

SEQ ID NO: 239 - DNA, 1095 bp, Arabidopsis thaliana
  misc_feature (1)..(1095): Ceres cDNA ID no. 6461580
  misc_feature (1)..(1095): Also known as  Ceres CDNA ID no. 0
atgtctagtagtaccaagaacattccaaaacctcctcctcttccttgtattacctaccagcgttttcaatctagtacaaggaaaccttcgagcttaatgcgccttgtgcctaaagaagcacttgaaacttgggataagcttttcaaggaaggatctggagcagatacatatgttgaaaccgataacaagtctcactttcctgcccattcaagtgtcctggctgcagcctcaccagttatagcgacacttctgaatcaatcgagggataagaatgggaatacatacctcaaaatccatggagttccttgtgaagcagtctacatgttcattaggtttctatactcttcctgctacgaggaggaagaaatgaagaagtttgtgctccatttattggttctgtcacattgctactcggtcccatctcttaaaagactttgtgtagagattctcgatcaaggatggattaacaaggagaatgtgatcgatgtgcttcaactagcgagaaactgtgacgtgacaaggatttgctttgtatgtctttccatggtcatcaaagacttcaaatctgtatcttcaacagagggatggaaagtgatgaaacgctctaatcctttgctcgaacaagagctcattgaggcagtcatcgaatccgacagtaggaaacaagaaagaagaagaaaactggaggagagagaagtgtatttgcagctctatgaagccatggaagctcttgtccacatatgtcgtgaaggttgtgggacaattggacctcgcgataaggcccttaaaggaagccataccgtgtgtaaattcccggcgtgtaaagggcttgaaggtgcgctcagacatttcttgggatgcaagtctagggcttcatgttctcattgcaaaaggatgtggcagcttcttcagcttcactcttgtatctgtgatgattctaattcttgcaaagtttctctctgctggaatttcaaggagaaaatgaagaagcttagcaagaaagaacaatctaaatggcgattgcttgtagaaaacattattagggcgaggaacagtctcgggcccttctcgtcacgttcttctggtttgatatag

SEQ ID NO: 240 - protein, 1095 aa, Arabidopsis thaliana
ATGTCTAGTAGTACCAAGAACATTCCAAAACCTCCTCCTCTTCCTTGTATTACCTACCAGCGTTTTCAATCTAGTACAAGGAAACCTTCGAGCTTAATGCGCCTTGTGCCTAAAGAAGCACTTGAAACTTGGGATAAGCTTTTCAAGGAAGGATCTGGAGCAGATACATATGTTGAAACCGATAACAAGTCTCACTTTCCTGCCCATTCAAGTGTCCTGGCTGCAGCCTCACCAGTTATAGCGACACTTCTGAATCAATCGAGGGATAAGAATGGGAATACATACCTCAAAATCCATGGAGTTCCTTGTGAAGCAGTCTACATGTTCATTAGGTTTCTATACTCTTCCTGCTACGAGGAGGAAGAAATGAAGAAGTTTGTGCTCCATTTATTGGTTCTGTCACATTGCTACTCGGTCCCATCTCTTAAAAGACTTTGTGTAGAGATTCTCGATCAAGGATGGATTAACAAGGAGAATGTGATCGATGTGCTTCAACTAGCGAGAAACTGTGACGTGACAAGGATTTGCTTTGTATGTCTTTCCATGGTCATCAAAGACTTCAAATCTGTATCTTCAACAGAGGGATGGAAAGTGATGAAACGCTCTAATCCTTTGCTCGAACAAGAGCTCATTGAGGCAGTCATCGAATCCGACAGTAGGAAACAAGAAAGAAGAAGAAAACTGGAGGAGAGAGAAGTGTATTTGCAGCTCTATGAAGCCATGGAAGCTCTTGTCCACATATGTCGTGAAGGTTGTGGGACAATTGGACCTCGCGATAAGGCCCTTAAAGGAAGCCATACCGTGTGTAAATTCCCGGCGTGTAAAGGGCTTGAAGGTGCGCTCAGACATTTCTTGGGATGCAAGTCTAGGGCTTCATGTTCTCATTGCAAAAGGATGTGGCAGCTTCTTCAGCTTCACTCTTGTATCTGTGATGATTCTAATTCTTGCAAAGTTTCTCTCTGCTGGAATTTCAAGGAGAAAATGAAGAAGCTTAGCAAGAAAGAACAATCTAAATGGCGATTGCTTGTAGAAAACATTATTAGGGCGAGGAACAGTCTCGGGCCCTTCTCGTCACGTTCTTCTGGTTTGATATAG

SEQ ID NO: 241 - DNA, 2657 bp, Arabidopsis thaliana
  misc_feature (1)..(2657): Ceres cDNA ID no. 7105238
gaagagaatccgatgcgtagaagactatcttccgtgctaatcaacaatcagtgcatcgcgtcccaacgccattaccacacatctcgacctgagaaacccacaaagaaagccagcagccatgaaccaactcacaaattcaccaggaagccatgggaggaagtgccatttctcaccgatctcaaagaaatcgaagacccagaggaagctctttctctcttccaccaataccaggaaatgggtttccgacacgactacccatcttactcttctctcatctacaagcttgcaaagtcccgtaacttcgacgccgtcgaccaaattctccgccttgttcgctatcgaaacgtccggtgcagagaatccctcttcatgggattgattcagcattacgggaaagccggttcggtcgacaaagccatcgatgttttccacaaaatcacctcctttgattgtgttcgcacgattcagtctctcaacactctcatcaacgttctggtcgataacggcgagttggaaaaggccaaaagctttttcgacggggcaaaggatatgcgtttgcgtcccaattcggtgtctttcaatattttgatcaaaggatttcttgataaatgcgattgggaagctgcatgtaaggtgttcgacgaaatgcttgagatggaggtgcaaccgagtgttgtgacatacaatagcctgattggtttcttatgccgaaatgacgatatgggtaaggcgaagagcttgcttgaagatatgattaagaaaagaatacgtccgaatgctgtgacatttgggttgttaatgaaaggtttatgttgtaagggagagtacaatgaagcaaagaagttgatgttcgatatggagtatcgtgggtgtaaaccgggtctcgttaactacggaattttgatgagtgatcttgggaagagagggagaattgatgaggcaaagcttctactcggcgagatgaagaaaagacggataaaaccagatgttgtgatctataacattctggtaaaccatctttgcactgagtgtagagtccctgaggcttatagagtgctgacggaaatgcagatgaaagggtgtaaaccaaatgcagctacataccgtatgatgattgatgggttttgtcgtatcgaggattttgattcagggttgaatgttttgaatgcaatgcttgcaagcagacactgtcccacacctgcaacgtttgtatgtatggttgctgggctgattaaaggcggtaacttggaccatgcttgctttgtgttagaggtgatgggaaagaaaaacttaagttttgggtctggtgcttggcaaaatctactttctgatctctgcatcaaggatggaggagtatattgtgaggctttgtcagaagtaatttccatctaagcaatgacctttttaaaggctgcaaagtactcttcttcctgattttagctctcgccattacttttgtctcagctgctcggcttcttgatgaagaagaagatattgggttggtccctttgcctaccacgagtcctggtcctttaccaacagttggtttaggcccctttcccactgctaattcaggccctgcaactggtatcgcttcaggtacaggttcagcctcagggggtttaggttccttgggtaccaatactggccccgggcctctatcgaccactggttctagtcttttaccagttgctagttcgggtaccttgcctgttactggccccggtcctctaccaaccagttctggtctcttaccgggtgctagttcgggtaacttgcctggttcaggttcagggcctttgcctactgttggttcaggtgctgcagctacgggtctgggcgcaggtgcagggtcagtgattggtggttcagttcctgacaacactttggttttcttcatgcacgatatactcggtggctcaaacccgacagcgagggctgtgactggagtcgtcgcaaacgcagccctcagtggccaaattccattcgctaagcccaatggtgcaaacctccctgttagtaacggcgttccatcagacaataacaacaatggaatcctgaacaataacaacgtcccacttctcgtcgggcttggcggaaccacttccaacattctacagaacaatggaaacaacatgttgaacggtcttcccgtggctaacggcggccagctcccatcgggttcgtctcttcagatgctcatgtttgggacattgacggtgatggacaacgaactaaccgaaggacacgaactcgggtctggtctgctgggtaaagcccaaggcttctacgtggcaagtgcccttgatgggaccagccagactatggctttcacggctatgtttgagagcggtggatatgaagatagcatcagtttcttcggtgtgcatagaacagctgcatcggaatctcatcttggggtaatgggcggtactggtaagtatgtgaatgcgagaggcttcgcaattgtcaagacttttacgggttcctccgggacccagcagcagcagccgcaccagttcacagatgggctcgagactgttctggagtgcaccgtttatctttcttactagtttcttttccctcttctcttatcttttttgtctaccaagaaaacgtgaaaacctattaatttgacaaccaatcccttgttattc

SEQ ID NO: 242 - protein, 459 aa, Arabidopsis thaliana
  misc_feature: PFam Name: Dirigent; PFam Description: Dirigent-like protein
  misc_feature: PFam Name: PPR; PFam Description: PPR repeat
  misc_feature: GI Number: 34895944; NR Description: P0011G08.13 [Oryza sativa (japonica cultivar-group)] >gi|15528621|dbj|BAB64642.1|
  misc_feature: GI Number: 42573413; NR Description: pentatricopeptide (PPR)
  misc_feature: GI Number: 27497202; NR Description: Putative disease resistance response protein [Oryza sativa (japonica
  misc_feature: GI Number: 34902570; NR Description: Putative indole-3-acetate beta-glucosyltransferase [Oryza sativa (japonica cultivar-group)] gi|20219038|gb|AAM15782.1| Putative indole-3-acetate beta-glucosyltransferase [Oryza sativa (japonica
  misc_feature: GI Number: 6630464; NR Description: F23N19.4 [Arabidopsis thaliana]
MRRRLSSVLINNQCIASQRHYHTSRPEKPTKKASSHEPTHKFTRKPWEEVPFLTDLKEIEDPEEALSLFHQYQEMGFRHDYPSYSSLIYKLAKSRNFDAVDQILRLVRYRNVRCRESLFMGLIQHYGKAGSVDKAIDVFHKITSFDCVRTIQSLNTLINVLVDNGELEKAKSFFDGAKDMRLRPNSVSFNILIKGFLDKCDWEAACKVFDEMLEMEVQPSVVTYNSLIGFLCRNDDMGKAKSLLEDMIKKRIRPNAVTFGLLMKGLCCKGEYNEAKKLMFDMEYRGCKPGLVNYGILMSDLGKRGRIDEAKLLLGEMKKRRIKPDVVIYNILVNHLCTECRVPEAYRVLTEMQMKGCKPNAATYRMMIDGFCRIEDFDSGLNVLNAMLASRHCPTPATFVCMVAGLIKGGNLDHACFVLEVMGKKNLSFGSGAWQNLLSDLCIKDGGVYCEALSEVISI

SEQ ID NO: 243 - DNA, 1718 bp, Arabidopsis thaliana
  misc_feature (1)..(1718): Ceres cDNA ID no. 7106572
agtgtgagtaatttagatccaggattcttcagattcctctcctttgatcctctctttaacaatctctctctctctgttttcttcgatccgttgtaggagaaaatggtcgttatcaacagtctccgacgcttggcgcgtaccactcaggttcatttgcacagtaggtatgccacttgcatgtctgggaactccacttccaggaggattttcactactgaggcagcacctgagaagaaaaacactgttgggtctaaagggcatgatatgcttgcaccttttactgctggatggcagagtgctgatttagatcccttggtcattgcaaagtctgagggaagttatgtgtatgatgatactgggaaaaaatatcttgactctctcgctggtttatggtgtactgccttaggaggaaatgagccaaggcttgtttctgccgctgttgaacagttgaacaccttgccgttttatcactccttttggaaccgtactactaaaccttctctggatcttgctaaggttcttttagagatgttcacggccaacaaaatggccaaagcattttttacaagcggtggatcagatgccaacgatacccaggtcaagctggtttggtattacaataacgcacttggaaggcccgagaagaaaaagtttatcgcgagaaagaaatcgtaccatggctccactctaatatcagcaagtttgtccggccttcccccgctacaccaaaattttgatttacctgcaccatttgtgttgcacacagattgccctcattattggcgttttcatcttccaggcgaaacggaagaggagttctcaaccagattagccaagaatttagaggatctaatcatcaaagaaggaccagaaactattggtgcttttatagctgaaccagtcatgggtgctgggggtgtgatacctccacctgctacctactttgaaaaggttcaagctgttgttaagaaatatgatatcttgttcattgctgatgaggtgatatgtgcatttggaaggctcgggacaatgtttggctgtgacaaatacaacattaagccagatcttgtgaccttagctaaggcactgtcttcagcatatatgccgattggagccattcttatgagccaagaagtggcagatgtcataaattctcatagcagcaagcttggcgttttctcccatggatttacttattctggtcatccagtttcgtgtgctgtagcaattgaagcgttaaagatatacaaggagaggaacataccagagtatgtcgccaaagttgccccaaggtttcaagatggagttaaagcgtttgcctctggtagtcctattattggagagacaagaggaacaggtttgattcttgggactgagtttgtagacaataaatctccgaacgaaccatttccaccagaatggggtgttggcgcattctttggagccgagtgccagaagcacgggatgttagtccgtgttgcaggtgatggcattttgatgtctccaccgctcattatctcacctgaagagattgatgagttgatttctatctatgggaaagcattgaaggcaacggaagagaaggtaaaagaactcaaggctcagcacaagaagtgaaaagcagagtcaaaatgatgttgatgaaaaatgttttttagattctcaaagtttggatctattgtttttttttttaacacacaacaagtctttaaataagt

SEQ ID NO: 244 - protein, 504 aa, Arabidopsis thaliana
  misc_feature: PFam Name: Aminotran_3; PFam Description: Aminotransferase
  misc_feature: GI Number: 11994739; NR Description: aminotransferase-like
  misc_feature: GI Number: 12963338; NR Description: aminotransferase-like
  misc_feature: GI Number: 14030435; NR Description: gamma-aminobutyrate
  misc_feature: GI Number: 29837282; NR Description: gamma-aminobutyrate
  misc_feature: GI Number: 29837284; NR Description: gamma-aminobutyrate
MVVINSLRRLARTTQVHLHSRYATCMSGNSTSRRIFTTEAAPEKKNTVGSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 245 - DNA, 1194 bp, Arabidopsis thaliana
  misc_feature (1)..(1194): Ceres cDNA ID no. 7106947
gaattcggcacgagaccttgtaaaccattaagaggctttgctcaattaacaagaaagaaaaaatgcttgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccacaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcatgggagacggccaaagcaaaaggtgtggacttagtggtgctaaatccggttttggttctcggaccaccgctccagtcagcgatcaacgctagtctagtccatattctcaagtacctcaccggttcagccaagacctacgctaacttgactcaggtctacgtggacgtccgtgacgtggcactaggccatgttctggtctacgaagcaccctccgcctcaggccgttacatcttcgccgagaccgcacttgaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatctgtcaagagcttgcaagagaaaggccatcttcctctacctcaagattcgaaccaaaacgaagtcatcatcgaatcttaggacacgatccacgaccctagaatctgatcatacctacatgaaaagctttattcttaagtaatacatacgttttgattttgactaaagtattgttaaatcttaaatcattatatatagctgattgttctttctt

SEQ ID NO: 246 - protein, 332 aa, Arabidopsis thaliana
  misc_feature: PFam Name: Epimerase; PFam Description: NAD dependent
  misc_feature: PFam Name: 3Beta_HSD; PFam Description: 3-beta
  misc_feature: PFam Name: NmrA; PFam Description: NmrA-like family
  misc_feature: PFam Name: Polysacc_synt_2; PFam Description: Polysaccharide
  misc_feature: GI Number: 52355804; NR Description: cinnamoyl CoA reductase 1 [Arabidopsis thaliana] gi|12083326|gb|AAG48822.1| putative cinnamoyl CoA reductase [Arabidopsis thaliana] gi|21592916|gb|AAM64866.1| cinnamoyl CoA reductase, puitative
  misc_feature: GI Number: 12407990; NR Description: cinnamoyl CoA reductase
  misc_feature: GI Number: 2960364; NR Description: cinnamoyl CoA reductase
  misc_feature: GI Number: 40233135; NR Description: cinnamoyl CoA reductase
  misc_feature: GI Number: 25140434; NR Description: cinnamoyl CoA reductase
MLVDGKLVCVTGAGGYIASWIVKLLLERGYTVRGTVRNPTDPKNNHLRELQGAKERLTLHSADLLDYEALCATIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYIFAETALDRGEVVEILAKFFPEYPLPTKCSDEKNPRAKPYKFTTQKIKDLGLEFKPIKQSLYESVKSLQEKGHLPLPQDSNQNEVIIES

SEQ ID NO: 247 - DNA, 734 bp, Arabidopsis thaliana
  misc_feature (1)..(734): Ceres cDNA ID no. 7108095
aggagctggtgctggtggagggtttggcggtggtgctggaggaggtcacggtggtggcgccggcgctggaggaggattaggcggtggtgctggaggaggatttggcggtggtgctggaggaggtggcggtgcaggaggaggatttggcggtggtgctggtggaggccacggtggaggtgctggtggaggatttggtggtggtgcaggaggtggaggaggtcacggtggaggtgctggtggaggatttggcggtggtgtaggaggtggaggaggccacggtggaggtgccgggggaggatttggcggtggtgcaggaggtggaggaggccacggtggaggtgccgggggaggatttggcggtggtgcaggaggtggaggaggccaaggtggaggtgctgggggaggttttggcggtggtgccggtgggggatttggcggtggtgcaggaggaggtgctggtggaggatttggcggtggtgcaggaggtggaggaggccatggtggtggtgccggtggtggagctggagggggctttggcggtggtgcaggaggtggaggaggccatggtggtggagctggtggaggttttggcggcggtgcaggaggaggaggaggccatggtggtcgtttttaaatatagctttatagggtaacttgcttgtgtctcaagccagattaaaaaggaagatatttgctggagaatcttattatgaatggaataaatgatatttagg

SEQ ID NO: 248 - protein, 215 aa, Arabidopsis thaliana
  misc_feature: PFam Name: Dehydrin; PFam Description: Dehydrin
  misc_feature: PFam Name: GRP; PFam Description: Glycine rich protein family
  misc_feature: PFam Name: Harpin; PFam Description: Harpin protein (HrpN)
  misc_feature: PFam Name: S-antigen; PFam Description: S-antigen protein
  misc_feature: PFam Name: Secretin_N; PFam Description: Bacterial type
  misc_feature: GI Number: 34898126; NR Description: putative glycine-rich cell wall protein precursor [Oryza sativa (japonica cultivar-group)] >gi|24059890|dbj|BAC21356.1| putative glycine-rich cell wall protein precursor [Oryza sativa (japonica
  misc_feature: GI Number: 7636182; NR Description: glycine-rich protein
  misc_feature: GI Number: 14549150; NR Description: glycine-rich protein
  misc_feature: GI Number: 9453857; NR Description: EBNA-1 [Cynomolgus
  misc_feature: GI Number: 2605798; NR Description: minor ampullate silk
RSWCWWRVWRWCWRRSRWWRRRWRRIRRWCWRRIWRWCWRRWRCRRRIWRWCWWRPRWRCWWRIWWWCRRWRRSRWRCWWRIWRWCRRWRRPRWRCRGRIWRWCRRWRRPRWRCRGRIWRWCRRWRRPRWRCWGRFWRWCRWGIWRWCRRRCWWRIWRWCRRWRRPWWWCRWWSWRGLWRWCRRWRRPWWWSWWRFWRRCRRRRRPWWSFLNIAL

SEQ ID NO: 249 - DNA, 1035 bp, Arabidopsis thaliana
  misc_feature (1)..(1035): Ceres cDNA ID no. 7108203
  misc_feature (1)..(1035): Also known as  Ceres CDNA ID no. 0
aagcctttagccatggccgattcttcctcttctaccattttctcccatccttccatctcctctaccatctcttcctccagaattcgcagctccagtgtttccctccttaccggacgcattaacctgcccctctctttctctcgcgtctctctatctcttaaaaccaaaacccaccttaaaaaatccccctttgtctccttcgttgcccagacttcggattgggctgaagaaggtggagaaggaagcgtcgctgttgaggagaccgagaacagtttagagtcacaagatgtgagcgaaggagatgagagcgaaggagatgtgagcgaaggagctgtgagcgaaagagctgagttcccggagccatcggaagaagccaagcttttcgtcggaaatttggcttatgatgttaatagccaagctttggctatgctctttgagcaagccggtactgttgaaatcgccgaggttatatacaatagggaaactgaccagagtcgtgggtttggatttgtgacaatgagttctgtggacgaagctgagacagctgtggagaagttcaaccgttatgatcttaacggacgtctactaactgtaaacaaggcagctccaagaggatcacgtccagaacgtgcgcctcgggtatatgaacctgcattcagagtatatgtagggaatctaccatgggatgtggacaatggccgtctagaacagcttttcagtgagcatggtaaagttgtggaagctagggtggtttacgaccgtgagacaggtcgttcacgtggattcgggtttgtcacaatgtctgacgtggatgaactcaacgaagccatctctgccctcgatggacagaacttggagggtagagcaatcagagtgaatgtagcggaagagcgtcctccaaggcgtggatattaaagctgagatctagctgtgccctctctctctccctatcttgcattgcattttgtttagacgagattcttacactcttcaacgattggtttttggctgaactctgaatgtgaaagttaagct

SEQ ID NO: 250 - protein, 1035 aa, Arabidopsis thaliana
AAGCCTTTAGCCATGGCCGATTCTTCCTCTTCTACCATTTTCTCCCATCCTTCCATCTCCTCTACCATCTCTTCCTCCAGAATTCGCAGCTCCAGTGTTTCCCTCCTTACCGGACGCATTAACCTGCCCCTCTCTTTCTCTCGCGTCTCTCTATCTCTTAAAACCAAAACCCACCTTAAAAAATCCCCCTTTGTCTCCTTCGTTGCCCAGACTTCGGATTGGGCTGAAGAAGGTGGAGAAGGAAGCGTCGCTGTTGAGGAGACCGAGAACAGTTTAGAGTCACAAGATGTGAGCGAAGGAGATGAGAGCGAAGGAGATGTGAGCGAAGGAGCTGTGAGCGAAAGAGCTGAGTTCCCGGAGCCATCGGAAGAAGCCAAGCTTTTCGTCGGAAATTTGGCTTATGATGTTAATAGCCAAGCTTTGGCTATGCTCTTTGAGCAAGCCGGTACTGTTGAAATCGCCGAGGTTATATACAATAGGGAAACTGACCAGAGTCGTGGGTTTGGATTTGTGACAATGAGTTCTGTGGACGAAGCTGAGACAGCTGTGGAGAAGTTCAACCGTTATGATCTTAACGGACGTCTACTAACTGTAAACAAGGCAGCTCCAAGAGGATCACGTCCAGAACGTGCGCCTCGGGTATATGAACCTGCATTCAGAGTATATGTAGGGAATCTACCATGGGATGTGGACAATGGCCGTCTAGAACAGCTTTTCAGTGAGCATGGTAAAGTTGTGGAAGCTAGGGTGGTTTACGACCGTGAGACAGGTCGTTCACGTGGATTCGGGTTTGTCACAATGTCTGACGTGGATGAACTCAACGAAGCCATCTCTGCCCTCGATGGACAGAACTTGGAGGGTAGAGCAATCAGAGTGAATGTAGCGGAAGAGCGTCCTCCAAGGCGTGGATATTAAAGCTGAGATCTAGCTGTGCCCTCTCTCTCTCCCTATCTTGCATTGCATTTTGTTTAGACGAGATTCTTACACTCTTCAACGATTGGTTTTTGGCTGAACTCTGAATGTGAAAGTTAAGCT

SEQ ID NO: 251 - DNA, 1078 bp, Arabidopsis thaliana
  misc_feature (1)..(1078): Ceres cDNA ID no. 7108389
cccagcaacgccaaacaccccggccaccccagccaccccaaacaccccagccacgccaaacaccccgaccacgccaacgaccccgaccacgccatcgaccccggccactccagccaccccagcaacgccaaacaccccaaaacccaccttaaaaaatccccctttgtctccttcgttgcccagactttggattgggctgaagaaggtggagaaggaagcgtcgctgttgaggagaccgagaacagtttagagtcacaagatgtgagcgaaggagatgagagcgaaggagatgcgagcgaaggagatgtgagcgaaggagatgagagcgaaggagatgtgagcgaaggagctgtgagcgaaagagctgagttcccggagccatcggaagaagccaagcttttcgtcggaaatttggcttatgatgttaatagccaagctttggctatgctctttgagcaagccggtactgttgaaatcgccgaggttatatacaatagggaaactgaccagagtcgtgggtttggatttgtgacaatgagttctgtggacgaagctgagacagctgtggagaagttcaaccgttatgatcttaacggacgtctactaactgtaaacaaggcagctccaagaggatcacgtccagaacgtgcgcctcgggtatatgaacctgcattcagagtatatgtagggaatctaccatgggatgtggacaatggccgtctagaacagcttttcagtgagcatggtaaagttgtggaagctagggtggtttacgaccgtgagacaggtcgttcacgtggattcgggtttgtcacaatgtctgacgtggatgaactcaacgaagccatctctgccctcgatggacagaacttggagggtagagcaatcagagtgaatgtagcggaagagcgtcctccaaggcgtggatattaaagctgagatctagctgtgccctctctctctccctatcttgcattttgtttagacgagattcttacactcttcaacgattgtttttggctgaactctgaatgtgaaagttaagctgcttctaaagtaatttgtatcgcttgttttt

SEQ ID NO: 252 - protein, 310 aa, Arabidopsis thaliana
  misc_feature: PFam Name: RRM_1; PFam Description: RNA recognition motif.
  misc_feature: GI Number: 510240; NR Description: RNA binding protein [Arabidopsis thaliana] gi|629557|pir||S49030RNA-binding protein
  misc_feature: GI Number: 475719; NR Description: RNA-binding protein 2
  misc_feature: GI Number: 681908; NR Description: cp31 [Arabidopsis thaliana]
  misc_feature: GI Number: 99684; NR Description: DNA-binding protein -
  misc_feature: GI Number: 19032260; NR Description: RNA-binding protein
PSNAKHPGHPSHPKHPSHAKHPDHANDPDHAIDPGHSSHPSNAKHPKTHLKKSPFVSFVAQTLDWAEEGGEGSVAVEETENSLESQDVSEGDESEGDASEGDVSEGDESEGDVSEGAVSERAEFPEPSEEAKLFVGNLAYDVNSQALAMLFEQAGTVEIAEVIYNRETDQSRGFGFVTMSSVDEAETAVEKFNRYDLNGRLLTVNKAAPRGSRPERAPRVYEPAFRVYVGNLPWDVDNGRLEQLFSEHGKVVEARVVYDRETGRSRGFGFVTMSDVDELNEAISALDGQNLEGRAIRVNVAEERPPRRGY

SEQ ID NO: 253 - DNA, 1337 bp, Arabidopsis thaliana
  misc_feature (1)..(1337): Ceres cDNA ID no. 7108467
gtcgacccacgcgtccgaaacagaaaccgatcaaaggatgggtcttaatctgaatttgtctatctactctttaccaaaacccttatctcaatttctcgatgaagtgtcgaggatcaaagacaatcattccaaactgtctgaaatcgatggttatgtcggaaaattagaggaagaaaggaacaaaatcgatgtttttaaacgagaactccctttatgcatgctcttattgaacgaagcgattggggcgttgaaggatgaggctagaaaagggttatcactgatggcatctaatgggaaattcgatgatgttgaaagggcaaaaccggaaactgataagaagagctggatgagctctgcccagttatggatctcgaaccctaattcccaattccgatcgacaaatgaagaagaagaagatcggtgtgtgagtcagaacccatttcagacatgtaattaccctaatcaaggaggggtatttatgccgatttaaccgtcccccacctcctccaccaccagctcctctgtctctcatgactccaacatcagagatgatgatggattatagcagaattgagcagagtcatcatcatcatcaattcaataaaccttcttcacagagtcatcacattcagaagaaagagcagagaaggagatggtcacaggaacttcaccgtaaatttgttgatgctcttcataggcttggagggccacaagttgctacaccaaagcagattagagatttgatgaaagttgatggtttaaccaatgatgaagtcaagagccatttacaaaaatatagaatgcatatccgtaagcatccgctgcatccgacaaagactttgtcatcgtcggatcagccaggtgtgttagagagagaatcgcagagcttaataagtttgtcgaggtcggattcgccacaaatcccacttgttgcaagagggttgttcagtagtaatgttggtcatagctcagaggaagatgaggaggaggaggatgaagaggaggagaagtctgatggacgtagtagctgtagaaatgatgaaacaaagaagaagagacaagtgttggatcttgagctttgaaagtctgcatagtgaatgatataatctttaccaacttatgttatatatgctcaaaactttgagtttgttcgggagtttttgtagatgtaaacatgagagttgaaataaggaagaggattttgagcaaaaagtagggtttgtttttgcaagaggaaatagatagagaagagtggttcgaaatcctctgtgttttttttttttttttttttacttcataagtaagataaactcatatatcaaagattttgtttttat

SEQ ID NO: 254 - protein, 183 aa, Arabidopsis thaliana
  misc_feature: PFam Name: Myb_DNA-binding; PFam Description: Myb-like
  misc_feature: GI Number: 14532434; NR Description: AT4g37180/C7A10_180
  misc_feature: GI Number: 30690890; NR Description: cytoskeletal protein
  misc_feature: GI Number: 18419989; NR Description: putative cytoskeletal
  misc_feature: GI Number: 1732509; NR Description: putative cytoskeletal
  misc_feature: GI Number: 4006862; NR Description: putative cytoskeletal protein [Arabidopsis thaliana] gi|7270667|emb|CAB80384.1| putative cytoskeletal protein [Arabidopsis thaliana] gi|25407794|pir||C85439
MTPTSEMMMDYSRIEQSHHHHQFNKPSSQSHHIQKKEQRRRWSQELHRKFVDALHRLGGPQVATPKQIRDLMKVDGLTNDEVKSHLQKYRMHIRKHPLHPTKTLSSSDQPGVLERESQSLISLSRSDSPQIPLVARGLFSSNVGHSSEEDEEEEDEEEEKSDGRSSCRNDETKKKRQVLDLEL

SEQ ID NO: 255 - DNA, 872 bp, Arabidopsis thaliana
  misc_feature (1)..(872): Ceres cDNA ID no. 7108678
gtctaatggatgagaaagaagaattcccggggaagcgtcgctgttgaggagaccgagaacagtttagagtcacaagatgtgagcgaaggagatgagagcgaaggagatgcgagcgaaggagatgtgagcgaaggagatgagagcgaaggagatgtgagcgaaggagctgtgagcgaaagagctgagttcccggagccatcggaagaagccaagcttttcgtcggaaatttggcttatgatgttaatagccaagctttggctatgctctttgagcaagccggtactgttgaaatcgccgaggttatatacaatagggaaactgaccagagtcgtgggtttggatttgtgacaatgagttctgtggacgaagctgagacagctgtggagaagttcaaccgttatgatcttaacggacgtctactaactgtaaacaaggcagctccaagaggatcacgtccagaacgtgcgcctcgggtatatgaacctgcattcagagtatatgtagggaatctaccatgggatgtggacaatggccgtctagaacagcttttcagtgagcatggtaaagttgtggaagctagggtggtttacgaccgtgagacaggtcgttcacgtggattcgggtttgtcacaatgtctgacgtggatgaactcaacgaagccatctctgccctcgatggacagaacttggagggtagagcaatcagagtgaatgtagcggaagagcgtcctccaaggcgtggatattaaagctgagatctagctgtgccctctctctctccctatcttgcattttgtttagacgagattcttacactcttcaacgattgtttttggctgaactctgaatgtgaaagttaagctgcttctaa

SEQ ID NO: 256 - protein, 246 aa, Arabidopsis thaliana
  misc_feature: PFam Name: RRM_1; PFam Description: RNA recognition motif.
  misc_feature: GI Number: 99684; NR Description: DNA-binding protein -
  misc_feature: GI Number: 475719; NR Description: RNA-binding protein 2
  misc_feature: GI Number: 510240; NR Description: RNA binding protein [Arabidopsis thaliana] gi|629557|pir||S49030RNA-binding protein
  misc_feature: GI Number: 681908; NR Description: cp31 [Arabidopsis thaliana]
  misc_feature: GI Number: 475720; NR Description: RNA-binding protein 3
MRKKNSRGSVAVEETENSLESQDVSEGDESEGDASEGDVSEGDESEGDVSEGAVSERAEFPEPSEEAKLFVGNLAYDVNSQALAMLFEQAGTVEIAEVIYNRETDQSRGFGFVTMSSVDEAETAVEKFNRYDLNGRLLTVNKAAPRGSRPERAPRVYEPAFRVYVGNLPWDVDNGRLEQLFSEHGKVVEARVVYDRETGRSRGFGFVTMSDVDELNEAISALDGQNLEGRAIRVNVAEERPPRRGY

SEQ ID NO: 257 - DNA, 963 bp, Arabidopsis thaliana
  misc_feature (1)..(963): Ceres cDNA ID no. 7108712
ggcacgagctcgtgcaattcggccgaattcggcacgagaaaatatggcaaatatctccagtattcacattctcttcctcgtgttcatcacaagcggcattgctgttatggccacagacttcactctaaggaacaattgccctaccaccgtctgggccggaactctcgccggtcaaggacccaagctcggcgatggaggatttgaattgactccaggtgcttcccgacagctcacggctcctgcaggatggtcaggccggttctgggctcgtacaggctgcaactttgacgcctccggaaacggtagatgtgtaaccggagactgtggcggtctaagatgtaacggcggcggagttcctcccgtcactctggctgaattcactctagtaggcgatggcggcaaagatttctacgatgtgagcctcgtagatggttacaatgtcaagctggggataagaccatccggaggatcgggagattgcaaatacgcaggctgtgtctctgacctcaacgcggcttgccccgacatgcttaaggtcatggatcagaacaatgtcgtggcctgcaagagtgcctgtgagaggtttaatacggatcaatattgctgccgtggagctaacgataagccggaaacttgtcctcccacggactactcgaggattttcaagaacgcttgccctgacgcctatagctacgcttatgacgacgaaacgagcaccttcacttgtaccggagctaactacgaaatcactttctgcccttaaaaaccgaagcttcgagttagatacagtcgggtttaattatctctcacgtttcttttgcttattatgtacggaaagataaataaggaaagctgatgactatgaatcatcgtcttccacttttaagcttttttagtgagtattagtcagttgttacactcagctgatttgtttacaaagaaataaaacaaaatgattgatct

SEQ ID NO: 258 - protein, 239 aa, Arabidopsis thaliana
  misc_feature: PFam Name: Thaumatin; PFam Description: Thaumatin family
  misc_feature: GI Number: 2435406; NR Description: thaumatin-like protein
  misc_feature: GI Number: 6273385; NR Description: SCUTL2 [Vitis vinifera]
  misc_feature: GI Number: 48310686; NR Description: At1g19320 [Arabidopsis thaliana] gi|8778412|gb|AAF79420.1| F18O14.4 [Arabidopsis thaliana] gi|30686314|ref|NP_173365.2| pathogenesis-related thaumatin family
  misc_feature: GI Number: 28973703; NR Description: putative
  misc_feature: GI Number: 60543124; NR Description: thaumatin-like protein
  misc_feature: Utility: Useful for making low fiber seeds with increased
MANISSIHILFLVFITSGIAVMATDFTLRNNCPTTVWAGTLAGQGPKLGDGGFELTPGASRQLTAPAGWSGRFWARTGCNFDASGNGRCVTGDCGGLRCNGGGVPPVTLAEFTLVGDGGKDFYDVSLVDGYNVKLGIRPSGGSGDCKYAGCVSDLNAACPDMLKVMDQNNVVACKSACERFNTDQYCCRGANDKPETCPPTDYSRIFKNACPDAYSYAYDDETSTFTCTGANYEITFCP

SEQ ID NO: 259 - DNA, 453 bp, Zea mays
  misc_feature (1)..(453): Ceres cDNA ID no. 11030669
  misc_feature (1)..(453): Ceres CLONE  ID no. 458792
  misc_feature (1)..(453): Also known as  Ceres CDNA ID no. 0
caagggatttgatggtgttgaagatgttattgcagatacgaaggcacacaaggtggtcgttaaggggaaaaaggcagctgctgacccaatgaaggtggtggaacgggtgcagaagaagacaggccgcaaggtagagcttctctcaccaatgccaccaccgaaagaagagaagaaggaagaggagaaaaaggaagaacctgagccaccaaaaaccgagaagaaagaggaggcaacggtgctcgctgtggtgctcaaggtgcatatgcattgtgaggcttgcacacaagtgatcaagaagagaatcctcaagatgaaaggcgtgcaatctgtagaggcagacctcaaggcttctcaagtcactgtgaagggtgtgttcgaggaggccaagctgtctgattatgtgtataggcgcactggtaagcacgctgctatcgtcaagtctgagccggttgc

SEQ ID NO: 260 - protein, 453 aa, Zea mays
CAAGGGATTTGATGGTGTTGAAGATGTTATTGCAGATACGAAGGCACACAAGGTGGTCGTTAAGGGGAAAAAGGCAGCTGCTGACCCAATGAAGGTGGTGGAACGGGTGCAGAAGAAGACAGGCCGCAAGGTAGAGCTTCTCTCACCAATGCCACCACCGAAAGAAGAGAAGAAGGAAGAGGAGAAAAAGGAAGAACCTGAGCCACCAAAAACCGAGAAGAAAGAGGAGGCAACGGTGCTCGCTGTGGTGCTCAAGGTGCATATGCATTGTGAGGCTTGCACACAAGTGATCAAGAAGAGAATCCTCAAGATGAAAGGCGTGCAATCTGTAGAGGCAGACCTCAAGGCTTCTCAAGTCACTGTGAAGGGTGTGTTCGAGGAGGCCAAGCTGTCTGATTATGTGTATAGGCGCACTGGTAAGCACGCTGCTATCGTCAAGTCTGAGCCGGTTGC

SEQ ID NO: 261 - DNA, 1351 bp, Arabidopsis thaliana
  misc_feature (1)..(1351): Ceres cDNA ID no. 11033748
gaaccgagtatattggtggtcaccgaagaatggctcgggttcatcgggtccgacccgaaacctaaccggatccatttcgccactctccccaacatcattccctccgagctcgtccgagccaacgacttcatcgccttcatcgacgccgtcctcaccagattagaagagccgttcgaacagctacttgaccgtctaaactctcctcccaccgcaatcatcgccgatacttacatcatttgggcagtacgtgtaggcacaaaaaggaatattccggtggcttctttctggactacgtcagccacgattctctccctcttcattaactccgatcttctcgcaagtcacggccattttccgatcgaaccatcagaatcaaaactagacgagattgttgattacatccccggtttatctccgacaagactcagtgacttacagatcttacacggctatagtcatcaagtcttcaatatattcaaaaagtctttcggtgagctttataaagctaagtatcttctcttcccttctgcttatgagctcgaaccaaaagccattgactttttcacttccaagtttgatttcccggtttactccactggtccgttaatacccttggaagaactatccgttggaaatgagaatagagaacttgattactttaagtggcttgatgagcaacctgaaagctctgttctttacatatctcaagggagttttctttcagtctccgaagctcagatggaggagattgttgtaggagttagagaggctggagttaagttcttttgggtggctcgtgggggtgagttaaagcttaaggaggctcttgaaggtagcttgggtgttgtggtgagctggtgtgatcagctacgtgttttgtgtcatgcggctataggcgggttttggacgcattgcgggtataactcgacattggaagggatatgttcgggagtaccgttgcttacatttcctgttttttgggatcagtttctgaatgctaagatgattgttgaggagtggagagttggaatggggatcgagaggaagaagcagatggagttgttgatagtgagtgatgagatcaaggaattggtaaaaaggtttatggatggagagagtgaagaagggaaagagatgagaagaaggacttgtgatctcagtgagatatgtcgtggagcggttgcgaaaggtggttcttctgatgctaacatcgatgctttcattaaagatattactaagatcgtgtgagttctattgttgttaatgattcaagtctatattagtatttgtataagtttgttaaagattcaaactttgtagagatttaagattgtttgtaaaactgttattt

SEQ ID NO: 262 - protein, 415 aa, Arabidopsis thaliana
  misc_feature: PFam Name: UDPGT; PFam Description: UDP-glucoronosyl and
  misc_feature: GI Number: 34909046; NR Description: putative glucosyltransferase [Oryza sativa (japonica cultivar-group)] >gi|20804578|dbj|BAB92270.1| putative glucosyltransferase [Oryza
  misc_feature: GI Number: 34909048; NR Description: putative glucosyltransferase [Oryza sativa (japonica cultivar-group)] >gi|20804579|dbj|BAB92271.1| putative glucosyltransferase [Oryza
  misc_feature: GI Number: 55296827; NR Description: putative UDP-glucose:salicylic acid glucosyltransferase [Oryza sativa
  misc_feature: GI Number: 22137016; NR Description: At2g36970/T1J8.15 [Arabidopsis thaliana] gi|4883613|gb|AAD31582.1| putative glucosyltransferase [Arabidopsis thaliana] gi|15809994|gb|AAL06924.1| At2g36970/T1J8.15 [Arabidopsis
  misc_feature: GI Number: 7385017; NR Description: UDP-glucose:salicylic
EPSILVVTEEWLGFIGSDPKPNRIHFATLPNIIPSELVRANDFIAFIDAVLTRLEEPFEQLLDRLNSPPTAIIADTYIIWAVRVGTKRNIPVASFWTTSATILSLFINSDLLASHGHFPIEPSESKLDEIVDYIPGLSPTRLSDLQILHGYSHQVFNIFKKSFGELYKAKYLLFPSAYELEPKAIDFFTSKFDFPVYSTGPLIPLEELSVGNENRELDYFKWLDEQPESSVLYISQGSFLSVSEAQMEEIVVGVREAGVKFFWVARGGELKLKEALEGSLGVVVSWCDQLRVLCHAAIGGFWTHCGYNSTLEGICSGVPLLTFPVFWDQFLNAKMIVEEWRVGMGIERKKQMELLIVSDEIKELVKRFMDGESEEGKEMRRRTCDLSEICRGAVAKGGSSDANIDAFIKDITKIV

SEQ ID NO: 263 - DNA, 1988 bp, Zea mays
  misc_feature (1)..(1988): Ceres cDNA ID no. 11048836
cttccgctttctcccttactcgcgctcagcacgcaggcgacggcgtcggcgctcaggtcgggctctgggcgacggcgtcatcggcttctcctcccgcctctctccagtcgcctcgcgccctcgcctccggtcctccgcacaccggccggtgaccctgcaaaaggaaattttcatggctgttaatgaggagtctgagggggagcaagctggggcaacactggaggatctgtttttctttaatggtgaagaggatgatgacagtgattgggaacctgctagtcgccttgttgtgaatagatggttttgcttgaactgcacaatgccaaatgtggacaagattacatattgcatgaattgccgtgagcttccaggatctgttgtagatggatatgatgtcttcaaaaagcaaattgcacaaacagctttgttatctgctgacacagggttgctgccagtgtctacggcgattggttttgatgaaagaatgctgctccacagtgagctagaagttaaaccaaatccacatccagaaagaccggatcgccttcgcgccattgctgcaagtcttgctgctgcagggatctttccctcaaaatgtgctttggtacctcctcgagaaatcacgaaggaggaacttcttatggttcatagtccagaccacattgaaagtgtcgagcagacaaagaacatgctttacagttacttcacttcggatacttacgcaaatggacattcagcatgtgctgccaaacttgcagctggattatgtgctgatcttgctagtttgatagtatctgggcgtgttcgcaatggctttgcgctggtaagacctcctgggcatcatgcaggggtgaagcaagcaatggggttttgtcttcacaacaatgcagcagtagctgcgttagctgcaaaaagagcaggtgccaagaaagtcctcatagttgactgggatgtgcaccatggaaatggcacacaagagatattcgacggggacaaaacagtcttgtacatatcattacatcgtcatgaggatggaaacttttaccctggaactggagctgctcatgaggtgggagttcttgatggtcaaggattctcagttaatataccttggagccgtggtggtgttggagatgatgactacatctttgcttttcagactgtggtgcttccaatagcttcagagtttgccgcagacatcactataatatctgcaggattcgatgcagctagaggtgaccctctgggttgttgtgacgtcactccaactggatactcttggatgacatccctgctagctggttcctcaaatggaagattgttggtgatacttgagggaggatacaatctccggtcgatatcctcatcagctactgaagttgttaaggtcctacttggggagggtcccaatcgtgcttcatttgtagtttcaccatcaaaagaggccttgagtactgtttctcaagtcctgaagattcaacaacagttttggccagttttaggtccaacatacgcatcactacaggcgcagcaggggtcggtttcttccaatcatagtaatgagctgaagaaaaggaagcgtccaggaggaggaccagggcccttctggtggaagatgggaagcaaaaggcttctatacgaagcgcttattgagcctcgcagccgtccgaggaaactcaaggggtcaactggttcagcagcgccttagacttagatgggcagtttgctggccgttgatcttctagacatgaacagggtagctcgctgaccgcgtttcctcaagcagagtaggctgcgtttacctagaaaacctagttttggctggttacttgcatgatggtcgaccgtttcagatggagtttgacagcaaacccgttgtgttaaccatgcgtggcgtatcagccgatgtttcatgcatgctactgtctttttctttggttggtttcgtaccatagatagacgtgtgtagcgaccatcgatgaagggcg

SEQ ID NO: 264 - protein, 568 aa, Zea mays
  misc_feature: PFam Name: Hist_deacetyl; PFam Description: Histone
  misc_feature: GI Number: 30684970; NR Description: histone deacetylase
  misc_feature: GI Number: 22135463; NR Description: histone deacetylase
  misc_feature: GI Number: 22135467; NR Description: histone deacetylase HDA110 isoform 3 [Zea mays] gi|22135465|gb|AAM93213.1| histone
  misc_feature: GI Number: 22135469; NR Description: histone deacetylase
  misc_feature: GI Number: 21554265; NR Description: histone deacetylase,
FRFLPYSRSARRRRRRRSGRALGDGVIGFSSRLSPVASRPRLRSSAHRPVTLQKEIFMAVNEESEGEQAGATLEDLFFFNGEEDDDSDWEPASRLVVNRWFCLNCTMPNVDKITYCMNCRELPGSVVDGYDVFKKQIAQTALLSADTGLLPVSTAIGFDERMLLHSELEVKPNPHPERPDRLRAIAASLAAAGIFPSKCALVPPREITKEELLMVHSPDHIESVEQTKNMLYSYFTSDTYANGHSACAAKLAAGLCADLASLIVSGRVRNGFALVRPPGHHAGVKQAMGFCLHNNAAVAALAAKRAGAKKVLIVDWDVHHGNGTQEIFDGDKTVLYISLHRHEDGNFYPGTGAAHEVGVLDGQGFSVNIPWSRGGVGDDDYIFAFQTVVLPIASEFAADITIISAGFDAARGDPLGCCDVTPTGYSWMTSLLAGSSNGRLLVILEGGYNLRSISSSATEVVKVLLGEGPNRASFVVSPSKEALSTVSQVLKIQQQFWPVLGPTYASLQAQQGSVSSNHSNELKKRKRPGGGPGPFWWKMGSKRLLYEALIEPRSRPRKLKGSTGSAAP

SEQ ID NO: 265 - DNA, 2137 bp, Zea mays
  misc_feature (1)..(2137): Ceres cDNA ID no. 11048848
  misc_feature (1)..(2137): Ceres CLONE  ID no. 1566291
cttccgctttctcccttactcgcgctcagcacgcaggcgacggcgtcggcgctcaggtcgggctctgggcgacggcgtcatcggcttctcctcccgcctctctccagtcgcctcgcgccctcgcctccggtcctccgcacaccggccggtgaccctgctcacactgatgtggaggcctcaaaagagaaccgtggagcatgcagtttgaacaatgatcgtgctgatgctctagaagaagaggccaatgtttccacagctaggataggtcatgttgagagtgctgaccctggtggctctgtgggtgtagaaaaggaaattttcatggctgttaatgaggagtctgagggggagcaagctggggcaacactggaggatctgtttttctttaatggtgaagaggatgatgacagtgattgggaacctgctagtcgccttgttgtgaatagatggttttgcttgaactgcacaatgccaaatgtggacaagattacatattgcatgaattgccgtgagcttccaggatctgttgtagatggatatgatgtcttcaaaaagcaaattgcacaaacagctttgttatctgctgacacagggttgctgccagtgtctacggcgattggttttgatgaaagaatgctgctccacagtgagctagaagttaaaccaaatccacatccagaaagaccggatcgccttcgcgccattgctgcaagtcttgctgctgcagggatctttccctcaaaatgtgctttggtacctcctcgagaaatcacgaaggaggaacttcttatggttcatagtccagaccacattgaaagtgtcgagcagacaaagaacatgctttacagttacttcacttcggatacttacgcaaatggacattcagcatgtgctgccaaacttgcagctggattatgtgctgatcttgctagtttgatagtatctgggcgtgttcgcaatggctttgcgctggtaagacctcctgggcatcatgcaggggtgaagcaagcaatggggttttgtcttcacaacaatgcagcagtagctgcgttagctgcaaaaagagcaggtgccaagaaagtcctcatagttgactgggatgtgcaccatggaaatggcacacaagagatattcgacggggacaaaacagtcttgtacatatcattacatcgtcatgaggatggaaacttttaccctggaactggagctgctcatgaggtgggagttcttgatggtcaaggattctcagttaatataccttggagccgtggtggtgttggagatgatgactacatctttgcttttcagactgtggtgcttccaatagcttcagagtttgccgcagacatcactataatatctgcaggattcgatgcagctagaggtgaccctctgggttgttgtgacgtcactccaactggatactcttggatgacatccctgctagctggttcctcaaatggaagattgttggtgatacttgagggaggatacaatctccggtcgatatcctcatcagctactgaagttgttaaggtcctacttggggagggtcccaatcgtgcttcatttgtagtttcaccatcaaaagaggccttgagtactgtttctcaagtcctgaagattcaacaacagttttggccagttttaggtccaacatacgcatcactacaggcgcagcaggggtcggtttcttccaatcatagtaatgagctgaagaaaaggaagcgtccaggaggaggaccagggcccttctggtggaagatgggaagcaaaaggcttctatacgaagcgcttattgagcctcgcagccgtccgaggaaactcaaggggtcaactggttcagcagcgccttagacttagatgggcagtttgctggccgttgatcttctagacatgaacagggtagctcgctgaccgcgtttcctcaagcagagtaggctgcgtttacctagaaaacctagttttggctggttacttgcatgatggtcgaccgtttcagatggagtttgacagcaaacccgttgtgttaaccatgcgtggcgtatcagccgatgtttcatgcatgctactgtctttttctttggttggtttcgtaccatagatagacgtgtgtagcgaccatcgatgaagggcg

SEQ ID NO: 266 - protein, 618 aa, Zea mays
  misc_feature: PFam Name: Hist_deacetyl; PFam Description: Histone
  misc_feature: GI Number: 30684970; NR Description: histone deacetylase
  misc_feature: GI Number: 22135463; NR Description: histone deacetylase
  misc_feature: GI Number: 22135467; NR Description: histone deacetylase HDA110 isoform 3 [Zea mays] gi|22135465|gb|AAM93213.1| histone
  misc_feature: GI Number: 22135469; NR Description: histone deacetylase
  misc_feature: GI Number: 21554265; NR Description: histone deacetylase,
LPLSPLLALSTQATASALRSGSGRRRHRLLLPPLSSRLAPSPPVLRTPAGDPAHTDVEASKENRGACSLNNDRADALEEEANVSTARIGHVESADPGGSVGVEKEIFMAVNEESEGEQAGATLEDLFFFNGEEDDDSDWEPASRLVVNRWFCLNCTMPNVDKITYCMNCRELPGSVVDGYDVFKKQIAQTALLSADTGLLPVSTAIGFDERMLLHSELEVKPNPHPERPDRLRAIAASLAAAGIFPSKCALVPPREITKEELLMVHSPDHIESVEQTKNMLYSYFTSDTYANGHSACAAKLAAGLCADLASLIVSGRVRNGFALVRPPGHHAGVKQAMGFCLHNNAAVAALAAKRAGAKKVLIVDWDVHHGNGTQEIFDGDKTVLYISLHRHEDGNFYPGTGAAHEVGVLDGQGFSVNIPWSRGGVGDDDYIFAFQTVVLPIASEFAADITIISAGFDAARGDPLGCCDVTPTGYSWMTSLLAGSSNGRLLVILEGGYNLRSISSSATEVVKVLLGEGPNRASFVVSPSKEALSTVSQVLKIQQQFWPVLGPTYASLQAQQGSVSSNHSNELKKRKRPGGGPGPFWWKMGSKRLLYEALIEPRSRPRKLKGSTGSAAP

SEQ ID NO: 267 - DNA, 2499 bp, Zea mays
  misc_feature (1)..(2499): Ceres cDNA ID no. 11048852
  misc_feature (1)..(2499): Also known as  Ceres CDNA ID no. 0
cttccgctttctcccttactcgcgctcagcacgcaggcgacggcgtcggcgctcaggtcgggctctgggcgacggcgtcatcggcttctcctcccgcctctctccagtcgcctcgcgccctcgcctccggtcctccgcacaccggccggtgaccctgcgtgcgtgcctctctctctctctctctctcccttcccgcctccggtggatcgtcaacaccgcccggcccgggtggcagcaccgcgcgcgacctgaggggtgagggcagcgggagccagcagccgctgctccaccaaggcggtcgcgccgcttttggagcgcttatgcccccggtccgctgagcgcttagtgcagttttttggaacatgagacctcctagcagtggcaaaaagactgaggtctcccatagcgtggggaaatgtggggtttctgatcaagcttgtcatggcaaatgccaaagctgtggcattgatgcaaaacctttttgtgctggagtgaacgaagtctccttgttgactggcagtcacactgatgtggaggcctcaaaagagaaccgtggagcatgcagtttgaacaatgatcgtgctgatgctctagaagaagaggccaatgtttccacagctaggataggtcatgttgagagtgctgaccctggtggctctgtgggtgtagaaaaggaaattttcatggctgttaatgaggagtctgagggggagcaagctggggcaacactggaggatctgtttttctttaatggtgaagaggatgatgacagtgattgggaacctgctagtcgccttgttgtgaatagatggttttgcttgaactgcacaatgccaaatgtggacaagattacatattgcatgaattgccgtgagcttccaggatctgttgtagatggatatgatgtcttcaaaaagcaaattgcacaaacagctttgttatctgctgacacagggttgctgccagtgtctacggcgattggttttgatgaaagaatgctgctccacagtgagctagaagttaaaccaaatccacatccagaaagaccggatcgccttcgcgccattgctgcaagtcttgctgctgcagggatctttccctcaaaatgtgctttggtacctcctcgagaaatcacgaaggaggaacttcttatggttcatagtccagaccacattgaaagtgtcgagcagacaaagaacatgctttacagttacttcacttcggatacttacgcaaatggacattcagcatgtgctgccaaacttgcagctggattatgtgctgatcttgctagtttgatagtatctgggcgtgttcgcaatggctttgcgctggtaagacctcctgggcatcatgcaggggtgaagcaagcaatggggttttgtcttcacaacaatgcagcagtagctgcgttagctgcaaaaagagcaggtgccaagaaagtcctcatagttgactgggatgtgcaccatggaaatggcacacaagagatattcgacggggacaaaacagtcttgtacatatcattacatcgtcatgaggatggaaacttttaccctggaactggagctgctcatgaggtgggagttcttgatggtcaaggattctcagttaatataccttggagccgtggtggtgttggagatgatgactacatctttgcttttcagactgtggtgcttccaatagcttcagagtttgccgcagacatcactataatatctgcaggattcgatgcagctagaggtgaccctctgggttgttgtgacgtcactccaactggatactcttggatgacatccctgctagctggttcctcaaatggaagattgttggtgatacttgagggaggatacaatctccggtcgatatcctcatcagctactgaagttgttaaggtcctacttggggagggtcccaatcgtgcttcatttgtagtttcaccatcaaaagaggccttgagtactgtttctcaagtcctgaagattcaacaacagttttggccagttttaggtccaacatacgcatcactacaggcgcagcaggggtcggtttcttccaatcatagtaatgagctgaagaaaaggaagcgtccaggaggaggaccagggcccttctggtggaagatgggaagcaaaaggcttctatacgaagcgcttattgagcctcgcagccgtccgaggaaactcaaggggtcaactggttcagcagcgccttagacttagatgggcagtttgctggccgttgatcttctagacatgaacagggtagctcgctgaccgcgtttcctcaagcagagtaggctgcgtttacctagaaaacctagttttggctggttacttgcatgatggtcgaccgtttcagatggagtttgacagcaaacccgttgtgttaaccatgcgtggcgtatcagccgatgtttcatgcatgctactgtctttttctttggttggtttcgtaccatagatagacgtgtgtagcgaccatcgatgaagggcg

SEQ ID NO: 268 - protein, 2499 aa, Zea mays
CTTCCGCTTTCTCCCTTACTCGCGCTCAGCACGCAGGCGACGGCGTCGGCGCTCAGGTCGGGCTCTGGGCGACGGCGTCATCGGCTTCTCCTCCCGCCTCTCTCCAGTCGCCTCGCGCCCTCGCCTCCGGTCCTCCGCACACCGGCCGGTGACCCTGCGTGCGTGCCTCTCTCTCTCTCTCTCTCTCCCTTCCCGCCTCCGGTGGATCGTCAACACCGCCCGGCCCGGGTGGCAGCACCGCGCGCGACCTGAGGGGTGAGGGCAGCGGGAGCCAGCAGCCGCTGCTCCACCAAGGCGGTCGCGCCGCTTTTGGAGCGCTTATGCCCCCGGTCCGCTGAGCGCTTAGTGCAGTTTTTTGGAACATGAGACCTCCTAGCAGTGGCAAAAAGACTGAGGTCTCCCATAGCGTGGGGAAATGTGGGGTTTCTGATCAAGCTTGTCATGGCAAATGCCAAAGCTGTGGCATTGATGCAAAACCTTTTTGTGCTGGAGTGAACGAAGTCTCCTTGTTGACTGGCAGTCACACTGATGTGGAGGCCTCAAAAGAGAACCGTGGAGCATGCAGTTTGAACAATGATCGTGCTGATGCTCTAGAAGAAGAGGCCAATGTTTCCACAGCTAGGATAGGTCATGTTGAGAGTGCTGACCCTGGTGGCTCTGTGGGTGTAGAAAAGGAAATTTTCATGGCTGTTAATGAGGAGTCTGAGGGGGAGCAAGCTGGGGCAACACTGGAGGATCTGTTTTTCTTTAATGGTGAAGAGGATGATGACAGTGATTGGGAACCTGCTAGTCGCCTTGTTGTGAATAGATGGTTTTGCTTGAACTGCACAATGCCAAATGTGGACAAGATTACATATTGCATGAATTGCCGTGAGCTTCCAGGATCTGTTGTAGATGGATATGATGTCTTCAAAAAGCAAATTGCACAAACAGCTTTGTTATCTGCTGACACAGGGTTGCTGCCAGTGTCTACGGCGATTGGTTTTGATGAAAGAATGCTGCTCCACAGTGAGCTAGAAGTTAAACCAAATCCACATCCAGAAAGACCGGATCGCCTTCGCGCCATTGCTGCAAGTCTTGCTGCTGCAGGGATCTTTCCCTCAAAATGTGCTTTGGTACCTCCTCGAGAAATCACGAAGGAGGAACTTCTTATGGTTCATAGTCCAGACCACATTGAAAGTGTCGAGCAGACAAAGAACATGCTTTACAGTTACTTCACTTCGGATACTTACGCAAATGGACATTCAGCATGTGCTGCCAAACTTGCAGCTGGATTATGTGCTGATCTTGCTAGTTTGATAGTATCTGGGCGTGTTCGCAATGGCTTTGCGCTGGTAAGACCTCCTGGGCATCATGCAGGGGTGAAGCAAGCAATGGGGTTTTGTCTTCACAACAATGCAGCAGTAGCTGCGTTAGCTGCAAAAAGAGCAGGTGCCAAGAAAGTCCTCATAGTTGACTGGGATGTGCACCATGGAAATGGCACACAAGAGATATTCGACGGGGACAAAACAGTCTTGTACATATCATTACATCGTCATGAGGATGGAAACTTTTACCCTGGAACTGGAGCTGCTCATGAGGTGGGAGTTCTTGATGGTCAAGGATTCTCAGTTAATATACCTTGGAGCCGTGGTGGTGTTGGAGATGATGACTACATCTTTGCTTTTCAGACTGTGGTGCTTCCAATAGCTTCAGAGTTTGCCGCAGACATCACTATAATATCTGCAGGATTCGATGCAGCTAGAGGTGACCCTCTGGGTTGTTGTGACGTCACTCCAACTGGATACTCTTGGATGACATCCCTGCTAGCTGGTTCCTCAAATGGAAGATTGTTGGTGATACTTGAGGGAGGATACAATCTCCGGTCGATATCCTCATCAGCTACTGAAGTTGTTAAGGTCCTACTTGGGGAGGGTCCCAATCGTGCTTCATTTGTAGTTTCACCATCAAAAGAGGCCTTGAGTACTGTTTCTCAAGTCCTGAAGATTCAACAACAGTTTTGGCCAGTTTTAGGTCCAACATACGCATCACTACAGGCGCAGCAGGGGTCGGTTTCTTCCAATCATAGTAATGAGCTGAAGAAAAGGAAGCGTCCAGGAGGAGGACCAGGGCCCTTCTGGTGGAAGATGGGAAGCAAAAGGCTTCTATACGAAGCGCTTATTGAGCCTCGCAGCCGTCCGAGGAAACTCAAGGGGTCAACTGGTTCAGCAGCGCCTTAGACTTAGATGGGCAGTTTGCTGGCCGTTGATCTTCTAGACATGAACAGGGTAGCTCGCTGACCGCGTTTCCTCAAGCAGAGTAGGCTGCGTTTACCTAGAAAACCTAGTTTTGGCTGGTTACTTGCATGATGGTCGACCGTTTCAGATGGAGTTTGACAGCAAACCCGTTGTGTTAACCATGCGTGGCGTATCAGCCGATGTTTCATGCATGCTACTGTCTTTTTCTTTGGTTGGTTTCGTACCATAGATAGACGTGTGTAGCGACCATCGATGAAGGGCG

SEQ ID NO: 269 - DNA, 2487 bp, Zea mays
  misc_feature (1)..(2487): Ceres cDNA ID no. 11049132
aggaattcggcacgaggcccactcctccggctcttcttctccaccggcaccagtccaccacctcccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtcaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacgggcacacgctgccgtcggaggtcacccgcgcggcgatgctggtgcgcatcaacaccctcctccagggctactccggcatccgcttcgagatcctcgaggccatcacgaagctgctcaacaccggtgtcagcccctgcctgccgctccggggcaccatcaccgcgtcgggcgacctggtcccgctctcctacatcgccggcctcatcacgggccgccccaacgcgcaggccgtcaccgtcgacggaaggaaggtggacgccgccgaggcgttcaagatcgccggcatcgagggcggcttcttcaagctcaaccccaaggagggcctcgccatcgtcaacggcacgtccgtgggctccgcgctcgcggccaccgtgatgtacgacgccaacgtcctggccgtcctgtcggaggtcctgtccgccgtcttctgcgaggtcatgaacggcaagcccgagtacacggaccacctgacccacaagctgaagcaccacccggggtccatcgaggccgcggccatcatggagcacatcctggatggcagctccttcatgaagcaggccaagaaggtgaacgagctggacccgctgctgaagcccaagcaggacaggtacgcgctccgcacgtcgccgcagtggctgggcccccagatcgaggtcatccgcgccgccaccaagtccatcgagcgcgaggtcaactccgtgaacgacaacccggtcatcgacgtccaccgcggcaaggcgctgcacggcggcaacttccagggcacccccatcggcgtgtccatggacaacgcccgcctcgccatcgccaacatcggcaagctcatgttcgcgcagttctccgagctcgtcaacgagttctacaacaacgggctcacctccaacctggccggcagccgcaaccccagcctggactacggcttcaagggcaccgagatcgccatggcctcctactgctccgagctccagtacctgggcaaccccatcaccaaccacgtgcagagcgcggacgagcacaaccaggacgtgaactccctgggcctcgtctcggccaggaagaccgccgaggcgatcgacatcctgaagctcatgtcgtccacctacatcgtggcgctgtgccaggccgtggacctgcgccacctcgaggagaacatcaaggcgtcggtgaagaacaccgtgacccaggtggccaagaaggtgctgaccatgaacccctcgggcgagctctccagcgcccgcttcagcgagaaggagctgatcagcgccatcgaccgcgaggccgtgttcacgtacgcggaggacgcggccagcgccagcctgccgctgatgcagaagctgcgcgccgtgctggtggaccacgccctcagcagcggcgagcgcggagcgggagccctccgtgttctccaagatcaccaggttcgaggaggagctccgcgcggtgctgccccaggaggtggaggccgcccgcgtggcgtcgccgagggcaccgcccccgtggcgaaccggatcgcggacagccggtcgttcccgctgtaccgcttcgtgcgcgaggagctcggctgcgtgttcctgaccggcgagaggctcaagtcccccggcgaggagtgcaacaaggtgttcgtcggcatcagccagggcaagctcgtggaccccatgctcgagtgcctcaaggagtgggacggcaagccgctgcccatcaacatcaagtaaaagaacgccaaggagaagaggagggaggggaggaaatacgtgaaaaaaaataaaacctgtacacgtgtctgtccagatcgtgccgtcgatcgctcttcgttgttgatttttggttgtattgatcgatccgtatgtgtgcgtgcgtgtgtggcgttgctctttcttcttttgtgtagctgtgccctgccaccggccgacgtgcgtgcatgccatggtggcgggcagcgttttctaaggtcatatactgttgttgtgtttaagt

SEQ ID NO: 270 - protein, 703 aa, Zea mays
  misc_feature: PFam Name: PAL; PFam Description: Phenylalanine and
  misc_feature: PFam Name: Pyr_redox_2; PFam Description: Pyridine
  misc_feature: PFam Name: Glutenin_hmw; PFam Description: High molecular
  misc_feature: PFam Name: Atrophin-1; PFam Description: Atrophin-1 family
  misc_feature: PFam Name: Pkinase; PFam Description: Protein kinase domain
  misc_feature: GI Number: 129594; NR Description: Phenylalanine ammonia-lyase >gi|2146799|pir||S66343 phenylalanine ammonia-lyase (EC 4.3.1.5) 1 - common tobacco >gi|170350|gb|AAA34122.1| phenylalanine ammonia lyase >gi|2564057|dbj|BAA22948.1|
  misc_feature: GI Number: 129585; NR Description: Phenylalanine ammonia-lyase class II >gi|81877|pir||S04127 phenylalanine ammonia-lyase (EC 4.3.1.5) class II - kidney bean
  misc_feature: GI Number: 478740; NR Description: phenylalanine
  misc_feature: GI Number: 82496; NR Description: phenylalanine ammonia-lyase
  misc_feature: GI Number: 62529133; NR Description: phenylalanine
MAGNGAIVESDPLNWGAAAAELAGSHLDEVKRMVAQARQPVVKIEGSTLRVGQVAAVASAKDASGVAVELDEEARPRVKASSEWILDCIAHGGDIYGVTTGFGGTSHRRTKDGPALQVELLRHLNAGIFGTGSDGHTLPSEVTRAAMLVRINTLLQGYSGIRFEILEAITKLLNTGVSPCLPLRGTITASGDLVPLSYIAGLITGRPNAQAVTVDGRKVDAAEAFKIAGIEGGFFKLNPKEGLAIVNGTSVGSALAATVMYDANVLAVLSEVLSAVFCEVMNGKPEYTDHLTHKLKHHPGSIEAAAIMEHILDGSSFMKQAKKVNELDPLLKPKQDRYALRTSPQWLGPQIEVIRAATKSIEREVNSVNDNPVIDVHRGKALHGGNFQGTPIGVSMDNARLAIANIGKLMFAQFSELVNEFYNNGLTSNLAGSRNPSLDYGFKGTEIAMASYCSELQYLGNPITNHVQSADEHNQDVNSLGLVSARKTAEAIDILKLMSSTYIVALCQAVDLRHLEENIKASVKNTVTQVAKKVLTMNPSGELSSARFSEKELISAIDREAVFTYAEDAASASLPLMQKLRAVLVDHALSSGERGAGALRVLQDHQVRGGAPRGAAPGGGGRPRGVAEGTAPVANRIADSRSFPLYRFVREELGCVFLTGERLKSPGEECNKVFVGISQGKLVDPMLECLKEWDGKPLPINIK

SEQ ID NO: 271 - DNA, 2149 bp, Zea mays
  misc_feature (1)..(2149): Ceres cDNA ID no. 11049340
aattcgcggccgccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcggcgccgtcggtcccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgacaagtacggctgctggtcgggctcggcgacgatcctggaggacggcacgccggcgatcctgtacacggggatcgaccgggcggacatcaactaccaggtgcaggtgctggcgctccccaaggacgcgtccgacccgctgctccgcgagtgggagaagccggaggagtacaacccggtggcgacgccggcggccggcggcatcaacgcgacgcagttccgcgacccgacgacggcgtggcggcacgcggggcactggcggatgctggtgggcagcgtgcgcggcgcgcgcgggatggcgctggtgtaccggagccgggacttcaggaagtggaccaaggccaagcacccgctgcactcggcggcgctgacggggatgtgggagtgccccgacttcttcccggtgtccgggccggggctgcaggccggcctcgacacctccgcgcccggaacaaagtacgtgctcaagagcagcctcgacctcacccgctacgactactacaccatcgggtcgtacgacggcggcaaggaccggtactaccccgacgaccccgccggcgactaccaccaccgccgccgctacgactacggcaactactacgcgtccaagacgttctacgaccccgtggagcgccgccgcgtgctgctcgggtgggccaacgagtccgacagcgtccccgacgacaaggccaagggctgggccggcatccatgcgatcccaaggaagatctggctggaccccaccgggaagcagctgctgcagtggcccatccacgaggtcgagaagctcagggggaaggccgtcagtgtggacgccaagctggtcaagcccggcgaccattttgaggtcacaggcatcgcaacttatcaggctgacgtggaggtgagcttcgagctggagctggaggcggggacgagcctgctggagaaggcggaggcgttcgacccggcgtacgacgacgacgcgcagaagctgtgcggagtcaagggcgcggacgccaggggcggcgtggggccattcggcctctgggtgctggcctccgccgacctgcaggagcggacggccgtcttcttcagggtgttcagggacggacacggcaagcccaaggtgctcatgtgcaccgaccccaccaagtcgtctcttagtccggatctgtacaagccgaccttcgcgggcttcgtcgacgccgacatctccagcggcaagatcacccttagaagcttgatcgatcggtccgtggtcgagagcttcggcgcgggaggcaagacgtgcatcctgtcacgggtgtacccgtccatcgccgtcgggaaggacgctcacctctacgttttcaacaacggcgaggtggacgtcacggtgtccggcctgaccgcctgggagatgaagaaaccgctgatgaacggcgcctgaaattgaagggaaaaaacaaaagtctatccggccgccacgtgactttctttattttcgttcttcttcttcttcgtcaacacacgtctctgccgccaaaggagaaattgattgatttcaacgtacgtatgtgtacgtctgctgccgatcgaaagagaattggattattataaaattgtttgaggccggtccttccattttctcgtccttaattcctctggcatgcaggatcagtgaccgacgacttgtagtttgcttgagcatgttgtttacgctgctagcttcttgttgtacgatacacatatacaacaatatgacacgatgaataaaaaaagcggccgcg

SEQ ID NO: 272 - protein, 590 aa, Zea mays
  misc_feature: PFam Name: Glyco_hydro_32; PFam Description: Glycosyl
  misc_feature: PFam Name: Mucin; PFam Description: Mucin-like glycoprotein
  misc_feature: PFam Name: Transferase; PFam Description: Transferase family
  misc_feature: GI Number: 26986190; NR Description: apoplastic invertase 1
  misc_feature: GI Number: 6318659; NR Description: cell wall invertase 2
  misc_feature: GI Number: 6318661; NR Description: cell wall invertase 2
  misc_feature: GI Number: 4105721; NR Description: cell wall invertase
  misc_feature: GI Number: 4105719; NR Description: cell wall invertase
MGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLREWEKPEEYNPVATPAAGGINATQFRDPTTAWRHAGHWRMLVGSVRGARGMALVYRSRDFRKWTKAKHPLHSAALTGMWECPDFFPVSGPGLQAGLDTSAPGTKYVLKSSLDLTRYDYYTIGSYDGGKDRYYPDDPAGDYHHRRRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQADVEVSFELELEAGTSLLEKAEAFDPAYDDDAQKLCGVKGADARGGVGPFGLWVLASADLQERTAVFFRVFRDGHGKPKVLMCTDPTKSSLSPDLYKPTFAGFVDADISSGKITLRSLIDRSVVESFGAGGKTCILSRVYPSIAVGKDAHLYVFNNGEVDVTVSGLTAWEMKKPLMNGA

SEQ ID NO: 273 - DNA, 1991 bp, Zea mays
  misc_feature (1)..(1991): Ceres cDNA ID no. 11049355
aagcagtggtaacaacgcagagtacgcgggggctcgcggccgcattagcgcggagatcgagagacaagagagggaaggcggcggcttgccggcttaagccttctctccctccgtcgtcgcctcctccttacgtccgcttcttcctcctgaatggagacgtcagcgccgcccaatgcccccgctccgccggcgcagcacggaggcggttgccgggacttccagcagtcagtgcggctcaagtatgtgaagctggggtaccactacctcatatcccacgggatgtacctgctgctgtcgccgctgatggcgctcgtcgccgtgcagctctccaccgtctccccgcatgacctcgccgacctgtgggagcagctccgcttcaacctcctctccgtcgtcgcctgctccacgctgctcgtcttcctctccaccgtttacttcctcacccgcccgcgccccgtgtacctgctcgacttcgcctgctacaagccggagtcggagcgcaagtgcacgcgcgagaccttcatgcactgctccaagctcaccggatccttcacggacgagaacctcgagttccagcgcaagatcctcgagcgctccggcctcggcgaggacacgtaccttccccccgccgtgctccgggtgccccctaacccgtgcatggacgaggcgcgtaaggaggcgcgcgccgtcatgttcggcgccatcgaccagctgctcgagaagaccggtgtcaggcccaaggacattggtgtcctagtggtcaactgcagcctgttcaacccgacgccgtcgctgtcagccatggtggtgaaccattacaagctgagggggaatattgtgagctacaacctcggcgggatgggctgcagcgccgggctcatcgacctcgccaaggatctgctgcaggtgcaccccaactcttacgccctggtgatcagcatggagaacatcacactgaattggtactttgggaacaaccggtccatgcttgtgtcgaattgcctgttccggatgggtggcgcggccatcctgctctcgaacaggcggtctgacaggcggaggtccaagtatgagctggtgcacacggtgcgcacgcacaagggcgccaacgacaagtgcttcggctgcgtgacacaggaggaagatgagattggcaagattggcgtgtcactgtccaaggacctcatggcagtggccggagacgcacttaagaccaacatcaccacgctggggccgttggtgctcccattatcagagcaacttctcttcatgggcacattgattgccaagaaggtgctcaagatgaaaatcaagccatacatccctgacttcaagctggctttcgagcacttctgcatccacgcaggcggccgcgctgtgctggatgagctggagaagaacctggagctcactgactggcacatggagccatcgaggatgaccctgtacaggtttggcaacacatcaagcagctcactctggtacgagctggcgtacactgaggcaaagggtaggatcaggaagcgcgacaggatctggcagatcgcatttggttctggattcaagtgcaacagcgccgtctggaaggcactccggacggtgaacccggccaaggagaagagcccctggatggatgagattgacaacttcccggtggatgttccaaagatttcaaaggttggtggcgcttgaagaaccattcttcttattattaggtggcaagtggagttgggtgattgtcaggggctgggcagagatttattccatcgtttccaccgttggttcttgtattcagttgtagcatggcatctgtgaaggaacttgagtagatgattcggttaggtagaaagggtgtgttcttcggctcgctagggttgtctgaatgcctgatatgtcctatttattcagattggagagagcaatcgatttgcattctttgctgcctgattgagatgttcacattgcaggccaacttaaacttgtaattcccc

SEQ ID NO: 274 - protein, 513 aa, Zea mays
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 34902606; NR Description: Putative fatty acid elongase [Oryza sativa (japonica cultivar-group)] >gi|22773252|gb|AAN06858.1| Putative fatty acid elongase [Oryza
  misc_feature: GI Number: 1045614; NR Description: beta-ketoacyl-CoA synthase
  misc_feature: GI Number: 30424120; NR Description: beta-ketoacyl-CoA
  misc_feature: GI Number: 30424122; NR Description: beta-ketoacyl-CoA
  misc_feature: GI Number: 12963438; NR Description: beta-ketoacyl-CoA
METSAPPNAPAPPAQHGGGCRDFQQSVRLKYVKLGYHYLISHGMYLLLSPLMALVAVQLSTVSPHDLADLWEQLRFNLLSVVACSTLLVFLSTVYFLTRPRPVYLLDFACYKPESERKCTRETFMHCSKLTGSFTDENLEFQRKILERSGLGEDTYLPPAVLRVPPNPCMDEARKEARAVMFGAIDQLLEKTGVRPKDIGVLVVNCSLFNPTPSLSAMVVNHYKLRGNIVSYNLGGMGCSAGLIDLAKDLLQVHPNSYALVISMENITLNWYFGNNRSMLVSNCLFRMGGAAILLSNRRSDRRRSKYELVHTVRTHKGANDKCFGCVTQEEDEIGKIGVSLSKDLMAVAGDALKTNITTLGPLVLPLSEQLLFMGTLIAKKVLKMKIKPYIPDFKLAFEHFCIHAGGRAVLDELEKNLELTDWHMEPSRMTLYRFGNTSSSSLWYELAYTEAKGRIRKRDRIWQIAFGSGFKCNSAVWKALRTVNPAKEKSPWMDEIDNFPVDVPKISKVGGA

SEQ ID NO: 275 - DNA, 1359 bp, Zea mays
  misc_feature (1)..(1359): Ceres cDNA ID no. 11049371
cacacacaccatatcacaagcaagcgccaacgatcgagcagaaagaagatcgtcgagatcgagcataagccatggcggcctctgtttctgcctcttgccttattagcctgtcgtcgttggcggtggtgctggtggcgctggcgtcggcggcgtcggcgcagctgtcgtcgacgttctacgacaggtcatgccccaacgcgctgtccaccatcaggagcggcgtgaactccgcggtgaggcaggagcctcgcgtgggggcgtcgctgctcaggctccatttccacgactgctttgtccggggctgcgacgcgtcccttctgctgaacgacacgtcaggggagcagagccagggcccgaatctaactctgaacccaaggggcttcgttgtcgtgaacagcatcaaggcgcaggtggagtccgtgtgcccggggatcgtctcctgcgccgacatcctcgccgtggccgccagggacggagtcgtatcgctcggcgggccttcgtggacagttctgctagggcgaagggactctaccgcttcattcccaggacagacaagcgaccccccacctccgacgtctagcctccgacagcttttgtctgcgtataacaagaagaatctcaacccaaccgacatggttgcactctcaggagctcacacgatcggacaggcgcagtgctcgagcttcaacgaccacatctacaacgacaccaacatcaactccgccttcgcggcgtcgctcagggccaactgccccagggcaggcagcaccgcccttgcgccgctggacaccacgacgcccaacgcgttcgacaacgcctactacaccaacctgctgtcccagaaggggctcctgcactcggaccaggagctcttcaacaacggcagcaccgacagcacggtcaggagcttcgcgtcccagcacgtcggccttcaacagcgccttcgccacggccatggtcaagatgggcaacctcagcccccagaccggaacccaggggcagatcaggcgcagctgctggaaggtcaactcgtaaactactagctacgtactacgcccaatgcaatgcgttatggcaggcagatcagagccaattagtaataaggcctcagctcgctctctacctgtacgtgtgtgtgtgactggtgttggtcgagtaagtgtacgtactacatggatggagcagagagagagagagatatatcgatttggccaccttattattgcatgcatatgtgtactgtattagcacgacactattagacacatttattaatggtacccatgctatgcttgtaaacgtacccagccattgacctagatatgacactataggtctaatcgtattgcggctaacacc

SEQ ID NO: 276 - protein, 323 aa, Zea mays
  misc_feature: PFam Name: peroxidase; PFam Description: Peroxidase
  misc_feature: PFam Name: Mucin; PFam Description: Mucin-like glycoprotein
  misc_feature: GI Number: 15011986; NR Description: putative peroxidase P7X
  misc_feature: GI Number: 2429292; NR Description: peroxidase [Oryza sativa]
  misc_feature: GI Number: 3411221; NR Description: peroxidase PXC2 precursor
  misc_feature: GI Number: 57635151; NR Description: peroxidase 3 [Triticum
  misc_feature: GI Number: 20286; NR Description: peroxidase [Oryza sativa] gi|100694|pir||S22087 peroxidase (EC.11.1.7) precursor - rice
MAASVSASCLISLSSLAVVLVALASAASAQLSSTFYDRSCPNALSTIRSGVNSAVRQEPRVGASLLRLHFHDCFVRGCDASLLLNDTSGEQSQGPNLTLNPRGFVVVNSIKAQVESVCPGIVSCADILAVAARDGVVSLGGPSWTVLLGRRDSTASFPGQTSDPPPPTSSLRQLLSAYNKKNLNPTDMVALSGAHTIGQAQCSSFNDHIYNDTNINSAFAASLRANCPRAGSTALAPLDTTTPNAFDNAYYTNLLSQKGLLHSDQELFNNGSTDSTVRSFASQHVGLQQRLRHGHGQDGQPQPPDRNPGADQAQLLEGQLVNY

SEQ ID NO: 277 - DNA, 1380 bp, Zea mays
  misc_feature (1)..(1380): Ceres cDNA ID no. 11049673
ggcacgagaggacacaagcgagcgctagccagaagagcagctgcaggtactattatcatcgtcgtcgtcgtcgccaggatgaccgtcgtcgacgccgtcgtctcctccaccgatgccggcgcccctgccgccgccgccgcaccggtaccggcggggaacgggcagaccgtgtgcgtcaccggcgcggccgggtacatcgcctcgtggttggtgaagctgctgctcgagaagggatacactgtgaagggcaccgtgaggaacccagatgacccgaagaacgcgcacctcagggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggaggcggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggccacctgccggtgctcggagagcggacgacgacggaggccgccgacaaggatgcccccgcggccgagatgcagcagggagggatcgccatccgtgcctgagagggcgatgccacacatgaacacaaagcaatgttcatactgctgccctgcacctgcaccttcccctgctgtgtaaacaggcctgtgtttgttctggctgatagtgatgtaccctaagacttgtaacgtcatgttcgttcttgtgaactatagcgagtgaataaaattggttaatgttggatattc

SEQ ID NO: 278 - protein, 371 aa, Zea mays
  misc_feature: PFam Name: Epimerase; PFam Description: NAD dependent
  misc_feature: PFam Name: 3Beta_HSD; PFam Description: 3-beta
  misc_feature: PFam Name: Transferase; PFam Description: Transferase family
  misc_feature: PFam Name: FH2; PFam Description: Formin Homology 2 Domain
  misc_feature: PFam Name: Peptidase_S8; PFam Description: Subtilase family
  misc_feature: GI Number: 25140432; NR Description: cinnamoyl CoA reductase
  misc_feature: GI Number: 9964087; NR Description: cinnamoyl CoA reductase
  misc_feature: GI Number: 2960364; NR Description: cinnamoyl CoA reductase
  misc_feature: GI Number: 7239228; NR Description: cinnamoyl CoA reductase;
  misc_feature: GI Number: 9998901; NR Description: cinnamoyl-CoA reductase
MTVVDAVVSSTDAGAPAAAAAPVPAGNGQTVCVTGAAGYIASWLVKLLLEKGYTVKGTVRNPDDPKNAHLRALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEQAAWEAARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPAAEMQQGGIAIRA

SEQ ID NO: 279 - DNA, 1422 bp, Zea mays
  misc_feature (1)..(1422): Ceres cDNA ID no. 11049748
ggcacgagctcggctgctacgtagctatatatagctgcagaacagttttagttaccggactgtaggcacaccaagctagatatccaaggggcccccccggaaactagctagctaggatgccaacagcagaggcgacgacgcccgtgccgccggagctgtcctccgggcaagggcggacggtttgcgtgaccggagctggagggttcattgcctcctggctcgtcaagcgcctcctggagaagggctacacagtccgcggcacggtcaggaaccctgtggatccaaagaacgaccacctgagggcccttgacggcgccgtcgaccgtctcgtcctcctccgcgccgacctgctggacccacagagccttgccgaggccttctccggctgtgacggcgtcttccacgccgcctccccggtcaccgatgaccctgagatgatgatcgagccagcgatccggggcacgcgctacgtgatggcggcggcggacgacgccggagtgaagcgcgtcgtgttcacgtcctccatcggcaccgtgtacatgaacccctaccgtgaccccagcaagcctgtggacgacacctgctggagcgacctcgagtattgcaagaacacccagaactggtactgctacgccaagacggtggcggagcagggcgcgtgggaggtggcgcggaagcgagggctggacctggtggtggtgaacccggtgctggtgctgggcccgctgctgcagccgacggtgaacgccagcacggaccacgtgatgaagtacctgacggggtcggccacgacctacgtgaacgcggcgcaggcgtacgtgcacgtcagggacgtggccgaggcgcacgtccgggtgtacgaggcgccccacgcgcacggccgctacatctgcgccgagagcaccctgcaccgcggcgacctctgccgcgtcctcgccaagctcttcccggagtaccccgtacccaccaagtgcaaggaccaggttaaccctccggtggtaggatacaagttcaccaaccagaggctcaaggatctggggatggacttcgtgccggtcctgcagtgcctctacgagacggtcaccagcctccaggagaaaggcatgctgcccgtgcttccgacaaaacaagaccatgaccaactcggcaaatcatgatcatattcatatccctcgttgacgatactagctgctgctaccacgcatatcatatcatatatataagatatatatatatatagtggattcatatagttaaccttatatatatgtgtgtgtgtgtgtgttattgtgtgttattagtgtgtacaattaaatggcaactctaatgggtgcatgcatctgcatgcatgctttcctgacaagtgccacacatgcatgcaatgtatctctttggacgatttatatacaatactccgttgcc

SEQ ID NO: 280 - protein, 346 aa, Zea mays
  misc_feature: PFam Name: Epimerase; PFam Description: NAD dependent
  misc_feature: PFam Name: 3Beta_HSD; PFam Description: 3-beta
  misc_feature: PFam Name: NmrA; PFam Description: NmrA-like family
  misc_feature: PFam Name: NAD_binding_4; PFam Description: Male sterility protein
  misc_feature: GI Number: 25140434; NR Description: cinnamoyl CoA reductase
  misc_feature: GI Number: 65306612; NR Description: cinnamoyl-CoA reductase
  misc_feature: GI Number: 9998901; NR Description: cinnamoyl-CoA reductase
  misc_feature: GI Number: 65306614; NR Description: cinnamoyl-CoA reductase
  misc_feature: GI Number: 2960364; NR Description: cinnamoyl CoA reductase
MPTAEATTPVPPELSSGQGRTVCVTGAGGFIASWLVKRLLEKGYTVRGTVRNPVDPKNDHLRALDGAVDRLVLLRADLLDPQSLAEAFSGCDGVFHAASPVTDDPEMMIEPAIRGTRYVMAAADDAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKQDHDQLGKS

SEQ ID NO: 281 - DNA, 1547 bp, Zea mays
  misc_feature (1)..(1547): Ceres cDNA ID no. 11049826
ttcggcacgagaaacctttcggtttctcgagcgcaatgcctctcgctgcagtgctccttcccctcctcgtcctcggcgcgtcgtcggtgtgtcaaggtcaaggcgctgcgagccacaacatcacggccatcctggcggcgtacccggagttcaccgacttcagcgctgccctggtcagcaccggcgccgcggcggagatcgaccgccgcagcaccgtcaccgtcctcgccgtcgacaacgccgtcatggcgcggctaaaggcgcagaagctgcagctcgacgacctgcagcgcgtgatctacctccacgtcctcctggactacttcgacgccgccaagctaggcagcatccagggcggtttcgcccaggccgctagcctctaccaggcctccggcaaggcgcaggggagcgacgggatcgtcaacatcaccgtgttccccgacggccgcgtggcggcgttcacgccgtcgggcccctccaacaggttgccgaccgccttctaccaacgatccatcaaggaacaaccgtactacatcgccgtcctgcaggtgagggacctgatctggtctccggcgccggcggacggggtgcaggctccaccgcccgcgccgcagcccgacgcggcgccggggttgacggatctgctgtccaagaacggctgcgggggcttcgccagcctcctcgccgcgacggccgacgcagtcaccaagtacgacagcagcgccgccgggctcaccgtcttctgcccggccgacgaggcggtggaggccttcaactccaccttcaagaacctcaccgccgacgcccagctcgcgctcctgctgtaccacggcgtggcggaacactactccgcgcagtctctcaaggcgatcaatggggacgtaagcacgcttgcctccgacggatccaagaacaacaacgggtacaacctaacgatacgtgccgacggggacacagtgaaaatctcgtctgcatctgccagcgccgccacggtgaccaagacgctgctcgacaaggcgccgctctccgtctacctcatcgacgcggtgctcctgccaaggcgcagtctaacgacgaccagggacacactgcgcccgcccctgcgccggcctcctcgcctgcacatgcacctacacctgcccttgcgccggtctcgccgtcgcctgcccctgtaccggtctcgccgtcgccgtcgccgtcgcctgcacatgcacccacacccccacttgcccctgctccggtgactgcacctgcgcccaggcgtcgcccagcgccatcgccagagcacactaccccagctccttcgccagacgcggacggccaaccgcctgcagatcagaagaacaacgcagcaagggacacggcatcttggactatcggcgcggcgctggcgatcgtgtgcctcttgtcgtgaagggtttaaggctttaagcttagatatattgacgccgattgggatccgtcatctcgccgccaataccagtgtacactgaagacaatgtttatgggcatgcattggccaaaataatattattctgcttccgcct

SEQ ID NO: 282 - protein, 402 aa, Zea mays
  misc_feature: PFam Name: Fasciclin; PFam Description: Fasciclin domain
  misc_feature: PFam Name: Pyr_redox_2; PFam Description: Pyridine
  misc_feature: PFam Name: Extensin_2; PFam Description: Extensin-like region
  misc_feature: PFam Name: Lipoprotein_5; PFam Description: Transferrin
  misc_feature: PFam Name: GATase_2; PFam Description: Glutamine
  misc_feature: GI Number: 14190409; NR Description: AT3g60900/T4C21_310
  misc_feature: GI Number: 21593224; NR Description: endosperm specific protein-like [Arabidopsis thaliana] gi|7329700|emb|CAB82694.1| endosperm specific protein-like [Arabidopsis thaliana] gi|38257776|sp|Q9LZX4|FA10_ARATH Fasciclin-like arabinogalactan
  misc_feature: GI Number: 13377778; NR Description: fasciclin-like
  misc_feature: GI Number: 21593810; NR Description: putative pollen surface
  misc_feature: GI Number: 21595125; NR Description: endosperm-specific
MPLAAVLLPLLVLGASSVCQGQGAASHNITAILAAYPEFTDFSAALVSTGAAAEIDRRSTVTVLAVDNAVMARLKAQKLQLDDLQRVIYLHVLLDYFDAAKLGSIQGGFAQAASLYQASGKAQGSDGIVNITVFPDGRVAAFTPSGPSNRLPTAFYQRSIKEQPYYIAVLQVRDLIWSPAPADGVQAPPPAPQPDAAPGLTDLLSKNGCGGFASLLAATADAVTKYDSSAAGLTVFCPADEAVEAFNSTFKNLTADAQLALLLYHGVAEHYSAQSLKAINGDVSTLASDGSKNNNGYNLTIRADGDTVKISSASASAATVTKTLLDKAPLSVYLIDAVLLPRRSLTTTRDTLRPPLRRPPRLHMHLHLPLRRSRRRLPLYRSRRRRRRRLHMHPHPHLPLLR

SEQ ID NO: 283 - DNA, 1220 bp, Zea mays
  misc_feature (1)..(1220): Ceres cDNA ID no. 11049993
  misc_feature (1)..(1220): Also known as  Ceres CDNA ID no. 0
cggcacgagatcgcacgcaccatcgtcctgccgatcgatcgcagccagccagtcttgctgagagacgaactgaagcctgaagtgaaccgatcgatcgatcgatcgagcgagcgagctcccatgaaggcgttgattctggcggcggtgctgctgctgcagcacgggggagccgcgagcgccggcggcaacttctaccaggacgtggacatcacctggggcgacggccgcggcaagatcctcgacaacggccagctcctgacgctgtccatggacaggtcctccggctcgggcttccagtccaaggcccagtacctctacggccgcttcgacatgcagctcaagctcgtcccgggggactccgccggcaccgtcgccaccttctatctttcgtcgcagggttcgcagcacgacgagatcgacttcgagttcctggggaacgcgagcggggagccgtacacggtgcacacgaacgtgtacagccaggggaagggcgggcgggagcagcagttccggatgtggttcgaccccacggcggccttccacgcctactccgtgctgtggaaccccgcccacgtcgtcttctacgtggacggcgtccccatccgggagttccggcgccgcggcgacgggaccgtgccgttcccgacgtcgcagccgatgcgggtgtacgccagcgtgtgggacgcggaggagtgggccacgcagggggggcgcgtccggaccgactggtccaaggcgcccttcgtcgcgtcgtaccgcgggtacgccgccgccgggtgcaccgcgccggacgccgccgcctgcgcgcgctccaacggcgcatggatgtcgcaggagctcgacagcgccggccaggagcagctccgccgggcgcaggccagctacatgatctacaactactgcaccgataagtaccggttcccgcagggcccgccgcccgagtgctcgtcgccggccaagtagtagatgagtagaattgatcggatacagagagcaatcaattaattaaatcgacccgtcgcttggtttttggtttacacattgtactacggcataagttcggcggatatatgtatacgtagacggctagacgccatgcatgtgtcttggcatgtatcgtattcgtatatatcgtaattcgtatgtacctcagtatacctgcatcgtacatttacatgcatatatatctccctatatataaatatatatggttttattat

SEQ ID NO: 284 - protein, 1220 aa, Zea mays
CGGCACGAGATCGCACGCACCATCGTCCTGCCGATCGATCGCAGCCAGCCAGTCTTGCTGAGAGACGAACTGAAGCCTGAAGTGAACCGATCGATCGATCGATCGAGCGAGCGAGCTCCCATGAAGGCGTTGATTCTGGCGGCGGTGCTGCTGCTGCAGCACGGGGGAGCCGCGAGCGCCGGCGGCAACTTCTACCAGGACGTGGACATCACCTGGGGCGACGGCCGCGGCAAGATCCTCGACAACGGCCAGCTCCTGACGCTGTCCATGGACAGGTCCTCCGGCTCGGGCTTCCAGTCCAAGGCCCAGTACCTCTACGGCCGCTTCGACATGCAGCTCAAGCTCGTCCCGGGGGACTCCGCCGGCACCGTCGCCACCTTCTATCTTTCGTCGCAGGGTTCGCAGCACGACGAGATCGACTTCGAGTTCCTGGGGAACGCGAGCGGGGAGCCGTACACGGTGCACACGAACGTGTACAGCCAGGGGAAGGGCGGGCGGGAGCAGCAGTTCCGGATGTGGTTCGACCCCACGGCGGCCTTCCACGCCTACTCCGTGCTGTGGAACCCCGCCCACGTCGTCTTCTACGTGGACGGCGTCCCCATCCGGGAGTTCCGGCGCCGCGGCGACGGGACCGTGCCGTTCCCGACGTCGCAGCCGATGCGGGTGTACGCCAGCGTGTGGGACGCGGAGGAGTGGGCCACGCAGGGGGGGCGCGTCCGGACCGACTGGTCCAAGGCGCCCTTCGTCGCGTCGTACCGCGGGTACGCCGCCGCCGGGTGCACCGCGCCGGACGCCGCCGCCTGCGCGCGCTCCAACGGCGCATGGATGTCGCAGGAGCTCGACAGCGCCGGCCAGGAGCAGCTCCGCCGGGCGCAGGCCAGCTACATGATCTACAACTACTGCACCGATAAGTACCGGTTCCCGCAGGGCCCGCCGCCCGAGTGCTCGTCGCCGGCCAAGTAGTAGATGAGTAGAATTGATCGGATACAGAGAGCAATCAATTAATTAAATCGACCCGTCGCTTGGTTTTTGGTTTACACATTGTACTACGGCATAAGTTCGGCGGATATATGTATACGTAGACGGCTAGACGCCATGCATGTGTCTTGGCATGTATCGTATTCGTATATATCGTAATTCGTATGTACCTCAGTATACCTGCATCGTACATTTACATGCATATATATCTCCCTATATATAAATATATATGGTTTTATTAT

SEQ ID NO: 285 - DNA, 1658 bp, Zea mays
  misc_feature (1)..(1658): Ceres cDNA ID no. 11050080
  misc_feature (1)..(1658): Ceres CLONE  ID no. 1544738
ggcacgagaaaaatctcacgcaggagacaaatccagtaatccacactttccttcgcctcctccatcgtggtcgcggccaaggccaacgaaccaattcctctaccattcctcctccctcctttcctgccattctcccatcccggcagggcgtctcctcctcctccctccctcctttccatcccgtttcttcgccgcctccatctccaggccgcgtcgaattcttccatccaccgcaccggtcgacgacgacgacgaggatgctgggcgcagcgaggaggcagcttggatccggtcccatgctgggacaggttttgcgaagactccgaccagcggtggcggctgaggtggcgaggggctactccgccgcggcgaaggagatgactgtccgtgatgcattgaactctgcattggatgaagagatgtctgctgatccttccgtttttctgatgggagaagaggttggagagtaccaaggtgcatacaagatttctaagggcttgcttgataggtatggtcctgatagggttcttgacacgcctatcacagaggctggttttactggcattggtgttggtgcagcttatcatggtcttcggcctattatagagtttatgacatttaatttctcgatgcaggctattgatcatatcatcaattcagctgccaagtcaaattatatgtcagctggtcagatatctgttcctattgtttttagaggaccaaacggagctgctgctggagttggtgctcaacactcacagtgttatgcagcttggtttgcacatgttccaggacttaaggttctcacaccatactcttcagaagatgcccgaggcttgctcaaagctgctatcagggaccctgatcctgttattttcctggaaaatgaattgctttatggagaatctttcccagtttctgctgaagtgcttgattctagtttttgcctaccgattggcaaagctaagatagaacgtgagggtaaagatgttaccattactgcgttctccaagatggttggctatgctctccaggctgcagagatactgtccaaggaaggaatcagtgctgaggtgatcaaccttcgatcaatcagaccacttgatagagctgctattaatgcatctgtcaggaaaaccaaccgattggtgactgttgaagaagggttcccccaacatgggattggtgccgagatatgcatgtctgttgtagaagaaagcttcgcgtaccttgatgcaccagttgagaggattgctggagctgatgtacctatgccctatgctgccaaccttgagagaatggctgttccgcaggtcgatgacattgtgcgggcggcaaagcgggcctgctacagggcagtaccaatggcagcagctgcctgattggtggacaagcctttctgttttccttccatcggttttcgctctctagccagaaacatgtagtattcataaggcgcaggcaaattggccggaacccagactccaagcgagctaattttgtagatctgccatggtgtgctttgtcccgttagtcgatatatgtggcgttatttctagattcaagtccatttgcttctctatgatttttgtacaccgctaaataatcttcttaagcccctgaatgaatgcaaaatatttaagatgttttaggaaaat

SEQ ID NO: 286 - protein, 374 aa, Zea mays
  misc_feature: PFam Name: Transket_pyr; PFam Description: Transketolase,
  misc_feature: PFam Name: Transketolase_C; PFam Description: Transketolase,
  misc_feature: GI Number: 520478; NR Description: pyruvate dehydrogenase E1
  misc_feature: GI Number: 3850999; NR Description: pyruvate dehydrogenase E1
  misc_feature: GI Number: 3851001; NR Description: pyruvate dehydrogenase E1
  misc_feature: GI Number: 3851003; NR Description: pyruvate dehydrogenase E1
  misc_feature: GI Number: 25012844; NR Description: RH05604p [Drosophila
MLGAARRQLGSGPMLGQVLRRLRPAVAAEVARGYSAAAKEMTVRDALNSALDEEMSADPSVFLMGEEVGEYQGAYKISKGLLDRYGPDRVLDTPITEAGFTGIGVGAAYHGLRPIIEFMTFNFSMQAIDHIINSAAKSNYMSAGQISVPIVFRGPNGAAAGVGAQHSQCYAAWFAHVPGLKVLTPYSSEDARGLLKAAIRDPDPVIFLENELLYGESFPVSAEVLDSSFCLPIGKAKIEREGKDVTITAFSKMVGYALQAAEILSKEGISAEVINLRSIRPLDRAAINASVRKTNRLVTVEEGFPQHGIGAEICMSVVEESFAYLDAPVERIAGADVPMPYAANLERMAVPQVDDIVRAAKRACYRAVPMAAAA

SEQ ID NO: 287 - DNA, 1493 bp, Zea mays
  misc_feature (1)..(1493): Ceres cDNA ID no. 11050084
ggcacgaggtccctcccaggcctcccctccctcctcccccgtcgccaaccaacctccaacccccagccgatcgcgtcggagatgctgggcgtcgcgcggaggcggctcggatctggatgcgtgctcgcccagctggcgcaggccctccgccccgccgccgctcccgccaggacctactccgccgcggccaaggagataactgtacgggaagcattgaataccgcattagatgaagaaatgtcggcagacccttctgttttcttgatgggagaagaggttggcgagtaccaaggtgcatacaagatatccaagggtttgcttgacaagtatggccccgatagggttctcgatactccgatcactgaggcgggcttcactggcattggtgttggtgccgcttaccatggtcttcgacctattgtagagttcatgacatttaacttttcgatgcaggcaattgatcacataattaattcagctgccaagtcgaactacatgtctgctgggcagatatctgttcctattgtctttaggggtccaaatggtgctgctgctggagttggtgcccaacactcacagtgctatgcagcttggtatgcacatgttcccggattgaaagttctagctccatattctgcagaagatgctcgaggtttgctgaaagcagcaatcagggatccagatcctgttgtgttccttgaaaatgaacttctttatggtgaatcatttcctgtatctgctgaggtacttgattctagcttctgccttccgattggaaaggctaagatagagcgacaagggaaagatgtcactatcactgcattctccaaaatggtgggatatgcccttcaggccgctgatatactggccaaggaaggtatcagtgccgaggtaatcaatcttcgctcaattagaccgctggatagagctactattaatgcatctgtgaggaaaaccaatagattggtaaccgtagaagaaggcttccctcaacatgggattggtgcggaaatatgcatgtctgttgtagaggacagctttgagtatcttgatgcaccagtcgagaggattgctggagctgatgtgcccatgccgtacgctgccaaccttgagaggatggctgttccacaggtcgatgacatcgtccgggcagccaagcgtgcttgctacagggcagcagtaccgatggcagcaaccgcctagtccagcagaaccctgcatgttgcatttctttgtctaattttaatgtccgtgctgcagaaagacgtgtcacataatggtgtgacgagtacccactgccgctgcaactcaactatagcatgagctgagtttttgtagagccaccgagaggtgttcagtactccagttccagttccgcttatcttcgccgccgcagccggaaggctgcgcatgactctgcgtctgttttatggttcacgaatgattgcagatttgcagcagagcctctggagatgagaattttacttgtggcg

SEQ ID NO: 288 - protein, 400 aa, Zea mays
  misc_feature: PFam Name: Transket_pyr; PFam Description: Transketolase,
  misc_feature: PFam Name: Transketolase_C; PFam Description: Transketolase,
  misc_feature: GI Number: 520478; NR Description: pyruvate dehydrogenase E1
  misc_feature: GI Number: 3850999; NR Description: pyruvate dehydrogenase E1
  misc_feature: GI Number: 3851001; NR Description: pyruvate dehydrogenase E1
  misc_feature: GI Number: 3851003; NR Description: pyruvate dehydrogenase E1
  misc_feature: GI Number: 25012844; NR Description: RH05604p [Drosophila
GTRSLPGLPSLLPRRQPTSNPQPIASEMLGVARRRLGSGCVLAQLAQALRPAAAPARTYSAAAKEITVREALNTALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSAEVLDSSFCLPIGKAKIERQGKDVTITAFSKMVGYALQAADILAKEGISAEVINLRSIRPLDRATINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 289 - DNA, 2184 bp, Zea mays
  misc_feature (1)..(2184): Ceres cDNA ID no. 11050130
atgtacacattgcccgtccgtgccaccacatccagcatcgtgccagcctgccacccccgcgccgtcctcctcctccggctccggcccccaggctcaggctcatccggaacgccccgtcttcgccgccccgccaccgtcgtgggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggactgcagcccggcgaggcattcaccgtccgcaacatcgcttccatggtcccaccctacgacaagatcaagtacgccggcacagggtccgccatcgagtacgccgtgtgcgcgctcaaggtgcaggtcatcgtggtcattggccacagctgctgcggtggcatcagggcgctcctctccctcaaggacggcgcgcccgacaacttcaccttcgtggaggactgggtcaggatcggcagccctgccaagaacaaggtgaagaaagagcacgcgtccgtgccgttcgatgaccagtgctccatcctggagaaggaggccgtgaacgtgtcgctccagaacctcaagagctaccccttcgtcaaggaagggctggccggcgggacgctcaagctggttggcgcccactacagcttcgtcaaagggcagttcgtcacatgggagcctccccaggacgccatcgagcgcttgacgagcggcttccagcagttcaaggtcaatgtctatgacaagaagccggagcttttcgggcctctcaagtccggccaggcccccaagtacatggtgttcgcctgctccgactcccgtgtgtgcccgtcggtgaccctgggcctgcagcccgcgaaggccttcaccgttcgcaacatcgccgccatggtcccaggctacgacaagaccaagtacaccggcatcgggtccgccatcgagtacgctgtgtgcgccctcaaggtggaggtcctcgtggtcattggccatagctgctgcggtggcatcagggcgctcctctccctcaaggacggcgcgcccgacaacttccacttcgtggaggactgggtcaggatcggcagccctgccaagaacaaggtgaagaaagagcacgcgtccgtgccgttcgatgaccagtgctccatcctggagaaggaggccgtgaacgtgtcgctccagaacctcaagagctaccccttggtcaaggaagggctggccggcgggacgtcaagtggttggccccactacgacttcgttaaagggcagttcgtcacatgggagcctccccaggacgccatcgagcgcttgacgagcggcttccagcagttcaaggtcaatgtctatgacaagaagccggagcttttcgggcctctcaagtccggccaggcccccaagtacatggtgttcgcctgctccgactcccgtgtgtccccgtcggtgaccctgggcctgcagcccggcgaggccttcaccgttcgcaacatcgccgccatggtccccggctacgacaagaccaagtacaccggcatcgggtccgccatcgagtacgctgtgtgcgccctcaaggtggaggtcctcgtggtcattggccatagctgctgcggtggcatcagggcgctcctctcactccaggacggcgcacctgacaccttccacttcgtcgaggactgggttaagatcgccttcattgccaagatgaaggtaaagaaagagcacgcctcggtgccgttcgatgaccagtggtccattctcgagaaggaggccgtgaacgtgtccctggagaacctcaagacctaccccttcgtcaaggaagggcttgcaaatgggaccctcaagctgatcggcgcccactacgactttgtctcaggagagttcctcacatggaaaaagtgaaaaactagggctaaggcaattctaccggcccgccgactcctgcatcatcataaatatatatactctataactatactactacgtacctaccgatatgcacccgagcaatgtgaatgcgtcgagtactatctgttttctgcatctacatatatataccggatcaacaatcgcccaatgtgaatgtaataagcaatatcattttctaccacttttcattcctaa

SEQ ID NO: 290 - protein, 653 aa, Zea mays
  misc_feature: PFam Name: Pro_CA; PFam Description: Carbonic anhydrase
  misc_feature: PFam Name: Pyr_redox_2; PFam Description: Pyridine
  misc_feature: PFam Name: Atrophin-1; PFam Description: Atrophin-1 family
  misc_feature: PFam Name: MAGE; PFam Description: MAGE family
  misc_feature: GI Number: 34911604; NR Description: carbonic anhydrase [Oryza sativa (japonica cultivar-group)] >gi|3345477|dbj|BAA31953.1| carbonic anhydrase [Oryza sativa] >gi|15290096|dbj|BAB63789.1| carbonic anhydrase [Oryza sativa
  misc_feature: GI Number: 729003; NR Description: CARBONIC ANHYDRASE, CHLOROPLAST PRECURSOR (CARBONATE DEHYDRATASE) >gi|7436817|pir||T04478 probable carbonate dehydratase (EC 4.2.1.1)
  misc_feature: GI Number: 882246; NR Description: carbonic anhydrase 2
  misc_feature: GI Number: 882248; NR Description: carbonic anhydrase 1
  misc_feature: GI Number: 27652186; NR Description: carbonic anhydrase 3
MYTLPVRATTSSIVPACHPRAVLLLRLRPPGSGSSGTPRLRRPATVVGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFTFVEDWVRIGSPAKNKVKKEHASVPFDDQCSILEKEAVNVSLQNLKSYPFVKEGLAGGTLKLVGAHYSFVKGQFVTWEPPQDAIERLTSGFQQFKVNVYDKKPELFGPLKSGQAPKYMVFACSDSRVCPSVTLGLQPAKAFTVRNIAAMVPGYDKTKYTGIGSAIEYAVCALKVEVLVVIGHSCCGGIRALLSLKDGAPDNFHFVEDWVRIGSPAKNKVKKEHASVPFDDQCSILEKEAVNVSLQNLKSYPLVKEGLAGGTSSGWPHYDFVKGQFVTWEPPQDAIERLTSGFQQFKVNVYDKKPELFGPLKSGQAPKYMVFACSDSRVSPSVTLGLQPGEAFTVRNIAAMVPGYDKTKYTGIGSAIEYAVCALKVEVLVVIGHSCCGGIRALLSLQDGAPDTFHFVEDWVKIAFIAKMKVKKEHASVPFDDQWSILEKEAVNVSLENLKTYPFVKEGLANGTLKLIGAHYDFVSGEFLTWKK

SEQ ID NO: 291 - DNA, 1878 bp, Zea mays
  misc_feature (1)..(1878): Ceres cDNA ID no. 11050193
gctaacacaagcaagcaagcaagtcactgagtagctagcagtatataccaccataaaaacaacacacacacacgtgcgctaataactaagcttaaggtagctcctctctatctccggctagctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaagaacgacggagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtcgtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccacttccgcaaggcgcggaagctggtcaccgtgcacctgctcaacgccagcaaggtgcggtcgcagcggcccgcgcgggaggaggaggtgcgcggcgcgctcgacagggtgcgccgcgccgccgccgcgcgggagcccgtcgacatgagcgagctcctgcactccttcgtcaacaacctcgtctgccgcgccgtctccggcaagttctccatggaggaaggccgcaacaggctgttccgggagctcaccgacatcaacgcgggcctcctcggagggttccacatccaggactacttccctaggctgggccggatcgagctcgtcaggaaggtggcgtgcgccaagaccaggagagtcaggaagcgctgggacgacctcctcgacaagctcatcgacgaccatgcggccaggatggcaacccatcaggacgaggacgacgataaggacttcatatacgtattgctgtctcttcagaaggagtatggcctcaccagagaccatatcaaggctatcttgatagacatgttcgaggccggaaccgacacctcgtacatgacgttggagttcgccatgacggagctcatacggaagccacacctgatgaagaagctgcaggaagaagtgcggcggaacgtgccggcggggcaggagatggtcaccgaggacaacctccccggcatgaccgacctcaaggccgtcatcaaggagacgctccgcctgcacccgccggtgccgctcctcctcccgcactactccctggacgcctgcgaggtcgccggctacaccatcccggccaacacccgcgtcgtcgtcaacgcctgggcgctcggccgccacagcggctactgggagcgcgagaacgagttcgtcccggagaggttcctcagcggggacgtggccggcggcgtcgacctcaagcccaacgagttccagttcctggcgttcgggtccgggcggaggatgtgccctggggtccactcggcgtccgcgaccatcgaggcgatgctgtccaacctcatgtaccggttcgactggcagctgccggcggggatgaaggcggaggacgtggacatgaccgaggtgtttgggatcacggtctcgaggaaggagaagctgctcctagtcccacaggctgcgtgatgatgatgatgatactagtgcaatgcaatagggttttaaattagtaacaccaaaggctgtgttactggaccttaattaataattaataaatgtgctactactatatagccaggcttcacg

SEQ ID NO: 292 - protein, 538 aa, Zea mays
  misc_feature: PFam Name: p450; PFam Description: Cytochrome P450
  misc_feature: GI Number: 19909892; NR Description: P450 [Triticum aestivum]
  misc_feature: GI Number: 19909894; NR Description: P450 [Triticum aestivum]
  misc_feature: GI Number: 45685727; NR Description: P450 [Triticum aestivum]
  misc_feature: GI Number: 62148964; NR Description: P450 [Triticum aestivum]
  misc_feature: GI Number: 62148970; NR Description: P450 [Triticum aestivum]
  misc_feature: Phenotype: Useful for delaying flowering time
  misc_feature: Phenotype: Useful for increasing chlorophyll and
  misc_feature: Phenotype: Useful for increasing increasing anthocyanin content
  misc_feature: Phenotype: Useful for making ornamental plants with modified
  misc_feature: Phenotype: Useful for making plants with altered leaf shape
MAAQLHHALYELLHEAAAAQRALLLAIPFSLLLLPLLLRYLAASASASATKNDGAAPASDPDKLLSLLPSPPMKLPIIGHLHLMGDIPYVSLAALATRYGPDLMLLRLGAVPTVVVSSPRVAEAVLRTYDHVFSSRPRSLVSDIIMYGATDSCFAPYGDHFRKARKLVTVHLLNASKVRSQRPAREEEVRGALDRVRRAAAAREPVDMSELLHSFVNNLVCRAVSGKFSMEEGRNRLFRELTDINAGLLGGFHIQDYFPRLGRIELVRKVACAKTRRVRKRWDDLLDKLIDDHAARMATHQDEDDDKDFIYVLLSLQKEYGLTRDHIKAILIDMFEAGTDTSYMTLEFAMTELIRKPHLMKKLQEEVRRNVPAGQEMVTEDNLPGMTDLKAVIKETLRLHPPVPLLLPHYSLDACEVAGYTIPANTRVVVNAWALGRHSGYWERENEFVPERFLSGDVAGGVDLKPNEFQFLAFGSGRRMCPGVHSASATIEAMLSNLMYRFDWQLPAGMKAEDVDMTEVFGITVSRKEKLLLVPQAA

SEQ ID NO: 293 - DNA, 3299 bp, Zea mays
  misc_feature (1)..(3299): Ceres cDNA ID no. 11050389
  misc_feature (1)..(3299): Ceres CLONE  ID no. 1570991
ttcggcacgaggatcgatctcacttagctgctgctgctgctgcttgctggtggcctgggcctggctgctgtgtctgtatcgatgtgtccgtattttctccatctcgtctgcatacgctgcaattggtaaggagctagctggcctttcatgtcttccatgctgccatagccatacgcccggccggaaggcaggataccccatcgctcgctgcacatgcatgtatgccgcatggggatacatgttcatcatcagcagcacagtggctctgtatcccccatcccaatccgatcctatataggaggaggagaaggaggagcagcagcagcagccaggcgcggccggcggccggagtagtatccgaatccgctcaacacccacaccggtgcgggtggtctctagctttcccatcgatcaatggctttcaaaggactcccgcgtgattcccgagggtccctcgaagtcttcaatccagacgcccctgtttcagatcgtgcaaccacctccccgttcctcctccctcctgcggtcgcgtcccatcccagcctcctcgccgccggagatggcggcgatgctgacgtgggtcgggcgacacagagggccgccgagtggggcctcgtcctccagaccgacgagcacaccggccgcccccagggtgtcgtcgcccgtccctccggttccaaccgcaccagcgagagtggcaactccatcgacgagagggccgccgccgccggtgctggtagagctctcccccgggtgtcggaggagcttcgcgccgcgctctcagcgttccagcagaccttcgtcgtgtccgatgccacccgccctgaccaccccatcctctacgccagcgctggattcttcaacatgacgggctactcctccaatgaggtcgtcggaaggaactgccgcttccttcaaggttctgggaccgaccccgtagagatttccaagatcagacaggctctcgcagctgggtcaaattactgtggccgtatcctcaactacaagaaggatggcacaccattctggaacctcctaaccgttgcccccataaaggatgaggatggcagggtcctcaagttcattgggatgcaagtggaagtaagtaagtacacggaaggtaacaaagatactgctcttcgtccaaatggattgccagagtcactcatcaaatatgatgcaaggcagaaggatcatgctcgtagctcagtctcggagctcctacttgccctgaaggatccacggtcattgtcagaatcaagaaacaataccttaaaaaggaaatcacaggaatcagcaggttcagctctagttcccggcaagagaagctccgaaactggatcccgtcgtaactcacatagtggaatgagaaactctctacaaaaaatcagtgaggtgcctgaaggagggaataagaccaggaaatctggtttgcgttcttttatgggccttattggtatgggacatgggaatgtagagaagaacattctaaaaccaagggaagatcccctacttgatagcgatgatgagagaccagatagcttcgatgacgatttcaggaagaaagaaatgagaaagggcatagatttggctaccacacttgaacgtattgaaaagaattttgtcatcaccgacccgaggttaccagataatccaattatatttgcatcggatagctttttgcgtttgacagagtattgccgcgaagaaatattgggaagaaactgcaggtttcttcaaggacctgaaactgaccgtgggacagtaaagaagataagagatgccatagataaccaaacagaagttactgttcagctgataaattatacaaagagcggtaagaaattctggaacctctttcacttgcagcctatgcgtgatcagaagggtgatgttcaatacttcattggggttcaattggatggaactgagcgtgttcgagaggctgctgcaaaagatggtgccatactggttaagaaaactgcagacaatattgatgaggctgcaaaggagcttccggatgctaatttgagacctgaggatctatgggctaatcactcaaaaccagtcttgccaaagccacatatgaaggatactgcatcgtggagagccatccaaaaggttcttgagaacggtgaaagcattgatttgaaacatttcagaccagtaaggcctttaggatctggtgatactggcagtgtccacttggtggagttgcttggcacaggtgaatactttgccatgaaagctatggataaaagtgtcatgcttaaccgaaacaaggtccatagagctaccgctgaacgacaaatccttgatatgttggaccacccattccttccgacattgtatgcatcatttcagacaaagacacatatatgtcttattgttgactattgtgctggtggggaactctttatgctccttgataggcaacctatgaaggttctgaaggaggatgcggtcaggttctatgctgcagaagtggtcacagcacttgaatacctacattgccaaggtataatctacagagacttaaagccagagaacattttacttcatagagatgggcacatttcattgacagactttgatttgtcttgcttgacatcctgccgaccacaagtgtttcttccacacgatattgataagaagaaaaagaggaggaagagcaggagtaatcccatattttttgctgaaccaatgcgagcatcaaattcttttgttggtacagaggagtacattgcaccggagattattaccggagctggccatacgagtgctgtagattggtgggcgctaggaattcttctatatgagatgttatatggttatacacccttcagagggaaaacaagacaaaggacatttgctaatattctgcacaaggatatcagatttcctgcgagcatacaggtgagcctggcggcaaggcagctgatataccggttgctacaccgagaccctgcaaataggctaggttcctatgagggcgctatggagatcaaacaacaccccttctttcgtggcataaactgggctctagttcgtgccgccacgcccccagagctggaggctcccctccaggatacattggaggccacactgcctcctcctgcagctgatgcggctcacaccgatatgttctgatcatacattgatccatgatgctgcatgttaatttgcttaaaggaagaaaaaaatattagatgatgaagatgcgtgactttggcatagatgagaacaataatgtatgttaaggactaattatcttgatccatctatgcatgctcacaatt

SEQ ID NO: 294 - protein, 911 aa, Zea mays
  misc_feature: PFam Name: Pkinase; PFam Description: Protein kinase domain
  misc_feature: PFam Name: PAS; PFam Description: PAS fold
  misc_feature: GI Number: 19570333; NR Description: PHY3 [Adiantum
  misc_feature: GI Number: 7522091; NR Description: PHY3 protein - maidenhair fern
  misc_feature: GI Number: 30697015; NR Description: non phototropic
  misc_feature: GI Number: 6688928; NR Description: non-phototropic hypocotyl
  misc_feature: GI Number: 6006312; NR Description: nonphototrophic hypocotyl
MAFKGLPRDSRGSLEVFNPDAPVSDRATTSPFLLPPAVASHPSLLAAGDGGDADVGRATQRAAEWGLVLQTDEHTGRPQGVVARPSGSNRTSESGNSIDERAAAAGAGRALPRVSEELRAALSAFQQTFVVSDATRPDHPILYASAGFFNMTGYSSNEVVGRNCRFLQGSGTDPVEISKIRQALAAGSNYCGRILNYKKDGTPFWNLLTVAPIKDEDGRVLKFIGMQVEVSKYTEGNKDTALRPNGLPESLIKYDARQKDHARSSVSELLLALKDPRSLSESRNNTLKRKSQESAGSALVPGKRSSETGSRRNSHSGMRNSLQKISEVPEGGNKTRKSGLRSFMGLIGMGHGNVEKNILKPREDPLLDSDDERPDSFDDDFRKKEMRKGIDLATTLERIEKNFVITDPRLPDNPIIFASDSFLRLTEYCREEILGRNCRFLQGPETDRGTVKKIRDAIDNQTEVTVQLINYTKSGKKFWNLFHLQPMRDQKGDVQYFIGVQLDGTERVREAAAKDGAILVKKTADNIDEAAKELPDANLRPEDLWANHSKPVLPKPHMKDTASWRAIQKVLENGESIDLKHFRPVRPLGSGDTGSVHLVELLGTGEYFAMKAMDKSVMLNRNKVHRATAERQILDMLDHPFLPTLYASFQTKTHICLIVDYCAGGELFMLLDRQPMKVLKEDAVRFYAAEVVTALEYLHCQGIIYRDLKPENILLHRDGHISLTDFDLSCLTSCRPQVFLPHDIDKKKKRRKSRSNPIFFAEPMRASNSFVGTEEYIAPEIITGAGHTSAVDWWALGILLYEMLYGYTPFRGKTRQRTFANILHKDIRFPASIQVSLAARQLIYRLLHRDPANRLGSYEGAMEIKQHPFFRGINWALVRAATPPELEAPLQDTLEATLPPPAADAAHTDMF

SEQ ID NO: 295 - DNA, 924 bp, Zea mays
  misc_feature (1)..(924): Ceres cDNA ID no. 11050602
gaattccggcttcaaatacttgcataagatggcaggttccgtggcaatcgtgggcatcttcgtcgccctcctcgccgtggccggcgaggcggctgtgttcacggtggtgaaccagtgcccgttcaccgtgtgggccgcgtccgtgccggtgggcggcgggcggcagctgaaccgcggcgagagctggcggatcacggcccccgcgggcacgacggccgcgcgcatctgggcgcgcacggggtgcaagttcgacgcgagcgggcgcgggagctgccgcacgggggactgcggcggcgtgctgcagtgcactgggtacgggcgcgcgcccaacacgctggcggagtacgcgctgaagcagttcaacaacctcgacttcttcgacatctccctcatcgacggcttcaacgtgcccatgagcttcctccccgacggcgggtccgggtgcagccgcggcccgcgctgcgccgtggacgtgaacgcgcgctgccctgccgagctgcggcaggacggcgtgtgcaacaacgcgtgccccgtgttcaagaaggacgagtactgctgcgtcggctcggcggccaacgactgccacccgaccaactactccaggtacttcaaggggcagtgccccgacgcgtacagctaccccaaggatgacgccaccagcaccttcacctgccccgccggaaccaactacaaggtcgtcttctgcccgtgaggccgctgaactagcatcagcgtgcgcgcgtcgaccaagaacaagaaataaacgaccgaggctgtgtatgttgcccgccgtgtgctcaactggagcaaaaataaagccaacaaaacaagcacgtgtgatctctatgtcaccaactctatcaccttaattaatggggcattatgaagttgtttctttacatgctcgtactgaaattgggtttt

SEQ ID NO: 296 - protein, 227 aa, Zea mays
  misc_feature: PFam Name: Thaumatin; PFam Description: Thaumatin family
  misc_feature: PFam Name: Mucin; PFam Description: Mucin-like glycoprotein
  misc_feature: GI Number: 82661; NR Description: 22K antifungal protein - maize
  misc_feature: GI Number: 123978; NR Description: Alpha-amylase/trypsin inhibitor (Antifungal protein) >gi|82672|pir||A29581 alpha-amylase/trypsin inhibitor - maize >gi|225623|prf||1307248A
  misc_feature: GI Number: 14164983; NR Description: thaumatin-like protein
  misc_feature: GI Number: 2062389; NR Description: pathogenesis-related
  misc_feature: GI Number: 7442171; NR Description: thaumatin-like protein - rice
  misc_feature: Utility: Useful for making low fiber seeds with increased
MAGSVAIVGIFVALLAVAGEAAVFTVVNQCPFTVWAASVPVGGGRQLNRGESWRITAPAGTTAARIWARTGCKFDASGRGSCRTGDCGGVLQCTGYGRAPNTLAEYALKQFNNLDFFDISLIDGFNVPMSFLPDGGSGCSRGPRCAVDVNARCPAELRQDGVCNNACPVFKKDEYCCVGSAANDCHPTNYSRYFKGQCPDAYSYPKDDATSTFTCPAGTNYKVVFCP

SEQ ID NO: 297 - DNA, 3781 bp, Zea mays
  misc_feature (1)..(3781): Ceres cDNA ID no. 11398585
  misc_feature (1)..(3781): Ceres CLONE  ID no. 1529665
cacagctcatataccaagagccggagcagcttagcgcagcccagagcggcgccgcgccaagcacaacccccacccgccacagccgcgtgcgcatgtgagcggtcgccgcggccgggagaccagaggaggggaggactacgtgcatttcgctgtgccgccgccgcggggttcgtgcgcgagcgagatccggcggggcggggcggggggcctgagatggaggctagcgcggggctggtggccggctcgcataaccggaacgagctggtggtgatccgccgcgaccgcgagtcgggagccgcgggcggcggcgcggcgcgccgggcggaggcgccgtgccagatatgcggcgacgaggtcggggtgggcttcgacggggagcccttcgtggcgtgcaacgagtgcgccttccccgtctgccgcgcctgctacgagtacgagcgccgcgagggctcgcaagcgtgcccgcagtgcaggacccgctacaagcgcctcaagggctgcccgcgggtggccggcgacgaggaggaggacggcgtcgacgacctggagggcgagttcggcctgcaggacggcgccgcccacgaggacgacccgcagtacgtcgccgagtccatgctcagggcgcagatgagctacggccgcggcggcgacgcgcaccccggcttcagccccgtccccaacgtgccgctcctcaccaacggccagatggttgatgacatcccgccggagcagcacgcgctcgtgccgtcctacatgagcggcggcggcggcgggggcaagaggatccacccgctccctttcgcagatcccaaccttccagtgcaaccgagatccatggacccgtccaaggatctggccgcctacggatatggcagcgtggcctggaaggagagaatggagggctggaagcagaagcaggagcgcctgcagcatgtcaggagcgagggtggcggtgattgggatggcgacgatgcagatctgccactaatggatgaagctaggcagccattgtccagaaaagtccctatatcatcaagccgaattaatccctacaggatgattatcgttatccggttggtggttttgggtttcttcttccactaccgagtgatgcatccggcgaaagatgcatttgcattgtggctcatatctgtaatctgtgaaatctggtttgcgatgtcctggattcttgatcagttcccaaagtggcttccaatcgagagagagacttacctggaccgtttgtcactaaggtttgacaaggaaggtcaaccctctcagcttgctccaatcgacttctttgtcagtacggttgatcccacaaaggaacctcccttggtcacagcgaacactgtcctttccatcctttctgtggattatccggttgagaaggtctcctgctatgtttctgatgatggtgctgcaatgcttacgtttgaagcattgtctgaaacatctgaatttgcaaagaaatgggttcctttcagcaaaaagtttaatatcgagcctcgtgctcctgagtggtacttccaacagaagatagactacctgaaagacaaggttgctgcttcatttgttagggagaggagggcgatgaagagagaatacgaggaattcaaggtaaggatcaatgccttggttgcaaaagcccaaaaggttcctgaggaaggatggacaatgcaagatggaagcccctggcctggaaacaacgtacgcgatcatcctggaatgattcaggtattccttggccaaagtggcggtcgtgatgtggaaggaaatgagttgcctcgcctggtttatgtctcgagagaaaagaggccaggttataaccatcacaagaaggctggtgccatgaatgcactggtccgtgtctctgctgtcttatcaaatgctgcatacctattgaacttggactgtgatcactacatcaacaatagcaaggccataaaagaggctatgtgtttcatgatggatcctttggtggggaagaaagtgtgctatgtacagttccctcagaggtttgatggtattgacaaaaatgatcgatacgctaacaggaacgttgtcttttttgacatcaacatgaaaggtttggacggtattcaaggacccatttatgtgggtactggatgtgttttcagacggcaggcactgtatggttatgatgctcctaaaacgaagaagccaccatcaagaacttgcaactgctggcccaagtggtgcctctcttgctgctgcagcaggaacaagaataaaaagaagactacaaaaccaaagacggagaagaagaaaagattatttttcaagaaagcagaaaacccatctcctgcatatgctttgggtgaaattgatgaaggtgctccaggtgctgatatcgagaaggccggaatcgtaaatcaacagaaactagagaagaaatttgggcagtcttctgtttttgtcgcatcaacacttcttgagaacggagggaccctgaagagcgcaagtccagcttctcttctgaaggaagctatacatgttatcagctgcggctacgaagacaagaccgactggggaaaagagattggctggatttacggatcgatcacagaggatatcttgactggatttaagatgcactgccatggctggcggtctatttactgcatcccgaagcggcctgcattcaaaggttctgcgcctctgaacctttccgaccgtcttcaccaggtccttcgctgggcccttgggtccgtcgaaattttcttcagcaagcactgcccactttggtacggatacggcggcgggctaaaattcctggaaaggttttcttatatcaactccatcgtttatccctggacgtccattcctctcctggcttactgtaccttgcctgccatctgcctgctcacggggaagtttatcacaccagagcttaccaatgtcgccagtatctggttcatggcacttttcatctgcatctccgtgaccggcatcctggaaatgaggtggagtggcgtggccatcgacgactggtggaggaacgagcagttctgggtcatcggaggcgtttcggcgcatctgttcgcggtgttccagggcctgctgaaggtgttcgccggcatcgacacgagcttcaccgtgacgtcgaaggccggggacgacgaggagttctcggagctgtacacgttcaagtggaccaccctgctgatacccccgaccacgctcctcctgctgaacttcatcggggtggtggccgggatctcgaacgcgatcaacaacgggtacgagtcgtggggccccctgttcgggaagctcttcttcgccttctgggtgatcgtccacctgtacccgttcctcaagggtctggtggggaggcagaacaggacgccgacgatcgtcatcgtctggtccatcctgctggcctcgatcttctcgctcctgtgggtccgcgtcgacccgttcctcgccaagagcaacggcccgctcctggaggagtgtggcctggactgcaactgaagtgggggccccctgtcactcgaagttctgtcacgggcgaattacgcctgattttttgttgttgttgttgttggaattctttgctgtagatagaaaccacatgtccacggcatctctgctgtgtccattggagcaggagagaggtgcctgctgctgtttgttgagtaaattaaaagttttaaagttatacagtgatgcacattccagtgcccagtgtattccctttttacagtctgtatattagcgacaaaggacatattggttaggagtttgattcttttgt

SEQ ID NO: 298 - protein, 1094 aa, Zea mays
  misc_feature: PFam Name: Cellulose_synt; PFam Description: Cellulose synthase
  misc_feature: PFam Name: Glycos_transf_2; PFam Description: Glycosyl transferase
  misc_feature: GI Number: 66269692; NR Description: cellulose synthase
  misc_feature: GI Number: 13925884; NR Description: cellulose synthase
  misc_feature: GI Number: 50919973; NR Description: cellulose synthase [Oryza sativa (japonica cultivar-group)] >gi|28376710|gb|AAO41140.1| cellulose synthase [Oryza sativa
  misc_feature: GI Number: 38532102; NR Description: cellulose synthase
  misc_feature: GI Number: 62321559; NR Description: cellulose synthase
MEASAGLVAGSHNRNELVVIRRDRESGAAGGGAARRAEAPCQICGDEVGVGFDGEPFVACNECAFPVCRACYEYERREGSQACPQCRTRYKRLKGCPRVAGDEEEDGVDDLEGEFGLQDGAAHEDDPQYVAESMLRAQMSYGRGGDAHPGFSPVPNVPLLTNGQMVDDIPPEQHALVPSYMSGGGGGGKRIHPLPFADPNLPVQPRSMDPSKDLAAYGYGSVAWKERMEGWKQKQERLQHVRSEGGGDWDGDDADLPLMDEARQPLSRKVPISSSRINPYRMIIVIRLVVLGFFFHYRVMHPAKDAFALWLISVICEIWFAMSWILDQFPKWLPIERETYLDRLSLRFDKEGQPSQLAPIDFFVSTVDPTKEPPLVTANTVLSILSVDYPVEKVSCYVSDDGAAMLTFEALSETSEFAKKWVPFSKKFNIEPRAPEWYFQQKIDYLKDKVAASFVRERRAMKREYEEFKVRINALVAKAQKVPEEGWTMQDGSPWPGNNVRDHPGMIQVFLGQSGGRDVEGNELPRLVYVSREKRPGYNHHKKAGAMNALVRVSAVLSNAAYLLNLDCDHYINNSKAIKEAMCFMMDPLVGKKVCYVQFPQRFDGIDKNDRYANRNVVFFDINMKGLDGIQGPIYVGTGCVFRRQALYGYDAPKTKKPPSRTCNCWPKWCLSCCCSRNKNKKKTTKPKTEKKKRLFFKKAENPSPAYALGEIDEGAPGADIEKAGIVNQQKLEKKFGQSSVFVASTLLENGGTLKSASPASLLKEAIHVISCGYEDKTDWGKEIGWIYGSITEDILTGFKMHCHGWRSIYCIPKRPAFKGSAPLNLSDRLHQVLRWALGSVEIFFSKHCPLWYGYGGGLKFLERFSYINSIVYPWTSIPLLAYCTLPAICLLTGKFITPELTNVASIWFMALFICISVTGILEMRWSGVAIDDWWRNEQFWVIGGVSAHLFAVFQGLLKVFAGIDTSFTVTSKAGDDEEFSELYTFKWTTLLIPPTTLLLLNFIGVVAGISNAINNGYESWGPLFGKLFFAFWVIVHLYPFLKGLVGRQNRTPTIVIVWSILLASIFSLLWVRVDPFLAKSNGPLLEECGLDCN

SEQ ID NO: 299 - DNA, 685 bp, Arabidopsis thaliana
  misc_feature (1)..(685): Ceres cDNA ID no. 11407659
  misc_feature (1)..(685): Ceres CLONE  ID no. 1334920
aaaaaaaaaagaagcttcaacggcctttgagtagttgtttctgcgccgcgctgtctctctaaaacagcctgtgttaaggttggatgatagaagacattttttgaccttctcttacaatgactacacgaagaaatggcgtttccaggcatcagcggtttgagagttttcgcggtgaaggaccaaattggatcttaattgctgggggtgctttgttgagtacattgtccattcgttttggctacaaattaaagcagtctattgactccaaacctcctcattccaatgccactggtggattaaaacctaatggaacaaccgacagaggaagatttaagggctgctgcttgcattctaatgcatcaccctgtgaaaggaataatgattgttgctttcactgcactcccggaactgagaatggggaaggaaatcatgctacaaatgagcaaatggcagagtccagtacttctctgcctcttgtgacagttcctgcttcatcatatagcaaagagagtgcagtcgtatggggatcttctcctgaccacctggaagtgccgatgaaagcataccatcaacattcgacctgctcagattctccttgcgtatctgaatccggctcagacatcttcagcaagcgagaagtaatacagaaactgaggcaacagctgaagagacgtgacgacatgat

SEQ ID NO: 300 - protein, 189 aa, Arabidopsis thaliana
  misc_feature: GI Number: 21536672; NR Description: unknown [Arabidopsis thaliana]
MTTRRNGVSRHQRFESFRGEGPNWILIAGGALLSTLSIRFGYKLKQSIDSKPPHSNATGGLKPNGTTDRGRFKGCCLHSNASPCERNNDCCFHCTPGTENGEGNHATNEQMAESSTSLPLVTVPASSYSKESAVVWGSSPDHLEVPMKAYHQHSTCSDSPCVSESGSDIFSKREVIQKLRQQLKRRDDM

SEQ ID NO: 301 - DNA, 480 bp, Arabidopsis thaliana
  misc_feature (1)..(480): Ceres cDNA ID no. 11435800
  misc_feature (1)..(480): Ceres CLONE  ID no. 1014077
aaaaacaagaatctttatggaagaagacgggtctgattggggcggattggctccagaaatactcatcaacatcatctcaaggcttacgattcaggagctatggaccggtccgatgttcgtccaaagatcgtggctaactgtttgcagagatccgtatctctggtctatcttcgatctggagccatggttcgattcctatcccgagtcgactcacttgtggtcccctgagttcgagcagaaggtagactcaatgctacgatcagtcgttgattggagcgaaggtggtctcactgagatccgcgtccgccattgcagcgaccacgctctctcttacgcagccgataggttcttgccattagaagcagtcctaacgtgacagacgcatcgatgacgaagatagcgtttcggtgcaggagtttaaaggaacttgatatcagttactgtcacgagatatctcacgacactcttgtgatgattggt

SEQ ID NO: 302 - protein, 119 aa, Arabidopsis thaliana
  misc_feature: PFam Name: F-box; PFam Description: F-box domain
  misc_feature: PFam Name: LRR_1; PFam Description: Leucine Rich Repeat
  misc_feature: GI Number: 18412949; NR Description: F-box protein family,
MEEDGSDWGGLAPEILINIISRLTIQELWTGPMFVQRSWLTVCRDPYLWSIFDLEPWFDSYPESTHLWSPEFEQKVDSMLRSVVDWSEGGLTEIRVRHCSDHALSYAADRFLPLEAVLT

SEQ ID NO: 303 - DNA, 1337 bp, Arabidopsis thaliana
  misc_feature (1)..(1337): Ceres cDNA ID no. 12321402
  misc_feature (1)..(1337): Ceres CLONE  ID no. 19570
  misc_feature (1)..(1337): Also known as  Ceres CDNA ID no. 23356929
agttcaaacaattcttcgtcctattaaatacaaaaaataaaaatccttaaaaatatatccttatcttcaaccaagaatgggagaggtccaagaaggtcccaaagttgaacaagagaagaagccggctgccaccgtagtcccagttgagactactgacggcaagccaaagagcggcggaggagattccgcggcagcagcagcaccaccggtcgccgcggttgtctctgcctttgtttacaaagtggatatgcactgtgaaggctgcgctaagaagataaagcgaatggttaagcactttgatggagtgaaagatgtgacggcggatactggtggaaataagcttttggtggtcggaaagattgatccagtgaaactccaggagaagttggaggagaaaaccaagagaaaggtggttctcgcgaatccaccgccaaaggtagagggacctgttgctgccgccgttggagagaagaaagccgatggtggagataaggaggcggctcctcctgctcctgctccggcgactccaaaagagagcgtggtgcctttaaagatcagactacattgcgaaggatgtattcagaaaatcaagaaaataatattgaaaatcaaaggagtcgaaacagtggctattgacggagctaaagacgtggtgacggttaaaggaacgatagacgttaaagaacttgtgcctctactcactaagaagctcaaaagaaccgtcgagcctcttgttcccgccaaaaaagatgacggagccgccgagataagaagaacggaacgtgccgctcctgacgcaaagaaagaggctccgtccgccggagttaacgaagcaaagaaggaaggaagtgacggtggagagaagaaaaaagaggttggagacggcggagagaagaagaaagaaggtggtgacggcggagagaaaaagaaagaagccggagacggaggagagaagaagaaagatggcggaggtgtgccggccccggtggcgatggtgaataagatggattattatgggtactcagcttatccaacggctcctatgcattggcaagaaggacacgtgtacggtcagagttattcgatgacaggtcagaattatccagtgggaggtcagagttatccaggttcaggatacaactacgcaagtgagagttacgtgccgtacgcgcagccaaacgtgaacgctcctggaatgttcagcgacgagaatcccaatggttgctctgttatgtaataatgcgttaactgtaaatataagaaactataaggttaaaacataattgtgggaacacaaaacttatgttaaaattttgaaagtctactttgagtcagcg

SEQ ID NO: 304 - protein, 1337 aa, Arabidopsis thaliana
  misc_feature: PFam Name: HMA; PFam Description: Heavy-metal-associated domain
  misc_feature: PFam Name: TT_ORF1; PFam Description: TT viral orf 1
  misc_feature: GI Number: 25408515; NR Description: probable farnesylated
  misc_feature: GI Number: 20197942; NR Description: putative farnesylated protein [Arabidopsis thaliana] >gi|18404283|ref|NP_565855.1| heavy-metal-associated domain-containing protein [Arabidopsis
  misc_feature: GI Number: 4097545; NR Description: ATFP2 [Arabidopsis thaliana]
  misc_feature: GI Number: 21591780; NR Description: cadmium induced protein CdI19 [Arabidopsis thaliana] >gi|21655291|gb|AAM65357.1| At5g03380/C160EPL23M [Arabidopsis thaliana] >gi|7378619|emb|CAB83295.1| farnesylated protein-like
  misc_feature: GI Number: 4097547; NR Description: ATFP3 [Arabidopsis thaliana]
AGTTCAAACAATTCTTCGTCCTATTAAATACAAAAAATAAAAATCCTTAAAAATATATCCTTATCTTCAACCAAGAATGGGAGAGGTCCAAGAAGGTCCCAAAGTTGAACAAGAGAAGAAGCCGGCTGCCACCGTAGTCCCAGTTGAGACTACTGACGGCAAGCCAAAGAGCGGCGGAGGAGATTCCGCGGCAGCAGCAGCACCACCGGTCGCCGCGGTTGTCTCTGCCTTTGTTTACAAAGTGGATATGCACTGTGAAGGCTGCGCTAAGAAGATAAAGCGAATGGTTAAGCACTTTGATGGAGTGAAAGATGTGACGGCGGATACTGGTGGAAATAAGCTTTTGGTGGTCGGAAAGATTGATCCAGTGAAACTCCAGGAGAAGTTGGAGGAGAAAACCAAGAGAAAGGTGGTTCTCGCGAATCCACCGCCAAAGGTAGAGGGACCTGTTGCTGCCGCCGTTGGAGAGAAGAAAGCCGATGGTGGAGATAAGGAGGCGGCTCCTCCTGCTCCTGCTCCGGCGACTCCAAAAGAGAGCGTGGTGCCTTTAAAGATCAGACTACATTGCGAAGGATGTATTCAGAAAATCAAGAAAATAATATTGAAAATCAAAGGAGTCGAAACAGTGGCTATTGACGGAGCTAAAGACGTGGTGACGGTTAAAGGAACGATAGACGTTAAAGAACTTGTGCCTCTACTCACTAAGAAGCTCAAAAGAACCGTCGAGCCTCTTGTTCCCGCCAAAAAAGATGACGGAGCCGCCGAGATAAGAAGAACGGAACGTGCCGCTCCTGACGCAAAGAAAGAGGCTCCGTCCGCCGGAGTTAACGAAGCAAAGAAGGAAGGAAGTGACGGTGGAGAGAAGAAAAAAGAGGTTGGAGACGGCGGAGAGAAGAAGAAAGAAGGTGGTGACGGCGGAGAGAAAAAGAAAGAAGCCGGAGACGGAGGAGAGAAGAAGAAAGATGGCGGAGGTGTGCCGGCCCCGGTGGCGATGGTGAATAAGATGGATTATTATGGGTACTCAGCTTATCCAACGGCTCCTATGCATTGGCAAGAAGGACACGTGTACGGTCAGAGTTATTCGATGACAGGTCAGAATTATCCAGTGGGAGGTCAGAGTTATCCAGGTTCAGGATACAACTACGCAAGTGAGAGTTACGTGCCGTACGCGCAGCCAAACGTGAACGCTCCTGGAATGTTCAGCGACGAGAATCCCAATGGTTGCTCTGTTATGTAATAATGCGTTAACTGTAAATATAAGAAACTATAAGGTTAAAACATAATTGTGGGAACACAAAACTTATGTTAAAATTTTGAAAGTCTACTTTGAGTCAGCG

SEQ ID NO: 305 - DNA, 1317 bp, Arabidopsis thaliana
  misc_feature (1)..(1317): Ceres cDNA ID no. 12322014
  misc_feature (1)..(1317): Ceres CLONE  ID no. 40827
  misc_feature (1)..(1317): Also known as  Ceres CDNA ID no. 23357496
aaacaaatttcaagttctttaaacgatttccttttcaagaaaaatccttctccttcttctttttaccacatagatcttcttgatctacaatggattctgtttctctttctgaggttactgtcattaaaggaacaacacatttgggttttatgcacagtttcagacagccattttgtggtgtcaaaatatctccaaagttctatttatccaaagttgatggaccaaaggcaatatcttcgagcagcaacacaaagagtcaatttgtttatggaggaggaagcatagctgcaacttcagattcaggttataagatgaatggagtaaacctaaaaagcagaacattgatgagttctgcagttaaagaaagatcattacttgatgcttatgatgatgagtatggtggagtaatagtagatcatggaaaattaccatcaaacccttatgctttcgcttctatgcttcgagcttctctatccgattggagaagaaagggaaagaaaggagtttggttaaagttacctgtggaacaatcagaattagtcccaatagctataaaggaaggttttgagtatcatcatgcagagaaaggatatgtaatgttaacatattggataccagaggaggaacctagtatgcttcctgcaaatgcttcacatcaagttggtgttggaggttttgtattaaatcaacataaagaggtgcttgtggtacaagaaaagtattctgctccttcgattactggtctatggaagttaccaacagggtttattaatgaatctgaagagattttctctggtgctgtaagagaagtcaaggaagaaactggggtagatacagagttctcagaggttatagctttcagacatgctcacaacgttgcatttgagaaatctgatctgttcttcatctgtatgttgagaccactctctgataagataatcatcgatgctcttgagatcaaagccgcaaagtggatgccattggctgaatttgtggagcaaccgatgataagaggagacaaaatgtttaaaagagtgattgaaatatgcgaggcgagattaagccatcggtactgcggtctttctcctcatcgacttgtctctacttttgatggcaaaccttcttctctctattacaacgttgttgatgatgatcatgatccttcccactccaattgtagcactgagttttatagatagacgggtaaaacagaaccaaatcaagtggttcgattctgtatatacttattctcatgtaatgtatgttgttatttgatactctctcttcagtatagtaaatagtaatagatcctctgcc

SEQ ID NO: 306 - protein, 1317 aa, Arabidopsis thaliana
  misc_feature: PFam Name: NUDIX; PFam Description: NUDIX domain
  misc_feature: GI Number: 23308325; NR Description: At5g47240/MQL5_10 [Arabidopsis thaliana] >gi|21928133|gb|AAM78094.1|
  misc_feature: GI Number: 18422772; NR Description: MutT/nudix family
  misc_feature: GI Number: 8809607; NR Description: mutT domain protein-like
  misc_feature: GI Number: 21593371; NR Description: mutT domain protein-like
  misc_feature: GI Number: 61656669; NR Description: OSJNBa0065H10.6 [Oryza
AAACAAATTTCAAGTTCTTTAAACGATTTCCTTTTCAAGAAAAATCCTTCTCCTTCTTCTTTTTACCACATAGATCTTCTTGATCTACAATGGATTCTGTTTCTCTTTCTGAGGTTACTGTCATTAAAGGAACAACACATTTGGGTTTTATGCACAGTTTCAGACAGCCATTTTGTGGTGTCAAAATATCTCCAAAGTTCTATTTATCCAAAGTTGATGGACCAAAGGCAATATCTTCGAGCAGCAACACAAAGAGTCAATTTGTTTATGGAGGAGGAAGCATAGCTGCAACTTCAGATTCAGGTTATAAGATGAATGGAGTAAACCTAAAAAGCAGAACATTGATGAGTTCTGCAGTTAAAGAAAGATCATTACTTGATGCTTATGATGATGAGTATGGTGGAGTAATAGTAGATCATGGAAAATTACCATCAAACCCTTATGCTTTCGCTTCTATGCTTCGAGCTTCTCTATCCGATTGGAGAAGAAAGGGAAAGAAAGGAGTTTGGTTAAAGTTACCTGTGGAACAATCAGAATTAGTCCCAATAGCTATAAAGGAAGGTTTTGAGTATCATCATGCAGAGAAAGGATATGTAATGTTAACATATTGGATACCAGAGGAGGAACCTAGTATGCTTCCTGCAAATGCTTCACATCAAGTTGGTGTTGGAGGTTTTGTATTAAATCAACATAAAGAGGTGCTTGTGGTACAAGAAAAGTATTCTGCTCCTTCGATTACTGGTCTATGGAAGTTACCAACAGGGTTTATTAATGAATCTGAAGAGATTTTCTCTGGTGCTGTAAGAGAAGTCAAGGAAGAAACTGGGGTAGATACAGAGTTCTCAGAGGTTATAGCTTTCAGACATGCTCACAACGTTGCATTTGAGAAATCTGATCTGTTCTTCATCTGTATGTTGAGACCACTCTCTGATAAGATAATCATCGATGCTCTTGAGATCAAAGCCGCAAAGTGGATGCCATTGGCTGAATTTGTGGAGCAACCGATGATAAGAGGAGACAAAATGTTTAAAAGAGTGATTGAAATATGCGAGGCGAGATTAAGCCATCGGTACTGCGGTCTTTCTCCTCATCGACTTGTCTCTACTTTTGATGGCAAACCTTCTTCTCTCTATTACAACGTTGTTGATGATGATCATGATCCTTCCCACTCCAATTGTAGCACTGAGTTTTATAGATAGACGGGTAAAACAGAACCAAATCAAGTGGTTCGATTCTGTATATACTTATTCTCATGTAATGTATGTTGTTATTTGATACTCTCTCTTCAGTATAGTAAATAGTAATAGATCCTCTGCC

SEQ ID NO: 307 - DNA, 1081 bp, Arabidopsis thaliana
  misc_feature (1)..(1081): Ceres cDNA ID no. 12322213
  misc_feature (1)..(1081): Ceres CLONE  ID no. 40519
  misc_feature (1)..(1081): Also known as  Ceres CDNA ID no. 23357678
attttctaccaatcgtcgtcgtctctcacgcaaattcttcattcgttctgtggaaacacagaaatggagactccatatccgaaactcatcgatccttcaaagactcgaataggatggattggcatcgggataatgggatcggccatggtttctcatattatcgccgcaggctattctgtcacagtttacgctcgcgacctccggaaaacaaaagatctgcaaaccaaaggagctcgcatagccaatagccccaaagaggttagcggagatgagcgacgttgtgttcacgattgttggaaacttcaacgatgtccgatcgttgcttctcggtgacgatggtgtactctctggtcttacgcccggtggagtaacagtggacatgactagtagcaaaccaggattggcgcgtgaaatacacgcagaagcgaggcgtaggaattgttgggcggtggatgcgccggtatcaggtggagacgctggagcacgagaggggacgttagggattttcgccggcggagattcagagattgtggagtggttgtccccggtgatgaagaatatagggactgttacttatatgggagaagcagggagtgggcaaagctgcaagatagggaatcagattgctggtgcgagcaacctggttggacttgctgaagggatagtgttcgctgagaaagcgggtttagatacagtgaaatggctcgaggcggtgaaggatggtgcagctggatcggcggttatgcggctgtttggggagatgatggtgaagagggattatagggcgactggctttgcggagtatatggtgaaagatttgggaatggctgcagaggcggcgatgcctggtgctgctctgagcaagcagttgttcactggaatggtggctaatggagatggcaagttaggtattcaaggcgtcgtctctgttattagaagacttaacggcatatcctgaaaacacttgtgttccaatgatttcacgatcaactaggcaaacttgtcttcgatttggtttaagttgataataagaagaacatcgagtctcaccaatctcaataagaaacaaagggcatttatg

SEQ ID NO: 308 - protein, 1081 aa, Arabidopsis thaliana
  misc_feature: PFam Name: NAD_binding_2; PFam Description: NAD binding
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
ATTTTCTACCAATCGTCGTCGTCTCTCACGCAAATTCTTCATTCGTTCTGTGGAAACACAGAAATGGAGACTCCATATCCGAAACTCATCGATCCTTCAAAGACTCGAATAGGATGGATTGGCATCGGGATAATGGGATCGGCCATGGTTTCTCATATTATCGCCGCAGGCTATTCTGTCACAGTTTACGCTCGCGACCTCCGGAAAACAAAAGATCTGCAAACCAAAGGAGCTCGCATAGCCAATAGCCCCAAAGAGGTTAGCGGAGATGAGCGACGTTGTGTTCACGATTGTTGGAAACTTCAACGATGTCCGATCGTTGCTTCTCGGTGACGATGGTGTACTCTCTGGTCTTACGCCCGGTGGAGTAACAGTGGACATGACTAGTAGCAAACCAGGATTGGCGCGTGAAATACACGCAGAAGCGAGGCGTAGGAATTGTTGGGCGGTGGATGCGCCGGTATCAGGTGGAGACGCTGGAGCACGAGAGGGGACGTTAGGGATTTTCGCCGGCGGAGATTCAGAGATTGTGGAGTGGTTGTCCCCGGTGATGAAGAATATAGGGACTGTTACTTATATGGGAGAAGCAGGGAGTGGGCAAAGCTGCAAGATAGGGAATCAGATTGCTGGTGCGAGCAACCTGGTTGGACTTGCTGAAGGGATAGTGTTCGCTGAGAAAGCGGGTTTAGATACAGTGAAATGGCTCGAGGCGGTGAAGGATGGTGCAGCTGGATCGGCGGTTATGCGGCTGTTTGGGGAGATGATGGTGAAGAGGGATTATAGGGCGACTGGCTTTGCGGAGTATATGGTGAAAGATTTGGGAATGGCTGCAGAGGCGGCGATGCCTGGTGCTGCTCTGAGCAAGCAGTTGTTCACTGGAATGGTGGCTAATGGAGATGGCAAGTTAGGTATTCAAGGCGTCGTCTCTGTTATTAGAAGACTTAACGGCATATCCTGAAAACACTTGTGTTCCAATGATTTCACGATCAACTAGGCAAACTTGTCTTCGATTTGGTTTAAGTTGATAATAAGAAGAACATCGAGTCTCACCAATCTCAATAAGAAACAAAGGGCATTTATG

SEQ ID NO: 309 - DNA, 1142 bp, Arabidopsis thaliana
  misc_feature (1)..(1142): Ceres cDNA ID no. 12322489
  misc_feature (1)..(1142): Ceres CLONE  ID no. 33259
  misc_feature (1)..(1142): Also known as  Ceres CDNA ID no. 12322489
acacacaccaatcttatcataactcaccaaccaatcaactaaccatggattccgagatcgccgtcgactgctctccattgctcaaaatctacaagagtggccgcatcgagcgactcatgggtgaagccaccgtcccaccttcttccgaaccacaaaacggagtcgtttccaaggacgttgtttattctgccgacaacaacctatccgtccgtatttacctcccggagaaagccgccgccgagaccgactcgaaactccctctcctcgtttacttccacggtggaggattcatcattgagacagctttctctccaacttaccacactttcctcacgacgtctgtctctgcgtcgaactgtgtagcggtctctgttgattaccgtcgtgcaccggagcatccgatctccgtcccgttcgatgattcttggacagctctcaaatgggtattcacccatatcactggatctggtcaagatgattggttaaacaaacatgctgacttcagcagagtgttcctctccggagacagtgcaggagcaaacatcgtgcatcacatggcgatgagagctgcgaaagagaaactcagtcctggtttgaacgatacaggaatctctggaatcatcttgcttcatccttacttctggtcgaaaacaccaatcgacgagaaggatacgaaagatgaaacgttgaggatgaagatagaggcgttttggatgatggcaagtcctaatagcaaagatggaacagatgatccgttgctcaacgtggtgcaatcagagtcggtggatttgtctgggttgggttgtggtaaggttttggtaatggtggctgagaaagatgcgttggtgaggcagggttggggttacgcggctaagcttgagaagtctggttggaaaggagaggttgaagtggtggagagtgaaggagaagatcatgtttttcatttgttgaaacctgaatgtgataatgctattgaagtcatgcataaattctcagggtttattaagggagggaactagctttgtgctctctagagatattggaataatttggtactacatattttagttgcgtctctcagtttctgtaatgtttcagtgattggcttttcgcccaaagcaacacaataaaaattgaagacg

SEQ ID NO: 310 - protein, 1142 aa, Arabidopsis thaliana
ACACACACCAATCTTATCATAACTCACCAACCAATCAACTAACCATGGATTCCGAGATCGCCGTCGACTGCTCTCCATTGCTCAAAATCTACAAGAGTGGCCGCATCGAGCGACTCATGGGTGAAGCCACCGTCCCACCTTCTTCCGAACCACAAAACGGAGTCGTTTCCAAGGACGTTGTTTATTCTGCCGACAACAACCTATCCGTCCGTATTTACCTCCCGGAGAAAGCCGCCGCCGAGACCGACTCGAAACTCCCTCTCCTCGTTTACTTCCACGGTGGAGGATTCATCATTGAGACAGCTTTCTCTCCAACTTACCACACTTTCCTCACGACGTCTGTCTCTGCGTCGAACTGTGTAGCGGTCTCTGTTGATTACCGTCGTGCACCGGAGCATCCGATCTCCGTCCCGTTCGATGATTCTTGGACAGCTCTCAAATGGGTATTCACCCATATCACTGGATCTGGTCAAGATGATTGGTTAAACAAACATGCTGACTTCAGCAGAGTGTTCCTCTCCGGAGACAGTGCAGGAGCAAACATCGTGCATCACATGGCGATGAGAGCTGCGAAAGAGAAACTCAGTCCTGGTTTGAACGATACAGGAATCTCTGGAATCATCTTGCTTCATCCTTACTTCTGGTCGAAAACACCAATCGACGAGAAGGATACGAAAGATGAAACGTTGAGGATGAAGATAGAGGCGTTTTGGATGATGGCAAGTCCTAATAGCAAAGATGGAACAGATGATCCGTTGCTCAACGTGGTGCAATCAGAGTCGGTGGATTTGTCTGGGTTGGGTTGTGGTAAGGTTTTGGTAATGGTGGCTGAGAAAGATGCGTTGGTGAGGCAGGGTTGGGGTTACGCGGCTAAGCTTGAGAAGTCTGGTTGGAAAGGAGAGGTTGAAGTGGTGGAGAGTGAAGGAGAAGATCATGTTTTTCATTTGTTGAAACCTGAATGTGATAATGCTATTGAAGTCATGCATAAATTCTCAGGGTTTATTAAGGGAGGGAACTAGCTTTGTGCTCTCTAGAGATATTGGAATAATTTGGTACTACATATTTTAGTTGCGTCTCTCAGTTTCTGTAATGTTTCAGTGATTGGCTTTTCGCCCAAAGCAACACAATAAAAATTGAAGACG

SEQ ID NO: 311 - DNA, 1039 bp, Arabidopsis thaliana
  misc_feature (1)..(1039): Ceres cDNA ID no. 12322765
  misc_feature (1)..(1039): Ceres CLONE  ID no. 27703
  misc_feature (1)..(1039): Also known as  Ceres CDNA ID no. 23358153
aatatgcctaggaagaagaaagagtgtaacaaacaaacaaaaaagttggtgaactactaaacaacactcacaccaaaaagacgacgatggtttcgtttcgcttccctttctcgttttctcagcccccgcgtgccaccacgtcattctccggattctccatttccgctgtcgctgtctccgtcaccgttggcgccgcagccgccggagctgcgatcgcggcgtcccggaatcccagccatccgattctagagtgggccttctcctctcaccgttcgtctctttcaccatggggatctataactctagcagacgaatccgttgtcgaacctaagaccggtttctcgtttcccgcttcaatcggagattcccggcgattactcggcgtcggcctgaggaagaagagcttactgggattgaagaacatcgatgtctacgccttcggcgtgtatgctgattgtgatgatgtgaagaaacttgtgggagacaagtacgcaaatcttccagcttcagagatcaggggaaacaagtcattcatggatgatctcatggaagccgatattaagatgacgataaggctacagattgtctacggcaaactcaacatccgatccgtgcgtaatgctttccaagagtctgttggaaacagactcaagaagttcggtggctcagacaatgacgagttgcttcaaagcttcactagcctcttcaaagatgagtataagattccaagaaactccaccattgatttgacaaaagatccgggccatgtactcagcgttgcaattgaggggaaccatgtcgggagtgtgaagagccatctcttgtgtagatcaatcttagacttgtacattggtgaagaaccgtttgataagaatgcaagagaagattttctagacaatgcagcttctctagccttcgacaactagttcacaacaaaatgttgctttctttctttcttaacggattctctatatatacggcataatgttgaggaatgtatttgaaataaattgcttggggaattgggttttgttagtct

SEQ ID NO: 312 - protein, 1039 aa, Arabidopsis thaliana
  misc_feature: GI Number: 33867695; NR Description: putative chalcone
AATATGCCTAGGAAGAAGAAAGAGTGTAACAAACAAACAAAAAAGTTGGTGAACTACTAAACAACACTCACACCAAAAAGACGACGATGGTTTCGTTTCGCTTCCCTTTCTCGTTTTCTCAGCCCCCGCGTGCCACCACGTCATTCTCCGGATTCTCCATTTCCGCTGTCGCTGTCTCCGTCACCGTTGGCGCCGCAGCCGCCGGAGCTGCGATCGCGGCGTCCCGGAATCCCAGCCATCCGATTCTAGAGTGGGCCTTCTCCTCTCACCGTTCGTCTCTTTCACCATGGGGATCTATAACTCTAGCAGACGAATCCGTTGTCGAACCTAAGACCGGTTTCTCGTTTCCCGCTTCAATCGGAGATTCCCGGCGATTACTCGGCGTCGGCCTGAGGAAGAAGAGCTTACTGGGATTGAAGAACATCGATGTCTACGCCTTCGGCGTGTATGCTGATTGTGATGATGTGAAGAAACTTGTGGGAGACAAGTACGCAAATCTTCCAGCTTCAGAGATCAGGGGAAACAAGTCATTCATGGATGATCTCATGGAAGCCGATATTAAGATGACGATAAGGCTACAGATTGTCTACGGCAAACTCAACATCCGATCCGTGCGTAATGCTTTCCAAGAGTCTGTTGGAAACAGACTCAAGAAGTTCGGTGGCTCAGACAATGACGAGTTGCTTCAAAGCTTCACTAGCCTCTTCAAAGATGAGTATAAGATTCCAAGAAACTCCACCATTGATTTGACAAAAGATCCGGGCCATGTACTCAGCGTTGCAATTGAGGGGAACCATGTCGGGAGTGTGAAGAGCCATCTCTTGTGTAGATCAATCTTAGACTTGTACATTGGTGAAGAACCGTTTGATAAGAATGCAAGAGAAGATTTTCTAGACAATGCAGCTTCTCTAGCCTTCGACAACTAGTTCACAACAAAATGTTGCTTTCTTTCTTTCTTAACGGATTCTCTATATATACGGCATAATGTTGAGGAATGTATTTGAAATAAATTGCTTGGGGAATTGGGTTTTGTTAGTCT

SEQ ID NO: 313 - DNA, 1294 bp, Arabidopsis thaliana
  misc_feature (1)..(1294): Ceres cDNA ID no. 12323541
  misc_feature (1)..(1294): Ceres CLONE  ID no. 37564
  misc_feature (1)..(1294): Also known as  Ceres CDNA ID no. 23358865
atgatcagtcaagaaatacgcgtttaatcgactttttctctctctatatacaattctttcaaaatgatcaaacatagtcataagttccgcaccaatcagtggaaataactaatcaaaactctgtatcatcgttttcaaaacctaattaatggctgtaacaaatcttcctacttgtgatggtttgttcattatcagtcttattgtcatcgtttcttcaatatttgggacatcatctgcgcaactaaacgcaacattttactctgggacttgtcccaacgcctctgccatcgtacgcagcactattcagcaagctcttcaatccgatacaagaatcggagccagcctcatccgccttcattttcatgactgttttgttaatggatgtgatgcatcgatcttgcttgacgacactggaagcatccagagcgagaagaacgctggtccgaatgtaaactcagctagaggattcaacgttgttgataatatcaagactgccctcgaaaacgcttgccctggtgttgtctcttgctctgacgttttagcccttgcctctgaggcttctgtgtctttggcaggagggccatcatggactgtattattaggaagaagagatagtctcacggccaacctcgccggtgcaaattcgtccattccttctcccatcgaaagcctaagcaacatcacatttaaattttcggctgtcgggcttaatacaaacgatctggtagccttatctggtgcgcatacgttcgggcgtgctcgatgtggagtattcaacaacagactatttaacttcagcgggacaggaaatcccgatccaactctaaactcaacgcttctgagcactcttcaacagctatgtcctcaaaacggtagcgcatcaacgatcaccaatcttgatttgagcacaccagatgcgttcgataacaattacttcgccaaccttcagagcaacgatggacttcttcagtcagaccaagagctgttctctaccaccggttcatccaccatcgcgattgttacttcgttcgcaagtaaccagactctgttttttcaggcctttgcacagtccatgatcaatatggggaatattagtcccttgactgggagtaatggagagattaggttagactgtaagaaggttaatggaagttgatttccttaaagctcattttctttgaaaaaacattggcaagctttggttgaataatttttgttatcataatcacatcaaatctgtattgcacttaaatcattctaagcaaatttatgataaatgaaattaaatcaaaac

SEQ ID NO: 314 - protein, 1294 aa, Arabidopsis thaliana
  misc_feature: PFam Name: peroxidase; PFam Description: Peroxidase
  misc_feature: GI Number: 11514092; NR Description: Chain A, Arabidopsis Thaliana Peroxidase A2 At Room Temperature >gi|11513747|pdb|1PA2|A
  misc_feature: GI Number: 1730490; NR Description: Peroxidase A2
  misc_feature: GI Number: 21593262; NR Description: peroxidase [Arabidopsis thaliana] >gi|42494611|gb|AAS17636.1| peroxidase ATPA2 [Arabidopsis
  misc_feature: GI Number: 21594792; NR Description: peroxidase [Arabidopsis thaliana] >gi|42494613|gb|AAS17637.1| peroxidase ATP29a
  misc_feature: GI Number: 20466025; NR Description: putative peroxidase [Arabidopsis thaliana] >gi|15810295|gb|AAL07035.1| putative peroxidase [Arabidopsis thaliana] >gi|9759300|dbj|BAB09806.1| peroxidase [Arabidopsis thaliana] >gi|1491617|emb|CAA68212.1|
ATGATCAGTCAAGAAATACGCGTTTAATCGACTTTTTCTCTCTCTATATACAATTCTTTCAAAATGATCAAACATAGTCATAAGTTCCGCACCAATCAGTGGAAATAACTAATCAAAACTCTGTATCATCGTTTTCAAAACCTAATTAATGGCTGTAACAAATCTTCCTACTTGTGATGGTTTGTTCATTATCAGTCTTATTGTCATCGTTTCTTCAATATTTGGGACATCATCTGCGCAACTAAACGCAACATTTTACTCTGGGACTTGTCCCAACGCCTCTGCCATCGTACGCAGCACTATTCAGCAAGCTCTTCAATCCGATACAAGAATCGGAGCCAGCCTCATCCGCCTTCATTTTCATGACTGTTTTGTTAATGGATGTGATGCATCGATCTTGCTTGACGACACTGGAAGCATCCAGAGCGAGAAGAACGCTGGTCCGAATGTAAACTCAGCTAGAGGATTCAACGTTGTTGATAATATCAAGACTGCCCTCGAAAACGCTTGCCCTGGTGTTGTCTCTTGCTCTGACGTTTTAGCCCTTGCCTCTGAGGCTTCTGTGTCTTTGGCAGGAGGGCCATCATGGACTGTATTATTAGGAAGAAGAGATAGTCTCACGGCCAACCTCGCCGGTGCAAATTCGTCCATTCCTTCTCCCATCGAAAGCCTAAGCAACATCACATTTAAATTTTCGGCTGTCGGGCTTAATACAAACGATCTGGTAGCCTTATCTGGTGCGCATACGTTCGGGCGTGCTCGATGTGGAGTATTCAACAACAGACTATTTAACTTCAGCGGGACAGGAAATCCCGATCCAACTCTAAACTCAACGCTTCTGAGCACTCTTCAACAGCTATGTCCTCAAAACGGTAGCGCATCAACGATCACCAATCTTGATTTGAGCACACCAGATGCGTTCGATAACAATTACTTCGCCAACCTTCAGAGCAACGATGGACTTCTTCAGTCAGACCAAGAGCTGTTCTCTACCACCGGTTCATCCACCATCGCGATTGTTACTTCGTTCGCAAGTAACCAGACTCTGTTTTTTCAGGCCTTTGCACAGTCCATGATCAATATGGGGAATATTAGTCCCTTGACTGGGAGTAATGGAGAGATTAGGTTAGACTGTAAGAAGGTTAATGGAAGTTGATTTCCTTAAAGCTCATTTTCTTTGAAAAAACATTGGCAAGCTTTGGTTGAATAATTTTTGTTATCATAATCACATCAAATCTGTATTGCACTTAAATCATTCTAAGCAAATTTATGATAAATGAAATTAAATCAAAAC

SEQ ID NO: 315 - DNA, 1168 bp, Arabidopsis thaliana
  misc_feature (1)..(1168): Ceres cDNA ID no. 12324442
  misc_feature (1)..(1168): Ceres CLONE  ID no. 41769
  misc_feature (1)..(1168): Also known as  Ceres CDNA ID no. 23359695
aagtcttggaatcttcgggacgtttcttgttgctctctttgactttcttgaagtatttgtttatgttttcccatttctctttgcatctctttgagttcctgttgaatcctaaccttctcattcccgctgatatctcttcccacaatggtccttttggtccgttttcttgatatttcgaatcaagattcgtcctcagctttatcaatgcttctatctccactttcggccaccgcgacgagctcgctgaagctgcaggagtcatattctgatcaccaccattgtccgttttcgttgtgtctaacgtcgacacaaccgcttgaattggctgcggaagcggagcaggaggttgcggtggaggagaccgttgaggcggttgctgctgattgttgttattaagctgcattgatggtcgaacttgttgcggctgaggctgcggttgtggctgattcggttgtttctctgacagtttttgaagaaaggccataacagcagcgtcttttgcagcggacatagagcgttcttgagctaagatctcgtgctcgcggttgattctggcaatctcttgaactctccaagactcttctctaaccaatctctcgtgttctcgcttttcaacagcttccaagaatttgcgttgaagctcttcctgtttatcaactacttgtttcatcaaccgctcgaaaaacaccttccatttcctcttccttttcttccttgtagtcgcagttccaccacccatctccatgtcagaagaagtcgaataagaagacgaagacgatgtagaattatccgatagaaaatcaccggagatgtttggaaacgaaggtacattaatctgctgagtatacggaggaattgatgaagaaggaagcgtcggcataactgtcgttaccggaggaggagttgaaaatatggagctgttgttgttgttgttgttgttgttgttgttttgctgtggtcgaagaggcgtttgttgttgatgatggtggagtgaggttgtagattgagactcgagagcttctaattgatcaaagaagcgataagttttgccttcggattttccggtacgaccttctttggttcgtttgtggtatttgtaaacgttctcgaatttctctttgcatttctttgcgtttcttatgtaaccatgctccgccattttcctacc

SEQ ID NO: 316 - protein, 1168 aa, Arabidopsis thaliana
AAGTCTTGGAATCTTCGGGACGTTTCTTGTTGCTCTCTTTGACTTTCTTGAAGTATTTGTTTATGTTTTCCCATTTCTCTTTGCATCTCTTTGAGTTCCTGTTGAATCCTAACCTTCTCATTCCCGCTGATATCTCTTCCCACAATGGTCCTTTTGGTCCGTTTTCTTGATATTTCGAATCAAGATTCGTCCTCAGCTTTATCAATGCTTCTATCTCCACTTTCGGCCACCGCGACGAGCTCGCTGAAGCTGCAGGAGTCATATTCTGATCACCACCATTGTCCGTTTTCGTTGTGTCTAACGTCGACACAACCGCTTGAATTGGCTGCGGAAGCGGAGCAGGAGGTTGCGGTGGAGGAGACCGTTGAGGCGGTTGCTGCTGATTGTTGTTATTAAGCTGCATTGATGGTCGAACTTGTTGCGGCTGAGGCTGCGGTTGTGGCTGATTCGGTTGTTTCTCTGACAGTTTTTGAAGAAAGGCCATAACAGCAGCGTCTTTTGCAGCGGACATAGAGCGTTCTTGAGCTAAGATCTCGTGCTCGCGGTTGATTCTGGCAATCTCTTGAACTCTCCAAGACTCTTCTCTAACCAATCTCTCGTGTTCTCGCTTTTCAACAGCTTCCAAGAATTTGCGTTGAAGCTCTTCCTGTTTATCAACTACTTGTTTCATCAACCGCTCGAAAAACACCTTCCATTTCCTCTTCCTTTTCTTCCTTGTAGTCGCAGTTCCACCACCCATCTCCATGTCAGAAGAAGTCGAATAAGAAGACGAAGACGATGTAGAATTATCCGATAGAAAATCACCGGAGATGTTTGGAAACGAAGGTACATTAATCTGCTGAGTATACGGAGGAATTGATGAAGAAGGAAGCGTCGGCATAACTGTCGTTACCGGAGGAGGAGTTGAAAATATGGAGCTGTTGTTGTTGTTGTTGTTGTTGTTGTTGTTTTGCTGTGGTCGAAGAGGCGTTTGTTGTTGATGATGGTGGAGTGAGGTTGTAGATTGAGACTCGAGAGCTTCTAATTGATCAAAGAAGCGATAAGTTTTGCCTTCGGATTTTCCGGTACGACCTTCTTTGGTTCGTTTGTGGTATTTGTAAACGTTCTCGAATTTCTCTTTGCATTTCTTTGCGTTTCTTATGTAACCATGCTCCGCCATTTTCCTACC

SEQ ID NO: 317 - DNA, 1739 bp, Arabidopsis thaliana
  misc_feature (1)..(1739): Ceres cDNA ID no. 12324446
  misc_feature (1)..(1739): Ceres CLONE  ID no. 11984
  misc_feature (1)..(1739): Also known as  Ceres CDNA ID no. 23646848
aaaccaaacggtcaaacctcactcaccatgagacaccttagctcacctccatggcctctcctccttctcctcctcctctcttctttcacctccggcgaatcctctctgtccgcagaaaaaaacaaattgcacaccggtggtctcagtagacagagttttcctaaaggattcgtgtttggaaccgccacgtcagcttatcaagtcgaaggcgagactcatcaagacggtcgtggcccaagcatttgggatgccttcgtcaagattcctgggaagatcgccaagaatgccacggctgagataacagtggaccagtatcaccgttacaaggaagatgtggatttgatgaagaaactgaacttcgatgcttacagattttccatttcatggtccaggatattccctgagggaagtggtaaagtcaactggaaaggagttgcttattacaatagattgattgattacatggttcaaaaagggattacaccttatgctaatctgtaccactacgatcttccattggctttggaaaacaagtataaaggcttgcttggtagacaagtagtgaaagattttgcggattacgctgagttttgttacaagacatttggtgatagagtgaaaaattggatgacgttcaacgagccgcgtgtggtagctgctttaggttatgataatggtattttcgcaccgggtagatgctcaaaagcatttggaaattgcactgaaggaaactccgcgacagagccatacatagttactcatcaccttatcttggcccacgcagcagcagtccaaagataccgcaaatattaccaagcgaaacaaaagggaagggttgggatacttttagatttcgtttggtatgagccgcttactagaagtaaagcagataatcttgcagctcaaagagcaagagacttccatatcggatggtttattcacccattagtatatggagagtatccaaagacaatgcagaacattgtgaaagagaggcttccaaagttcacggagaaagaagtgaaaatggtgaaaggttccatagattttgtgggaataaaccaatacacgacttattacatgtccgaaccacatcccaccaccaaacctaaggatttgggttatcaacaagattggaatgtggaatttggctttgctaagttggggaagccaataggtccaagggcttactcgtcttggttatacaacgtaccatggggaatgtacaaggccttgatgtatatgaaggaacgttacggcaaccctactatgatcctctctgaaaacggtatggatgacccgggaaacgttactctagctcaaggactacatgacaccacgagaatcaagtattacaaagattacttaaccaaccttaagaaagctagggatgatggagccaatgtggttggatattttgcgtggtcattgctagataatttcgaatggttatcaggatatacttcaaggtttgggatcgtttatgttgattacaaaacattgaagaggtaccccaagatgtctgctcagtggtttaagcaacttctgaaacgaaacaacaaatgatctcaatgtatcaatgccgggtggatttagtttttaaaaaggttggaattgatgattgaagaaataatggggccggtttagtcactttgtttattataaggggggtgaattgtaacttgaactctctccttcttcagttctttgacttttcaacacaaataaaataaaagttt

SEQ ID NO: 318 - protein, 1739 aa, Arabidopsis thaliana
  misc_feature: PFam Name: Glyco_hydro_1; PFam Description: Glycosyl
  misc_feature: GI Number: 62733403; NR Description: Putative Glycosyl
  misc_feature: GI Number: 50918079; NR Description: beta-glucosidase (with alternative splicing) [Oryza sativa (japonica cultivar-group)] >gi|41469453|gb|AAS07254.1| beta-glucosidase (with alternative
  misc_feature: GI Number: 9294062; NR Description: beta-glucosidase
  misc_feature: GI Number: 18875458; NR Description: beta-glucosidase [Oryza
  misc_feature: GI Number: 50881478; NR Description: beta-glucosidase,
AAACCAAACGGTCAAACCTCACTCACCATGAGACACCTTAGCTCACCTCCATGGCCTCTCCTCCTTCTCCTCCTCCTCTCTTCTTTCACCTCCGGCGAATCCTCTCTGTCCGCAGAAAAAAACAAATTGCACACCGGTGGTCTCAGTAGACAGAGTTTTCCTAAAGGATTCGTGTTTGGAACCGCCACGTCAGCTTATCAAGTCGAAGGCGAGACTCATCAAGACGGTCGTGGCCCAAGCATTTGGGATGCCTTCGTCAAGATTCCTGGGAAGATCGCCAAGAATGCCACGGCTGAGATAACAGTGGACCAGTATCACCGTTACAAGGAAGATGTGGATTTGATGAAGAAACTGAACTTCGATGCTTACAGATTTTCCATTTCATGGTCCAGGATATTCCCTGAGGGAAGTGGTAAAGTCAACTGGAAAGGAGTTGCTTATTACAATAGATTGATTGATTACATGGTTCAAAAAGGGATTACACCTTATGCTAATCTGTACCACTACGATCTTCCATTGGCTTTGGAAAACAAGTATAAAGGCTTGCTTGGTAGACAAGTAGTGAAAGATTTTGCGGATTACGCTGAGTTTTGTTACAAGACATTTGGTGATAGAGTGAAAAATTGGATGACGTTCAACGAGCCGCGTGTGGTAGCTGCTTTAGGTTATGATAATGGTATTTTCGCACCGGGTAGATGCTCAAAAGCATTTGGAAATTGCACTGAAGGAAACTCCGCGACAGAGCCATACATAGTTACTCATCACCTTATCTTGGCCCACGCAGCAGCAGTCCAAAGATACCGCAAATATTACCAAGCGAAACAAAAGGGAAGGGTTGGGATACTTTTAGATTTCGTTTGGTATGAGCCGCTTACTAGAAGTAAAGCAGATAATCTTGCAGCTCAAAGAGCAAGAGACTTCCATATCGGATGGTTTATTCACCCATTAGTATATGGAGAGTATCCAAAGACAATGCAGAACATTGTGAAAGAGAGGCTTCCAAAGTTCACGGAGAAAGAAGTGAAAATGGTGAAAGGTTCCATAGATTTTGTGGGAATAAACCAATACACGACTTATTACATGTCCGAACCACATCCCACCACCAAACCTAAGGATTTGGGTTATCAACAAGATTGGAATGTGGAATTTGGCTTTGCTAAGTTGGGGAAGCCAATAGGTCCAAGGGCTTACTCGTCTTGGTTATACAACGTACCATGGGGAATGTACAAGGCCTTGATGTATATGAAGGAACGTTACGGCAACCCTACTATGATCCTCTCTGAAAACGGTATGGATGACCCGGGAAACGTTACTCTAGCTCAAGGACTACATGACACCACGAGAATCAAGTATTACAAAGATTACTTAACCAACCTTAAGAAAGCTAGGGATGATGGAGCCAATGTGGTTGGATATTTTGCGTGGTCATTGCTAGATAATTTCGAATGGTTATCAGGATATACTTCAAGGTTTGGGATCGTTTATGTTGATTACAAAACATTGAAGAGGTACCCCAAGATGTCTGCTCAGTGGTTTAAGCAACTTCTGAAACGAAACAACAAATGATCTCAATGTATCAATGCCGGGTGGATTTAGTTTTTAAAAAGGTTGGAATTGATGATTGAAGAAATAATGGGGCCGGTTTAGTCACTTTGTTTATTATAAGGGGGGTGAATTGTAACTTGAACTCTCTCCTTCTTCAGTTCTTTGACTTTTCAACACAAATAAAATAAAAGTTT

SEQ ID NO: 319 - DNA, 1358 bp, Arabidopsis thaliana
  misc_feature (1)..(1358): Ceres cDNA ID no. 12324690
  misc_feature (1)..(1358): Ceres CLONE  ID no. 35002
  misc_feature (1)..(1358): Also known as  Ceres CDNA ID no. 23359913
aagttcataactgaaaaataaaaataagacagaaaacaaagttaaaaataaaataaaaacggaagagagaaaataaataaataaaatcactcaaagaatttccacagtttttctttccatgttgatttagcccattcgtagacttcctccgcgccgccgttagacgccgcctcggaagtatcagcaaccgccgtggtgttcgtcgccttcaaagactcgtttctctcctctctctgagatctgaatttgagatgtttaaaaaaatgagtgctactacaagcaagacggatcagaaagcggcattagacattgcatcatggctattcaatgtggttacttccgttggaatcatcctcgttaacaaagctttaatggctacttatggctttagtttcgctactacattaaccggtttgcatttcggaacaacgacattgttgacaactttcttgacatggcttggttatatccaaccttctcagcttccttggcctgatcttttgaaattcgttttgttcgctaacttctctatcgttgggatgaacgtcagtctcatgtggaattctgttggcttctaccagattgcgaagctgagtatgatcccggtttcttgtcttctagaagttatgcttgacaatgtcaggtattcaagagatacaaagcttagcattttgttagttcttgctggtgttgccgtctgtactgtaaccgatgttagtgtcaatctcaacggatttctagctgccgctattgctgtctggagcaccgcgcttcagcaatactatgtacattatctacaacggaaatattcactcggttctttcaatttactggcgcataccgctccagttcaagctgcgtcattgttgttggtcggaccatttctagactactggttgactaaccaaagagtggatgcatacaacttttcatttgtatctctgttcttcttaatactctcgtgcagtatcgcggttgggaccaatctcagccaattcatctgtattggaagattcacggcggtgtctttccaagtacttggtcacatgaagacaattctggttttggttttgggattcactttcttcggtaaggaaggattaaacctacaagtagtgcttggaatgctgattgctatactcggtatgatctggtacggtaatgcatcttctaaaccgggtggtaaagaacgtcgtagcctgtctattcccataaccaagtcacagaaactatctgaaacaaacgaatctgatgaaaaggtgtagaagaaagaagtgaatcgcattgacatagaaacaaaaacaagatactcagatacaaacaggtagagttatcaaatgggatattatttataaacc

SEQ ID NO: 320 - protein, 1358 aa, Arabidopsis thaliana
  misc_feature: GI Number: 50933293; NR Description: putative transmembrane protein [Oryza sativa (japonica cultivar-group)] >gi|48843759|gb|AAT47018.1| putative transmembrane protein [Oryza
  misc_feature: GI Number: 30313364; NR Description: putative transmembrane
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
  misc_feature: GI Number: 21593003; NR Description: unknown [Arabidopsis thaliana]
  misc_feature: GI Number: 21595054; NR Description: unknown [Arabidopsis thaliana]
AAGTTCATAACTGAAAAATAAAAATAAGACAGAAAACAAAGTTAAAAATAAAATAAAAACGGAAGAGAGAAAATAAATAAATAAAATCACTCAAAGAATTTCCACAGTTTTTCTTTCCATGTTGATTTAGCCCATTCGTAGACTTCCTCCGCGCCGCCGTTAGACGCCGCCTCGGAAGTATCAGCAACCGCCGTGGTGTTCGTCGCCTTCAAAGACTCGTTTCTCTCCTCTCTCTGAGATCTGAATTTGAGATGTTTAAAAAAATGAGTGCTACTACAAGCAAGACGGATCAGAAAGCGGCATTAGACATTGCATCATGGCTATTCAATGTGGTTACTTCCGTTGGAATCATCCTCGTTAACAAAGCTTTAATGGCTACTTATGGCTTTAGTTTCGCTACTACATTAACCGGTTTGCATTTCGGAACAACGACATTGTTGACAACTTTCTTGACATGGCTTGGTTATATCCAACCTTCTCAGCTTCCTTGGCCTGATCTTTTGAAATTCGTTTTGTTCGCTAACTTCTCTATCGTTGGGATGAACGTCAGTCTCATGTGGAATTCTGTTGGCTTCTACCAGATTGCGAAGCTGAGTATGATCCCGGTTTCTTGTCTTCTAGAAGTTATGCTTGACAATGTCAGGTATTCAAGAGATACAAAGCTTAGCATTTTGTTAGTTCTTGCTGGTGTTGCCGTCTGTACTGTAACCGATGTTAGTGTCAATCTCAACGGATTTCTAGCTGCCGCTATTGCTGTCTGGAGCACCGCGCTTCAGCAATACTATGTACATTATCTACAACGGAAATATTCACTCGGTTCTTTCAATTTACTGGCGCATACCGCTCCAGTTCAAGCTGCGTCATTGTTGTTGGTCGGACCATTTCTAGACTACTGGTTGACTAACCAAAGAGTGGATGCATACAACTTTTCATTTGTATCTCTGTTCTTCTTAATACTCTCGTGCAGTATCGCGGTTGGGACCAATCTCAGCCAATTCATCTGTATTGGAAGATTCACGGCGGTGTCTTTCCAAGTACTTGGTCACATGAAGACAATTCTGGTTTTGGTTTTGGGATTCACTTTCTTCGGTAAGGAAGGATTAAACCTACAAGTAGTGCTTGGAATGCTGATTGCTATACTCGGTATGATCTGGTACGGTAATGCATCTTCTAAACCGGGTGGTAAAGAACGTCGTAGCCTGTCTATTCCCATAACCAAGTCACAGAAACTATCTGAAACAAACGAATCTGATGAAAAGGTGTAGAAGAAAGAAGTGAATCGCATTGACATAGAAACAAAAACAAGATACTCAGATACAAACAGGTAGAGTTATCAAATGGGATATTATTTATAAACC

SEQ ID NO: 321 - DNA, 1856 bp, Arabidopsis thaliana
  misc_feature (1)..(1856): Ceres cDNA ID no. 12324698
  misc_feature (1)..(1856): Ceres CLONE  ID no. 43076
  misc_feature (1)..(1856): Also known as  Ceres CDNA ID no. 23359921
aaatcataaaaacacaagttttcgacagatcaactgttttcttcattacgtgttcttcaatggcgtcacttcactgattctattcctatcaaagccacttacccatttccttttatatgcacaaattctcataaagttttcatttttattccatttttctcggaagccatggaagctgctaatgagcctgttaatggcggatccgtacagatccgaacagagaacaacgaaagacgaaagcttcctaatttcttacaaagcgtcaacatgaaatacgtcaagctaggttatcattacctcattactcatctcttcaagctctgtttggttccattaatggcggttttagtcacagagacctctcgattaacaacagacgatctttaccagatttggcttcatctccaatacaatctcgttgctttcatctttctctctgctttagctatctttggctccaccgtttacatcatgagtcgtcccagatctgtttatctcgttgattactcttgttatcttcctccggagagtcttcaggttaagtatcagaagtttatggatcattctaagttgattgaagatttcaatgagtcatctttagagtttcagaggaagattcttgaacgttctggtttaggagaagagacttatctccctgaagctttacattgtatccctccgaggcctacgatgatggcggctcgtgaggaatctgagcaggtaatgtttggtgctcttgataagcttttcgagaataccaagattaaccctagggatattggtgtgttggttgtgaattgtagcttgtttaatcctacaccttcgttgtcagctatgattgttaacaagtataagcttagagggaatgttaagagttttaaccttggtggaatggggtgtagtgctggtgttatctctatcgatttagctaaagatatgttgcaagttcataggaatacttatgctgttgtggttagtactgagaacattactcagaattggtattttgggaataagaaggctatgttgattccgaattgtttgtttcgtgttggtggttcggcgattttgttgtcgaacaaggggaaagatcgtagacggtctaagtataagcttgttcataccgttaggactcataaaggagctgttgagaaggctttcaactgtgtttaccaagagcaagatgataatgggaagaccggggtttcgttgtcgaaagatcttatggctatagctggggaagctcttaaggcgaatatcactactttaggtcctttggttcttcctataagtgagcagattctgtttttcatgactttggttacgaagaaactgtttaactcgaagctgaagccgtatattccgaatttcaagcttgcgtttgatcatttctgtatccatgctggtggtagagctgtgattgatgagcttgagaagaatctgcagctttcgcagactcatgtcgaggcatcgagaatgacactgcatagatttggaaacacttcttcgagctcgatttggtatgaactggcttacatagaggctaaaggtaggatgaagaaaggaaaccgggtttggcagattgcttttggaagtgggtttaagtgtaacagtgcagtttgggtggctctaaacaatgtcaagccttcggttagtagtccgtgggaacactgcatcgaccgatatccggttaagctcgacttctgatttaatcaaaaaccatttgtttggttagtcctagtctttactagactctgccttgtttatttttcttcttttcttgttaagctcttgtactcttaatgtgacgcttcttgattattactctcgcgttttattctatggcatctttatcc

SEQ ID NO: 322 - protein, 1856 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 32172502; NR Description: FAE1 [Marchantia polymorpha]
  misc_feature: GI Number: 32172500; NR Description: FAE3 [Marchantia polymorpha]
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 29417540; NR Description:
AAATCATAAAAACACAAGTTTTCGACAGATCAACTGTTTTCTTCATTACGTGTTCTTCAATGGCGTCACTTCACTGATTCTATTCCTATCAAAGCCACTTACCCATTTCCTTTTATATGCACAAATTCTCATAAAGTTTTCATTTTTATTCCATTTTTCTCGGAAGCCATGGAAGCTGCTAATGAGCCTGTTAATGGCGGATCCGTACAGATCCGAACAGAGAACAACGAAAGACGAAAGCTTCCTAATTTCTTACAAAGCGTCAACATGAAATACGTCAAGCTAGGTTATCATTACCTCATTACTCATCTCTTCAAGCTCTGTTTGGTTCCATTAATGGCGGTTTTAGTCACAGAGACCTCTCGATTAACAACAGACGATCTTTACCAGATTTGGCTTCATCTCCAATACAATCTCGTTGCTTTCATCTTTCTCTCTGCTTTAGCTATCTTTGGCTCCACCGTTTACATCATGAGTCGTCCCAGATCTGTTTATCTCGTTGATTACTCTTGTTATCTTCCTCCGGAGAGTCTTCAGGTTAAGTATCAGAAGTTTATGGATCATTCTAAGTTGATTGAAGATTTCAATGAGTCATCTTTAGAGTTTCAGAGGAAGATTCTTGAACGTTCTGGTTTAGGAGAAGAGACTTATCTCCCTGAAGCTTTACATTGTATCCCTCCGAGGCCTACGATGATGGCGGCTCGTGAGGAATCTGAGCAGGTAATGTTTGGTGCTCTTGATAAGCTTTTCGAGAATACCAAGATTAACCCTAGGGATATTGGTGTGTTGGTTGTGAATTGTAGCTTGTTTAATCCTACACCTTCGTTGTCAGCTATGATTGTTAACAAGTATAAGCTTAGAGGGAATGTTAAGAGTTTTAACCTTGGTGGAATGGGGTGTAGTGCTGGTGTTATCTCTATCGATTTAGCTAAAGATATGTTGCAAGTTCATAGGAATACTTATGCTGTTGTGGTTAGTACTGAGAACATTACTCAGAATTGGTATTTTGGGAATAAGAAGGCTATGTTGATTCCGAATTGTTTGTTTCGTGTTGGTGGTTCGGCGATTTTGTTGTCGAACAAGGGGAAAGATCGTAGACGGTCTAAGTATAAGCTTGTTCATACCGTTAGGACTCATAAAGGAGCTGTTGAGAAGGCTTTCAACTGTGTTTACCAAGAGCAAGATGATAATGGGAAGACCGGGGTTTCGTTGTCGAAAGATCTTATGGCTATAGCTGGGGAAGCTCTTAAGGCGAATATCACTACTTTAGGTCCTTTGGTTCTTCCTATAAGTGAGCAGATTCTGTTTTTCATGACTTTGGTTACGAAGAAACTGTTTAACTCGAAGCTGAAGCCGTATATTCCGAATTTCAAGCTTGCGTTTGATCATTTCTGTATCCATGCTGGTGGTAGAGCTGTGATTGATGAGCTTGAGAAGAATCTGCAGCTTTCGCAGACTCATGTCGAGGCATCGAGAATGACACTGCATAGATTTGGAAACACTTCTTCGAGCTCGATTTGGTATGAACTGGCTTACATAGAGGCTAAAGGTAGGATGAAGAAAGGAAACCGGGTTTGGCAGATTGCTTTTGGAAGTGGGTTTAAGTGTAACAGTGCAGTTTGGGTGGCTCTAAACAATGTCAAGCCTTCGGTTAGTAGTCCGTGGGAACACTGCATCGACCGATATCCGGTTAAGCTCGACTTCTGATTTAATCAAAAACCATTTGTTTGGTTAGTCCTAGTCTTTACTAGACTCTGCCTTGTTTATTTTTCTTCTTTTCTTGTTAAGCTCTTGTACTCTTAATGTGACGCTTCTTGATTATTACTCTCGCGTTTTATTCTATGGCATCTTTATCC

SEQ ID NO: 323 - DNA, 2077 bp, Arabidopsis thaliana
  misc_feature (1)..(2077): Ceres cDNA ID no. 12324770
  misc_feature (1)..(2077): Ceres CLONE  ID no. 9723
  misc_feature (1)..(2077): Also known as  Ceres CDNA ID no. 23359995
aatcctattttcacagactctcactagggttttggtttctcctatcagggttttaatcgttcaccatttctctcagagaaaatgtcttctctaatggcgattcgttgcgcacgaacccagaatatcgtcacaatcggctctctccttcagttacgttcttcatttcccagactctcctctcaattccacttctccggtaccctaaactcaattccgatcaaacacctaagcacatccgccgccgcaaacgattaccaccagaatcctcaatctggatcaccgtctcagcatcaacgcccatatccacctcaaagcttcgattctcagagctctcagaatcagaccaacactaatcaacgagttccacaaagccctaatcaatggtctactcaacacggtggtcaaatacctcaatacggtggtcaaaatcctcaacacgggggtcaaaggcctccatacggtggtcaaaatcctcaacaaggtggtcaaatgtctcaatacggtggtcacaatcctcaacacggtggtcacaggcctcagtacggtggtcagaggcctcaatacggtggacctggtaacaattatcagaatcagaatgttcaacaaagtaatcagagtcagtactacactccgcagcagcagcaacaaccgcaaccaccacgaagctcgaatcaaagccctaatcagatgaatgaggtagctcctcctcctagtgttgaagaggtgatgaggttatgtcagcgtaggctatataaagatgctattgaattgcttgataaaggagctatgcctgatagagaatgtttcgttttgttgtttgagtcttgtgcgaatttgaagtcgcttgagcattctaagaaggtacatgatcatttccttcagtctaagtttagaggtgatccaaaacttaacaatatggtgattagtatgtttggagagtgtagtagtattacagatgctaagagagtgtttgatcatatggttgataaagatatggattcttggcatttgatgatgtgtgcgtatagtgataacggaatgggagatgatgcgttgcatttgttcgaagagatgacgaaacatgggttgaagccgaacgaggagactttccttacggtcttcttggcttgtgctactgttggtggtatagaagaagcgtttttgcattttgattcgatgaagaacgagcatgggattagtccgaagacagagcattatttgggtgttttaggtgttcttgggaaatgtggacatcttgttgaggctgagcaatatatccgtgatcttccgtttgaacccacagctgatttctgggaggctatgcggaactatgctcggttacatggtgatatcgatttagaggattacatggaggaattgatggttgatgttgatccttcaaaggctgtaatcaacaaaattcctactcctccacctaaatcattcaaggaaacaaatatggttactagtaagagtaggatccttgagtttcgaaatctgactttctacaaggatgaagcaaaggagatggctgcaaagaaaggagtggtttatgttcctgacacacggtttgtgcttcatgatatcgatcaagaggctaaagaacaggcactactctaccacagtgagaggttagcgattgcttatggtatcatatgcaccccaccaaggaagaccctaacaatcatcaagaatctccgtgtgtgtggggattgtcacaactttatcaagatcatgtccaaaatcattggtagggtgttgatcgtgagagacaacaaacgtttccatcacttcaaagacggtaaatgttcttgcggggattactggtagagcggcgttttctgtgactttgtttcgcatcatgtatagcgcgctctaagctctcgccagaactttgctagcagttgggaaatggaatagtatttgctacgctgtaacaagtttcatctgctctagacccttttacatgaggaattatcaagtttattgctttatatctactattattggtctcattctcgaagaacatgacttaatgttttgaaattagatcgtatgaataatgaactttgattac

SEQ ID NO: 324 - protein, 2077 aa, Arabidopsis thaliana
  misc_feature: PFam Name: PPR; PFam Description: PPR repeat
  misc_feature: PFam Name: Glutenin_hmw; PFam Description: High molecular
  misc_feature: PFam Name: FBA_1; PFam Description: F-box associated
  misc_feature: GI Number: 34909332; NR Description: putative selenium-binding protein [Oryza sativa (japonica cultivar-group)] >gi|20160509|dbj|BAB89460.1| putative selenium-binding protein
  misc_feature: GI Number: 50938811; NR Description: pentatricopeptide (PPR) repeat-containing protein-like protein [Oryza sativa (japonica cultivar-group)] >gi|34393605|dbj|BAC83258.1| pentatricopeptide (PPR) repeat-containing protein-like protein [Oryza sativa
  misc_feature: GI Number: 4874299; NR Description: putative selenium-binding protein [Arabidopsis thaliana] >gi|25412333|pir||B84650 probable selenium-binding protein [imported] - Arabidopsis thaliana >gi|15224758|ref|NP_180129.1| pentatricopeptide (PPR)
  misc_feature: GI Number: 51969930; NR Description: putative
  misc_feature: GI Number: 50400032; NR Description: putative PPR repeat
AATCCTATTTTCACAGACTCTCACTAGGGTTTTGGTTTCTCCTATCAGGGTTTTAATCGTTCACCATTTCTCTCAGAGAAAATGTCTTCTCTAATGGCGATTCGTTGCGCACGAACCCAGAATATCGTCACAATCGGCTCTCTCCTTCAGTTACGTTCTTCATTTCCCAGACTCTCCTCTCAATTCCACTTCTCCGGTACCCTAAACTCAATTCCGATCAAACACCTAAGCACATCCGCCGCCGCAAACGATTACCACCAGAATCCTCAATCTGGATCACCGTCTCAGCATCAACGCCCATATCCACCTCAAAGCTTCGATTCTCAGAGCTCTCAGAATCAGACCAACACTAATCAACGAGTTCCACAAAGCCCTAATCAATGGTCTACTCAACACGGTGGTCAAATACCTCAATACGGTGGTCAAAATCCTCAACACGGGGGTCAAAGGCCTCCATACGGTGGTCAAAATCCTCAACAAGGTGGTCAAATGTCTCAATACGGTGGTCACAATCCTCAACACGGTGGTCACAGGCCTCAGTACGGTGGTCAGAGGCCTCAATACGGTGGACCTGGTAACAATTATCAGAATCAGAATGTTCAACAAAGTAATCAGAGTCAGTACTACACTCCGCAGCAGCAGCAACAACCGCAACCACCACGAAGCTCGAATCAAAGCCCTAATCAGATGAATGAGGTAGCTCCTCCTCCTAGTGTTGAAGAGGTGATGAGGTTATGTCAGCGTAGGCTATATAAAGATGCTATTGAATTGCTTGATAAAGGAGCTATGCCTGATAGAGAATGTTTCGTTTTGTTGTTTGAGTCTTGTGCGAATTTGAAGTCGCTTGAGCATTCTAAGAAGGTACATGATCATTTCCTTCAGTCTAAGTTTAGAGGTGATCCAAAACTTAACAATATGGTGATTAGTATGTTTGGAGAGTGTAGTAGTATTACAGATGCTAAGAGAGTGTTTGATCATATGGTTGATAAAGATATGGATTCTTGGCATTTGATGATGTGTGCGTATAGTGATAACGGAATGGGAGATGATGCGTTGCATTTGTTCGAAGAGATGACGAAACATGGGTTGAAGCCGAACGAGGAGACTTTCCTTACGGTCTTCTTGGCTTGTGCTACTGTTGGTGGTATAGAAGAAGCGTTTTTGCATTTTGATTCGATGAAGAACGAGCATGGGATTAGTCCGAAGACAGAGCATTATTTGGGTGTTTTAGGTGTTCTTGGGAAATGTGGACATCTTGTTGAGGCTGAGCAATATATCCGTGATCTTCCGTTTGAACCCACAGCTGATTTCTGGGAGGCTATGCGGAACTATGCTCGGTTACATGGTGATATCGATTTAGAGGATTACATGGAGGAATTGATGGTTGATGTTGATCCTTCAAAGGCTGTAATCAACAAAATTCCTACTCCTCCACCTAAATCATTCAAGGAAACAAATATGGTTACTAGTAAGAGTAGGATCCTTGAGTTTCGAAATCTGACTTTCTACAAGGATGAAGCAAAGGAGATGGCTGCAAAGAAAGGAGTGGTTTATGTTCCTGACACACGGTTTGTGCTTCATGATATCGATCAAGAGGCTAAAGAACAGGCACTACTCTACCACAGTGAGAGGTTAGCGATTGCTTATGGTATCATATGCACCCCACCAAGGAAGACCCTAACAATCATCAAGAATCTCCGTGTGTGTGGGGATTGTCACAACTTTATCAAGATCATGTCCAAAATCATTGGTAGGGTGTTGATCGTGAGAGACAACAAACGTTTCCATCACTTCAAAGACGGTAAATGTTCTTGCGGGGATTACTGGTAGAGCGGCGTTTTCTGTGACTTTGTTTCGCATCATGTATAGCGCGCTCTAAGCTCTCGCCAGAACTTTGCTAGCAGTTGGGAAATGGAATAGTATTTGCTACGCTGTAACAAGTTTCATCTGCTCTAGACCCTTTTACATGAGGAATTATCAAGTTTATTGCTTTATATCTACTATTATTGGTCTCATTCTCGAAGAACATGACTTAATGTTTTGAAATTAGATCGTATGAATAATGAACTTTGATTAC

SEQ ID NO: 325 - DNA, 1323 bp, Arabidopsis thaliana
  misc_feature (1)..(1323): Ceres cDNA ID no. 12324839
  misc_feature (1)..(1323): Ceres CLONE  ID no. 38400
  misc_feature (1)..(1323): Also known as  Ceres CDNA ID no. 23360065
aaacaaatttcaagttctttaaacgatttccttttcaagaaaaacccttctccttcttctttttaccacatagatcttcttgatctacaatggattctgtttctctttctgaggttactgtcattagagaaacaacacatttggggtttatgcacagtttcagactcagacagccattttgtggtgtcaaaatatctccaaagttctatttatccaaagttgatggaccaaaggcaatatcttcgagcagcaacacaaagagtcaatttgtttatggaggaggaagcatagctgcaacttcagattcaggttataagatgaatggagtaaacctaaaaagcagaacattgatgagttctgcagttaaagaaagatcattacttgatgcttatgatgatgagtatggtggagtaatagtagatcatggaaaattaccatcaaacccttatgctttcgcttctatgcttcgagcttctctatccgattggagaagaaagggaaagaaaggagtttggttaaagttacctgtggaacaatcagaattagtcccaatagctataaaggaaggttttgagtatcatcatgcagagaaaggatatgtaatgttaacatattggataccaaaggaggaacctagtatgcttcctgcaaatgcttcacatcaagttggtgttggaggttttgtattaaatcaacataaagaggtgcttgtggtacaagaaaagtattgtgctccttcgattactggtctatggaaattaccaacagggtttatcaatgaatctgaagagattttctctggtgctgtaagagaagtcaaggaagaaactggggtagatacagagttctcagaggttatagctttcagacatgctcacaacgttgcatttgagaaatctgatctgttcttcatctgtatgttgagaccactctctgataagataatcatcgatgctcttgagatcaaagccgcaaagtggatgccattggctgaatttgtggagcaaccgatgataagaggggacaaaatgtttaagagagtgattgaaatctgcgaggcaagattaagccatcggtactgcggtctttctcctcatcgacttgtctctacttttgatggcaaaccttcttctctctattacaacgttgttgatgatgatcatgatccttcccactccaattgtagcactgagttttatagatagacgggtaaaacagaaccaaatcaagtggttcgattctgtatatacttattctcatgtaatgtatgttgttatttgatactctctcttcagtatagtaaatagtaatagatcctctgcg

SEQ ID NO: 326 - protein, 1323 aa, Arabidopsis thaliana
  misc_feature: PFam Name: NUDIX; PFam Description: NUDIX domain
  misc_feature: GI Number: 23308325; NR Description: At5g47240/MQL5_10 [Arabidopsis thaliana] >gi|21928133|gb|AAM78094.1|
  misc_feature: GI Number: 18422772; NR Description: MutT/nudix family
  misc_feature: GI Number: 8809607; NR Description: mutT domain protein-like
  misc_feature: GI Number: 21593371; NR Description: mutT domain protein-like
  misc_feature: GI Number: 61656669; NR Description: OSJNBa0065H10.6 [Oryza
AAACAAATTTCAAGTTCTTTAAACGATTTCCTTTTCAAGAAAAACCCTTCTCCTTCTTCTTTTTACCACATAGATCTTCTTGATCTACAATGGATTCTGTTTCTCTTTCTGAGGTTACTGTCATTAGAGAAACAACACATTTGGGGTTTATGCACAGTTTCAGACTCAGACAGCCATTTTGTGGTGTCAAAATATCTCCAAAGTTCTATTTATCCAAAGTTGATGGACCAAAGGCAATATCTTCGAGCAGCAACACAAAGAGTCAATTTGTTTATGGAGGAGGAAGCATAGCTGCAACTTCAGATTCAGGTTATAAGATGAATGGAGTAAACCTAAAAAGCAGAACATTGATGAGTTCTGCAGTTAAAGAAAGATCATTACTTGATGCTTATGATGATGAGTATGGTGGAGTAATAGTAGATCATGGAAAATTACCATCAAACCCTTATGCTTTCGCTTCTATGCTTCGAGCTTCTCTATCCGATTGGAGAAGAAAGGGAAAGAAAGGAGTTTGGTTAAAGTTACCTGTGGAACAATCAGAATTAGTCCCAATAGCTATAAAGGAAGGTTTTGAGTATCATCATGCAGAGAAAGGATATGTAATGTTAACATATTGGATACCAAAGGAGGAACCTAGTATGCTTCCTGCAAATGCTTCACATCAAGTTGGTGTTGGAGGTTTTGTATTAAATCAACATAAAGAGGTGCTTGTGGTACAAGAAAAGTATTGTGCTCCTTCGATTACTGGTCTATGGAAATTACCAACAGGGTTTATCAATGAATCTGAAGAGATTTTCTCTGGTGCTGTAAGAGAAGTCAAGGAAGAAACTGGGGTAGATACAGAGTTCTCAGAGGTTATAGCTTTCAGACATGCTCACAACGTTGCATTTGAGAAATCTGATCTGTTCTTCATCTGTATGTTGAGACCACTCTCTGATAAGATAATCATCGATGCTCTTGAGATCAAAGCCGCAAAGTGGATGCCATTGGCTGAATTTGTGGAGCAACCGATGATAAGAGGGGACAAAATGTTTAAGAGAGTGATTGAAATCTGCGAGGCAAGATTAAGCCATCGGTACTGCGGTCTTTCTCCTCATCGACTTGTCTCTACTTTTGATGGCAAACCTTCTTCTCTCTATTACAACGTTGTTGATGATGATCATGATCCTTCCCACTCCAATTGTAGCACTGAGTTTTATAGATAGACGGGTAAAACAGAACCAAATCAAGTGGTTCGATTCTGTATATACTTATTCTCATGTAATGTATGTTGTTATTTGATACTCTCTCTTCAGTATAGTAAATAGTAATAGATCCTCTGCG

SEQ ID NO: 327 - DNA, 1061 bp, Arabidopsis thaliana
  misc_feature (1)..(1061): Ceres cDNA ID no. 12324892
  misc_feature (1)..(1061): Ceres CLONE  ID no. 34363
  misc_feature (1)..(1061): Also known as  Ceres CDNA ID no. 23360114
gtcttcgttgctttttcgagcggtgcctagtctcaacttccatggctgacatcttaccttcaaattttctcaaaccaaccaaaaagcttcttctccttttctaaaatttcatcaaaccctatagggttttctcaatacaattgattttttttttcttcttcttctctatggatacgaccctttctcccgccgtggaggcggaacaaatcgccgactcaacgatcgacactgtttctcgtttgatcgccggcgttttctccggcgcacttactggaatcttcgctatggctggagcttttactggagctgtaactggtgcggtggcaggaagagctgcacagtatggagttctccgtggggctgcacttggcgctgttgctggagctatcctctctgttgaagtgttggaggcttctcgtgcgtattggtatttagagctgtcaggatcaaggggtccatcatctatggcagattttgtagagcaactgtttcgtgggagactggtagatgaacaacttatgtcaacaatgataaattcacaccattggcagttaaggatttccgatgtaagttatgaagagcgggaggatgtttatggtgaactggaagctagaggcttatcgggtgactctttaaggaaactaccatgctatataatgtcaagtgaaatggtcaggaggcaggtcactcactgcacaatttgtctgcaggacatcaaaacaggggaaatcacacgaagcttaccgaaatgtgatcatacgtttcatctggtatgtgttgataaatggctcatcagacacgggtcatgccccatttgcagacaggcagttaaagattaaaacacgactgttgccgagctgtgtacatagcaaaaacacattatccttatatgttgttgtaacttgtaagtctaaaacccctttcttctgtatttttcctcatttcatttagagcaatctcagcttgagccataggtttcgacttttgaatgtatattgttgtagacatgaataagaatacctacagatgtattgaaaagaatatagaactcgatcaagtcg

SEQ ID NO: 328 - protein, 1061 aa, Arabidopsis thaliana
  misc_feature: PFam Name: zf-C3HC4; PFam Description: Zinc finger, C3HC4
  misc_feature: GI Number: 21592935; NR Description: putative RING zinc
  misc_feature: GI Number: 20147407; NR Description: At1g74410/F1M20_9 [Arabidopsis thaliana] >gi|15215808|gb|AAK91449.1| At1g74410/F1M20_9 [Arabidopsis thaliana] >gi|18410608|ref|NP_565085.1| zinc finger (C3HC4-type RING
  misc_feature: GI Number: 51964362; NR Description: PREDICTED OJ1734_E02.21-2 gene product [Oryza sativa (japonica cultivar-group)] >gi|50912677|ref|XP_467746.1| putative NEP1-interacting protein [Oryza sativa (japonica cultivar-group)]
  misc_feature: GI Number: 51535177; NR Description: putative
  misc_feature: GI Number: 50912679; NR Description: putative NEP1-interacting protein [Oryza sativa (japonica cultivar-group)] >gi|46390630|dbj|BAD16113.1| putative NEP1-interacting protein
GTCTTCGTTGCTTTTTCGAGCGGTGCCTAGTCTCAACTTCCATGGCTGACATCTTACCTTCAAATTTTCTCAAACCAACCAAAAAGCTTCTTCTCCTTTTCTAAAATTTCATCAAACCCTATAGGGTTTTCTCAATACAATTGATTTTTTTTTTCTTCTTCTTCTCTATGGATACGACCCTTTCTCCCGCCGTGGAGGCGGAACAAATCGCCGACTCAACGATCGACACTGTTTCTCGTTTGATCGCCGGCGTTTTCTCCGGCGCACTTACTGGAATCTTCGCTATGGCTGGAGCTTTTACTGGAGCTGTAACTGGTGCGGTGGCAGGAAGAGCTGCACAGTATGGAGTTCTCCGTGGGGCTGCACTTGGCGCTGTTGCTGGAGCTATCCTCTCTGTTGAAGTGTTGGAGGCTTCTCGTGCGTATTGGTATTTAGAGCTGTCAGGATCAAGGGGTCCATCATCTATGGCAGATTTTGTAGAGCAACTGTTTCGTGGGAGACTGGTAGATGAACAACTTATGTCAACAATGATAAATTCACACCATTGGCAGTTAAGGATTTCCGATGTAAGTTATGAAGAGCGGGAGGATGTTTATGGTGAACTGGAAGCTAGAGGCTTATCGGGTGACTCTTTAAGGAAACTACCATGCTATATAATGTCAAGTGAAATGGTCAGGAGGCAGGTCACTCACTGCACAATTTGTCTGCAGGACATCAAAACAGGGGAAATCACACGAAGCTTACCGAAATGTGATCATACGTTTCATCTGGTATGTGTTGATAAATGGCTCATCAGACACGGGTCATGCCCCATTTGCAGACAGGCAGTTAAAGATTAAAACACGACTGTTGCCGAGCTGTGTACATAGCAAAAACACATTATCCTTATATGTTGTTGTAACTTGTAAGTCTAAAACCCCTTTCTTCTGTATTTTTCCTCATTTCATTTAGAGCAATCTCAGCTTGAGCCATAGGTTTCGACTTTTGAATGTATATTGTTGTAGACATGAATAAGAATACCTACAGATGTATTGAAAAGAATATAGAACTCGATCAAGTCG

SEQ ID NO: 329 - DNA, 1015 bp, Arabidopsis thaliana
  misc_feature (1)..(1015): Ceres cDNA ID no. 12324924
  misc_feature (1)..(1015): Ceres CLONE  ID no. 159007
  misc_feature (1)..(1015): Also known as  Ceres CDNA ID no. 23360146
ctctgaaatcgaagtttctcgaactgttttgttttgttttttttccgatgaggtgtaagagacacacagtagatttcagtagcagtatcggcgtttgtgcttcttgtctccgtgaacgactctttactctcgccgtttcaaccgccgcgtctgaaaacgacgataacgatcatcgtcattctcgtatttctccacctcctctgctttttcctcgttctgtttctccttacgttgctcctagaaaatccgacgccggaaccggaaccggagctggaggaagagactccgtagcttcttctaataaccgattcttcgcaacgccgcaagtggttgttcaatcatcgtcatcggaaaaagtcttcgaatcagacagatcgtttaagaagaaaaaaagcggtttatctagattctctagcttcttcagaacgagatctgacgattacgattcgcgtcgcgattcatgcgacgcctccacggttttttctcaaccgtcgtcggcgacgacttcacggtcatggttttcgaaggttatatcagttcgatcgaagaaacaatcaaccaccaatacttgctacatcgaagatttgatcgcttccgaatccgatcatcatcatcataatcaaaatcgacctagacagagatattgtagaggaatgtcgccggcgggagattcaacgacgaacgatgaatcagttgaggaatctccagggagattaagaagaacgccggtgatgggaactccgggaaggaaaaagacggcgacgattgggattggtagaagtgtatcagggatggctttttgcttaagtccattagtgagagctaaacctaactgttcttctaactggaaagcgaaatttccgccggattttggatattccggtgaattgaaatctccggcgaagcctcacctatcaacggcggcgtctttttgcggtaaccggtctaagaagcttgtggatttaggtagagttgatcaccgccgttgatttttttggttgaggtcaaaatctga

SEQ ID NO: 330 - protein, 1015 aa, Arabidopsis thaliana
CTCTGAAATCGAAGTTTCTCGAACTGTTTTGTTTTGTTTTTTTTCCGATGAGGTGTAAGAGACACACAGTAGATTTCAGTAGCAGTATCGGCGTTTGTGCTTCTTGTCTCCGTGAACGACTCTTTACTCTCGCCGTTTCAACCGCCGCGTCTGAAAACGACGATAACGATCATCGTCATTCTCGTATTTCTCCACCTCCTCTGCTTTTTCCTCGTTCTGTTTCTCCTTACGTTGCTCCTAGAAAATCCGACGCCGGAACCGGAACCGGAGCTGGAGGAAGAGACTCCGTAGCTTCTTCTAATAACCGATTCTTCGCAACGCCGCAAGTGGTTGTTCAATCATCGTCATCGGAAAAAGTCTTCGAATCAGACAGATCGTTTAAGAAGAAAAAAAGCGGTTTATCTAGATTCTCTAGCTTCTTCAGAACGAGATCTGACGATTACGATTCGCGTCGCGATTCATGCGACGCCTCCACGGTTTTTTCTCAACCGTCGTCGGCGACGACTTCACGGTCATGGTTTTCGAAGGTTATATCAGTTCGATCGAAGAAACAATCAACCACCAATACTTGCTACATCGAAGATTTGATCGCTTCCGAATCCGATCATCATCATCATAATCAAAATCGACCTAGACAGAGATATTGTAGAGGAATGTCGCCGGCGGGAGATTCAACGACGAACGATGAATCAGTTGAGGAATCTCCAGGGAGATTAAGAAGAACGCCGGTGATGGGAACTCCGGGAAGGAAAAAGACGGCGACGATTGGGATTGGTAGAAGTGTATCAGGGATGGCTTTTTGCTTAAGTCCATTAGTGAGAGCTAAACCTAACTGTTCTTCTAACTGGAAAGCGAAATTTCCGCCGGATTTTGGATATTCCGGTGAATTGAAATCTCCGGCGAAGCCTCACCTATCAACGGCGGCGTCTTTTTGCGGTAACCGGTCTAAGAAGCTTGTGGATTTAGGTAGAGTTGATCACCGCCGTTGATTTTTTTGGTTGAGGTCAAAATCTGA

SEQ ID NO: 331 - DNA, 1129 bp, Arabidopsis thaliana
  misc_feature (1)..(1129): Ceres cDNA ID no. 12325093
  misc_feature (1)..(1129): Ceres CLONE  ID no. 36370
  misc_feature (1)..(1129): Also known as  Ceres CDNA ID no. 23360311
aagcttcccaaagcgtttgttttatcctctcagagagctttctttagtgatggcggcgcttatccggtgttgctcctccttctctcatacttccggtggccaaccaccgccgcgtgacaagtctcgagctccagagattggaaaatttgctacatctattggctactcagtagtcagaaaacctggggatcatcctcctttctccaaaattatacattcgtcttcacagcctaaggagcgacaaggaaagggaatcttacaaacgccatttgccagtgtgggatctcttgacaagttttcagcttttgagggaattgggaggctcaaattaccggtgatggcagtgttgttgacaaactcccttcagatggctacacctcttgaagctttggctgctgagatatgtgagcctgagagctccatgttcagcatgcctattttgttgcttgttgctcttattggagccaccgttggagggttgcttgctcggcagaggaaaggggagttacagaggttgaatgaacaactacgacagattaacgcagctcttaggagacaagccaaaatcgagtcttatgcaccaagcttgagttatgctccagtgggagcaagaatcccagatagtgaaatcattgtggaaccaaagaaacaagagttgatttccaagttgaaaacaggaaaaacctttcttaggaaccaagaaccagagaaagcttatacagagttcaagatagctttggaacttgcccagagtctcaaagaccccaccgaagaaaagaaggctgcaagaggcctaggcgcctcgctgcagcgccaagggaagtatagggaagccatacagtatcactccatggttctagccatctcaaagagggaaagtgaagattctggaatcactgaagcatatggagctattgcagactgttataccgagctgggagatctcgagaaagctggaaagttctatgatacgtacattgctcggttagagactgactgatccttccgcaatgtttttttctttgttgtctgtttatgttcatgtaaaatcacatagaatggatatccaaatcccttttattgaatgtaattcgcttgtcttacaatccatgggaatacataactaatc

SEQ ID NO: 332 - protein, 1129 aa, Arabidopsis thaliana
  misc_feature: PFam Name: TPR_1; PFam Description: Tetratricopeptide repeat
  misc_feature: GI Number: 21593122; NR Description: unknown [Arabidopsis thaliana] >gi|17386154|gb|AAL38623.1| AT3g14110/MAG2_6 [Arabidopsis thaliana] >gi|15450619|gb|AAK96581.1| AT3g14110/MAG2_6 [Arabidopsis
  misc_feature: GI Number: 42572429; NR Description: tetratricopeptide repeat
  misc_feature: GI Number: 34914598; NR Description: P0520B06.12 [Oryza sativa (japonica cultivar-group)] >gi|20804493|dbj|BAB92188.1|
  misc_feature: GI Number: 50909895; NR Description: putative tetratricopeptide repeat (TPR)-containing protein [Oryza sativa (japonica cultivar-group)] >gi|46806280|dbj|BAD17488.1| putative tetratricopeptide repeat (TPR)-containing protein [Oryza sativa
  misc_feature: GI Number: 51950311; NR Description: chloroplast Flu-like
AAGCTTCCCAAAGCGTTTGTTTTATCCTCTCAGAGAGCTTTCTTTAGTGATGGCGGCGCTTATCCGGTGTTGCTCCTCCTTCTCTCATACTTCCGGTGGCCAACCACCGCCGCGTGACAAGTCTCGAGCTCCAGAGATTGGAAAATTTGCTACATCTATTGGCTACTCAGTAGTCAGAAAACCTGGGGATCATCCTCCTTTCTCCAAAATTATACATTCGTCTTCACAGCCTAAGGAGCGACAAGGAAAGGGAATCTTACAAACGCCATTTGCCAGTGTGGGATCTCTTGACAAGTTTTCAGCTTTTGAGGGAATTGGGAGGCTCAAATTACCGGTGATGGCAGTGTTGTTGACAAACTCCCTTCAGATGGCTACACCTCTTGAAGCTTTGGCTGCTGAGATATGTGAGCCTGAGAGCTCCATGTTCAGCATGCCTATTTTGTTGCTTGTTGCTCTTATTGGAGCCACCGTTGGAGGGTTGCTTGCTCGGCAGAGGAAAGGGGAGTTACAGAGGTTGAATGAACAACTACGACAGATTAACGCAGCTCTTAGGAGACAAGCCAAAATCGAGTCTTATGCACCAAGCTTGAGTTATGCTCCAGTGGGAGCAAGAATCCCAGATAGTGAAATCATTGTGGAACCAAAGAAACAAGAGTTGATTTCCAAGTTGAAAACAGGAAAAACCTTTCTTAGGAACCAAGAACCAGAGAAAGCTTATACAGAGTTCAAGATAGCTTTGGAACTTGCCCAGAGTCTCAAAGACCCCACCGAAGAAAAGAAGGCTGCAAGAGGCCTAGGCGCCTCGCTGCAGCGCCAAGGGAAGTATAGGGAAGCCATACAGTATCACTCCATGGTTCTAGCCATCTCAAAGAGGGAAAGTGAAGATTCTGGAATCACTGAAGCATATGGAGCTATTGCAGACTGTTATACCGAGCTGGGAGATCTCGAGAAAGCTGGAAAGTTCTATGATACGTACATTGCTCGGTTAGAGACTGACTGATCCTTCCGCAATGTTTTTTTCTTTGTTGTCTGTTTATGTTCATGTAAAATCACATAGAATGGATATCCAAATCCCTTTTATTGAATGTAATTCGCTTGTCTTACAATCCATGGGAATACATAACTAATC

SEQ ID NO: 333 - DNA, 1019 bp, Arabidopsis thaliana
  misc_feature (1)..(1019): Ceres cDNA ID no. 12325114
  misc_feature (1)..(1019): Ceres CLONE  ID no. 101259
  misc_feature (1)..(1019): Also known as  Ceres CDNA ID no. 23649454
atttcaacctagcatcttcgattcggaattatcctcacggtgtgctcagcgaagatgggttttataaagtggaagcgaacagttccgtgttatggtttcagctttgtgacgtgctgattttcaatcacgatccccctcgatgtgttggttgcgaagattgtggaggtccatctcactgcggaacgtcatgtagtgcacttgtgtcagaaaatgtaagagggtatgatgtatgcacttctctagggcatgcctcaagcacaaaagttgatattattgataaagaggatcctggcaaaggcgtcattgttcagatgtcaactggaaataggaaccaaaattgctcgctttcagtttctgttatttgccagaaaactaaagttgatggaccactcactttggcgaaatctggtacctgtcagtatgctactcagctgcgacatcctgccggttgtgcagtagctatatccggccatagtagtggatggggctggtttagtaccttactaatcattatcttgtgcctgtttggagcttatctggtgggtggtgcagtatatcggtatttctcccttggaattcgtggcatagatgtaatcccgaatgtggattactgggccactgtacctcacagtatacagagcttttttggctcactattttcaagattcggggggtctagtcgtggtcagcaaacctcatattctcaggtcaacttctgagcagtctcagcatcttctctgatccatggtctggagacacatccccaaactttccttgactggttcaaccaattgcaaacgccgatagattgttataccctgagtactcttttggccattatatgactgcaagttataaggtgcctctccttttcagcttgttatgtcatggatccctttagaaacaaaagaatcttgttcattggatagatacaatgtcaagccattgcaatctgcagcctttcccatttcgtgtgtttgctctttggagattgtttcagtttcttgatgctgattttg

SEQ ID NO: 334 - protein, 1019 aa, Arabidopsis thaliana
  misc_feature: PFam Name: Man-6-P_recep; PFam Description: Cation-dependent
ATTTCAACCTAGCATCTTCGATTCGGAATTATCCTCACGGTGTGCTCAGCGAAGATGGGTTTTATAAAGTGGAAGCGAACAGTTCCGTGTTATGGTTTCAGCTTTGTGACGTGCTGATTTTCAATCACGATCCCCCTCGATGTGTTGGTTGCGAAGATTGTGGAGGTCCATCTCACTGCGGAACGTCATGTAGTGCACTTGTGTCAGAAAATGTAAGAGGGTATGATGTATGCACTTCTCTAGGGCATGCCTCAAGCACAAAAGTTGATATTATTGATAAAGAGGATCCTGGCAAAGGCGTCATTGTTCAGATGTCAACTGGAAATAGGAACCAAAATTGCTCGCTTTCAGTTTCTGTTATTTGCCAGAAAACTAAAGTTGATGGACCACTCACTTTGGCGAAATCTGGTACCTGTCAGTATGCTACTCAGCTGCGACATCCTGCCGGTTGTGCAGTAGCTATATCCGGCCATAGTAGTGGATGGGGCTGGTTTAGTACCTTACTAATCATTATCTTGTGCCTGTTTGGAGCTTATCTGGTGGGTGGTGCAGTATATCGGTATTTCTCCCTTGGAATTCGTGGCATAGATGTAATCCCGAATGTGGATTACTGGGCCACTGTACCTCACAGTATACAGAGCTTTTTTGGCTCACTATTTTCAAGATTCGGGGGGTCTAGTCGTGGTCAGCAAACCTCATATTCTCAGGTCAACTTCTGAGCAGTCTCAGCATCTTCTCTGATCCATGGTCTGGAGACACATCCCCAAACTTTCCTTGACTGGTTCAACCAATTGCAAACGCCGATAGATTGTTATACCCTGAGTACTCTTTTGGCCATTATATGACTGCAAGTTATAAGGTGCCTCTCCTTTTCAGCTTGTTATGTCATGGATCCCTTTAGAAACAAAAGAATCTTGTTCATTGGATAGATACAATGTCAAGCCATTGCAATCTGCAGCCTTTCCCATTTCGTGTGTTTGCTCTTTGGAGATTGTTTCAGTTTCTTGATGCTGATTTTG

SEQ ID NO: 335 - DNA, 1449 bp, Arabidopsis thaliana
  misc_feature (1)..(1449): Ceres cDNA ID no. 12325319
  misc_feature (1)..(1449): Ceres CLONE  ID no. 14246
  misc_feature (1)..(1449): Also known as  Ceres CDNA ID no. 23657254
atatttttgtgattagaaattaggatcttacagaaatctttcaaaaagaaattcataacagttccattttttttggtaagattcataaaaaaattcaagttaaatgcattttataaaaatgtaggaaaaactttcaacaaaaatcgttgagaagaacatacagtatatcttatccactctcttcctcatccacgcggcaaaggcacaaacctctttagaaaaatgtcgtcagcttattgttcctccgccgtggctgtatccgccgcagccaccgcttcctccgccgctacctttaatccattactctcctcccactccaattcccaactcttctatcgctttacaccaaaatccttcaaactcgttgccaattgccctaatccactaatcctccactcaaatatccgccgccaccgcttcttctgcgccgccgaaaccgaagctagttccgccgatgatgaaatccaggcatcagtagaagaagaagaagaggtagaagaagaaggagatgaaggtgaagaagaagtagaggaagaaaaacagacgacgcaagcgagtggtgaagaagggaggctttacgttgggaatttaccttacacaatcacttcttctgagctctctcagatttttggagaagctggaactgtcgtcgatgttcagattgtttatgataaagttactgatagaagcagaggatttggatttgtaacaatgggaagcattgaagaagctaaagaagcgatgcagatgtttaacagctctcaaattggtggtagaacggtgaaagtgaacttcccggaggtgccgagaggcggtgagaacgaagtaatgagaaccaaaatccgtgataataaccggagttatgttgatagtcctcataaggtatatgcaggaaaccttggttggaatctaacctcacaaggtttaaaggatgcatttggtgatcaacctggtgtgcttggtgctaaagttatctatgaaagaaatactgggaggtctagggggtttggtttcatctcgttcgagtcagcggaaaatgttcagtctgctttggctacaatgaatggcgtggaagttgaaggacgagcgctgaggctaaatttggcttcagagagagagaaacccactgtgtctcctccttccgtagaagaaggagaaaccgaggaggccagtctagagagtaacgaggtgctttcgaatgttagtgcatgaagcagcaaaagcacaatagattccggataagtttcagactgatctgctcgaggtgccaaaaatgaaaattttgttgtctttataaatgtgttgttttgttctagtgaggctgaagaagaagacaatatatgagatagaaaacaagagattgtttgtaatttttattgagaatgtttttaatccataaatggtgtaatgtaacaacatatcttgattccagtaaactgcaaatttctg

SEQ ID NO: 336 - protein, 1449 aa, Arabidopsis thaliana
  misc_feature: PFam Name: RRM_1; PFam Description: RNA recognition motif.
  misc_feature: GI Number: 21553418; NR Description: RNA-binding protein cp33 [Arabidopsis thaliana] >gi|681910|dbj|BAA06522.1| cp33 [Arabidopsis thaliana] >gi|4886289|emb|CAB43448.1| RNA-binding protein cp33
  misc_feature: GI Number: 681912; NR Description: cp33 [Arabidopsis thaliana]
  misc_feature: GI Number: 17064758; NR Description: ubiquitin / ribosomal
  misc_feature: GI Number: 311952; NR Description: 33 kd chloroplast ribonucleoprotein [Nicotiana sylvestris] >gi|7446342|pir||S77714
  misc_feature: GI Number: 20009; NR Description: ribonucleoprotein [Nicotiana tabacum] >gi|100376|pir||S18883 ribonucleoprotein
ATATTTTTGTGATTAGAAATTAGGATCTTACAGAAATCTTTCAAAAAGAAATTCATAACAGTTCCATTTTTTTTGGTAAGATTCATAAAAAAATTCAAGTTAAATGCATTTTATAAAAATGTAGGAAAAACTTTCAACAAAAATCGTTGAGAAGAACATACAGTATATCTTATCCACTCTCTTCCTCATCCACGCGGCAAAGGCACAAACCTCTTTAGAAAAATGTCGTCAGCTTATTGTTCCTCCGCCGTGGCTGTATCCGCCGCAGCCACCGCTTCCTCCGCCGCTACCTTTAATCCATTACTCTCCTCCCACTCCAATTCCCAACTCTTCTATCGCTTTACACCAAAATCCTTCAAACTCGTTGCCAATTGCCCTAATCCACTAATCCTCCACTCAAATATCCGCCGCCACCGCTTCTTCTGCGCCGCCGAAACCGAAGCTAGTTCCGCCGATGATGAAATCCAGGCATCAGTAGAAGAAGAAGAAGAGGTAGAAGAAGAAGGAGATGAAGGTGAAGAAGAAGTAGAGGAAGAAAAACAGACGACGCAAGCGAGTGGTGAAGAAGGGAGGCTTTACGTTGGGAATTTACCTTACACAATCACTTCTTCTGAGCTCTCTCAGATTTTTGGAGAAGCTGGAACTGTCGTCGATGTTCAGATTGTTTATGATAAAGTTACTGATAGAAGCAGAGGATTTGGATTTGTAACAATGGGAAGCATTGAAGAAGCTAAAGAAGCGATGCAGATGTTTAACAGCTCTCAAATTGGTGGTAGAACGGTGAAAGTGAACTTCCCGGAGGTGCCGAGAGGCGGTGAGAACGAAGTAATGAGAACCAAAATCCGTGATAATAACCGGAGTTATGTTGATAGTCCTCATAAGGTATATGCAGGAAACCTTGGTTGGAATCTAACCTCACAAGGTTTAAAGGATGCATTTGGTGATCAACCTGGTGTGCTTGGTGCTAAAGTTATCTATGAAAGAAATACTGGGAGGTCTAGGGGGTTTGGTTTCATCTCGTTCGAGTCAGCGGAAAATGTTCAGTCTGCTTTGGCTACAATGAATGGCGTGGAAGTTGAAGGACGAGCGCTGAGGCTAAATTTGGCTTCAGAGAGAGAGAAACCCACTGTGTCTCCTCCTTCCGTAGAAGAAGGAGAAACCGAGGAGGCCAGTCTAGAGAGTAACGAGGTGCTTTCGAATGTTAGTGCATGAAGCAGCAAAAGCACAATAGATTCCGGATAAGTTTCAGACTGATCTGCTCGAGGTGCCAAAAATGAAAATTTTGTTGTCTTTATAAATGTGTTGTTTTGTTCTAGTGAGGCTGAAGAAGAAGACAATATATGAGATAGAAAACAAGAGATTGTTTGTAATTTTTATTGAGAATGTTTTTAATCCATAAATGGTGTAATGTAACAACATATCTTGATTCCAGTAAACTGCAAATTTCTG

SEQ ID NO: 337 - DNA, 1164 bp, Arabidopsis thaliana
  misc_feature (1)..(1164): Ceres cDNA ID no. 12325990
  misc_feature (1)..(1164): Ceres CLONE  ID no. 30064
  misc_feature (1)..(1164): Also known as  Ceres CDNA ID no. 23361125
gaaacttagagagacagagagagagaaagctcaaattcaatcatcaatgttaacggacgagagagaagtagtctgtgtcaccggcgccagtggctgcatcggctcgtggctggtccatcagctcctcctccgcggctactccgtccacgccaccgtgaaaaacctccaggatgagaaagagacgaaacatctagaaggtctcgaaggtgcagccacacgcctccatctattcgagatggatctcctacaatacgacaccgtttccgccgccatcaatggttgctccggcgtattccacctcgcatcaccttgtatcgtcgatgaagtccaagatccccagaagcaactacttgacccggcggttaaaggaaccataaatgttctgacggcggcaaaagaagccagtgttaagagagttgttgtgacgtcttcgatatcggcgattactccaagtcccaactggcctgctgataagatcaagaatgaggaatgttgggctgctgaagactactgcaggcaaaatggattgtggtatccactgtcgaagacgcttgctgagaaggcagcttgggaatttgcagaggagaaaggattggatgtggttgtggtgaatccaggcactgtcatggggcctgtgattcctccgtctcttaacgctagcatgcacatgcttctacgccttcttcaggggtgcacggagacatacgagaacttctttatggggtctgtgcatttcaaggatgtggctttagctcatattcttgtatacgaggatccatattcgaaaggaaggcacttgtgcgttgaggctatctctcactacggtgattttgtagccaaagttgctgagctctatcccaattacaatgtccccaagttaccgagagagactcaaccgggtttacttcgagataagaatgcatcaaagaagctcatagatttggggttaaagttcatttccatggaggaaatcatcaaggaaggtgtggagagtcttaaaagcaaaggatttatctcttaatacctacctctgtaactctgtttgattgagcaattaacacaatctctaggcagcagaaacatttcatatgatatacgattttgcacttttgtaataaataagctggcctatggtatggtatgaacatccaattaatatttatt

SEQ ID NO: 338 - protein, 1164 aa, Arabidopsis thaliana
  misc_feature: PFam Name: Epimerase; PFam Description: NAD dependent
  misc_feature: PFam Name: 3Beta_HSD; PFam Description: 3-beta
  misc_feature: PFam Name: Polysacc_synt_2; PFam Description: Polysaccharide
  misc_feature: PFam Name: NAD_binding_4; PFam Description: Male sterility protein
  misc_feature: GI Number: 21592589; NR Description: cinnamoyl-CoA reductase-like protein [Arabidopsis thaliana] >gi|10177026|dbj|BAB10264.1| dihydroflavonol 4-reductase-like [Arabidopsis thaliana] >gi|27754235|gb|AAO22571.1| putative
  misc_feature: GI Number: 47900734; NR Description: putative cinnamoyl-CoA
  misc_feature: GI Number: 50919439; NR Description: putative cinnamoyl-CoA reductase [Oryza sativa (japonica cultivar-group)] >gi|28876000|gb|AAO60009.1| putative cinnamoyl-CoA reductase [Oryza sativa (japonica cultivar-group)]
  misc_feature: GI Number: 29824207; NR Description: putative cinnamoyl-CoA reductase [Arabidopsis thaliana] >gi|28973736|gb|AAO64184.1| putative cinnamoyl-CoA reductase [Arabidopsis thaliana] >gi|3894172|gb|AAC78522.1| putative cinnamoyl-CoA reductase
  misc_feature: GI Number: 34907928; NR Description: putative cinnamoyl CoA reductase [Oryza sativa (japonica cultivar-group)] >gi|15624051|dbj|BAB68104.1| putative cinnamoyl CoA reductase
GAAACTTAGAGAGACAGAGAGAGAGAAAGCTCAAATTCAATCATCAATGTTAACGGACGAGAGAGAAGTAGTCTGTGTCACCGGCGCCAGTGGCTGCATCGGCTCGTGGCTGGTCCATCAGCTCCTCCTCCGCGGCTACTCCGTCCACGCCACCGTGAAAAACCTCCAGGATGAGAAAGAGACGAAACATCTAGAAGGTCTCGAAGGTGCAGCCACACGCCTCCATCTATTCGAGATGGATCTCCTACAATACGACACCGTTTCCGCCGCCATCAATGGTTGCTCCGGCGTATTCCACCTCGCATCACCTTGTATCGTCGATGAAGTCCAAGATCCCCAGAAGCAACTACTTGACCCGGCGGTTAAAGGAACCATAAATGTTCTGACGGCGGCAAAAGAAGCCAGTGTTAAGAGAGTTGTTGTGACGTCTTCGATATCGGCGATTACTCCAAGTCCCAACTGGCCTGCTGATAAGATCAAGAATGAGGAATGTTGGGCTGCTGAAGACTACTGCAGGCAAAATGGATTGTGGTATCCACTGTCGAAGACGCTTGCTGAGAAGGCAGCTTGGGAATTTGCAGAGGAGAAAGGATTGGATGTGGTTGTGGTGAATCCAGGCACTGTCATGGGGCCTGTGATTCCTCCGTCTCTTAACGCTAGCATGCACATGCTTCTACGCCTTCTTCAGGGGTGCACGGAGACATACGAGAACTTCTTTATGGGGTCTGTGCATTTCAAGGATGTGGCTTTAGCTCATATTCTTGTATACGAGGATCCATATTCGAAAGGAAGGCACTTGTGCGTTGAGGCTATCTCTCACTACGGTGATTTTGTAGCCAAAGTTGCTGAGCTCTATCCCAATTACAATGTCCCCAAGTTACCGAGAGAGACTCAACCGGGTTTACTTCGAGATAAGAATGCATCAAAGAAGCTCATAGATTTGGGGTTAAAGTTCATTTCCATGGAGGAAATCATCAAGGAAGGTGTGGAGAGTCTTAAAAGCAAAGGATTTATCTCTTAATACCTACCTCTGTAACTCTGTTTGATTGAGCAATTAACACAATCTCTAGGCAGCAGAAACATTTCATATGATATACGATTTTGCACTTTTGTAATAAATAAGCTGGCCTATGGTATGGTATGAACATCCAATTAATATTTATT

SEQ ID NO: 339 - DNA, 1197 bp, Arabidopsis thaliana
  misc_feature (1)..(1197): Ceres cDNA ID no. 12326979
  misc_feature (1)..(1197): Ceres CLONE  ID no. 40538
  misc_feature (1)..(1197): Also known as  Ceres CDNA ID no. 23648217
aaaaagttttcattcttcctccactctctcaattccaaaacactgcgccgggaagacatggacaccgagatggagacagaacaaatataccaggtcgatgtcggaaatctcttggctttcaatcccaatcaccgcttctcatctgctccttcttcaaggggggagcttgtgaaggagatcctaacggagggaacaaaacttgttcaggaaatagccaataaacttttcaactttccttctactgaaacaaatgatggtcctattgtccaattgcctccgcctacaaccaaacttcctagagagaaacatattccaaggcctaagcctcctacgaagtgggaagagtttgcgcttaagaaaggtatacagaagcgcaagaaggaaaaagttgtatgggatgaacaaactaatcagtttaagcgtcgccatggttatgaccgtgttaacgatgataatgatgttcccatcattgaggcgaaagaatcagatgaaccaggagtagatccttttgccaagagactagatgataagaagaagagagttggaaagcaagaaaagaatagacttcagaatctgaaggctgctgaaaaagctggtgctttaccaagccatgtccaacttgctgcaacatcattgcccatatcaggaacgaaagctcaaccaaagaaaattggaaaggatgaacttggagatgtagcaggtttagccgctacttcaaccgctagtggtggaaaattcgataaaaagttgcctggagaaaaacctccaaagaagcagggcaaacatcacaagtatttaccggttgtatcagggcgtggggatgttaacgcagaaaaagaacagacaaataatgtactcagcaagatattctcaaagcattcgcatgagatcctcaatgttggcaaggcgataaacatgtacaacgtcaagaaggagaagaagaagtcaggaaggtcagacaagttgaaacctaagaaggacatcaccaagaagcctgccaacaaagccaagtgaagagactctcccatgtctaatttactcttctatctgtctccatcttctatcacaaaacaaattttgggttgctctgttaaagtaatactttatgagtacgtttattttaatcttattgacttcatattttgcaccataaaacaatttaaagctcgcaaggtctagaaatccagtttgattttc

SEQ ID NO: 340 - protein, 1197 aa, Arabidopsis thaliana
  misc_feature: PFam Name: RRS1; PFam Description: Ribosome biogenesis
  misc_feature: GI Number: 18404610; NR Description: ribosome biogenesis
  misc_feature: GI Number: 21593609; NR Description: unknown [Arabidopsis thaliana]
  misc_feature: GI Number: 47940235; NR Description: MGC78981 protein
  misc_feature: GI Number: 45709905; NR Description: Unknown (protein for
  misc_feature: GI Number: 41056045; NR Description: Ribosome biogenesis regulatory protein homolog; wu:fj66c04 [Danio rerio] >gi|33585885|gb|AAH55615.1| Ribosome biogenesis regulatory protein
AAAAAGTTTTCATTCTTCCTCCACTCTCTCAATTCCAAAACACTGCGCCGGGAAGACATGGACACCGAGATGGAGACAGAACAAATATACCAGGTCGATGTCGGAAATCTCTTGGCTTTCAATCCCAATCACCGCTTCTCATCTGCTCCTTCTTCAAGGGGGGAGCTTGTGAAGGAGATCCTAACGGAGGGAACAAAACTTGTTCAGGAAATAGCCAATAAACTTTTCAACTTTCCTTCTACTGAAACAAATGATGGTCCTATTGTCCAATTGCCTCCGCCTACAACCAAACTTCCTAGAGAGAAACATATTCCAAGGCCTAAGCCTCCTACGAAGTGGGAAGAGTTTGCGCTTAAGAAAGGTATACAGAAGCGCAAGAAGGAAAAAGTTGTATGGGATGAACAAACTAATCAGTTTAAGCGTCGCCATGGTTATGACCGTGTTAACGATGATAATGATGTTCCCATCATTGAGGCGAAAGAATCAGATGAACCAGGAGTAGATCCTTTTGCCAAGAGACTAGATGATAAGAAGAAGAGAGTTGGAAAGCAAGAAAAGAATAGACTTCAGAATCTGAAGGCTGCTGAAAAAGCTGGTGCTTTACCAAGCCATGTCCAACTTGCTGCAACATCATTGCCCATATCAGGAACGAAAGCTCAACCAAAGAAAATTGGAAAGGATGAACTTGGAGATGTAGCAGGTTTAGCCGCTACTTCAACCGCTAGTGGTGGAAAATTCGATAAAAAGTTGCCTGGAGAAAAACCTCCAAAGAAGCAGGGCAAACATCACAAGTATTTACCGGTTGTATCAGGGCGTGGGGATGTTAACGCAGAAAAAGAACAGACAAATAATGTACTCAGCAAGATATTCTCAAAGCATTCGCATGAGATCCTCAATGTTGGCAAGGCGATAAACATGTACAACGTCAAGAAGGAGAAGAAGAAGTCAGGAAGGTCAGACAAGTTGAAACCTAAGAAGGACATCACCAAGAAGCCTGCCAACAAAGCCAAGTGAAGAGACTCTCCCATGTCTAATTTACTCTTCTATCTGTCTCCATCTTCTATCACAAAACAAATTTTGGGTTGCTCTGTTAAAGTAATACTTTATGAGTACGTTTATTTTAATCTTATTGACTTCATATTTTGCACCATAAAACAATTTAAAGCTCGCAAGGTCTAGAAATCCAGTTTGATTTTC

SEQ ID NO: 341 - DNA, 1056 bp, Arabidopsis thaliana
  misc_feature (1)..(1056): Ceres cDNA ID no. 12327024
  misc_feature (1)..(1056): Ceres CLONE  ID no. 20695
  misc_feature (1)..(1056): Also known as  Ceres CDNA ID no. 23362053
gatgggtgataggaaacaaacacacatacgtcatcatcatccttaatttctatttctccttcttcttcatcatcaatatcaatctcatcttccactactcctcccctctaacaataagcagcatctctataatccctaagattcacaatggagcttggaggaaaatgcaatgcaattacaaccacaacaataatctcaacagaagtaaagccacatacggatccggaaccagaagccaaacccgaatcagatccatccatggctttattcccgatcaagaaagaaaaccaaaaaccaaagacacgtgtcgaccaaggagctaagtaccgggaatgtcagaagaaccacgcggcctcaaccggaggacacgtggtggacggatgctgcgagttcatggccggcggagaagaaggtacactcggtgctttaaaatgcgccgcctgtaactgtcaccggagcttccaccggaaagaagtgtacggacacatgaacagtaaacaagattatcagctgatgataactccggcgttttacagcagtaacagctcgtacaagccacgtgtaatgcatccaacgggtgagattggacggaggacttcatcttcaagcgaggatatgaagaagattctgagtcatcgtaaccaaaacgttgatgggaaaagtttgatgatgatgatgatgaggaagaagaagagagtgaggacaaagatcaatgaagaacaaaaggagaagatgaaggaatttgcagagagattagggtggaggatgcagaagaaagatgaagaagagattgataagttttgtaggatggtgaatctgaggagacaagtttttaaggtttggatgcataataacaagcaagcaatgaagagaaacaatagtaacattagtgaatagtttgatgatctgataaaagtgaaataaatttttacaatcctgttttgcttttatatataatttttgcccttcaaattattcaaaatcttgagtataaatctgtggaatcttgtatgttttgattgttttatattgtatctgggattatttttttctttt

SEQ ID NO: 342 - protein, 1056 aa, Arabidopsis thaliana
  misc_feature: PFam Name: ZF-HD_dimer; PFam Description: ZF-HD protein
  misc_feature: PFam Name: Homeobox; PFam Description: Homeobox domain
  misc_feature: GI Number: 21554149; NR Description: unknown [Arabidopsis thaliana]
  misc_feature: GI Number: 50900288; NR Description: putative ZF-HD homeobox protein [Oryza sativa (japonica cultivar-group)] >gi|46806323|dbj|BAD17515.1| putative ZF-HD homeobox protein [Oryza
  misc_feature: GI Number: 50946893; NR Description: putative ZF-HD homeobox protein [Oryza sativa (japonica cultivar-group)] >gi|42408573|dbj|BAD09750.1| putative ZF-HD homeobox protein [Oryza
  misc_feature: GI Number: 13374061; NR Description: ZF-HD homeobox protein
  misc_feature: GI Number: 5091602; NR Description: 10A19I.6 [Oryza sativa
GATGGGTGATAGGAAACAAACACACATACGTCATCATCATCCTTAATTTCTATTTCTCCTTCTTCTTCATCATCAATATCAATCTCATCTTCCACTACTCCTCCCCTCTAACAATAAGCAGCATCTCTATAATCCCTAAGATTCACAATGGAGCTTGGAGGAAAATGCAATGCAATTACAACCACAACAATAATCTCAACAGAAGTAAAGCCACATACGGATCCGGAACCAGAAGCCAAACCCGAATCAGATCCATCCATGGCTTTATTCCCGATCAAGAAAGAAAACCAAAAACCAAAGACACGTGTCGACCAAGGAGCTAAGTACCGGGAATGTCAGAAGAACCACGCGGCCTCAACCGGAGGACACGTGGTGGACGGATGCTGCGAGTTCATGGCCGGCGGAGAAGAAGGTACACTCGGTGCTTTAAAATGCGCCGCCTGTAACTGTCACCGGAGCTTCCACCGGAAAGAAGTGTACGGACACATGAACAGTAAACAAGATTATCAGCTGATGATAACTCCGGCGTTTTACAGCAGTAACAGCTCGTACAAGCCACGTGTAATGCATCCAACGGGTGAGATTGGACGGAGGACTTCATCTTCAAGCGAGGATATGAAGAAGATTCTGAGTCATCGTAACCAAAACGTTGATGGGAAAAGTTTGATGATGATGATGATGAGGAAGAAGAAGAGAGTGAGGACAAAGATCAATGAAGAACAAAAGGAGAAGATGAAGGAATTTGCAGAGAGATTAGGGTGGAGGATGCAGAAGAAAGATGAAGAAGAGATTGATAAGTTTTGTAGGATGGTGAATCTGAGGAGACAAGTTTTTAAGGTTTGGATGCATAATAACAAGCAAGCAATGAAGAGAAACAATAGTAACATTAGTGAATAGTTTGATGATCTGATAAAAGTGAAATAAATTTTTACAATCCTGTTTTGCTTTTATATATAATTTTTGCCCTTCAAATTATTCAAAATCTTGAGTATAAATCTGTGGAATCTTGTATGTTTTGATTGTTTTATATTGTATCTGGGATTATTTTTTTCTTTT

SEQ ID NO: 343 - DNA, 1065 bp, Arabidopsis thaliana
  misc_feature (1)..(1065): Ceres cDNA ID no. 12327094
  misc_feature (1)..(1065): Ceres CLONE  ID no. 4845
  misc_feature (1)..(1065): Also known as  Ceres CDNA ID no. 23362114
atcatcttcattttctctataggtttatgagaagctaaagctatgatgatttctttaatcaaaatagcttagggttttggagagagattactaagaaagttttaatgtttgtttaagagaaaagttatatattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtgagagatttctatatatatatatatactatttttacttctctttgttcaacattgctttaacttaaagactttgtgtttattgtataacaaattgattttagagccc

SEQ ID NO: 344 - protein, 1065 aa, Arabidopsis thaliana
  misc_feature: PFam Name: ZF-HD_dimer; PFam Description: ZF-HD protein
  misc_feature: PFam Name: Homeobox; PFam Description: Homeobox domain
  misc_feature: GI Number: 21554149; NR Description: unknown [Arabidopsis thaliana]
  misc_feature: GI Number: 50900288; NR Description: putative ZF-HD homeobox protein [Oryza sativa (japonica cultivar-group)] >gi|46806323|dbj|BAD17515.1| putative ZF-HD homeobox protein [Oryza
  misc_feature: GI Number: 50946893; NR Description: putative ZF-HD homeobox protein [Oryza sativa (japonica cultivar-group)] >gi|42408573|dbj|BAD09750.1| putative ZF-HD homeobox protein [Oryza
  misc_feature: GI Number: 13374061; NR Description: ZF-HD homeobox protein
  misc_feature: GI Number: 13277220; NR Description: ZF-HD homeobox protein
ATCATCTTCATTTTCTCTATAGGTTTATGAGAAGCTAAAGCTATGATGATTTCTTTAATCAAAATAGCTTAGGGTTTTGGAGAGAGATTACTAAGAAAGTTTTAATGTTTGTTTAAGAGAAAAGTTATATATTAGGGTTTTCTTTATTCAGAAGCTTCAAGATCAGAAAAGATGGAAGTTAGAGAGAAGAAAGATGAGAAAATGGAGATGACAAGAAGAAAATCATCAGCTCTAGATCATCATCGTCTTCCTCCGTACACTTACTCCCAAACCGCCAACAAAGAGAAACCCACCACCAAAAGAAACGGGTCGGACCCGGATCCGGATCCGGATCTTGATACTAACCCAATTTCTATATCTCATGCTCCAAGATCATACGCTAGGCCTCAAACTACTTCTCCGGGGAAGGCAAGGTATAGAGAATGCCAAAAGAATCACGCGGCGAGCTCCGGTGGACACGTTGTCGACGGTTGCGGCGAGTTTATGTCTTCCGGGGAAGAAGGCACGGTGGAGTCTCTTCTTTGTGCAGCTTGTGATTGCCACCGGAGCTTCCATAGAAAAGAGATCGATGGTTTGTTTGTTGTCAATTTCAATAGCTTTGGCCATTCACAGAGACCACTCGGAAGCCGCCACGTGTCTCCGATAATGATGAGTTTTGGTGGTGGTGGTGGTTGTGCGGCGGAGTCATCGACGGAGGATCTAAACAAGTTTCATCAATCTTTTAGTGGTTATGGAGTGGATCAGTTTCATCATTATCAACCCAAGAAACGGTTTAGGACAAAGTTTAATGAAGAACAGAAGGAGAAGATGATGGAGTTTGCTGAGAAGATTGGTTGGAGAATGACAAAACTAGAAGATGATGAAGTGAATCGGTTTTGTCGTGAGATTAAAGTTAAAAGACAAGTGTTTAAAGTTTGGATGCACAACAATAAACAAGCAGCAAAGAAGAAGGATTTGTGAGAGATTTCTATATATATATATATACTATTTTTACTTCTCTTTGTTCAACATTGCTTTAACTTAAAGACTTTGTGTTTATTGTATAACAAATTGATTTTAGAGCCC

SEQ ID NO: 345 - DNA, 1251 bp, Arabidopsis thaliana
  misc_feature (1)..(1251): Ceres cDNA ID no. 12327166
  misc_feature (1)..(1251): Ceres CLONE  ID no. 1490
  misc_feature (1)..(1251): Also known as  Ceres CDNA ID no. 24419359
accctctgttttgtttctccccaataaaaaaaatctcaatcccaatcacttcgcttctaatcttaaagcctttaatttagtcttcgagccctctaatggcggatcagagcaaaaacactccagagatcttcgagctcaacaatggcaccatgcaggtcaagatctcaaactacggcaccaccatcacctctttgtctgttcccgacaagaacgggaaactgggggatgtagttctcggattcgactcggtggatccatatgtgaaagggcttgcaccatactttgggtgcattgttggtcgtgtggcaaatcggatcaaggagggaaaattcagtctcaatggagttaactacactttgcctatcaacaagcctcctaatagtctccacggtggtaacaagggtttcgataagaagatatgggaagttgcagggcacaagagagacggcgaaaaacctttcatcactttcaaatatcacagtgccgatggagaagaaggttaccctggtgcggtttctgtcacggcgacatacactctcacgtcagccacgacaatgagacttgacatggaagctgttccagagaacaaagatactcccatcaacttagctcaacatacatactggaacttagcaggtcatgactcaggaaacattctagaccataagattcagatatgggggtctcatatcacgccggttgacgaatacacagttcctacaggagagatcttgcctgtaaagggaactcctttcgatttcactgaggagaagcggataggcgagtctattggagaggttggtatcggatacgatcataactacgtgttggactgtcctgatcaagagaaggaggggctgaaacacgcagcgaagctcagtgatgctgctagctcaagggtactgaacttgtggaccaatgtgccgggaatgcagttttataccgggaactatgtgaatggagtggttgggaaagggaatgcggtttacgggaaacatgcgggtgtgtgccttgagacgcagggattcccgaacgcgattaaccagtcgaatttcccgtctgttgtggttaaggctggtgagaagtacaatcacacgatgctgtttgagttttcagcttgagtttatagatggacgttttaggtgttagatgatgggaataaagggccggttcatttgattcactgggctggaaaaagagtgattttaattttatctctttgggggagaataataaaaccaaactgtttac

SEQ ID NO: 346 - protein, 1251 aa, Arabidopsis thaliana
  misc_feature: PFam Name: Aldose_epim; PFam Description: Aldose 1-epimerase
  misc_feature: GI Number: 9294498; NR Description: aldose 1-epimerase-like protein [Arabidopsis thaliana] >gi|30684727|ref|NP_566594.2| aldose
  misc_feature: GI Number: 14532616; NR Description: putative aldose 1-epimerase [Arabidopsis thaliana] >gi|25054834|gb|AAN71907.1|
  misc_feature: GI Number: 31430258; NR Description: putative aldose 1-epimerase - like protein [Oryza sativa (japonica cultivar-group)] gi|37531218|ref|NP_919911.1| putative aldose 1-epimerase - like protein [Oryza sativa (japonica cultivar-group)] protein [Oryza
  misc_feature: GI Number: 21537069; NR Description: aldose 1-epimerase-like
  misc_feature: GI Number: 2739168; NR Description: aldose-1-epimerase-like protein [Nicotiana tabacum] >gi|7430313|pir||T01933 probable aldose
ACCCTCTGTTTTGTTTCTCCCCAATAAAAAAAATCTCAATCCCAATCACTTCGCTTCTAATCTTAAAGCCTTTAATTTAGTCTTCGAGCCCTCTAATGGCGGATCAGAGCAAAAACACTCCAGAGATCTTCGAGCTCAACAATGGCACCATGCAGGTCAAGATCTCAAACTACGGCACCACCATCACCTCTTTGTCTGTTCCCGACAAGAACGGGAAACTGGGGGATGTAGTTCTCGGATTCGACTCGGTGGATCCATATGTGAAAGGGCTTGCACCATACTTTGGGTGCATTGTTGGTCGTGTGGCAAATCGGATCAAGGAGGGAAAATTCAGTCTCAATGGAGTTAACTACACTTTGCCTATCAACAAGCCTCCTAATAGTCTCCACGGTGGTAACAAGGGTTTCGATAAGAAGATATGGGAAGTTGCAGGGCACAAGAGAGACGGCGAAAAACCTTTCATCACTTTCAAATATCACAGTGCCGATGGAGAAGAAGGTTACCCTGGTGCGGTTTCTGTCACGGCGACATACACTCTCACGTCAGCCACGACAATGAGACTTGACATGGAAGCTGTTCCAGAGAACAAAGATACTCCCATCAACTTAGCTCAACATACATACTGGAACTTAGCAGGTCATGACTCAGGAAACATTCTAGACCATAAGATTCAGATATGGGGGTCTCATATCACGCCGGTTGACGAATACACAGTTCCTACAGGAGAGATCTTGCCTGTAAAGGGAACTCCTTTCGATTTCACTGAGGAGAAGCGGATAGGCGAGTCTATTGGAGAGGTTGGTATCGGATACGATCATAACTACGTGTTGGACTGTCCTGATCAAGAGAAGGAGGGGCTGAAACACGCAGCGAAGCTCAGTGATGCTGCTAGCTCAAGGGTACTGAACTTGTGGACCAATGTGCCGGGAATGCAGTTTTATACCGGGAACTATGTGAATGGAGTGGTTGGGAAAGGGAATGCGGTTTACGGGAAACATGCGGGTGTGTGCCTTGAGACGCAGGGATTCCCGAACGCGATTAACCAGTCGAATTTCCCGTCTGTTGTGGTTAAGGCTGGTGAGAAGTACAATCACACGATGCTGTTTGAGTTTTCAGCTTGAGTTTATAGATGGACGTTTTAGGTGTTAGATGATGGGAATAAAGGGCCGGTTCATTTGATTCACTGGGCTGGAAAAAGAGTGATTTTAATTTTATCTCTTTGGGGGAGAATAATAAAACCAAACTGTTTAC

SEQ ID NO: 347 - DNA, 1157 bp, Arabidopsis thaliana
  misc_feature (1)..(1157): Ceres cDNA ID no. 12327414
  misc_feature (1)..(1157): Ceres CLONE  ID no. 23733
  misc_feature (1)..(1157): Also known as  Ceres CDNA ID no. 23362416
atcatctcttttgattttgattgtgcttctgcaacctttgatactctctctgaagctctgaggaagacatgatttcgtctctctcagcttcttcttcattggtttcttctttcgtcgccgttaaagcgactccggtcaccggacctctgattccccgtcgcgatcttctttctattcgtatcagagctagctcgaatcagaatagttctggttattgttttccagaaaagtttaaatcttttgccaaatcagcgattctcatcggtgctgctgtttcaatgaccggaaagttttcaactttaccggttaaagccgagtctccggttacgactatcgaaaagacctacgaggaagtgaaagaagagaaactgtctgagatcacgccattatctgagcttttggattccactcctgaggccgtcgagacgctgagatcactcctgcagcagaagctagagaagggagaagatgaagaagctcttaagctattagagagactagtagctgcacaaccagaagaaacagagtggaagttcttaatggcgaggctgttaggcgaaatgggtcgtcccgaaaacgcacgccagatgttcgaggaaattctccaaagaaacccactttcgtttgaggctttattcgagaatgcattgctcatggacaggtccggggaaggaaatgcagtgctgcagaggctagaagatgctttagctgtagctgaggctgagtatttggtgaaggaagcgagagatgtgagactgatcattgcgcagatacatttcttgcagaagaatgtggatgaagcattgaagagctacgagcagctgacgaaagaggatcctaaggatttcagaccgtatttctgtcgaggtatgatctatagcttgcttgacaagaacgttgaagctaaggaacagtttgctaagtacagagagctctctccaaagaaatttgaagtagaagggtacttgaggactccattgtctaaaatgaagctttttggtggtagtgaggagaactaagttagtacgatagctttaaatcatatcagaagaataagacactggaagataatgttgtttccctgagaaattatgctgtgattttgctttgttgaattgaactttgaaactcaaccatttttggatcttgttttgttt

SEQ ID NO: 348 - protein, 1157 aa, Arabidopsis thaliana
  misc_feature: PFam Name: TPR_1; PFam Description: Tetratricopeptide repeat
  misc_feature: PFam Name: TPR_2; PFam Description: Tetratricopeptide repeat
  misc_feature: GI Number: 21617936; NR Description: unknown [Arabidopsis thaliana]
  misc_feature: GI Number: 28416459; NR Description: At4g39470/F23K16_100 [Arabidopsis thaliana] >gi|15215656|gb|AAK91373.1| AT4g39470/F23K16_100 [Arabidopsis thaliana] >gi|18420460|ref|NP_568061.1| chloroplast lumen common family
  misc_feature: GI Number: 57900694; NR Description: unknow protein [Oryza
  misc_feature: GI Number: 21553360; NR Description: unknown [Arabidopsis thaliana] >gi|18413971|ref|NP_568104.1| chloroplast lumen common
ATCATCTCTTTTGATTTTGATTGTGCTTCTGCAACCTTTGATACTCTCTCTGAAGCTCTGAGGAAGACATGATTTCGTCTCTCTCAGCTTCTTCTTCATTGGTTTCTTCTTTCGTCGCCGTTAAAGCGACTCCGGTCACCGGACCTCTGATTCCCCGTCGCGATCTTCTTTCTATTCGTATCAGAGCTAGCTCGAATCAGAATAGTTCTGGTTATTGTTTTCCAGAAAAGTTTAAATCTTTTGCCAAATCAGCGATTCTCATCGGTGCTGCTGTTTCAATGACCGGAAAGTTTTCAACTTTACCGGTTAAAGCCGAGTCTCCGGTTACGACTATCGAAAAGACCTACGAGGAAGTGAAAGAAGAGAAACTGTCTGAGATCACGCCATTATCTGAGCTTTTGGATTCCACTCCTGAGGCCGTCGAGACGCTGAGATCACTCCTGCAGCAGAAGCTAGAGAAGGGAGAAGATGAAGAAGCTCTTAAGCTATTAGAGAGACTAGTAGCTGCACAACCAGAAGAAACAGAGTGGAAGTTCTTAATGGCGAGGCTGTTAGGCGAAATGGGTCGTCCCGAAAACGCACGCCAGATGTTCGAGGAAATTCTCCAAAGAAACCCACTTTCGTTTGAGGCTTTATTCGAGAATGCATTGCTCATGGACAGGTCCGGGGAAGGAAATGCAGTGCTGCAGAGGCTAGAAGATGCTTTAGCTGTAGCTGAGGCTGAGTATTTGGTGAAGGAAGCGAGAGATGTGAGACTGATCATTGCGCAGATACATTTCTTGCAGAAGAATGTGGATGAAGCATTGAAGAGCTACGAGCAGCTGACGAAAGAGGATCCTAAGGATTTCAGACCGTATTTCTGTCGAGGTATGATCTATAGCTTGCTTGACAAGAACGTTGAAGCTAAGGAACAGTTTGCTAAGTACAGAGAGCTCTCTCCAAAGAAATTTGAAGTAGAAGGGTACTTGAGGACTCCATTGTCTAAAATGAAGCTTTTTGGTGGTAGTGAGGAGAACTAAGTTAGTACGATAGCTTTAAATCATATCAGAAGAATAAGACACTGGAAGATAATGTTGTTTCCCTGAGAAATTATGCTGTGATTTTGCTTTGTTGAATTGAACTTTGAAACTCAACCATTTTTGGATCTTGTTTTGTTT

SEQ ID NO: 349 - DNA, 1722 bp, Arabidopsis thaliana
  misc_feature (1)..(1722): Ceres cDNA ID no. 12327448
  misc_feature (1)..(1722): Ceres CLONE  ID no. 25703
  misc_feature (1)..(1722): Also known as  Ceres CDNA ID no. 23362449
agagctggatgttttttcctctataaacctcttttgctttctctcttcgtctctgaccactttggctccggcgttagttttttccctctctgctactgctgcggctccggctcctgctacggtatttgacaagtgtgttgacattctctcataacaattcaaatgggtgactcggaaaacgttcagcaaccttcaaaaaagagaggtgccttgaagcagctgtctcgtgataatccaggtcttgatgatgatgatgattcagctgaacttgagagtggaactttcaagaaggccagtgatgaggttttggctagtagaagaattgtcagagttaagcgcaaagagccatctgctgctccagttgcagcatccaatccatttgctggaattcagttggtccctacgactgcacctgcttcaacccctgtgggaacaaatgcacctctggctgagtcaaaattggctccagctgaagcagtagttgaggacaatcaaaaagcaagtgatattgaggagggcgatgaagttgacagtaagaaggttgatgtcaaagatgctgttggggaagagactgaaaagactaaagataaggatgataatcattgtggaaagagtgctgatgtccaagttgcggctacagaagtagctcagatggtctcatgtgacacaaacgtttgcaacaacgctgttgaaggaacagaccaaactgattttcctcttgagaaggattcaggaggtgatcaggctgagaaaaaagaaaaagaaggcaacggaattgaggaagcagataagaatggcgataatggtgctttcagctcattccaacagcattcaagtaacaaaaacgcattcaccggacttgccagtacagaggcttcagggtcttcgttctcatttggtttggtttctcaggatggttcaactggtactgggtctctctttggctttggccttccaagcagcaatagctcttctatattcggtgcaactggatcgtccattatcaagaagagtgaaggtagtgggtttccgccaaagcaagaggtttccacagaaacaggtgaagagaatgagaaagttgccttctcagctgactcgatcatgttcgaatatcttgatggaggatggaaagagcgtggaaaaggagaactcaaggtaaacgtctccagtaatgatggtaaagcaagattagttatgagagctaaaggaaactacagattgatcttaaacgcgagtctttacccagagatgaaacttgcaaacatggataaaaagggaatcacattcgcttgtgtgaatagtgtaagcgaaggcaaagaaggtctctctacatttgcactgaagttcaaagacccgacaattgttgaagagtttcgtgtagccattgacaaacacaaagatagtaaaccaatggagaaagcagcagaaaaatcagctcttcctctgaagacacctgagaactctccaacagctacagatacttgaagaaaaggtaaaaagaaaaaaagaaaaaacatgtagaaacacttctctcgtctctctcgtctctcttgtcttttgtcttgtcttgttacttccaagtagttgaattttgaggcagaggaaaactaaaatatttggagaagtttgttgttttttttacacagttgttgagactttttggttacatgtttctgtttgtagaaggaaaccatatatgacttaaatctgcatccttgattt

SEQ ID NO: 350 - protein, 1722 aa, Arabidopsis thaliana
  misc_feature: PFam Name: Ran_BP1; PFam Description: RanBP1 domain
  misc_feature: GI Number: 21536684; NR Description: unknown [Arabidopsis thaliana]
  misc_feature: GI Number: 31205915; NR Description: ENSANGP00000010912 [Anopheles gambiae] >gi|21295390|gb|EAA07535.1| ENSANGP00000010912
  misc_feature: GI Number: 6382079; NR Description: RAN binding protein 2; nucleoporin 358; nuclear pore complex protein Nup358; P270 [Homo sapiens] >gi|2136081|pir||S58884 Ran-binding protein 2 - human >gi|1009337|dbj|BAA07662.1| RanBP2 (Ran-binding protein 2) [Homo
  misc_feature: GI Number: 1098322; NR Description: Ran/TC4-binding
  misc_feature: GI Number: 62088546; NR Description: RAN binding protein 2
AGAGCTGGATGTTTTTTCCTCTATAAACCTCTTTTGCTTTCTCTCTTCGTCTCTGACCACTTTGGCTCCGGCGTTAGTTTTTTCCCTCTCTGCTACTGCTGCGGCTCCGGCTCCTGCTACGGTATTTGACAAGTGTGTTGACATTCTCTCATAACAATTCAAATGGGTGACTCGGAAAACGTTCAGCAACCTTCAAAAAAGAGAGGTGCCTTGAAGCAGCTGTCTCGTGATAATCCAGGTCTTGATGATGATGATGATTCAGCTGAACTTGAGAGTGGAACTTTCAAGAAGGCCAGTGATGAGGTTTTGGCTAGTAGAAGAATTGTCAGAGTTAAGCGCAAAGAGCCATCTGCTGCTCCAGTTGCAGCATCCAATCCATTTGCTGGAATTCAGTTGGTCCCTACGACTGCACCTGCTTCAACCCCTGTGGGAACAAATGCACCTCTGGCTGAGTCAAAATTGGCTCCAGCTGAAGCAGTAGTTGAGGACAATCAAAAAGCAAGTGATATTGAGGAGGGCGATGAAGTTGACAGTAAGAAGGTTGATGTCAAAGATGCTGTTGGGGAAGAGACTGAAAAGACTAAAGATAAGGATGATAATCATTGTGGAAAGAGTGCTGATGTCCAAGTTGCGGCTACAGAAGTAGCTCAGATGGTCTCATGTGACACAAACGTTTGCAACAACGCTGTTGAAGGAACAGACCAAACTGATTTTCCTCTTGAGAAGGATTCAGGAGGTGATCAGGCTGAGAAAAAAGAAAAAGAAGGCAACGGAATTGAGGAAGCAGATAAGAATGGCGATAATGGTGCTTTCAGCTCATTCCAACAGCATTCAAGTAACAAAAACGCATTCACCGGACTTGCCAGTACAGAGGCTTCAGGGTCTTCGTTCTCATTTGGTTTGGTTTCTCAGGATGGTTCAACTGGTACTGGGTCTCTCTTTGGCTTTGGCCTTCCAAGCAGCAATAGCTCTTCTATATTCGGTGCAACTGGATCGTCCATTATCAAGAAGAGTGAAGGTAGTGGGTTTCCGCCAAAGCAAGAGGTTTCCACAGAAACAGGTGAAGAGAATGAGAAAGTTGCCTTCTCAGCTGACTCGATCATGTTCGAATATCTTGATGGAGGATGGAAAGAGCGTGGAAAAGGAGAACTCAAGGTAAACGTCTCCAGTAATGATGGTAAAGCAAGATTAGTTATGAGAGCTAAAGGAAACTACAGATTGATCTTAAACGCGAGTCTTTACCCAGAGATGAAACTTGCAAACATGGATAAAAAGGGAATCACATTCGCTTGTGTGAATAGTGTAAGCGAAGGCAAAGAAGGTCTCTCTACATTTGCACTGAAGTTCAAAGACCCGACAATTGTTGAAGAGTTTCGTGTAGCCATTGACAAACACAAAGATAGTAAACCAATGGAGAAAGCAGCAGAAAAATCAGCTCTTCCTCTGAAGACACCTGAGAACTCTCCAACAGCTACAGATACTTGAAGAAAAGGTAAAAAGAAAAAAAGAAAAAACATGTAGAAACACTTCTCTCGTCTCTCTCGTCTCTCTTGTCTTTTGTCTTGTCTTGTTACTTCCAAGTAGTTGAATTTTGAGGCAGAGGAAAACTAAAATATTTGGAGAAGTTTGTTGTTTTTTTTACACAGTTGTTGAGACTTTTTGGTTACATGTTTCTGTTTGTAGAAGGAAACCATATATGACTTAAATCTGCATCCTTGATTT

SEQ ID NO: 351 - DNA, 1172 bp, Arabidopsis thaliana
  misc_feature (1)..(1172): Ceres cDNA ID no. 12327612
  misc_feature (1)..(1172): Ceres CLONE  ID no. 118484
  misc_feature (1)..(1172): Also known as  Ceres CDNA ID no. 23362597
tttcctctgcttctcaacatctctaagctttcattgaacaaggaatatgaaatcttctccaagatcagaaggaagaaagttcattatcccttctttcttcttcatcatagctctttgtgtactagctttcatcaacgggatcagattcgatagcttattgagttttggaagatgtgctttgtcaaatgttcctatgaataatggttcatcagagactccattgttgtcttcttctcctgttgatgatgagattaggattcttattggaatccttacacttcctgatcagtattcacgtcgccattttctccggatgatctacgggacacaaaatgttccggacggtgttaaggttgatgtgaagtttgtgttctgtaatttgactaaagaagaccagaaagtgcttgttgctttggagattatgcgttatgatgacatcattatactcaactgcaatgagaatatgaacaaaggcaagacttacacatacttctcaagcttaccagacatattcaatgagaccgatgcacaaaaaccaccgtaccattacgtaatgaaagccgacgacgacacatacataagactagaaagtctcgttgcatctttgagaccactccctcgagaagatctttactacggctatgtaattccatgtccaagcatggacccatttgttcattacatgtcaggaatgggttacttagtgtcatgggatattgcggtttggctcaaagactcggaaattcccaagaaacatctagaaggtcctgaagacaaagtgtttggcgattggattcgagaaggaagacgaggaaaaaaccggtttaacgctaagtggtccatgtataatttccctgagccaccgactagatgcacacatgagctttggccagacactattgccgttcatttgttaaagaaccaagagaagtggatacgtacattgaactatttcaatgttactagcaatctcaagccttctaaactataccacataccgtagatagtctttttgtttgcttttaccggattcttatatttatactttacattgtttctcttgaaattggtaagaaatgttctttaataatcgattttttgggagggatttgtagtacactaattaaggattgttcaaacatgtttaatagtcaatctggttgggttttttc

SEQ ID NO: 352 - protein, 1172 aa, Arabidopsis thaliana
  misc_feature: PFam Name: Galactosyl_T; PFam Description: Galactosyltransferase
  misc_feature: GI Number: 21537037; NR Description: unknown [Arabidopsis thaliana]
  misc_feature: GI Number: 14719291; NR Description: unknown [Zea mays]
TTTCCTCTGCTTCTCAACATCTCTAAGCTTTCATTGAACAAGGAATATGAAATCTTCTCCAAGATCAGAAGGAAGAAAGTTCATTATCCCTTCTTTCTTCTTCATCATAGCTCTTTGTGTACTAGCTTTCATCAACGGGATCAGATTCGATAGCTTATTGAGTTTTGGAAGATGTGCTTTGTCAAATGTTCCTATGAATAATGGTTCATCAGAGACTCCATTGTTGTCTTCTTCTCCTGTTGATGATGAGATTAGGATTCTTATTGGAATCCTTACACTTCCTGATCAGTATTCACGTCGCCATTTTCTCCGGATGATCTACGGGACACAAAATGTTCCGGACGGTGTTAAGGTTGATGTGAAGTTTGTGTTCTGTAATTTGACTAAAGAAGACCAGAAAGTGCTTGTTGCTTTGGAGATTATGCGTTATGATGACATCATTATACTCAACTGCAATGAGAATATGAACAAAGGCAAGACTTACACATACTTCTCAAGCTTACCAGACATATTCAATGAGACCGATGCACAAAAACCACCGTACCATTACGTAATGAAAGCCGACGACGACACATACATAAGACTAGAAAGTCTCGTTGCATCTTTGAGACCACTCCCTCGAGAAGATCTTTACTACGGCTATGTAATTCCATGTCCAAGCATGGACCCATTTGTTCATTACATGTCAGGAATGGGTTACTTAGTGTCATGGGATATTGCGGTTTGGCTCAAAGACTCGGAAATTCCCAAGAAACATCTAGAAGGTCCTGAAGACAAAGTGTTTGGCGATTGGATTCGAGAAGGAAGACGAGGAAAAAACCGGTTTAACGCTAAGTGGTCCATGTATAATTTCCCTGAGCCACCGACTAGATGCACACATGAGCTTTGGCCAGACACTATTGCCGTTCATTTGTTAAAGAACCAAGAGAAGTGGATACGTACATTGAACTATTTCAATGTTACTAGCAATCTCAAGCCTTCTAAACTATACCACATACCGTAGATAGTCTTTTTGTTTGCTTTTACCGGATTCTTATATTTATACTTTACATTGTTTCTCTTGAAATTGGTAAGAAATGTTCTTTAATAATCGATTTTTTGGGAGGGATTTGTAGTACACTAATTAAGGATTGTTCAAACATGTTTAATAGTCAATCTGGTTGGGTTTTTTC

SEQ ID NO: 353 - DNA, 1348 bp, Arabidopsis thaliana
  misc_feature (1)..(1348): Ceres cDNA ID no. 12327810
  misc_feature (1)..(1348): Ceres CLONE  ID no. 122731
  misc_feature (1)..(1348): Also known as  Ceres CDNA ID no. 23362778
ataaaattgggatctcttcttcttcttcttcttcttcatagtgactgattcacttctgaaacggagatggcttcgtcgacacctaaaaccctaatggatttttttcaacctgccaaacgcctcaaagcttccccttcttcctcctctttccccgccgtctccgtcgccggtggttcccgtgatttgggttctgtagcaaactcgccgcctcgtgtaaccgttaccacttccgtcgccgatgattcgtctggccttacacctgaacagatcgctcgcgcagagttcaacaagttcgtcgccaagtccaagcgtaacctcgccgtctgctccgagagggtcacaaaagcaaaatctgaaggaaactgctacgtaccattgagtgagctcttagtagaagaatcatggcttaaagctcttcctggggaatttcataaaccctacgccaaatcactttctgatttccttgaacgtgagatcatcactgacagtaaaagccctctgatttatccaccgcagcacttgattttcaatgctcttaatacaactccttttgatcgagttaagactgtcattatcggacaggatccttatcatggacctggtcaagctatgggtttgtccttctctgtacctgaaggagaaaagcttccttctagtctgttgaacatctttaaggagcttcataaagatgttggctgttccatcccacgtcacggtaatctacagaaatgggctgtgcagggtgtgttactcctgaatgctgttcttacagtaaggagtaaacagcctaattcacatgcaaagaaaggatgggaacaattcactgatgctgttattcaaagtatctcacagcagaaggaaggtgttgtttttcttctctggggaagatacgctcaagagaaatccaagttgatagatgcgactaaacatcatatactcacagcagctcatccatctggtttgtcggcgaatagaggcttcttcgactgcaggcatttctctcgcgcaaaccagctactcgaggaaatggggattcctcccatagactggcaactttaacttgttaaccgtagtcttaaggccaaggcgaagtgtgattcatctcgggaagccttgtgttttttgcagtcctttttggtgaagagagtttgaagttcttaacagttctaatgtcccttttttgtgaaatatgttatcacggaaccctagcataagctgttgaagtagttggatctgagtatggctcagtagtggcaaactgtctttatgttgtagttttgaagagtggtggtgtattatattttgtatggaaagtgcatgaaagaaaaccagaagctttaagttctgc

SEQ ID NO: 354 - protein, 1348 aa, Arabidopsis thaliana
  misc_feature: PFam Name: UDG; PFam Description: Uracil DNA glycosylase
  misc_feature: GI Number: 21537176; NR Description: uracil-DNA glycosylase, putative [Arabidopsis thaliana] >gi|9294324|dbj|BAB02221.1| uracil-DNA glycosylase-like protein [Arabidopsis thaliana] >gi|15230152|ref|NP_188493.1| uracil DNA glycosylase family
  misc_feature: GI Number: 53611343; NR Description: COG0692: Uracil DNA
  misc_feature: GI Number: 26988146; NR Description: uracil-DNA glycosylase [Pseudomonas putida KT2440] >gi|24982878|gb|AAN67035.1| uracil-DNA glycosylase [Pseudomonas putida KT2440]
  misc_feature: GI Number: 48861305; NR Description: COG0692: Uracil DNA
  misc_feature: GI Number: 29654303; NR Description: uracil-DNA glycosylase [Coxiella burnetii RSA 493] >gi|29541570|gb|AAO90509.1| uracil-DNA glycosylase [Coxiella burnetii RSA 493]
ATAAAATTGGGATCTCTTCTTCTTCTTCTTCTTCTTCATAGTGACTGATTCACTTCTGAAACGGAGATGGCTTCGTCGACACCTAAAACCCTAATGGATTTTTTTCAACCTGCCAAACGCCTCAAAGCTTCCCCTTCTTCCTCCTCTTTCCCCGCCGTCTCCGTCGCCGGTGGTTCCCGTGATTTGGGTTCTGTAGCAAACTCGCCGCCTCGTGTAACCGTTACCACTTCCGTCGCCGATGATTCGTCTGGCCTTACACCTGAACAGATCGCTCGCGCAGAGTTCAACAAGTTCGTCGCCAAGTCCAAGCGTAACCTCGCCGTCTGCTCCGAGAGGGTCACAAAAGCAAAATCTGAAGGAAACTGCTACGTACCATTGAGTGAGCTCTTAGTAGAAGAATCATGGCTTAAAGCTCTTCCTGGGGAATTTCATAAACCCTACGCCAAATCACTTTCTGATTTCCTTGAACGTGAGATCATCACTGACAGTAAAAGCCCTCTGATTTATCCACCGCAGCACTTGATTTTCAATGCTCTTAATACAACTCCTTTTGATCGAGTTAAGACTGTCATTATCGGACAGGATCCTTATCATGGACCTGGTCAAGCTATGGGTTTGTCCTTCTCTGTACCTGAAGGAGAAAAGCTTCCTTCTAGTCTGTTGAACATCTTTAAGGAGCTTCATAAAGATGTTGGCTGTTCCATCCCACGTCACGGTAATCTACAGAAATGGGCTGTGCAGGGTGTGTTACTCCTGAATGCTGTTCTTACAGTAAGGAGTAAACAGCCTAATTCACATGCAAAGAAAGGATGGGAACAATTCACTGATGCTGTTATTCAAAGTATCTCACAGCAGAAGGAAGGTGTTGTTTTTCTTCTCTGGGGAAGATACGCTCAAGAGAAATCCAAGTTGATAGATGCGACTAAACATCATATACTCACAGCAGCTCATCCATCTGGTTTGTCGGCGAATAGAGGCTTCTTCGACTGCAGGCATTTCTCTCGCGCAAACCAGCTACTCGAGGAAATGGGGATTCCTCCCATAGACTGGCAACTTTAACTTGTTAACCGTAGTCTTAAGGCCAAGGCGAAGTGTGATTCATCTCGGGAAGCCTTGTGTTTTTTGCAGTCCTTTTTGGTGAAGAGAGTTTGAAGTTCTTAACAGTTCTAATGTCCCTTTTTTGTGAAATATGTTATCACGGAACCCTAGCATAAGCTGTTGAAGTAGTTGGATCTGAGTATGGCTCAGTAGTGGCAAACTGTCTTTATGTTGTAGTTTTGAAGAGTGGTGGTGTATTATATTTTGTATGGAAAGTGCATGAAAGAAAACCAGAAGCTTTAAGTTCTGC

SEQ ID NO: 355 - DNA, 1042 bp, Arabidopsis thaliana
  misc_feature (1)..(1042): Ceres cDNA ID no. 12328103
  misc_feature (1)..(1042): Ceres CLONE  ID no. 27813
  misc_feature (1)..(1042): Also known as  Ceres CDNA ID no. 23363047
aaaaacacaacatgaagattatgtgggaaacagcagttgtgttctgtctctgttcattgtctttggtttctgcacacagcaggaaattcacaacaccaaacgtgacacgcctcacagatcaattcagtaagatcgccattgaaaatggcttctccagacgtttcggagctcacaatattcaggtcaatggctccctcgctaagctcactctcgacaaatcctccggagctgggttggtgtcaaagaacaactatcactatggtttcttcagtgcaagactcaagcttcccgctggatttgcctctggtgttgtggttgctttctatttatcaaacgcagagacttatccgaaaagccacgacgagatagacatagaattgttgggtagaagtaggagagatgattggacgatccaaacgaatgtatatgcaaatggaagtactagaacgggaagggaagagaagttttatttttggttcgatccaacgcaagcctttcacgactataccctcatttggaactcccaccatactgtatttttggtagacaacattccggttaggcagtttccaaaccggggagccttcacaagcgcgtacccgtctaaaccgatgtctctatacgtcaccgtttgggacggttcagagtgggccactaaaggtggtaagtaccccgtcaactacaagtacgcccctttcgtggtttccgttgctgacgtggagttaagtggctgttccgttaacaacggatcctctaccgggtccgggccatgtaccaagtcgggcgggtcgatttcgagtctggaccctgttgatggtcaggattttgccacgttgtcgaagaatcagatcaatgccatggattgggctaggagaaagctgatgttctattcttattgcagtgataagccaagatacaaagtcatgcctgctgagtgcaactgattttttttttgttaaaacacacattgttactttctattgttttatgatataattttacgtaggatattagaggtttaaagtatgtttcaaacttcgcc

SEQ ID NO: 356 - protein, 1042 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 5091548; NR Description: T10O24.17 [Arabidopsis thaliana] >gi|38605339|sp|Q8LC45|XT33_ARATH Probable xyloglucan endotransglucosylase/hydrolase protein 33 precursor (At-XTH33) (XTH-33) >gi|15218558|ref|NP_172525.1| xyloglucan:xyloglucosyl
  misc_feature: GI Number: 21555405; NR Description: putative endoxyloglucan
  misc_feature: GI Number: 31711806; NR Description: At2g01850 [Arabidopsis thaliana] >gi|2154609|dbj|BAA20289.1| endoxyloglucan transferase related protein [Arabidopsis thaliana] >gi|4522010|gb|AAD21783.1| xyloglucan endotransglycosylase >gi|38605340|sp|Q8LDS2|XT27_ARATH
  misc_feature: GI Number: 5533313; NR Description: endoxyloglucan
  misc_feature: GI Number: 21553969; NR Description: putative
AAAAACACAACATGAAGATTATGTGGGAAACAGCAGTTGTGTTCTGTCTCTGTTCATTGTCTTTGGTTTCTGCACACAGCAGGAAATTCACAACACCAAACGTGACACGCCTCACAGATCAATTCAGTAAGATCGCCATTGAAAATGGCTTCTCCAGACGTTTCGGAGCTCACAATATTCAGGTCAATGGCTCCCTCGCTAAGCTCACTCTCGACAAATCCTCCGGAGCTGGGTTGGTGTCAAAGAACAACTATCACTATGGTTTCTTCAGTGCAAGACTCAAGCTTCCCGCTGGATTTGCCTCTGGTGTTGTGGTTGCTTTCTATTTATCAAACGCAGAGACTTATCCGAAAAGCCACGACGAGATAGACATAGAATTGTTGGGTAGAAGTAGGAGAGATGATTGGACGATCCAAACGAATGTATATGCAAATGGAAGTACTAGAACGGGAAGGGAAGAGAAGTTTTATTTTTGGTTCGATCCAACGCAAGCCTTTCACGACTATACCCTCATTTGGAACTCCCACCATACTGTATTTTTGGTAGACAACATTCCGGTTAGGCAGTTTCCAAACCGGGGAGCCTTCACAAGCGCGTACCCGTCTAAACCGATGTCTCTATACGTCACCGTTTGGGACGGTTCAGAGTGGGCCACTAAAGGTGGTAAGTACCCCGTCAACTACAAGTACGCCCCTTTCGTGGTTTCCGTTGCTGACGTGGAGTTAAGTGGCTGTTCCGTTAACAACGGATCCTCTACCGGGTCCGGGCCATGTACCAAGTCGGGCGGGTCGATTTCGAGTCTGGACCCTGTTGATGGTCAGGATTTTGCCACGTTGTCGAAGAATCAGATCAATGCCATGGATTGGGCTAGGAGAAAGCTGATGTTCTATTCTTATTGCAGTGATAAGCCAAGATACAAAGTCATGCCTGCTGAGTGCAACTGATTTTTTTTTTGTTAAAACACACATTGTTACTTTCTATTGTTTTATGATATAATTTTACGTAGGATATTAGAGGTTTAAAGTATGTTTCAAACTTCGCC

SEQ ID NO: 357 - DNA, 1363 bp, Arabidopsis thaliana
  misc_feature (1)..(1363): Ceres cDNA ID no. 12328258
  misc_feature (1)..(1363): Ceres CLONE  ID no. 105319
  misc_feature (1)..(1363): Also known as  Ceres CDNA ID no. 23363195
aaattgttgtcttttaggttttgacagtagcaaagaaaagctgaatctagttagaaattgcttttgcagggtttttgaatagtttgtgtattgaagattgtctgaaatggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaattgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaatttgtatcgaggccttcgagcaagttctgagctttctagagaaagaagaaactatggagatcccagacggcgacctctaatttcccagccttctgttctccgtctcttcatttatctgtttaatcaactaaacgaagcaatcactcatcaccaggccattgagcaagttcagagacaaagaagacctctagttactggttccgggtcattggagcttacacgagcctaattttgactggaactatggtttattgaaagaagattcaatacatgtatatataaaatatatacttttttttttgtttcagtatcatccttcttctcttttccttacaataagaattaaggaaaagtagccgtgtttgttaacatgggccaagaacaagcaaagtgatcattcaaatataaaagtagctttctcatgg

SEQ ID NO: 358 - protein, 1363 aa, Arabidopsis thaliana
  misc_feature: PFam Name: SKI; PFam Description: Shikimate kinase
  misc_feature: GI Number: 39104605; NR Description: putative shikimate
  misc_feature: GI Number: 4417286; NR Description: putative shikimate kinase precursor [Arabidopsis thaliana] >gi|25288007|pir||A84607 probable shikimate kinase precursor [imported] - Arabidopsis thaliana >gi|20137565|sp|Q9SJ05|AROK_ARATH Probable shikimate
  misc_feature: GI Number: 30681570; NR Description: shikimate kinase,
  misc_feature: GI Number: 42570867; NR Description: shikimate kinase,
  misc_feature: GI Number: 7270938; NR Description: shikimate kinase-like protein [Arabidopsis thaliana] >gi|5042170|emb|CAB44689.1| shikimate kinase-like protein [Arabidopsis thaliana] >gi|7434489|pir||T09370 shikimate kinase homolog F23K16.170 -
AAATTGTTGTCTTTTAGGTTTTGACAGTAGCAAAGAAAAGCTGAATCTAGTTAGAAATTGCTTTTGCAGGGTTTTTGAATAGTTTGTGTATTGAAGATTGTCTGAAATGGAAGCAGCTATTACTCAGAGGATTCAGTACCCATCATGGGTTGATTGTAGAAAAGTTGAGTGTAAGCCGCAGCGTGGTTCATTGCGGTATTCTCAGCAGGTTAAGGTAGATAGAAGGTTTAGAGGTCTTTCTTTGGCTCGCTTGCAACCTGAAAGAAGAATTGATCAACGAAGAGCAGTTTCTCCAGCGGTTTCCTGTTCTGATAACAATTCCTCAGCGTTGTTGGAGACTGGAAGTGTTTATCCATTTGATGAAGATATTCTCAAGAGAAAAGCAGAAGAGGTTAAACCGTATTTGAATGGACGATCTATGTACCTTGTCGGAATGATGGGTTCTGGGAAAACAACTGTGGGAAAGTTAATGTCCAAAGTGCTCGGTTATACGTTCTTTGACTGCGACACTTTGATTGAACAGGCGATGAATGGAACTTCTGTTGCAGAGATATTTGTTCATCACGGAGAGAATTTTTTTAGAGGAAAGGAGACCGATGCGCTTAAGAAGCTCTCTTCGAGGTATCAAGTTGTTGTTTCCACAGGTGGAGGTGCAGTTATAAGACCCATTAACTGGAAGTATATGCATAAAGGAATCAGCATTTGGCTAGATGTGCCTCTAGAAGCATTAGCCCATAGAATCGCTGCTGTTGGAACTGATTCACGACCACTGCTACACGATGAATCAGGAGATGCATACTCAGTGGCTTTCAAACGTCTCTCGGCTATTTGGGACGAGCGCGGTGAAGCATACACAAACGCAAATGCCAGAGTCTCCTTAGAAAATATTGCAGCAAAGCGTGGCTATAAAAATGTCTCAGATCTCACACCAACTGAAATTTGTATCGAGGCCTTCGAGCAAGTTCTGAGCTTTCTAGAGAAAGAAGAAACTATGGAGATCCCAGACGGCGACCTCTAATTTCCCAGCCTTCTGTTCTCCGTCTCTTCATTTATCTGTTTAATCAACTAAACGAAGCAATCACTCATCACCAGGCCATTGAGCAAGTTCAGAGACAAAGAAGACCTCTAGTTACTGGTTCCGGGTCATTGGAGCTTACACGAGCCTAATTTTGACTGGAACTATGGTTTATTGAAAGAAGATTCAATACATGTATATATAAAATATATACTTTTTTTTTTGTTTCAGTATCATCCTTCTTCTCTTTTCCTTACAATAAGAATTAAGGAAAAGTAGCCGTGTTTGTTAACATGGGCCAAGAACAAGCAAAGTGATCATTCAAATATAAAAGTAGCTTTCTCATGG

SEQ ID NO: 359 - DNA, 1209 bp, Arabidopsis thaliana
  misc_feature (1)..(1209): Ceres cDNA ID no. 12328556
  misc_feature (1)..(1209): Ceres CLONE  ID no. 125711
  misc_feature (1)..(1209): Also known as  Ceres CDNA ID no. 23363487
gttggccggaaatcaatttcttcgtcttcatcgactctttctctccctgaattttctctggcatttcgaatttatagaggtacgcatggctgccaaggctttaaaagatttgaagaatcttcctgtctctgagaggaatatcgactataaaacaaagcttttggttggcaaaatgaatggaacagctgaagataaaccaccacaaaactctgtcccctttgatcacaatcatcctaaaggcgatgagattgagaaacctgaggcagagagagttatcgtagaaattgagtatatagaatccaaagacttgaacaatgtaacccaagttgatgcagttctcaagtcacttgtaaccgagctagactccaaggattgggttttggtctgtgatgctcttaataccattcgtcgtctttccatattccacaaggaagaaatgctgcatatgctggagaaagtgatcctgtttatcgtgaaatcactgaagaacccaagaagtgctgtaagtaaaaccgcatgtatgacatctgctgacatcttcagctcatataatgaccatacaatcgatcaattggatctcttgcttactcaactcctccttaaatcttcccaagacaagcgatttgtttgtgaagcagcagaaaaagcattagtagcaatgactgcacatgtttctcctgccttgctgttgccaaagcttcaaccttttctcaagaataggaatcctcggatccgcgcaaaagcatccacgtgcttctcccgatgtgttccccgactgggcattgaaggcattagagaatatggaattgagaaactagtccaagcagcatcgtctcagctcagtgacaaactcccagaatctcgggaggctgcacgggcagtcttactggaacttcagacagtgtacaagaaaactactaatgtcgaaccgaaggaggagcatccagagccagtcacttggcaaatcttctgccaatcaaacctctcacctcttagtgcacaggctgtgatacgtgtcaccaatgtcgcaggtgtggctcgagagggtcttgttgcgggttcatgacagtcacaagccctcagtttgatattgtaagcctctgtgagtaaacgttgtacgaccactgtttctctatctttggtttatgggtttgtttctttattttgtgtgtgaatatgtcgatgtggtaagataaatctcaacgactc

SEQ ID NO: 360 - protein, 1209 aa, Arabidopsis thaliana
  misc_feature: PFam Name: HEAT; PFam Description: HEAT repeat
  misc_feature: GI Number: 21537265; NR Description: unknown [Arabidopsis thaliana]
  misc_feature: GI Number: 51979208; NR Description: PREDICTED P0543C11.17-3 gene product [Oryza sativa (japonica cultivar-group)] >gi|51979206|ref|XP_507469.1| PREDICTED P0543C11.17-3 gene product [Oryza sativa (japonica cultivar-group)] [Oryza sativa
  misc_feature: GI Number: 51979707; NR Description: PREDICTED P0702C09.23 gene product [Oryza sativa (japonica cultivar-group)] >gi|51979705|ref|XP_507599.1| PREDICTED P0702C09.23 gene product [Oryza sativa (japonica cultivar-group)] [Oryza sativa (japonica
  misc_feature: GI Number: 51766866; NR Description: LOAA0423 [Mus musculus]
  misc_feature: GI Number: 50510481; NR Description: mKIAA0423 protein [Mus
GTTGGCCGGAAATCAATTTCTTCGTCTTCATCGACTCTTTCTCTCCCTGAATTTTCTCTGGCATTTCGAATTTATAGAGGTACGCATGGCTGCCAAGGCTTTAAAAGATTTGAAGAATCTTCCTGTCTCTGAGAGGAATATCGACTATAAAACAAAGCTTTTGGTTGGCAAAATGAATGGAACAGCTGAAGATAAACCACCACAAAACTCTGTCCCCTTTGATCACAATCATCCTAAAGGCGATGAGATTGAGAAACCTGAGGCAGAGAGAGTTATCGTAGAAATTGAGTATATAGAATCCAAAGACTTGAACAATGTAACCCAAGTTGATGCAGTTCTCAAGTCACTTGTAACCGAGCTAGACTCCAAGGATTGGGTTTTGGTCTGTGATGCTCTTAATACCATTCGTCGTCTTTCCATATTCCACAAGGAAGAAATGCTGCATATGCTGGAGAAAGTGATCCTGTTTATCGTGAAATCACTGAAGAACCCAAGAAGTGCTGTAAGTAAAACCGCATGTATGACATCTGCTGACATCTTCAGCTCATATAATGACCATACAATCGATCAATTGGATCTCTTGCTTACTCAACTCCTCCTTAAATCTTCCCAAGACAAGCGATTTGTTTGTGAAGCAGCAGAAAAAGCATTAGTAGCAATGACTGCACATGTTTCTCCTGCCTTGCTGTTGCCAAAGCTTCAACCTTTTCTCAAGAATAGGAATCCTCGGATCCGCGCAAAAGCATCCACGTGCTTCTCCCGATGTGTTCCCCGACTGGGCATTGAAGGCATTAGAGAATATGGAATTGAGAAACTAGTCCAAGCAGCATCGTCTCAGCTCAGTGACAAACTCCCAGAATCTCGGGAGGCTGCACGGGCAGTCTTACTGGAACTTCAGACAGTGTACAAGAAAACTACTAATGTCGAACCGAAGGAGGAGCATCCAGAGCCAGTCACTTGGCAAATCTTCTGCCAATCAAACCTCTCACCTCTTAGTGCACAGGCTGTGATACGTGTCACCAATGTCGCAGGTGTGGCTCGAGAGGGTCTTGTTGCGGGTTCATGACAGTCACAAGCCCTCAGTTTGATATTGTAAGCCTCTGTGAGTAAACGTTGTACGACCACTGTTTCTCTATCTTTGGTTTATGGGTTTGTTTCTTTATTTTGTGTGTGAATATGTCGATGTGGTAAGATAAATCTCAACGACTC

SEQ ID NO: 361 - DNA, 1221 bp, Arabidopsis thaliana
  misc_feature (1)..(1221): Ceres cDNA ID no. 12328669
  misc_feature (1)..(1221): Ceres CLONE  ID no. 124846
  misc_feature (1)..(1221): Also known as  Ceres CDNA ID no. 23363597
aacgactcataactcatagctatatcttgtcttaaaaagaagaagcaaagagaattagtggagtacgataagcagagaagtatgttaaaggtggtgttgttgatgatgataatgatgttggcgtcacagtccgaggctcagctgaaccgtgacttttacaaggaaagctgtccatcattgttccttgtcgtgagacgagtcgtgaaacgggccgtggccagagagcctcgcatgggtgcttctctccttcgtttgttcttccatgattgttttgtcaatgggtgtgacggatccttactgttggatgacacaccgtcttttttgggagagaaaacctcaggacccagcaataactctgtgagggggttcgaagtgatcgacaaaatcaagtttaaggttgagaaaatgtgcccgggcatcgtctcatgcgcagacattctagccatcactgctcgggactccgttctcctcctaggtggaccggggtggagcgtgaaacttggaagaagagactctacgacggcgaacttcgcggccgcgaactccggagtcatccctcctccgatcactacccttagcaacctcataaaccgtttcaaagcacaaggtttgtccacacgtgacatggtcgccctctctggttctcacaccattggacgagcccaatgtgttacattcagaaaccgaatctacaacgcaagcaatatcgacacctctttcgccatctctaaacggaggaagctgtcctgccaccagtggctccggagacaacaagaaagccaatcttgacgtccgctctcccgataggttcgaccacggcttctacaagcaacttctgagcaaaaaaggtttgcttacgtcagaccaagtcctctttaataatggtcctaccgactcgctcgtcatagcttacagccacaatctcaatgccttctaccgcgactttgcaagggcaatgattaagatgggagacatcagccccctcaccggatccaatggtcagatccgccaaaactgtcggaggcccaactgaatgattctcttttatattatcccaagcccattgagctcaataatcacctcttcgtcaactgttttttcatgtgcattccccttcttcgtcaactgttaaaatacatcttcattatataaaaaacaataaacacgtaaaagtttgtgactatgcagttttccattataaattactgtctatattctctt

SEQ ID NO: 362 - protein, 1221 aa, Arabidopsis thaliana
  misc_feature: PFam Name: peroxidase; PFam Description: Peroxidase
  misc_feature: GI Number: 21537247; NR Description: peroxidase [Arabidopsis
  misc_feature: GI Number: 8777340; NR Description: peroxidase [Arabidopsis thaliana] >gi|26397866|sp|Q9LVL2|PE67_ARATH Peroxidase 67 precursor (Atperox P67) (ATP44) >gi|15237187|ref|NP_200647.1| peroxidase,
  misc_feature: GI Number: 30793803; NR Description: putative peroxidase [Arabidopsis thaliana] >gi|8777341|dbj|BAA96931.1| peroxidase [Arabidopsis thaliana] >gi|26451590|dbj|BAC42892.1| putative peroxidase [Arabidopsis thaliana]
  misc_feature: GI Number: 39777536; NR Description: peroxidase precursor
  misc_feature: GI Number: 39777532; NR Description: peroxidase precursor
AACGACTCATAACTCATAGCTATATCTTGTCTTAAAAAGAAGAAGCAAAGAGAATTAGTGGAGTACGATAAGCAGAGAAGTATGTTAAAGGTGGTGTTGTTGATGATGATAATGATGTTGGCGTCACAGTCCGAGGCTCAGCTGAACCGTGACTTTTACAAGGAAAGCTGTCCATCATTGTTCCTTGTCGTGAGACGAGTCGTGAAACGGGCCGTGGCCAGAGAGCCTCGCATGGGTGCTTCTCTCCTTCGTTTGTTCTTCCATGATTGTTTTGTCAATGGGTGTGACGGATCCTTACTGTTGGATGACACACCGTCTTTTTTGGGAGAGAAAACCTCAGGACCCAGCAATAACTCTGTGAGGGGGTTCGAAGTGATCGACAAAATCAAGTTTAAGGTTGAGAAAATGTGCCCGGGCATCGTCTCATGCGCAGACATTCTAGCCATCACTGCTCGGGACTCCGTTCTCCTCCTAGGTGGACCGGGGTGGAGCGTGAAACTTGGAAGAAGAGACTCTACGACGGCGAACTTCGCGGCCGCGAACTCCGGAGTCATCCCTCCTCCGATCACTACCCTTAGCAACCTCATAAACCGTTTCAAAGCACAAGGTTTGTCCACACGTGACATGGTCGCCCTCTCTGGTTCTCACACCATTGGACGAGCCCAATGTGTTACATTCAGAAACCGAATCTACAACGCAAGCAATATCGACACCTCTTTCGCCATCTCTAAACGGAGGAAGCTGTCCTGCCACCAGTGGCTCCGGAGACAACAAGAAAGCCAATCTTGACGTCCGCTCTCCCGATAGGTTCGACCACGGCTTCTACAAGCAACTTCTGAGCAAAAAAGGTTTGCTTACGTCAGACCAAGTCCTCTTTAATAATGGTCCTACCGACTCGCTCGTCATAGCTTACAGCCACAATCTCAATGCCTTCTACCGCGACTTTGCAAGGGCAATGATTAAGATGGGAGACATCAGCCCCCTCACCGGATCCAATGGTCAGATCCGCCAAAACTGTCGGAGGCCCAACTGAATGATTCTCTTTTATATTATCCCAAGCCCATTGAGCTCAATAATCACCTCTTCGTCAACTGTTTTTTCATGTGCATTCCCCTTCTTCGTCAACTGTTAAAATACATCTTCATTATATAAAAAACAATAAACACGTAAAAGTTTGTGACTATGCAGTTTTCCATTATAAATTACTGTCTATATTCTCTT

SEQ ID NO: 363 - DNA, 1270 bp, Arabidopsis thaliana
  misc_feature (1)..(1270): Ceres cDNA ID no. 12328910
  misc_feature (1)..(1270): Ceres CLONE  ID no. 142064
  misc_feature (1)..(1270): Also known as  Ceres CDNA ID no. 23363817
cttttgatccaagtttggttgcccagaaatatcaaagaaaaaaaaacaaagctttgttgtttctggcagtagaatcattcatggctttctttgcgtgttaaacattcactaacctaaaaactaaaacttcgttttcagcaatcatgagattcaacaagggaactaaagtcgaagtgttgagcaaatcatcggttccatctggcgcctggcggtctgcagagatcatatcaggaaatgggcattactacactgtcatgtatgatcataatgatggtacagagagggtaccgaggaagagtatgaggcctgagcctcctcgtttacaagttcttgatgcttggtgtcctggtgacattcttgaggttttccaaagttgttcgtggaagatggcaatcgtttccaaggttttaggaaacggttgtttcttggttagattacttggttcctcactgaagttcaaggtgactaaatccgatattcgggttagacaatcttggcaagataacgagtggatcatgattggacagggtacatcaagattaagcgcacagacttcaacaggagaactaaggagaaaggtgaatccgaaaggcgactacatttcatctgagagcaaagacaagcttgatgagtctgatgtacctttgtcagtaggtctaaagaaacggacttactctttggttgaacctcacaatcaaactagagctttagctgcttatcctccaaggtttcgtgaagaagtgaaagaagaagaagaagatagagagagtgttgcttcttctgttggtagttgttgcatggatactgatggtctcagtgctgtttcattcaatcccattgaaaccggtaactctagtgacacagagtcatcgtcttgtggctacgggaaggtcaagaagttggtggttccaagaaaaggctcagaggctgctgatgttcataggttagagctggatgcataccgaagcagtatcgagagattgcacgcatccggaccaatcataacatgggaacaagaaacgtggattacaaatctccgtctcaaattgaacatttcgaatgaggaacatctgatgcagataagaaaccttatctctgacgataacagtactatatacagatagcagcagcagcagcattgagaactacagtttgtgttacatagaataaaaactgagtgtagattgtacaaatgtcattttatttttcattcaggtttttttatttaattccaaacttgtgaaagaaaatttgatcatctttactcttc

SEQ ID NO: 364 - protein, 1270 aa, Arabidopsis thaliana
  misc_feature: PFam Name: Agenet; PFam Description: Agenet domain
  misc_feature: PFam Name: ENT; PFam Description: ENT domain
  misc_feature: GI Number: 21553399; NR Description: unknown [Arabidopsis thaliana] >gi|27808580|gb|AAO24570.1| At5g20030 [Arabidopsis thaliana] >gi|15241247|ref|NP_197503.1| agenet domain-containing
  misc_feature: GI Number: 50906127; NR Description: putative agenet domain-containing protein [Oryza sativa (japonica cultivar-group)] >gi|51536260|dbj|BAD38428.1| putative agenet domain-containing protein [Oryza sativa (japonica
  misc_feature: GI Number: 42573127; NR Description: agenet domain-containing
CTTTTGATCCAAGTTTGGTTGCCCAGAAATATCAAAGAAAAAAAAACAAAGCTTTGTTGTTTCTGGCAGTAGAATCATTCATGGCTTTCTTTGCGTGTTAAACATTCACTAACCTAAAAACTAAAACTTCGTTTTCAGCAATCATGAGATTCAACAAGGGAACTAAAGTCGAAGTGTTGAGCAAATCATCGGTTCCATCTGGCGCCTGGCGGTCTGCAGAGATCATATCAGGAAATGGGCATTACTACACTGTCATGTATGATCATAATGATGGTACAGAGAGGGTACCGAGGAAGAGTATGAGGCCTGAGCCTCCTCGTTTACAAGTTCTTGATGCTTGGTGTCCTGGTGACATTCTTGAGGTTTTCCAAAGTTGTTCGTGGAAGATGGCAATCGTTTCCAAGGTTTTAGGAAACGGTTGTTTCTTGGTTAGATTACTTGGTTCCTCACTGAAGTTCAAGGTGACTAAATCCGATATTCGGGTTAGACAATCTTGGCAAGATAACGAGTGGATCATGATTGGACAGGGTACATCAAGATTAAGCGCACAGACTTCAACAGGAGAACTAAGGAGAAAGGTGAATCCGAAAGGCGACTACATTTCATCTGAGAGCAAAGACAAGCTTGATGAGTCTGATGTACCTTTGTCAGTAGGTCTAAAGAAACGGACTTACTCTTTGGTTGAACCTCACAATCAAACTAGAGCTTTAGCTGCTTATCCTCCAAGGTTTCGTGAAGAAGTGAAAGAAGAAGAAGAAGATAGAGAGAGTGTTGCTTCTTCTGTTGGTAGTTGTTGCATGGATACTGATGGTCTCAGTGCTGTTTCATTCAATCCCATTGAAACCGGTAACTCTAGTGACACAGAGTCATCGTCTTGTGGCTACGGGAAGGTCAAGAAGTTGGTGGTTCCAAGAAAAGGCTCAGAGGCTGCTGATGTTCATAGGTTAGAGCTGGATGCATACCGAAGCAGTATCGAGAGATTGCACGCATCCGGACCAATCATAACATGGGAACAAGAAACGTGGATTACAAATCTCCGTCTCAAATTGAACATTTCGAATGAGGAACATCTGATGCAGATAAGAAACCTTATCTCTGACGATAACAGTACTATATACAGATAGCAGCAGCAGCAGCATTGAGAACTACAGTTTGTGTTACATAGAATAAAAACTGAGTGTAGATTGTACAAATGTCATTTTATTTTTCATTCAGGTTTTTTTATTTAATTCCAAACTTGTGAAAGAAAATTTGATCATCTTTACTCTTC

SEQ ID NO: 365 - DNA, 1396 bp, Arabidopsis thaliana
  misc_feature (1)..(1396): Ceres cDNA ID no. 12328918
  misc_feature (1)..(1396): Ceres CLONE  ID no. 32152
  misc_feature (1)..(1396): Also known as  Ceres CDNA ID no. 23363825
attttcaactcaaatagcttcacagttttactaatctctctcatcttcttcccaacatcaaagaagacctttacttctggttagaatagaccaagaacactgagtacgacaaagaaccatgatgaatctttcttctcgtcgcgcctcttccactctcacattgagcttcactgttctccttttagcttccacaggttcgtatggctcaacattcacattcgctaatcggtgcggctacaccgtatggcctggaatcctatcgaatgctggctcacctactctctccaccaccggatttgagctccctaaaggcacctctcgctctctccaagctcccaccggttggtccggtcgattctgggctcgtaccggttgcaagttcgacagttctggctccggtacatgcaaaaccggtgactgcggctccaacgctgtcgaatgcgccgggcttggtgccgcaccgcctgtaactctcgcggagttcactctaggcactggcggcgatgatttctacgacgttagtctcgtcgacggttacaacattccgatgatagttgaagtcgccggtggatctgggcagtgcgcttctaccggatgcactacggatcttaacattcagtgccctgctgagctgcgtttcggcgacggagacgcttgcaaaagcgcgtgtttagcgtttcggagtcctgaatactgttgcagcggcgcgtatgctacaccttctagttgtcggccttccgtgtattcggagatgtttaaagccgcgtgtcctcgctcctatagctacgcttacgacgatgctacgagcactttcacttgcgccggtggagattatacggtgacgttttgcccttcttcccctagtcaaaaatcgactagctactcccctccagtgacagactcgtcgtcgacctcacaaggttccgatcctgtgcctggttctgatactggttacgctggtcagggtcaacagactccaggtcaaggtaatgtgtacgggtcacaggggactgggtcggagatgggtacgggtgagaccatgttacaagacggatcatggatggctggtttggccatgggagaggcaagcagaccagccggcgtttcattgacagtgctgcttgctgcatttacttttccgtttattttctcgtagcatcatcgtctttagatttggtagtcgttttgttagcattgcctttgtttagtttttgttgatactcgatgattatcgcttaagactgcgacaatttgggttttaggcttttagggttttgcattgtagctttgtcgtgtacgcgcgtgtttgcttgtatcatctgtcattgaagattgtttatcatgttcgaaattgtgagatatgctttgtgatttaaagaaagatcttttgtggctt

SEQ ID NO: 366 - protein, 1396 aa, Arabidopsis thaliana
  misc_feature: PFam Name: Thaumatin; PFam Description: Thaumatin family
  misc_feature: GI Number: 20466021; NR Description: putative thaumatin [Arabidopsis thaliana] >gi|17979355|gb|AAL49903.1| putative thaumatin protein [Arabidopsis thaliana] >gi|18420282|ref|NP_568046.1| thaumatin, putative [Arabidopsis
  misc_feature: GI Number: 21592749; NR Description: putative thaumatin-like
  misc_feature: GI Number: 7270849; NR Description: putative thaumatin-like protein [Arabidopsis thaliana] >gi|4467153|emb|CAB37522.1| putative thaumatin-like protein [Arabidopsis thaliana] >gi|7442168|pir||T05694 pathogenesis-related protein F20M13.220 -
  misc_feature: GI Number: 2262099; NR Description: thaumatin isolog
  misc_feature: GI Number: 7269268; NR Description: thaumatin-like protein [Arabidopsis thaliana] >gi|5051760|emb|CAB45053.1| thaumatin-like protein [Arabidopsis thaliana] >gi|15233738|ref|NP_194149.1| pathogenesis-related thaumatin family protein [Arabidopsis
ATTTTCAACTCAAATAGCTTCACAGTTTTACTAATCTCTCTCATCTTCTTCCCAACATCAAAGAAGACCTTTACTTCTGGTTAGAATAGACCAAGAACACTGAGTACGACAAAGAACCATGATGAATCTTTCTTCTCGTCGCGCCTCTTCCACTCTCACATTGAGCTTCACTGTTCTCCTTTTAGCTTCCACAGGTTCGTATGGCTCAACATTCACATTCGCTAATCGGTGCGGCTACACCGTATGGCCTGGAATCCTATCGAATGCTGGCTCACCTACTCTCTCCACCACCGGATTTGAGCTCCCTAAAGGCACCTCTCGCTCTCTCCAAGCTCCCACCGGTTGGTCCGGTCGATTCTGGGCTCGTACCGGTTGCAAGTTCGACAGTTCTGGCTCCGGTACATGCAAAACCGGTGACTGCGGCTCCAACGCTGTCGAATGCGCCGGGCTTGGTGCCGCACCGCCTGTAACTCTCGCGGAGTTCACTCTAGGCACTGGCGGCGATGATTTCTACGACGTTAGTCTCGTCGACGGTTACAACATTCCGATGATAGTTGAAGTCGCCGGTGGATCTGGGCAGTGCGCTTCTACCGGATGCACTACGGATCTTAACATTCAGTGCCCTGCTGAGCTGCGTTTCGGCGACGGAGACGCTTGCAAAAGCGCGTGTTTAGCGTTTCGGAGTCCTGAATACTGTTGCAGCGGCGCGTATGCTACACCTTCTAGTTGTCGGCCTTCCGTGTATTCGGAGATGTTTAAAGCCGCGTGTCCTCGCTCCTATAGCTACGCTTACGACGATGCTACGAGCACTTTCACTTGCGCCGGTGGAGATTATACGGTGACGTTTTGCCCTTCTTCCCCTAGTCAAAAATCGACTAGCTACTCCCCTCCAGTGACAGACTCGTCGTCGACCTCACAAGGTTCCGATCCTGTGCCTGGTTCTGATACTGGTTACGCTGGTCAGGGTCAACAGACTCCAGGTCAAGGTAATGTGTACGGGTCACAGGGGACTGGGTCGGAGATGGGTACGGGTGAGACCATGTTACAAGACGGATCATGGATGGCTGGTTTGGCCATGGGAGAGGCAAGCAGACCAGCCGGCGTTTCATTGACAGTGCTGCTTGCTGCATTTACTTTTCCGTTTATTTTCTCGTAGCATCATCGTCTTTAGATTTGGTAGTCGTTTTGTTAGCATTGCCTTTGTTTAGTTTTTGTTGATACTCGATGATTATCGCTTAAGACTGCGACAATTTGGGTTTTAGGCTTTTAGGGTTTTGCATTGTAGCTTTGTCGTGTACGCGCGTGTTTGCTTGTATCATCTGTCATTGAAGATTGTTTATCATGTTCGAAATTGTGAGATATGCTTTGTGATTTAAAGAAAGATCTTTTGTGGCTT

SEQ ID NO: 367 - DNA, 1484 bp, Arabidopsis thaliana
  misc_feature (1)..(1484): Ceres cDNA ID no. 12328944
  misc_feature (1)..(1484): Ceres CLONE  ID no. 108694
  misc_feature (1)..(1484): Also known as  Ceres CDNA ID no. 23363850
attttttcatcacttatcagcgatttgacgagaagagccttttggtttctgcgaatcatccaaaatccgccatggaagcaactacaagaatcttgagtacttcttctgctctcaatcgtcttcttcttctcagtaagctcaatctaaaatcagatccccgtaatatcaattccacaaatcagctactacacaatgccgttacccgaaaatcctctatctccgccgctcgtatacggtgctcttcgctccctgcgaatgcgaatctcttcagatcactcttcttcctaacgtcaacgtttcgtctcgagaacaccgccgttcacgctaatccattccgatccgaacctaacgacggcgtcgccgtctggaacagagctccacggatcgtgaacggaggtggaaacgcggcgatattcggcgggaacgaggggaaagagacgacggtggttctccttggttggctaggagcgaaagctaaacatctaaggagatacgttgagtggtacaactccaggggaattaacgccgttactttcactgttgacgttagggatttgctccggttagatcttggtcggcggcttgaacgaaggatagctgaatttgggaatgaattggttaattgggtatcggagaaagaagatgatggtagagagaaatgcttggtgtttcacagcttcagtaacactggttggcttgtatatggtgccttgctagagagcttcattggtagacaagatttagtagaaaggattgagggttgtatcattgactcgggaggagcagatcctcttgatactaagatttgggcagcggggtttaccgcagctatactgaagaagcgtagctccaccataaccacagaaccaaacagtcccataaaagaagaggatgcttcaacaccacaaaagaaggaacctttaggaatcgaaaacataatgctatcatctctggagaaactcttccccatcttcttaaaccacccagacgtcaatacgaggctaacaaaaatcattcaaaaactatatgagaaccatcctccatgtcctcagctctatctttacagctccggggacaaagttgttccatctcattccgttgagctccgcatccgagaacaacagaagattggaagaaagatacattctttcaatttcaagtcctctcctcacgtggatcattaccggaactttcctgacttgtattcctcacagcttcaaaacttcttgcaagaatgcttcacaccaacaaaacaacaagctctgtgactttggaacatctttttttgcagaatatttgtagccttggtttgtttgtttgttttctcctcaaaagttgtttattattgatgatagaacaagataatccgaaggagacagaaactccaaactgtgtcgacgagctactgagcagagatagtttctgaaactcttagattgttgttgctagtttggcttcatatgtgaaacttgaccgatgctcgg

SEQ ID NO: 368 - protein, 1484 aa, Arabidopsis thaliana
  misc_feature: GI Number: 25411844; NR Description: probable integral
  misc_feature: GI Number: 21536700; NR Description: unknown [Arabidopsis thaliana]
  misc_feature: GI Number: 50540342; NR Description: zgc:92204 [Danio rerio]
  misc_feature: GI Number: 48146813; NR Description: FLJ22353 [Homo sapiens]
ATTTTTTCATCACTTATCAGCGATTTGACGAGAAGAGCCTTTTGGTTTCTGCGAATCATCCAAAATCCGCCATGGAAGCAACTACAAGAATCTTGAGTACTTCTTCTGCTCTCAATCGTCTTCTTCTTCTCAGTAAGCTCAATCTAAAATCAGATCCCCGTAATATCAATTCCACAAATCAGCTACTACACAATGCCGTTACCCGAAAATCCTCTATCTCCGCCGCTCGTATACGGTGCTCTTCGCTCCCTGCGAATGCGAATCTCTTCAGATCACTCTTCTTCCTAACGTCAACGTTTCGTCTCGAGAACACCGCCGTTCACGCTAATCCATTCCGATCCGAACCTAACGACGGCGTCGCCGTCTGGAACAGAGCTCCACGGATCGTGAACGGAGGTGGAAACGCGGCGATATTCGGCGGGAACGAGGGGAAAGAGACGACGGTGGTTCTCCTTGGTTGGCTAGGAGCGAAAGCTAAACATCTAAGGAGATACGTTGAGTGGTACAACTCCAGGGGAATTAACGCCGTTACTTTCACTGTTGACGTTAGGGATTTGCTCCGGTTAGATCTTGGTCGGCGGCTTGAACGAAGGATAGCTGAATTTGGGAATGAATTGGTTAATTGGGTATCGGAGAAAGAAGATGATGGTAGAGAGAAATGCTTGGTGTTTCACAGCTTCAGTAACACTGGTTGGCTTGTATATGGTGCCTTGCTAGAGAGCTTCATTGGTAGACAAGATTTAGTAGAAAGGATTGAGGGTTGTATCATTGACTCGGGAGGAGCAGATCCTCTTGATACTAAGATTTGGGCAGCGGGGTTTACCGCAGCTATACTGAAGAAGCGTAGCTCCACCATAACCACAGAACCAAACAGTCCCATAAAAGAAGAGGATGCTTCAACACCACAAAAGAAGGAACCTTTAGGAATCGAAAACATAATGCTATCATCTCTGGAGAAACTCTTCCCCATCTTCTTAAACCACCCAGACGTCAATACGAGGCTAACAAAAATCATTCAAAAACTATATGAGAACCATCCTCCATGTCCTCAGCTCTATCTTTACAGCTCCGGGGACAAAGTTGTTCCATCTCATTCCGTTGAGCTCCGCATCCGAGAACAACAGAAGATTGGAAGAAAGATACATTCTTTCAATTTCAAGTCCTCTCCTCACGTGGATCATTACCGGAACTTTCCTGACTTGTATTCCTCACAGCTTCAAAACTTCTTGCAAGAATGCTTCACACCAACAAAACAACAAGCTCTGTGACTTTGGAACATCTTTTTTTGCAGAATATTTGTAGCCTTGGTTTGTTTGTTTGTTTTCTCCTCAAAAGTTGTTTATTATTGATGATAGAACAAGATAATCCGAAGGAGACAGAAACTCCAAACTGTGTCGACGAGCTACTGAGCAGAGATAGTTTCTGAAACTCTTAGATTGTTGTTGCTAGTTTGGCTTCATATGTGAAACTTGACCGATGCTCGG

SEQ ID NO: 369 - DNA, 1065 bp, Arabidopsis thaliana
  misc_feature (1)..(1065): Ceres cDNA ID no. 12329120
  misc_feature (1)..(1065): Ceres CLONE  ID no. 33385
  misc_feature (1)..(1065): Also known as  Ceres CDNA ID no. 23364023
atcatcactctctgagatcgaagagaaagcaaaatcaaagttgtgatgaaatctctattgatgagaaccggttcgatgccggttcttcaaaaccggttaatttcaggtggttcatcgcggaagatgacgcctatctccaggaccaactccgtcgaatcattatccagctacggcgagagattcgccggcgggaagatttcgatcgaggttaaggctaatgtagggatgcggagggtgttatcggaaagtgatgtgattagatctgagagaatgttgaaaagtgttggatctaagccttcgccggcgagaatcccggaggatgatgaagcgggggaggaagaaattaggtttgcagatggttgggggtctatgatctccggtggtttacctgtggaggagaaatgtttcacgggtggcggtgttggtggtggatctggttatagcggcggttatggaaacggaggaggaggcggttatgaagataagagcaagatcggtgattattatcgagagatgttgagatctaatcctaataattcgcttcttctgatgaattacggcaagtttttgtatgaggtggagaaagatgcagagggagctgaagagtactatggaagagcaatactggagaatccaggagatggagaagctttatccatgtatggaagattgatatgggaaacgaagagagatgagaagagagctcaaggttactttgatcaagctgttaatgcttctcctaatgattgtatggttttgggatcatatgcacgtttcatgtgggaggcagaggatgatgatgatgatgatgaagaagaagaagaagaagaagaagaatggatggctgcatcaccactcatggtttctgcagtttagagactaacacgacgaagatgaagaagaagtaatggagactaagattatgtatcaagtatcaacctttttttttgtctatttcactgtctttttactaacttttgctgtaataacctgaagagtaatgaaaacatgtatgtgaaagaaaacgaatgtaaccttattataagagaataaaagtgcttttgc

SEQ ID NO: 370 - protein, 1065 aa, Arabidopsis thaliana
  misc_feature: PFam Name: GRP; PFam Description: Glycine rich protein family
  misc_feature: GI Number: 21592868; NR Description: unknown [Arabidopsis thaliana]
  misc_feature: GI Number: 21555875; NR Description: unknown [Arabidopsis thaliana]
  misc_feature: GI Number: 22165073; NR Description: putative peroxidase [Oryza sativa (japonica cultivar-group)] >gi|37535784|ref|NP_922194.1| putative peroxidase [Oryza sativa (japonica cultivar-group)] >gi|31432905|gb|AAP54481.1| putative
  misc_feature: GI Number: 48831816; NR Description: COG0457: FOG: TPR repeat
ATCATCACTCTCTGAGATCGAAGAGAAAGCAAAATCAAAGTTGTGATGAAATCTCTATTGATGAGAACCGGTTCGATGCCGGTTCTTCAAAACCGGTTAATTTCAGGTGGTTCATCGCGGAAGATGACGCCTATCTCCAGGACCAACTCCGTCGAATCATTATCCAGCTACGGCGAGAGATTCGCCGGCGGGAAGATTTCGATCGAGGTTAAGGCTAATGTAGGGATGCGGAGGGTGTTATCGGAAAGTGATGTGATTAGATCTGAGAGAATGTTGAAAAGTGTTGGATCTAAGCCTTCGCCGGCGAGAATCCCGGAGGATGATGAAGCGGGGGAGGAAGAAATTAGGTTTGCAGATGGTTGGGGGTCTATGATCTCCGGTGGTTTACCTGTGGAGGAGAAATGTTTCACGGGTGGCGGTGTTGGTGGTGGATCTGGTTATAGCGGCGGTTATGGAAACGGAGGAGGAGGCGGTTATGAAGATAAGAGCAAGATCGGTGATTATTATCGAGAGATGTTGAGATCTAATCCTAATAATTCGCTTCTTCTGATGAATTACGGCAAGTTTTTGTATGAGGTGGAGAAAGATGCAGAGGGAGCTGAAGAGTACTATGGAAGAGCAATACTGGAGAATCCAGGAGATGGAGAAGCTTTATCCATGTATGGAAGATTGATATGGGAAACGAAGAGAGATGAGAAGAGAGCTCAAGGTTACTTTGATCAAGCTGTTAATGCTTCTCCTAATGATTGTATGGTTTTGGGATCATATGCACGTTTCATGTGGGAGGCAGAGGATGATGATGATGATGATGAAGAAGAAGAAGAAGAAGAAGAAGAATGGATGGCTGCATCACCACTCATGGTTTCTGCAGTTTAGAGACTAACACGACGAAGATGAAGAAGAAGTAATGGAGACTAAGATTATGTATCAAGTATCAACCTTTTTTTTTGTCTATTTCACTGTCTTTTTACTAACTTTTGCTGTAATAACCTGAAGAGTAATGAAAACATGTATGTGAAAGAAAACGAATGTAACCTTATTATAAGAGAATAAAAGTGCTTTTGC

SEQ ID NO: 371 - DNA, 1811 bp, Arabidopsis thaliana
  misc_feature (1)..(1811): Ceres cDNA ID no. 12329212
  misc_feature (1)..(1811): Ceres CLONE  ID no. 248505
  misc_feature (1)..(1811): Also known as  Ceres CDNA ID no. 23659446
aagaaaaaatctatctccgccatgaacgcgagagctcttctttgctcttcaaatattcactctctctacacttcaaatcgtccacctgaaaaaacctcttcttctcgcagcctccgtaatctcaaaccatctccaaagtcgttacgggtatggatctacccgcgaaataggtccagtgttttccgggtattagttcggagctccgacaagagtgaaagcagtaattcgtattacgtagaaggagataaagtaagtggaaacaatgacgtcgtttctgattcgcctagctctatcgtcctcccatggtgggaagagtttccgaagcggtgggtgattgtgttactctgtttctcagcttttcttctctgcaatatggacagagtgaatatgagtatagctatacttccgatgtcagctgagtatggttggaatccagcaacagttggtctgattcagtcttctttcttctggggttaccttcttacacagatagctggtggaatttgggcagacactgtaggagggaaaagggttcttggattcggtgttatttggtggtcaatcgctacaattctcactcctgtagctgctaaactcggtcttccttacttgctcgttgttcgtgctttcatgggagttggagagggtgttgcaatgcctgctatgaataatatattgtcgaagtgggttcctgtgcaagagagaagcagatcactcgcgcttgtttacagcggaatgtaccttggatctgtcaccggtttagccttttcgcctttcttgattcatcaatttggatggccttctgtgttttattctttcgggtctcttggaactgtatggttgactctgtggctaactaaggcagagagttcaccattagaagatccaacattgctccctgaagaaagaaagctaattgcagacaactgtgctagcaaagagccagtgaagtcgatcccgtggaggctgatattgtcgaaaccaccggtttgggctctcatcagttgccacttttgtcacaactggggaacattcattctcttaacatggatgccaacttattaccatcaagtgctgaagttcaaccttatggagtcaggacttctctctgtatttccatggatgacaatggcaatatctgcaaatgccggtggatggattgccgatacacttgtcagccgaggtttctctgtcacgaatgtccgcaagataatgcaaacaatagggtttcttggaccagcgttcttcctaacacagctgaaacacatagattctcctacaatggctgttttgtgcatggcttgtagtcaggggactgatgcgttttcacagtctggtctatactctaaccatcaagacatcgctccaagatactctggagtgttacttggtttgtctaatactgctggagtacttgccggagttcttggcacagctgcgactggtcacatactacaacacggttcttgggatgacgttttcacgatttcggtcggtctttacctcgttgggaccgtcatttggaacctattttcaaccggagagaagataatcgattgatccattccgagaatagtaaatagttcggctccaagacctctcatcaggtgcaacttcacctcacgccagtctctgattatacaagtatcattgcagtctgagagctagccggaatattccttttttgccagaaaattcttcaggatctttctgctcgttgatttaggccaaacgcatatgaataatactttgtagatgaaagatatacagatgattttttgtaaataaacaaagctcacactttctcaaga

SEQ ID NO: 372 - protein, 1811 aa, Arabidopsis thaliana
  misc_feature: PFam Name: Sugar_tr; PFam Description: Sugar (and other)
  misc_feature: PFam Name: MFS_1; PFam Description: Major Facilitator Superfamily
  misc_feature: GI Number: 30725652; NR Description: At2g29650 [Arabidopsis thaliana] >gi|25082713|gb|AAN71994.1| putative Na+-dependent inorganic phosphate cotransporter [Arabidopsis thaliana] >gi|30684317|ref|NP_850136.1| inorganic phosphate transporter,
  misc_feature: GI Number: 42570975; NR Description: inorganic phosphate
  misc_feature: GI Number: 21387197; NR Description: putative Na+-dependent inorganic phosphate cotransporter [Arabidopsis thaliana] >gi|17064976|gb|AAL32642.1| putative Na+-dependent inorganic
  misc_feature: GI Number: 52077187; NR Description: putative sialin [Oryza
  misc_feature: GI Number: 7267124; NR Description: AT4g00370 [Arabidopsis thaliana] >gi|6049889|gb|AAF02804.1| weak similarity to phthalate permease family [Arabidopsis thaliana] >gi|2252847|gb|AAB62846.1| A_IG005I10.nn gene product [Arabidopsis A_IG005I10.nn -
AAGAAAAAATCTATCTCCGCCATGAACGCGAGAGCTCTTCTTTGCTCTTCAAATATTCACTCTCTCTACACTTCAAATCGTCCACCTGAAAAAACCTCTTCTTCTCGCAGCCTCCGTAATCTCAAACCATCTCCAAAGTCGTTACGGGTATGGATCTACCCGCGAAATAGGTCCAGTGTTTTCCGGGTATTAGTTCGGAGCTCCGACAAGAGTGAAAGCAGTAATTCGTATTACGTAGAAGGAGATAAAGTAAGTGGAAACAATGACGTCGTTTCTGATTCGCCTAGCTCTATCGTCCTCCCATGGTGGGAAGAGTTTCCGAAGCGGTGGGTGATTGTGTTACTCTGTTTCTCAGCTTTTCTTCTCTGCAATATGGACAGAGTGAATATGAGTATAGCTATACTTCCGATGTCAGCTGAGTATGGTTGGAATCCAGCAACAGTTGGTCTGATTCAGTCTTCTTTCTTCTGGGGTTACCTTCTTACACAGATAGCTGGTGGAATTTGGGCAGACACTGTAGGAGGGAAAAGGGTTCTTGGATTCGGTGTTATTTGGTGGTCAATCGCTACAATTCTCACTCCTGTAGCTGCTAAACTCGGTCTTCCTTACTTGCTCGTTGTTCGTGCTTTCATGGGAGTTGGAGAGGGTGTTGCAATGCCTGCTATGAATAATATATTGTCGAAGTGGGTTCCTGTGCAAGAGAGAAGCAGATCACTCGCGCTTGTTTACAGCGGAATGTACCTTGGATCTGTCACCGGTTTAGCCTTTTCGCCTTTCTTGATTCATCAATTTGGATGGCCTTCTGTGTTTTATTCTTTCGGGTCTCTTGGAACTGTATGGTTGACTCTGTGGCTAACTAAGGCAGAGAGTTCACCATTAGAAGATCCAACATTGCTCCCTGAAGAAAGAAAGCTAATTGCAGACAACTGTGCTAGCAAAGAGCCAGTGAAGTCGATCCCGTGGAGGCTGATATTGTCGAAACCACCGGTTTGGGCTCTCATCAGTTGCCACTTTTGTCACAACTGGGGAACATTCATTCTCTTAACATGGATGCCAACTTATTACCATCAAGTGCTGAAGTTCAACCTTATGGAGTCAGGACTTCTCTCTGTATTTCCATGGATGACAATGGCAATATCTGCAAATGCCGGTGGATGGATTGCCGATACACTTGTCAGCCGAGGTTTCTCTGTCACGAATGTCCGCAAGATAATGCAAACAATAGGGTTTCTTGGACCAGCGTTCTTCCTAACACAGCTGAAACACATAGATTCTCCTACAATGGCTGTTTTGTGCATGGCTTGTAGTCAGGGGACTGATGCGTTTTCACAGTCTGGTCTATACTCTAACCATCAAGACATCGCTCCAAGATACTCTGGAGTGTTACTTGGTTTGTCTAATACTGCTGGAGTACTTGCCGGAGTTCTTGGCACAGCTGCGACTGGTCACATACTACAACACGGTTCTTGGGATGACGTTTTCACGATTTCGGTCGGTCTTTACCTCGTTGGGACCGTCATTTGGAACCTATTTTCAACCGGAGAGAAGATAATCGATTGATCCATTCCGAGAATAGTAAATAGTTCGGCTCCAAGACCTCTCATCAGGTGCAACTTCACCTCACGCCAGTCTCTGATTATACAAGTATCATTGCAGTCTGAGAGCTAGCCGGAATATTCCTTTTTTGCCAGAAAATTCTTCAGGATCTTTCTGCTCGTTGATTTAGGCCAAACGCATATGAATAATACTTTGTAGATGAAAGATATACAGATGATTTTTTGTAAATAAACAAAGCTCACACTTTCTCAAGA

SEQ ID NO: 373 - DNA, 1349 bp, Arabidopsis thaliana
  misc_feature (1)..(1349): Ceres cDNA ID no. 12329597
  misc_feature (1)..(1349): Ceres CLONE  ID no. 119313
  misc_feature (1)..(1349): Also known as  Ceres CDNA ID no. 23364491
aatcaaagtttgggataatagtcttatctctttcatccacactaatataaataggatacatacacaacacattacaagaagataaatccaaacttttctttctctctctttcgtttcccattttttctcttatcactcatagatcctgattgatctgaaaaaatggtgaagaagcaatcgccattacacgttgtcggtgtgtctgttttgatggtgttgttatgcagtgttaattacagtctgtgtgaaaagatcaaaacgtataagctcacaagaggaagcttaagtgttactttcactaactatggtgctgtcatgacgtctcttctcctccctgacagacatggaaaacaagacgatgttgttcttggatttgatactgttgatggttacaagaatgatacaacatattttggagcaattgtgggaagagtggctaatagaataggaggtgctaaattcaagttaaatggtcatctctacaaaaccgatcccaacgaaggccataacactctccatggtggttcaaagggatttagtgatgtgatttggtcagtccaaaagtatgttcccactagtcacattactttcacatacgatagcttcgacggtgaagaaggttttccggggaatgtgacggtgaaagtgacgtacatgttgatcggagaaaacaaactcggtgtaaaaatggaagcaaagccactcaacaaacctacaccaatcaacttagctctccacacttactggaacctccacagccacaactccgggaacatcctctcccacaaaattcaactcctcgccggaaaaatcactcccgtcgacgacaaactcatccccaccggcgaaatcacctccattgccggaactccttacgattttctcgagcctcgcgagatcggaagccggatccacgaattacccggaggttacgacatcaattacgtgatcgatggaccgatcgggaaacatctgaggaaaactgcggttgtgacggaggaagtcaccggaaggaagatggagctgtggacgaatcagcctggtgttcagttttacacgagtaatatgatgaaacgtgtcgtcggtaaaggtaaagccgtttatgagaaatacggtggcttgtgtttggagactcaaggcttcccagattccgtcaatcacaagaactttccgtcgcagattgttaatcccggcgagagttatttgcatgttatgctcttcagattcactgctcactaatcgggtcgggtcgggtcgggtcgggtttttagggtttaatttttccgaatactcgccaacgtcgttgtaatgcaaaattgcaaatgccaataaaaatattcgacttttgc

SEQ ID NO: 374 - protein, 1349 aa, Arabidopsis thaliana
  misc_feature: PFam Name: Aldose_epim; PFam Description: Aldose 1-epimerase
  misc_feature: GI Number: 21537069; NR Description: aldose 1-epimerase-like
  misc_feature: GI Number: 7671483; NR Description: putative aldose 1-epimerase-like protein [Arabidopsis thaliana] >gi|11358633|pir||T49949 probable aldose 1-epimerase-like protein - Arabidopsis thaliana >gi|15242223|ref|NP_197018.1| aldose
  misc_feature: GI Number: 15824567; NR Description: non-cell-autonomous
  misc_feature: GI Number: 15824565; NR Description: non-cell-autonomous
  misc_feature: GI Number: 2739168; NR Description: aldose-1-epimerase-like protein [Nicotiana tabacum] >gi|7430313|pir||T01933 probable aldose
AATCAAAGTTTGGGATAATAGTCTTATCTCTTTCATCCACACTAATATAAATAGGATACATACACAACACATTACAAGAAGATAAATCCAAACTTTTCTTTCTCTCTCTTTCGTTTCCCATTTTTTCTCTTATCACTCATAGATCCTGATTGATCTGAAAAAATGGTGAAGAAGCAATCGCCATTACACGTTGTCGGTGTGTCTGTTTTGATGGTGTTGTTATGCAGTGTTAATTACAGTCTGTGTGAAAAGATCAAAACGTATAAGCTCACAAGAGGAAGCTTAAGTGTTACTTTCACTAACTATGGTGCTGTCATGACGTCTCTTCTCCTCCCTGACAGACATGGAAAACAAGACGATGTTGTTCTTGGATTTGATACTGTTGATGGTTACAAGAATGATACAACATATTTTGGAGCAATTGTGGGAAGAGTGGCTAATAGAATAGGAGGTGCTAAATTCAAGTTAAATGGTCATCTCTACAAAACCGATCCCAACGAAGGCCATAACACTCTCCATGGTGGTTCAAAGGGATTTAGTGATGTGATTTGGTCAGTCCAAAAGTATGTTCCCACTAGTCACATTACTTTCACATACGATAGCTTCGACGGTGAAGAAGGTTTTCCGGGGAATGTGACGGTGAAAGTGACGTACATGTTGATCGGAGAAAACAAACTCGGTGTAAAAATGGAAGCAAAGCCACTCAACAAACCTACACCAATCAACTTAGCTCTCCACACTTACTGGAACCTCCACAGCCACAACTCCGGGAACATCCTCTCCCACAAAATTCAACTCCTCGCCGGAAAAATCACTCCCGTCGACGACAAACTCATCCCCACCGGCGAAATCACCTCCATTGCCGGAACTCCTTACGATTTTCTCGAGCCTCGCGAGATCGGAAGCCGGATCCACGAATTACCCGGAGGTTACGACATCAATTACGTGATCGATGGACCGATCGGGAAACATCTGAGGAAAACTGCGGTTGTGACGGAGGAAGTCACCGGAAGGAAGATGGAGCTGTGGACGAATCAGCCTGGTGTTCAGTTTTACACGAGTAATATGATGAAACGTGTCGTCGGTAAAGGTAAAGCCGTTTATGAGAAATACGGTGGCTTGTGTTTGGAGACTCAAGGCTTCCCAGATTCCGTCAATCACAAGAACTTTCCGTCGCAGATTGTTAATCCCGGCGAGAGTTATTTGCATGTTATGCTCTTCAGATTCACTGCTCACTAATCGGGTCGGGTCGGGTCGGGTCGGGTTTTTAGGGTTTAATTTTTCCGAATACTCGCCAACGTCGTTGTAATGCAAAATTGCAAATGCCAATAAAAATATTCGACTTTTGC

SEQ ID NO: 375 - DNA, 1337 bp, Arabidopsis thaliana
  misc_feature (1)..(1337): Ceres cDNA ID no. 12329732
  misc_feature (1)..(1337): Ceres CLONE  ID no. 117993
  misc_feature (1)..(1337): Also known as  Ceres CDNA ID no. 23364621
atcttgtccgatggttcaaacagaaaccgatcaaaggatgggtcttaatctgaatttgtctatctactctttaccaaaacccttatctcaatttctcgatgaagtgtcgaggatcaaagacaatcattccaaactgtctgaaatcgatggttatgtcggaaaattagaggaagaaaggaacaaaatcgatgtttttaaacgagaactccctttatgcatgctcttattgaacgaagcgattggggcgttgaaggatgaggctagaaaagggttatcactgatggcatctaatgggaaattcgatgatgttgaaagggcaaaaccggaaactgataagaagagctggatgagctctgcccagttatggatctcgaaccctaattcccaattccgatcgacaaatgaagaagaagaagatcggtgtgtgagtcagaacccatttcagacatgtaattaccctaatcaaggaggggtatttatgccatttaaccgtcccccacctcctccaccaccagctcctctgtctctcatgactccaacatcagagatgatgatggattatagcagaattgagcagagtcatcatcatcatcaattcaataaaccttcttcacagagtcatcacattcagaagaaagagcagagaaggagatggtcacaggaacttcaccgtaaatttgttgatgctcttcataggcttggagggccacaagttgctacaccaaagcagattagagatttgatgaaagttgatggtttaaccaatgatgaagtcaagagccatttacaaaaatatagaatgcatatccgtaagcatccgctgcatccgacaaagactttgtcatcgtcggatcagccaggtgtgttagagagagaatcgcagagcttaataagtttgtcgaggtcggattcgccacaaagcccacttgttgcaagagggttgttcagtagtaatgttggtcatagctcagaggaagatgaggaggaggaggatgaagaggaggagaagtctgatggacgtagtagctgtagaaatgatgaaacaaagaagaagagacaagtgttggatcttgagctttgaaagtctgcatagtgaatgatataatctttaccaacttatgttatatatgctcaaaactttgagtttgttcgggagtttttgtagatgtaaacatgagagttgaaataaggaagaggattttgagcaaaaagtagggtttgtttttgcaagaggaaatagatagagaagagtgttcgaaatcctctgtgttttttttttttttttttttttacttcataagtaagataaactcatatatcaaagattttgtttttat

SEQ ID NO: 376 - protein, 1337 aa, Arabidopsis thaliana
  misc_feature: PFam Name: Myb_DNA-binding; PFam Description: Myb-like
  misc_feature: GI Number: 14532434; NR Description: AT4g37180/C7A10_180
  misc_feature: GI Number: 18419989; NR Description: myb family transcription
  misc_feature: GI Number: 30690890; NR Description: myb family transcription
  misc_feature: GI Number: 4006862; NR Description: putative cytoskeletal protein [Arabidopsis thaliana] >gi|7270667|emb|CAB80384.1| putative cytoskeletal protein [Arabidopsis thaliana] >gi|25407794|pir||C85439 probable cytoskeletal protein [imported]
  misc_feature: GI Number: 1732509; NR Description: putative cytoskeletal
ATCTTGTCCGATGGTTCAAACAGAAACCGATCAAAGGATGGGTCTTAATCTGAATTTGTCTATCTACTCTTTACCAAAACCCTTATCTCAATTTCTCGATGAAGTGTCGAGGATCAAAGACAATCATTCCAAACTGTCTGAAATCGATGGTTATGTCGGAAAATTAGAGGAAGAAAGGAACAAAATCGATGTTTTTAAACGAGAACTCCCTTTATGCATGCTCTTATTGAACGAAGCGATTGGGGCGTTGAAGGATGAGGCTAGAAAAGGGTTATCACTGATGGCATCTAATGGGAAATTCGATGATGTTGAAAGGGCAAAACCGGAAACTGATAAGAAGAGCTGGATGAGCTCTGCCCAGTTATGGATCTCGAACCCTAATTCCCAATTCCGATCGACAAATGAAGAAGAAGAAGATCGGTGTGTGAGTCAGAACCCATTTCAGACATGTAATTACCCTAATCAAGGAGGGGTATTTATGCCATTTAACCGTCCCCCACCTCCTCCACCACCAGCTCCTCTGTCTCTCATGACTCCAACATCAGAGATGATGATGGATTATAGCAGAATTGAGCAGAGTCATCATCATCATCAATTCAATAAACCTTCTTCACAGAGTCATCACATTCAGAAGAAAGAGCAGAGAAGGAGATGGTCACAGGAACTTCACCGTAAATTTGTTGATGCTCTTCATAGGCTTGGAGGGCCACAAGTTGCTACACCAAAGCAGATTAGAGATTTGATGAAAGTTGATGGTTTAACCAATGATGAAGTCAAGAGCCATTTACAAAAATATAGAATGCATATCCGTAAGCATCCGCTGCATCCGACAAAGACTTTGTCATCGTCGGATCAGCCAGGTGTGTTAGAGAGAGAATCGCAGAGCTTAATAAGTTTGTCGAGGTCGGATTCGCCACAAAGCCCACTTGTTGCAAGAGGGTTGTTCAGTAGTAATGTTGGTCATAGCTCAGAGGAAGATGAGGAGGAGGAGGATGAAGAGGAGGAGAAGTCTGATGGACGTAGTAGCTGTAGAAATGATGAAACAAAGAAGAAGAGACAAGTGTTGGATCTTGAGCTTTGAAAGTCTGCATAGTGAATGATATAATCTTTACCAACTTATGTTATATATGCTCAAAACTTTGAGTTTGTTCGGGAGTTTTTGTAGATGTAAACATGAGAGTTGAAATAAGGAAGAGGATTTTGAGCAAAAAGTAGGGTTTGTTTTTGCAAGAGGAAATAGATAGAGAAGAGTGTTCGAAATCCTCTGTGTTTTTTTTTTTTTTTTTTTTTTACTTCATAAGTAAGATAAACTCATATATCAAAGATTTTGTTTTTAT

SEQ ID NO: 377 - DNA, 1376 bp, Arabidopsis thaliana
  misc_feature (1)..(1376): Ceres cDNA ID no. 12329797
  misc_feature (1)..(1376): Ceres CLONE  ID no. 107675
  misc_feature (1)..(1376): Also known as  Ceres CDNA ID no. 23364686
atcacggaaaatgtcaagcagagaaaaccctagcggaatctgcaaaagcattcccaagctcatctcttccttcgtcgacactttcgttgattactccgtctccggcatcttcctgccccaagatcctagctcacaaaatgagattctgcaaacgaggttcgagaagccggagcgactcgttgcaatcggtgatctccatggcgatctcgagaagtctagagaagcattcaagatcgctggtctgattgattcgtcggacagatggactggtggatcaacgatggttgttcaggtgggcgacgtactagatcgaggtggagaggagttgaagatactttatttcttagagaaattgaaacgagaggctgagagagctggaggtaagattctgactatgaatgggaaccatgagatcatgaatatagaaggtgactttagatatgtgactaagaaaggtttagaggaatttcagatttgggctgattggtattgtttagggaacaagatgaagactttatgcagtggtcttgataaacctaaggatccttacgaagggattccgatgagcttccctcgtatgagagccgactgttttgaaggaattagagctaggattgctgcattgagacctgatggtccgattgcaaagagattcttgactaagaatcaaacagttgctgttgttggtgattcggtttttgttcacggtggtcttttagctgagcatatagagtatggactggagaggattaacgaggaggttcggggttggattaacgggtttaaaggaggaagatatgcgcctgcttattgtagaggagggaactctgtagtttggttgaggaagttctcggaagaaatggctcacaaatgtgattgtgcagctcttgagcatgctctttccactattcccggggttaagaggatgatcatgggacatacaatccaggatgctggtatcaacggtgtttgtaatgataaagccattaggattgatgttggcatgtccaagggatgtgctgatggattgcctgaggttttggagatccgcagggactccggtgtacggatagtgacatcgaatccattgtataaggagaatctgtattctcatgtagctcctgatagtaaaacgggtctcgggttactggtaccagttcctaagcaagttgaagtcaaagcttgaagacttttcgttgatactctctgtttagatgattgatgccttttgcaagtctagcattggcggattcttagcatgaccaaccataaacatcttcttggcgcataaattgtagtttttatcattaaaacgatagataatgtttgtagcaatatggaacattatttcttattcaatataattgttcaaggcc

SEQ ID NO: 378 - protein, 1376 aa, Arabidopsis thaliana
  misc_feature: PFam Name: Metallophos; PFam Description: Calcineurin-like
  misc_feature: GI Number: 23308175; NR Description: At1g18480/F15H18_1 [Arabidopsis thaliana] >gi|16226290|gb|AAL16125.1| At1g18480/F15H18_1 [Arabidopsis thaliana] >gi|18394613|ref|NP_564053.1| calcineurin-like phosphoesterase
  misc_feature: GI Number: 58743497; NR Description: Putative [Brassica oleracea]
  misc_feature: GI Number: 25402861; NR Description: protein F15H18.4 [imported] - Arabidopsis thaliana >gi|6714305|gb|AAF26001.1|
  misc_feature: GI Number: 21536655; NR Description: unknown [Arabidopsis thaliana]
  misc_feature: GI Number: 62733791; NR Description: At1g18480/F15H18_1
ATCACGGAAAATGTCAAGCAGAGAAAACCCTAGCGGAATCTGCAAAAGCATTCCCAAGCTCATCTCTTCCTTCGTCGACACTTTCGTTGATTACTCCGTCTCCGGCATCTTCCTGCCCCAAGATCCTAGCTCACAAAATGAGATTCTGCAAACGAGGTTCGAGAAGCCGGAGCGACTCGTTGCAATCGGTGATCTCCATGGCGATCTCGAGAAGTCTAGAGAAGCATTCAAGATCGCTGGTCTGATTGATTCGTCGGACAGATGGACTGGTGGATCAACGATGGTTGTTCAGGTGGGCGACGTACTAGATCGAGGTGGAGAGGAGTTGAAGATACTTTATTTCTTAGAGAAATTGAAACGAGAGGCTGAGAGAGCTGGAGGTAAGATTCTGACTATGAATGGGAACCATGAGATCATGAATATAGAAGGTGACTTTAGATATGTGACTAAGAAAGGTTTAGAGGAATTTCAGATTTGGGCTGATTGGTATTGTTTAGGGAACAAGATGAAGACTTTATGCAGTGGTCTTGATAAACCTAAGGATCCTTACGAAGGGATTCCGATGAGCTTCCCTCGTATGAGAGCCGACTGTTTTGAAGGAATTAGAGCTAGGATTGCTGCATTGAGACCTGATGGTCCGATTGCAAAGAGATTCTTGACTAAGAATCAAACAGTTGCTGTTGTTGGTGATTCGGTTTTTGTTCACGGTGGTCTTTTAGCTGAGCATATAGAGTATGGACTGGAGAGGATTAACGAGGAGGTTCGGGGTTGGATTAACGGGTTTAAAGGAGGAAGATATGCGCCTGCTTATTGTAGAGGAGGGAACTCTGTAGTTTGGTTGAGGAAGTTCTCGGAAGAAATGGCTCACAAATGTGATTGTGCAGCTCTTGAGCATGCTCTTTCCACTATTCCCGGGGTTAAGAGGATGATCATGGGACATACAATCCAGGATGCTGGTATCAACGGTGTTTGTAATGATAAAGCCATTAGGATTGATGTTGGCATGTCCAAGGGATGTGCTGATGGATTGCCTGAGGTTTTGGAGATCCGCAGGGACTCCGGTGTACGGATAGTGACATCGAATCCATTGTATAAGGAGAATCTGTATTCTCATGTAGCTCCTGATAGTAAAACGGGTCTCGGGTTACTGGTACCAGTTCCTAAGCAAGTTGAAGTCAAAGCTTGAAGACTTTTCGTTGATACTCTCTGTTTAGATGATTGATGCCTTTTGCAAGTCTAGCATTGGCGGATTCTTAGCATGACCAACCATAAACATCTTCTTGGCGCATAAATTGTAGTTTTTATCATTAAAACGATAGATAATGTTTGTAGCAATATGGAACATTATTTCTTATTCAATATAATTGTTCAAGGCC

SEQ ID NO: 379 - DNA, 1553 bp, Arabidopsis thaliana
  misc_feature (1)..(1553): Ceres cDNA ID no. 12329896
  misc_feature (1)..(1553): Ceres CLONE  ID no. 120155
  misc_feature (1)..(1553): Also known as  Ceres CDNA ID no. 24419095
atgaaccaagaaaatatcttcaaattattgaacacaaaagtaagaaaaaagtgagataataaggaaattaaaacaataaattatcctttcggtgggattttttttgtcgtcttctattgtttttgtgagtgtgtgtgtttatataatggtaagagatctctgatctctcaagcttctctatagagagagtttcttctcatgctctttctaccaaggagaagattttctcgttaattttgtttgacttgcctcttcgaagcaacctgattctgtggtctgaatcttttcaagggaagagaagataagctaaacaagagaatggtgacaggttgtgttgatcttcatcaatctttcaaatctgcagattcatcttctgtgccaattcctcctcctcttccatcaaaatctgatggactcaagaaaaaacttgggcatagcagcgtttcgacagccacaagagatatgtgggatcgtcttttcaatgacggatacaaagctgatgtagtcatctatacagataatggcagtatcatctatgctcatgccaacatccttggaactgcttccactgtgatcaaaggcatgttgaagcaagccaagagacatggcaagtggcatacaatatcaatccgaggtgtccctcatgatgctgtgcgagtttttatccgtttcctctactcttcttgctatgagaaagaagaaatgaacgagtttatcatgcatttgctacttctgtcacacgcgtacgtggttcctcagctgaaacgggtctgtgaatggcatctagaacatggtttgcttaccactgagaatgtggttgatgtgttccagcttgcgctgctgtgtgatttccctcggcttagcctcatatctcaccgtatgatcatgaaacactttaacgaactctctgcgacagaagcatggacagctatgaagaaaagccatccctttcttgagaaagaagttagagactcagtaatcatcgaagcaaatacgcggaaagagaggatgagaaaacgcaatgatcagaggatatattcgcagctatacgaagcaatggaagcacttgttcatatatgcagagatggatgtaaaacaatagggccacacgataaagatttcaaaccgaaccatgcaacgtgtaactatgaagcttgcaagggattagaatcactgatccggcatttcgcaggctgtaagctaagagttccaggaggttgcgtgcattgcaagagaatgtggcaactccttgaactgcattcacgtgtttgcgcaggttctgatcaatgtcgagtccctctatgcagaaaccttaaggagaagatggagaaacagagcaagaaagatgagtcgagatggaaacttctggtgaagaatgtattggggagtaagaaaatcggaggctctcctttctttttaccggtgacaaactgttaaaaaacattttgtcaatctcaagaagggcgagttttaagcgtttcttgtgatcctatctttaaaacaagtgtaacataatgagtttgaataaatgacacatattttggtcggccaag

SEQ ID NO: 380 - protein, 1553 aa, Arabidopsis thaliana
  misc_feature: PFam Name: BTB; PFam Description: BTB/POZ domain
  misc_feature: PFam Name: zf-TAZ; PFam Description: TAZ zinc finger
  misc_feature: GI Number: 42573822; NR Description: TAZ zinc finger family
  misc_feature: GI Number: 36955924; NR Description: BTB and TAZ domain protein 5 [Arabidopsis thaliana] >gi|18420081|ref|NP_568031.1| TAZ zinc finger family protein / BTB/POZ domain-containing protein
  misc_feature: GI Number: 21537174; NR Description: unknown [Arabidopsis thaliana]
  misc_feature: GI Number: 57899800; NR Description: putative BTB and TAZ
  misc_feature: GI Number: 42561724; NR Description: TAZ zinc finger family
ATGAACCAAGAAAATATCTTCAAATTATTGAACACAAAAGTAAGAAAAAAGTGAGATAATAAGGAAATTAAAACAATAAATTATCCTTTCGGTGGGATTTTTTTTGTCGTCTTCTATTGTTTTTGTGAGTGTGTGTGTTTATATAATGGTAAGAGATCTCTGATCTCTCAAGCTTCTCTATAGAGAGAGTTTCTTCTCATGCTCTTTCTACCAAGGAGAAGATTTTCTCGTTAATTTTGTTTGACTTGCCTCTTCGAAGCAACCTGATTCTGTGGTCTGAATCTTTTCAAGGGAAGAGAAGATAAGCTAAACAAGAGAATGGTGACAGGTTGTGTTGATCTTCATCAATCTTTCAAATCTGCAGATTCATCTTCTGTGCCAATTCCTCCTCCTCTTCCATCAAAATCTGATGGACTCAAGAAAAAACTTGGGCATAGCAGCGTTTCGACAGCCACAAGAGATATGTGGGATCGTCTTTTCAATGACGGATACAAAGCTGATGTAGTCATCTATACAGATAATGGCAGTATCATCTATGCTCATGCCAACATCCTTGGAACTGCTTCCACTGTGATCAAAGGCATGTTGAAGCAAGCCAAGAGACATGGCAAGTGGCATACAATATCAATCCGAGGTGTCCCTCATGATGCTGTGCGAGTTTTTATCCGTTTCCTCTACTCTTCTTGCTATGAGAAAGAAGAAATGAACGAGTTTATCATGCATTTGCTACTTCTGTCACACGCGTACGTGGTTCCTCAGCTGAAACGGGTCTGTGAATGGCATCTAGAACATGGTTTGCTTACCACTGAGAATGTGGTTGATGTGTTCCAGCTTGCGCTGCTGTGTGATTTCCCTCGGCTTAGCCTCATATCTCACCGTATGATCATGAAACACTTTAACGAACTCTCTGCGACAGAAGCATGGACAGCTATGAAGAAAAGCCATCCCTTTCTTGAGAAAGAAGTTAGAGACTCAGTAATCATCGAAGCAAATACGCGGAAAGAGAGGATGAGAAAACGCAATGATCAGAGGATATATTCGCAGCTATACGAAGCAATGGAAGCACTTGTTCATATATGCAGAGATGGATGTAAAACAATAGGGCCACACGATAAAGATTTCAAACCGAACCATGCAACGTGTAACTATGAAGCTTGCAAGGGATTAGAATCACTGATCCGGCATTTCGCAGGCTGTAAGCTAAGAGTTCCAGGAGGTTGCGTGCATTGCAAGAGAATGTGGCAACTCCTTGAACTGCATTCACGTGTTTGCGCAGGTTCTGATCAATGTCGAGTCCCTCTATGCAGAAACCTTAAGGAGAAGATGGAGAAACAGAGCAAGAAAGATGAGTCGAGATGGAAACTTCTGGTGAAGAATGTATTGGGGAGTAAGAAAATCGGAGGCTCTCCTTTCTTTTTACCGGTGACAAACTGTTAAAAAACATTTTGTCAATCTCAAGAAGGGCGAGTTTTAAGCGTTTCTTGTGATCCTATCTTTAAAACAAGTGTAACATAATGAGTTTGAATAAATGACACATATTTTGGTCGGCCAAG

SEQ ID NO: 381 - DNA, 1491 bp, Arabidopsis thaliana
  misc_feature (1)..(1491): Ceres cDNA ID no. 12330177
  misc_feature (1)..(1491): Ceres CLONE  ID no. 108716
  misc_feature (1)..(1491): Also known as  Ceres CDNA ID no. 23365038
acagttacttctctctttctctccctctcttcttcttcttcttcttctctctctcgtcgtcactctcagtagatcggaaaatggagccatggattgacgaattaaccgacgacttacagagtgtaagctttacatcagccggaaccaccgtgaatcgaagcacaagctccggttctcgctcttcctcctccgccgcagctttaacaccagcaccatcagctcacggttcattctcatcttcgaaactccctccttcactccgatcatctctctcactctccgatctcagattccgtctccgtctcggttccggcgacatcggctctgttttcttagccgaattcaaatccctaaccgccgtaacagaaacctccgccgttaaattacctctgttagcagcgaaagttatggataaaaaggagctcgcgagcagaagcaaagaaggtagagctaagacggagagagagattctcgaatctcttgatcatccgtttcttccgacgctttacgccgccattgattctccgaaatggctctgtttgttaacggagttttgtcccggcggtgaccttcatgttctccgtcaaaaacagactcataaacgtttccatgaatccgccgtcagattctatgtatcggaagtgatcgtagccattgaatatcttcacatgttggggattgtttaccgcgacttgaagcctgagaacgtgctggttcgatcagatggtcacatcatgttaactgattttgatctctccttaaaatgtgatgaatcgacttccacaccacagatagtgctgaaccggaacaaccttcctaatggctcgtctgaccagaacgagaaccaaggcatggaccaccgtcaaaccacatcatcctcttgcatgatccctaactgtattgtccctgctgtctcttgcttccacccgagaatccgaaggcgcaagaagaaaactgatcaccgtaacaacggtcctgagcttgtagccgagcctgtggatgtccggtctatgtccttcgttgggacgcatgagtacttggctcctgagattgtttcaggagaaggacatggtagtgcagtggactggtggacattagggatattcatgttcgagctgttctacggaacaacaccgtttaaaggaatggaccacgagttaactcttgccaacatcgtagctcgagccctcgaattcccgaaagaaccaacgattccaagcgcagccaaggatctgatctctcagctacttgccaaggacccgagccgacggttagggtcatctctgggtgcaacagccgtgaaacgtcacccatttttccaaggagtgaattgggcattgctcatgtgtactcgtcctccttttcttcctccacctttccgcaaagaacttttgtctgatgacatttgtccggaaacccatgtcgactattattaataacttaattagcgctacgtaattaattaattttcttcagatataaattatttct

SEQ ID NO: 382 - protein, 1491 aa, Arabidopsis thaliana
  misc_feature: PFam Name: Pkinase; PFam Description: Protein kinase domain
  misc_feature: GI Number: 30692190; NR Description: protein kinase family
  misc_feature: GI Number: 6967109; NR Description: protein kinase-like protein [Arabidopsis thaliana] >gi|11260282|pir||T47436 protein
  misc_feature: GI Number: 62701689; NR Description: second messenger-dependent protein kinase, putative [Oryza sativa
  misc_feature: GI Number: 1200256; NR Description: stpk1 protein kinase [Solanum tuberosum] >gi|7446383|pir||T07670 probable protein kinase
  misc_feature: GI Number: 125568; NR Description: Protein kinase PVPK-1 >gi|100013|pir||A30311 protein kinase C (EC 2.7.1.-) homolog -
ACAGTTACTTCTCTCTTTCTCTCCCTCTCTTCTTCTTCTTCTTCTTCTCTCTCTCGTCGTCACTCTCAGTAGATCGGAAAATGGAGCCATGGATTGACGAATTAACCGACGACTTACAGAGTGTAAGCTTTACATCAGCCGGAACCACCGTGAATCGAAGCACAAGCTCCGGTTCTCGCTCTTCCTCCTCCGCCGCAGCTTTAACACCAGCACCATCAGCTCACGGTTCATTCTCATCTTCGAAACTCCCTCCTTCACTCCGATCATCTCTCTCACTCTCCGATCTCAGATTCCGTCTCCGTCTCGGTTCCGGCGACATCGGCTCTGTTTTCTTAGCCGAATTCAAATCCCTAACCGCCGTAACAGAAACCTCCGCCGTTAAATTACCTCTGTTAGCAGCGAAAGTTATGGATAAAAAGGAGCTCGCGAGCAGAAGCAAAGAAGGTAGAGCTAAGACGGAGAGAGAGATTCTCGAATCTCTTGATCATCCGTTTCTTCCGACGCTTTACGCCGCCATTGATTCTCCGAAATGGCTCTGTTTGTTAACGGAGTTTTGTCCCGGCGGTGACCTTCATGTTCTCCGTCAAAAACAGACTCATAAACGTTTCCATGAATCCGCCGTCAGATTCTATGTATCGGAAGTGATCGTAGCCATTGAATATCTTCACATGTTGGGGATTGTTTACCGCGACTTGAAGCCTGAGAACGTGCTGGTTCGATCAGATGGTCACATCATGTTAACTGATTTTGATCTCTCCTTAAAATGTGATGAATCGACTTCCACACCACAGATAGTGCTGAACCGGAACAACCTTCCTAATGGCTCGTCTGACCAGAACGAGAACCAAGGCATGGACCACCGTCAAACCACATCATCCTCTTGCATGATCCCTAACTGTATTGTCCCTGCTGTCTCTTGCTTCCACCCGAGAATCCGAAGGCGCAAGAAGAAAACTGATCACCGTAACAACGGTCCTGAGCTTGTAGCCGAGCCTGTGGATGTCCGGTCTATGTCCTTCGTTGGGACGCATGAGTACTTGGCTCCTGAGATTGTTTCAGGAGAAGGACATGGTAGTGCAGTGGACTGGTGGACATTAGGGATATTCATGTTCGAGCTGTTCTACGGAACAACACCGTTTAAAGGAATGGACCACGAGTTAACTCTTGCCAACATCGTAGCTCGAGCCCTCGAATTCCCGAAAGAACCAACGATTCCAAGCGCAGCCAAGGATCTGATCTCTCAGCTACTTGCCAAGGACCCGAGCCGACGGTTAGGGTCATCTCTGGGTGCAACAGCCGTGAAACGTCACCCATTTTTCCAAGGAGTGAATTGGGCATTGCTCATGTGTACTCGTCCTCCTTTTCTTCCTCCACCTTTCCGCAAAGAACTTTTGTCTGATGACATTTGTCCGGAAACCCATGTCGACTATTATTAATAACTTAATTAGCGCTACGTAATTAATTAATTTTCTTCAGATATAAATTATTTCT

SEQ ID NO: 383 - DNA, 1371 bp, Arabidopsis thaliana
  misc_feature (1)..(1371): Ceres cDNA ID no. 12330189
  misc_feature (1)..(1371): Ceres CLONE  ID no. 34141
  misc_feature (1)..(1371): Also known as  Ceres CDNA ID no. 23365054
aatatatacgaaacgtaccacaaatttctaactaaagcattcatagtctctcgaaagcctcttttcagaaccgaagctctttactttcgtccaccgggaaatatgccagtcgacgtagcctcaccggccggaaaaaccgtctgcgtcaccggagctggtggatacatcgcttcttggattgttaagatacttctcgagagaggttacacagtcaaaggaaccgtacggaatccagatgatccgaagaacacacatttgagagaactagaaggaggaaaggagagactgattctgtgcaaagcagatcttcaggactacgaggctcttaaggcggcgattgatggttgcgacggcgtctttcacacggcttctcctgtcaccgacgatccggaacaaatggtggagccggccgtgaatggagccaagtttgtaattaatgctgcggctgaggccaaggtcaagcgcgtggtcatcacctcctccattggtgccgtctacatggacccgaaccgtgaccctgaggctgtcgttgacgaaagttgttggagtgatcttgacttctgcaaaaacaccaagaattggtattgttacggcaagatggtggcggaacaagcggcgtgggagacagcaaaggagaaaggtgttgacttggtggtgttgaatccggtgctggttcttggaccgccgttacagccgacgatcaacgccagtctttaccacgtcctcaaatatctaaccggctcggctaagacttatgctaatttgactcaagcttatgtggatgttcgcgatgtcgcgctggctcatgttctggtctatgaggcaccctcggcctccggacgttatctcctagccgagagtgctcgccaccgcggggaagttgttgagattctggctaagctattcccggagtatcctcttccgaccaagtgcaaggacgagaagaaccctagagccaagccatacaaattcactaaccagaagattaaggacttaggcttagagttcacttccaccaagcaaagcctctacgacacagtcaagagcttacaagagaaaggccatcttgctcctcctcctcctcctccttcagcatcgcaagaatccgtggaaaatggcattaagatcgggtcttgaaaagcttattaattccctcaagtatcccccttaagtatccttaaccattgaagttgcttttgtttgttgtctctggttatgtgaaacctctgtttcaatatgtctcgtctggttatgaatctgtacactcagttctttggccaaaccgtttgatggattttgtagtcaagtcttcatgtttgatcctatgtaatagattacacttaagtaaacaacttcatttttattctatgc

SEQ ID NO: 384 - protein, 1371 aa, Arabidopsis thaliana
  misc_feature: PFam Name: Epimerase; PFam Description: NAD dependent
  misc_feature: PFam Name: 3Beta_HSD; PFam Description: 3-beta
  misc_feature: PFam Name: Polysacc_synt_2; PFam Description: Polysaccharide
  misc_feature: PFam Name: NmrA; PFam Description: NmrA-like family
  misc_feature: GI Number: 29028764; NR Description: At1g80820 [Arabidopsis thaliana] >gi|6503293|gb|AAF14669.1| Similar to gb|X98083 cinnamoyl-CoA reductase from Zea mays. ESTs gb|Z24528 and gb|AI996461 come from this gene. [Arabidopsis putative
  misc_feature: GI Number: 52355804; NR Description: cinnamoyl CoA reductase 1 [Arabidopsis thaliana] >gi|12083326|gb|AAG48822.1| putative cinnamoyl CoA reductase [Arabidopsis thaliana] >gi|21592916|gb|AAM64866.1| cinnamoyl CoA reductase, puitative
  misc_feature: GI Number: 12407990; NR Description: cinnamoyl CoA reductase
  misc_feature: GI Number: 31414896; NR Description: cinnamoyl CoA reductase
  misc_feature: GI Number: 2960364; NR Description: cinnamoyl CoA reductase
AATATATACGAAACGTACCACAAATTTCTAACTAAAGCATTCATAGTCTCTCGAAAGCCTCTTTTCAGAACCGAAGCTCTTTACTTTCGTCCACCGGGAAATATGCCAGTCGACGTAGCCTCACCGGCCGGAAAAACCGTCTGCGTCACCGGAGCTGGTGGATACATCGCTTCTTGGATTGTTAAGATACTTCTCGAGAGAGGTTACACAGTCAAAGGAACCGTACGGAATCCAGATGATCCGAAGAACACACATTTGAGAGAACTAGAAGGAGGAAAGGAGAGACTGATTCTGTGCAAAGCAGATCTTCAGGACTACGAGGCTCTTAAGGCGGCGATTGATGGTTGCGACGGCGTCTTTCACACGGCTTCTCCTGTCACCGACGATCCGGAACAAATGGTGGAGCCGGCCGTGAATGGAGCCAAGTTTGTAATTAATGCTGCGGCTGAGGCCAAGGTCAAGCGCGTGGTCATCACCTCCTCCATTGGTGCCGTCTACATGGACCCGAACCGTGACCCTGAGGCTGTCGTTGACGAAAGTTGTTGGAGTGATCTTGACTTCTGCAAAAACACCAAGAATTGGTATTGTTACGGCAAGATGGTGGCGGAACAAGCGGCGTGGGAGACAGCAAAGGAGAAAGGTGTTGACTTGGTGGTGTTGAATCCGGTGCTGGTTCTTGGACCGCCGTTACAGCCGACGATCAACGCCAGTCTTTACCACGTCCTCAAATATCTAACCGGCTCGGCTAAGACTTATGCTAATTTGACTCAAGCTTATGTGGATGTTCGCGATGTCGCGCTGGCTCATGTTCTGGTCTATGAGGCACCCTCGGCCTCCGGACGTTATCTCCTAGCCGAGAGTGCTCGCCACCGCGGGGAAGTTGTTGAGATTCTGGCTAAGCTATTCCCGGAGTATCCTCTTCCGACCAAGTGCAAGGACGAGAAGAACCCTAGAGCCAAGCCATACAAATTCACTAACCAGAAGATTAAGGACTTAGGCTTAGAGTTCACTTCCACCAAGCAAAGCCTCTACGACACAGTCAAGAGCTTACAAGAGAAAGGCCATCTTGCTCCTCCTCCTCCTCCTCCTTCAGCATCGCAAGAATCCGTGGAAAATGGCATTAAGATCGGGTCTTGAAAAGCTTATTAATTCCCTCAAGTATCCCCCTTAAGTATCCTTAACCATTGAAGTTGCTTTTGTTTGTTGTCTCTGGTTATGTGAAACCTCTGTTTCAATATGTCTCGTCTGGTTATGAATCTGTACACTCAGTTCTTTGGCCAAACCGTTTGATGGATTTTGTAGTCAAGTCTTCATGTTTGATCCTATGTAATAGATTACACTTAAGTAAACAACTTCATTTTTATTCTATGC

SEQ ID NO: 385 - DNA, 1155 bp, Arabidopsis thaliana
  misc_feature (1)..(1155): Ceres cDNA ID no. 12330230
  misc_feature (1)..(1155): Ceres CLONE  ID no. 115917
  misc_feature (1)..(1155): Also known as  Ceres CDNA ID no. 23365091
acaaacaaagatctgagagatggatgaagaactcaagaacttgatcaaagtatgggtttctgcaataatctcgatatcttattgttactacataccacctagaatcaaatctggtgctcctcgattcctctctgtttcccctgttcttgctctgtttcttgttcttcctctgtttttctcctctctgcatttatctttaatcacagcgtttttcctcacatggcttgctaatttcaaactcatcctcttctccttcgataaaggtcctttaatcccaattccaacaaatttccctcgattcttctgcttcacttgcttccccatcaaggttcagcaaaaccctaaatctcaaaaccatttgcccaaattggttttcgccattaaacttgcaatctttgcagtgctattacatttgtatagctacagacaaaatctgtctccgactatactattaggtctctattttgtgcatctctacttagagattgagattatattaacgtttgttaaagttgttgtttttatctctcttggctgcgatcttgagccacagtccaataaaccgtacttagccacatctctacaagacttctggggtcgccggtggaatctcatggttccggcgattctccggccagccgtttacgcaccaatgcggcgagtctctgaacgcaaaatgagttccggttgggctctgtttccggggattttggcagcgtttatcgtctccggtttggttcacgaattgctcttcttctatttgatacgtgagatgcctacaggagaagttactctgttctttgtgttacatggcgtttgtactgctgtagaattggcggtgaagaagaaaacgacggtagcacagcggtggcggttgagtccgggggtgtcgcgggttctcacggtggggtttgtgtttgtgactggtggttggttgtttacacctcagcttaaaaggagcggggtgatggagagattcacatctgaagctgtgttgctcgttgagttcattaagcgataagttattttatttacgttgttggggatattttataacgagtgttaaatgagcacgagttaacgttattgagtccggttgagcatcaaagtccataatggtcaactacttatcttgaaatgaatcgaacttgtctt

SEQ ID NO: 386 - protein, 1155 aa, Arabidopsis thaliana
  misc_feature: PFam Name: MBOAT; PFam Description: MBOAT family
  misc_feature: GI Number: 9758167; NR Description: wax synthase-like protein [Arabidopsis thaliana] >gi|15240497|ref|NP_200346.1| membrane bound O-acyl transferase (MBOAT) family protein / wax synthase-related
  misc_feature: GI Number: 9758168; NR Description: wax synthase-like protein [Arabidopsis thaliana] >gi|15240498|ref|NP_200347.1| long-chain-alcohol O-fatty-acyltransferase family protein / wax
  misc_feature: GI Number: 8778260; NR Description: F12K21.17 [Arabidopsis
  misc_feature: GI Number: 9758165; NR Description: wax synthase-like protein [Arabidopsis thaliana] >gi|15240495|ref|NP_200344.1| membrane bound O-acyl transferase (MBOAT) family protein / wax synthase-related
  misc_feature: GI Number: 15218662; NR Description: membrane bound O-acyl transferase (MBOAT) family protein / wax synthase-related
ACAAACAAAGATCTGAGAGATGGATGAAGAACTCAAGAACTTGATCAAAGTATGGGTTTCTGCAATAATCTCGATATCTTATTGTTACTACATACCACCTAGAATCAAATCTGGTGCTCCTCGATTCCTCTCTGTTTCCCCTGTTCTTGCTCTGTTTCTTGTTCTTCCTCTGTTTTTCTCCTCTCTGCATTTATCTTTAATCACAGCGTTTTTCCTCACATGGCTTGCTAATTTCAAACTCATCCTCTTCTCCTTCGATAAAGGTCCTTTAATCCCAATTCCAACAAATTTCCCTCGATTCTTCTGCTTCACTTGCTTCCCCATCAAGGTTCAGCAAAACCCTAAATCTCAAAACCATTTGCCCAAATTGGTTTTCGCCATTAAACTTGCAATCTTTGCAGTGCTATTACATTTGTATAGCTACAGACAAAATCTGTCTCCGACTATACTATTAGGTCTCTATTTTGTGCATCTCTACTTAGAGATTGAGATTATATTAACGTTTGTTAAAGTTGTTGTTTTTATCTCTCTTGGCTGCGATCTTGAGCCACAGTCCAATAAACCGTACTTAGCCACATCTCTACAAGACTTCTGGGGTCGCCGGTGGAATCTCATGGTTCCGGCGATTCTCCGGCCAGCCGTTTACGCACCAATGCGGCGAGTCTCTGAACGCAAAATGAGTTCCGGTTGGGCTCTGTTTCCGGGGATTTTGGCAGCGTTTATCGTCTCCGGTTTGGTTCACGAATTGCTCTTCTTCTATTTGATACGTGAGATGCCTACAGGAGAAGTTACTCTGTTCTTTGTGTTACATGGCGTTTGTACTGCTGTAGAATTGGCGGTGAAGAAGAAAACGACGGTAGCACAGCGGTGGCGGTTGAGTCCGGGGGTGTCGCGGGTTCTCACGGTGGGGTTTGTGTTTGTGACTGGTGGTTGGTTGTTTACACCTCAGCTTAAAAGGAGCGGGGTGATGGAGAGATTCACATCTGAAGCTGTGTTGCTCGTTGAGTTCATTAAGCGATAAGTTATTTTATTTACGTTGTTGGGGATATTTTATAACGAGTGTTAAATGAGCACGAGTTAACGTTATTGAGTCCGGTTGAGCATCAAAGTCCATAATGGTCAACTACTTATCTTGAAATGAATCGAACTTGTCTT

SEQ ID NO: 387 - DNA, 1335 bp, Arabidopsis thaliana
  misc_feature (1)..(1335): Ceres cDNA ID no. 12330247
  misc_feature (1)..(1335): Ceres CLONE  ID no. 106148
  misc_feature (1)..(1335): Also known as  Ceres CDNA ID no. 23365107
acactcctctccttcttctttacacctctccaatggtaaaatctctcattcactaactttctctgcttctctctatctttctctgtgcataccaactctaaagtctctcatcaatggcggctcgaaaactagggtcgttgttacgtcaatactttttctctctatgcttcctcttcctcggttgcttcttcttccctaaagacgcagactataaacaaaagagaagaaagaagaagcttagaagagtttcttcttcttctggttcatctctatcctcttcttggacgtatttaaaacgagttttcttatccacgacaaggatatccaaatcccgtaaccaaacacatcctaacgttactttaacatccgcaagatcatctcaaaactccctcgtcactctcgtccaacccgataccacaaaccaacccgacccggaaacacgtattcatcagcaaaccgaattcgagatctcctcttccgacgagattttcccttgtaactcgtgtggcgagattttcccaaaaatcaatctcctcgagaatcacatcgcgatcaaacacgccgtgtcggagctaatcgccggagaatcaagcacgaacatcgtcaagatcatattcaaatctggttggccggagcaaggtaattacaaatctccggtgatcaatcgaatcttaaaaatccacaacagttcaaagattctcaccagattcgaagagtatcgtgagttcgtgaaagctaaagccgctcgtagcaacggcggtggaagacggtgggacgatgaacgttgcgtcgccgacggaaacgaacttttacgattttactgctcgacgtttatgtgtgatttagggcaaaacggtaaatcaaatctctgtggtcatcagtattgtagtatctgtggtatcatcggatctggattctcgccgaagctcgacgggatcgcgacgttggcgacggggtggagaggacacgtggcggttccggaggaggttgaagaagagtttgggtttatgaatgtgaaacgggccatgttggtttgtcgggttgtagcgggtcgggtcgggtgtgatttgattgatgatgatgacgtggataagagtgatggtggagggtatgattctctggttgggcagagtgggaacaagagtggggctctgttgaggatcgacgatgatgagcttttggtttttaatccaagggctgtgcttccttgttttgttattgtgtatactgtgtaaccggatttgtgatcctgtgtgtttttgtttatattttgttacaattgtgaagtgtgaaacgctttaggtttgtttggaaaatggtaaaatctttgtggtg

SEQ ID NO: 388 - protein, 1335 aa, Arabidopsis thaliana
  misc_feature: PFam Name: zf-C2H2; PFam Description: Zinc finger, C2H2 type
  misc_feature: GI Number: 5777616; NR Description: CAA30374.1 protein [Oryza
  misc_feature: GI Number: 15222333; NR Description: zinc finger (C2H2 type) family protein [Arabidopsis thaliana] >gi|9369383|gb|AAF87132.1|
  misc_feature: GI Number: 9802582; NR Description: T2E6.3 [Arabidopsis thaliana]
  misc_feature: GI Number: 62701936; NR Description: Zinc finger, C2H2 type,
  misc_feature: GI Number: 52076893; NR Description: zinc finger (C2H2 type) protein-like [Oryza sativa (japonica cultivar-group)] >gi|52076647|dbj|BAD45547.1| zinc finger (C2H2 type) protein-like
ACACTCCTCTCCTTCTTCTTTACACCTCTCCAATGGTAAAATCTCTCATTCACTAACTTTCTCTGCTTCTCTCTATCTTTCTCTGTGCATACCAACTCTAAAGTCTCTCATCAATGGCGGCTCGAAAACTAGGGTCGTTGTTACGTCAATACTTTTTCTCTCTATGCTTCCTCTTCCTCGGTTGCTTCTTCTTCCCTAAAGACGCAGACTATAAACAAAAGAGAAGAAAGAAGAAGCTTAGAAGAGTTTCTTCTTCTTCTGGTTCATCTCTATCCTCTTCTTGGACGTATTTAAAACGAGTTTTCTTATCCACGACAAGGATATCCAAATCCCGTAACCAAACACATCCTAACGTTACTTTAACATCCGCAAGATCATCTCAAAACTCCCTCGTCACTCTCGTCCAACCCGATACCACAAACCAACCCGACCCGGAAACACGTATTCATCAGCAAACCGAATTCGAGATCTCCTCTTCCGACGAGATTTTCCCTTGTAACTCGTGTGGCGAGATTTTCCCAAAAATCAATCTCCTCGAGAATCACATCGCGATCAAACACGCCGTGTCGGAGCTAATCGCCGGAGAATCAAGCACGAACATCGTCAAGATCATATTCAAATCTGGTTGGCCGGAGCAAGGTAATTACAAATCTCCGGTGATCAATCGAATCTTAAAAATCCACAACAGTTCAAAGATTCTCACCAGATTCGAAGAGTATCGTGAGTTCGTGAAAGCTAAAGCCGCTCGTAGCAACGGCGGTGGAAGACGGTGGGACGATGAACGTTGCGTCGCCGACGGAAACGAACTTTTACGATTTTACTGCTCGACGTTTATGTGTGATTTAGGGCAAAACGGTAAATCAAATCTCTGTGGTCATCAGTATTGTAGTATCTGTGGTATCATCGGATCTGGATTCTCGCCGAAGCTCGACGGGATCGCGACGTTGGCGACGGGGTGGAGAGGACACGTGGCGGTTCCGGAGGAGGTTGAAGAAGAGTTTGGGTTTATGAATGTGAAACGGGCCATGTTGGTTTGTCGGGTTGTAGCGGGTCGGGTCGGGTGTGATTTGATTGATGATGATGACGTGGATAAGAGTGATGGTGGAGGGTATGATTCTCTGGTTGGGCAGAGTGGGAACAAGAGTGGGGCTCTGTTGAGGATCGACGATGATGAGCTTTTGGTTTTTAATCCAAGGGCTGTGCTTCCTTGTTTTGTTATTGTGTATACTGTGTAACCGGATTTGTGATCCTGTGTGTTTTTGTTTATATTTTGTTACAATTGTGAAGTGTGAAACGCTTTAGGTTTGTTTGGAAAATGGTAAAATCTTTGTGGTG

SEQ ID NO: 389 - DNA, 889 bp, Arabidopsis thaliana
  misc_feature (1)..(889): Ceres cDNA ID no. 12330482
  misc_feature (1)..(889): Ceres CLONE  ID no. 149466
  misc_feature (1)..(889): Also known as  Ceres CDNA ID no. 23365335
aaaggttccttctgtttccagacaaagaaaacacaaattcattccctcctcctcttcatctcttttgcagatatggatggttattattctctgtctcccatctctgtcctccaccggattaaagattccttccatttcgccgtctctgcccttctcgccaacctcttctccgctctcttcaccttcttcttcgctttaggggctttgatcggccaagaaacagagagcggtttcatcagaggagccgccgttggtgctatctcaggcgccgtcttctccatcgaagtctttgaatcttccctcctcctttggcaatccgatgagtctggaattggatgccttctctacttgccttttgagcgggaggcttgttcgtgagcgtatcggtcctgcaatgctaagtgccgtccagagtcagatgggagctgtggagtcccagttccaagatcatacagacatctttgacactgccatttcaaagggtctcactggggactctctcaacaggatccctaaggtccgaatcacagacacctctccggagattgtctcttgctctgtctgccttcaggactttcaggtgggagagacagttagaagtttgccgcactgccatcatatgttccacctaccatgcatcgacaaatggcttcgcaggcatgcttcttgtcccttgtgcagaagacatctttgaattgattttgaactcttctttcttctcttctttgtacatgaggtataggcatacacacacacacatatatacacactagtagtcttccttgattttttttagattacacgttacacagattttgatgcaccaatcattgtaacttcactcatctcttggagatcctgtttatttatgctacttattcttggctcc

SEQ ID NO: 390 - protein, 889 aa, Arabidopsis thaliana
  misc_feature: PFam Name: zf-C3HC4; PFam Description: Zinc finger, C3HC4
  misc_feature: GI Number: 27524904; NR Description: NEP1-interacting protein 2 [Arabidopsis thaliana] >gi|30680091|ref|NP_179364.2| zinc finger
  misc_feature: GI Number: 27524902; NR Description: NEP1-interacting protein
  misc_feature: GI Number: 38228693; NR Description: zinc finger protein
  misc_feature: GI Number: 18855037; NR Description: putative zinc finger
  misc_feature: GI Number: 50937111; NR Description: putative NEP1-interacting protein 2 [Oryza sativa (japonica cultivar-group)] >gi|33146606|dbj|BAC79837.1| putative NEP1-interacting protein 2 [Oryza sativa (japonica cultivar-group)] [Oryza sativa (japonica
AAAGGTTCCTTCTGTTTCCAGACAAAGAAAACACAAATTCATTCCCTCCTCCTCTTCATCTCTTTTGCAGATATGGATGGTTATTATTCTCTGTCTCCCATCTCTGTCCTCCACCGGATTAAAGATTCCTTCCATTTCGCCGTCTCTGCCCTTCTCGCCAACCTCTTCTCCGCTCTCTTCACCTTCTTCTTCGCTTTAGGGGCTTTGATCGGCCAAGAAACAGAGAGCGGTTTCATCAGAGGAGCCGCCGTTGGTGCTATCTCAGGCGCCGTCTTCTCCATCGAAGTCTTTGAATCTTCCCTCCTCCTTTGGCAATCCGATGAGTCTGGAATTGGATGCCTTCTCTACTTGCCTTTTGAGCGGGAGGCTTGTTCGTGAGCGTATCGGTCCTGCAATGCTAAGTGCCGTCCAGAGTCAGATGGGAGCTGTGGAGTCCCAGTTCCAAGATCATACAGACATCTTTGACACTGCCATTTCAAAGGGTCTCACTGGGGACTCTCTCAACAGGATCCCTAAGGTCCGAATCACAGACACCTCTCCGGAGATTGTCTCTTGCTCTGTCTGCCTTCAGGACTTTCAGGTGGGAGAGACAGTTAGAAGTTTGCCGCACTGCCATCATATGTTCCACCTACCATGCATCGACAAATGGCTTCGCAGGCATGCTTCTTGTCCCTTGTGCAGAAGACATCTTTGAATTGATTTTGAACTCTTCTTTCTTCTCTTCTTTGTACATGAGGTATAGGCATACACACACACACATATATACACACTAGTAGTCTTCCTTGATTTTTTTTAGATTACACGTTACACAGATTTTGATGCACCAATCATTGTAACTTCACTCATCTCTTGGAGATCCTGTTTATTTATGCTACTTATTCTTGGCTCC

SEQ ID NO: 391 - DNA, 1199 bp, Arabidopsis thaliana
  misc_feature (1)..(1199): Ceres cDNA ID no. 12330950
  misc_feature (1)..(1199): Ceres CLONE  ID no. 157740
  misc_feature (1)..(1199): Also known as  Ceres CDNA ID no. 23365782
aactttatagttaaagttatcaattattcgaaaacaaagctggatttttgttttgtcccttaaaccagcatgatcaagaacttaagtaatatgaagaatgacaatcagaaacgtgaaaaatgttgcgagtacatcgaagctctcgaagaagaacgtcgcaagatcaatgttttccaacgcgagcttcctctttgcgtagagctcgtgactcaagcgattgaggcgtataagagggagatatcagggacgtcgacggataacttatacggacagtcggagtgctcagagcagaccaccggagaatgtgggcgcatcttggatctgttcataccaatcaaacactcttcgacctccatagaagaagaggttgatgacaaagatgatgatgatgaagaacaccagtctcatgaaaccgacatagattttgatgacaagaacatgaaatctgaatggctcaagtcggttcagctctggaaccaatccgacgcagttgtttctaataatagacaggatcgctcacaagaaaagacagagacgctggtagagttgataaaaataaacgatgaagcagcgaagaaaaacaacaacataaaatcaccggtgactactagcgatggtggcagtggcggtggcggtggcagaagagggcagagaaagaataggcggtgttggtcgcaagagttacacagacgcttcttgaacgctcttaaacaacttggtggccctcatgtagctacgccgaaacagataagagatataatgaaggttgatgggttaacaaatgatgaagtcaaaagtcatttacagaaatataggctgcatgcaagacggccaagccaaacaacaccgaacaacagaaactctcaaacgcaacatttcgtggtggttggtggaatatgggtcccacagactaaccattcaacggccaacgcagtcaacgccgtcgcatcgggtgagaccaccaccgggatttatgggcctatggtcagttcgttgccgtccgagtggccgaggcattccaattttggtaggaagatttcggaagatagatcaagatgctctaacaacggattttttcggtgtagctcaccagctatgtcttgttctactcgtacaaagacgaaagatgcaaaaataatatcataaatttaatttttgattatttattaagagaaaaaagttatagacattaatattgc

SEQ ID NO: 392 - protein, 1199 aa, Arabidopsis thaliana
  misc_feature: PFam Name: Myb_DNA-binding; PFam Description: Myb-like
  misc_feature: GI Number: 21553699; NR Description: unknown [Arabidopsis thaliana]
  misc_feature: GI Number: 21700901; NR Description: At1g13300/T6J4_6 [Arabidopsis thaliana] >gi|13605875|gb|AAK32923.1| At1g13300/T6J4_6 [Arabidopsis thaliana] >gi|25511627|pir||F86267 T6J4.6 protein - Arabidopsis thaliana
  misc_feature: GI Number: 5734711; NR Description: F24J5.9 [Arabidopsis thaliana] >gi|25404762|pir||C96711 F24J5.9 [imported] - Arabidopsis
  misc_feature: GI Number: 21593572; NR Description: unknown [Arabidopsis thaliana]
  misc_feature: GI Number: 21554044; NR Description: unknown [Arabidopsis thaliana]
AACTTTATAGTTAAAGTTATCAATTATTCGAAAACAAAGCTGGATTTTTGTTTTGTCCCTTAAACCAGCATGATCAAGAACTTAAGTAATATGAAGAATGACAATCAGAAACGTGAAAAATGTTGCGAGTACATCGAAGCTCTCGAAGAAGAACGTCGCAAGATCAATGTTTTCCAACGCGAGCTTCCTCTTTGCGTAGAGCTCGTGACTCAAGCGATTGAGGCGTATAAGAGGGAGATATCAGGGACGTCGACGGATAACTTATACGGACAGTCGGAGTGCTCAGAGCAGACCACCGGAGAATGTGGGCGCATCTTGGATCTGTTCATACCAATCAAACACTCTTCGACCTCCATAGAAGAAGAGGTTGATGACAAAGATGATGATGATGAAGAACACCAGTCTCATGAAACCGACATAGATTTTGATGACAAGAACATGAAATCTGAATGGCTCAAGTCGGTTCAGCTCTGGAACCAATCCGACGCAGTTGTTTCTAATAATAGACAGGATCGCTCACAAGAAAAGACAGAGACGCTGGTAGAGTTGATAAAAATAAACGATGAAGCAGCGAAGAAAAACAACAACATAAAATCACCGGTGACTACTAGCGATGGTGGCAGTGGCGGTGGCGGTGGCAGAAGAGGGCAGAGAAAGAATAGGCGGTGTTGGTCGCAAGAGTTACACAGACGCTTCTTGAACGCTCTTAAACAACTTGGTGGCCCTCATGTAGCTACGCCGAAACAGATAAGAGATATAATGAAGGTTGATGGGTTAACAAATGATGAAGTCAAAAGTCATTTACAGAAATATAGGCTGCATGCAAGACGGCCAAGCCAAACAACACCGAACAACAGAAACTCTCAAACGCAACATTTCGTGGTGGTTGGTGGAATATGGGTCCCACAGACTAACCATTCAACGGCCAACGCAGTCAACGCCGTCGCATCGGGTGAGACCACCACCGGGATTTATGGGCCTATGGTCAGTTCGTTGCCGTCCGAGTGGCCGAGGCATTCCAATTTTGGTAGGAAGATTTCGGAAGATAGATCAAGATGCTCTAACAACGGATTTTTTCGGTGTAGCTCACCAGCTATGTCTTGTTCTACTCGTACAAAGACGAAAGATGCAAAAATAATATCATAAATTTAATTTTTGATTATTTATTAAGAGAAAAAAGTTATAGACATTAATATTGC

SEQ ID NO: 393 - DNA, 1192 bp, Arabidopsis thaliana
  misc_feature (1)..(1192): Ceres cDNA ID no. 12331001
  misc_feature (1)..(1192): Ceres CLONE  ID no. 207314
  misc_feature (1)..(1192): Also known as  Ceres CDNA ID no. 23365821
attagagaagaaaaaaagaatggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatactcagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattgattagttaaataggcggtggttggtgcgttctttttactggaatgattatattttccattaggatggttaggcttttgtttattaaagctatcaagtttcttttttttttacgaataattcggatgacaattagctagtgtttgtttgtttgttttgtggcggcttttctgacttgactattttgatcgtggatagctttgtatgaaagtgaattgattgtagaatcgtcttttgaatttt

SEQ ID NO: 394 - protein, 1192 aa, Arabidopsis thaliana
  misc_feature: GI Number: 21593180; NR Description: putative DNA-binding
  misc_feature: GI Number: 56121926; NR Description: At2g45430 [Arabidopsis thaliana] gi|50198795|gb|AAT70431.1| At2g45430 [Arabidopsis thaliana] gi|2583112|gb|AAB82621.1| putative AT-hook DNA-binding protein [Arabidopsis thaliana] gi|25348246|pir||D84890 probable
  misc_feature: GI Number: 50915952; NR Description: DNA-binding protein-like [Oryza sativa (japonica cultivar-group)] >gi|48716263|dbj|BAD22878.1| DNA-binding protein-like [Oryza sativa (japonica cultivar-group)] >gi|48716505|dbj|BAD23110.1|
  misc_feature: GI Number: 50252749; NR Description: putative DNA-binding
  misc_feature: GI Number: 32815961; NR Description: At4g12050 [Arabidopsis thaliana] >gi|4586110|emb|CAB40946.1| putative DNA-binding protein [Arabidopsis thaliana] >gi|7267906|emb|CAB78248.1| putative DNA-binding protein [Arabidopsis thaliana]
ATTAGAGAAGAAAAAAAGAATGGCGAATCCTTGGTGGGTAGGGAATGTTGCGATCGGTGGAGTTGAGAGTCCAGTGACGTCATCAGCTCCTTCTTTGCACCACAGAAACAGTAACAACAACAACCCACCGACTATGACTCGTTCGGATCCAAGATTGGACCATGACTTCACCACCAACAACAGTGGAAGCCCTAATACTCAGACTCAGAGCCAAGAAGAACAGAACAGCAGAGACGAGCAACCAGCTGTTGAACCCGGATCCGGATCCGGGTCTACGGGTCGTCGTCCTAGAGGTAGACCTCCTGGTTCCAAGAACAAACCAAAGAGTCCAGTTGTTGTTACCAAAGAAAGCCCTAACTCTCTCCAGAGCCATGTTCTTGAGATTGCTACGGGAGCTGACGTGGCGGAAAGCTTAAACGCCTTTGCTCGTAGACGCGGCCGGGGCGTTTCGGTGCTGAGCGGTAGTGGTTTGGTTACTAATGTTACTCTGCGTCAGCCTGCTGCATCCGGTGGAGTTGTTAGTTTACGTGGTCAGTTTGAGATCTTGTCTATGTGTGGGGCTTTTCTTCCTACGTCTGGCTCTCCTGCTGCAGCCGCTGGTTTAACCATTTACTTAGCTGGAGCTCAAGGTCAAGTTGTGGGAGGTGGAGTTGCTGGCCCGCTTATTGCCTCTGGACCCGTTATTGTGATAGCTGCTACGTTTTGCAATGCCACTTATGAGAGGTTACCGATTGAGGAAGAACAACAGCAAGAGCAGCCGCTTCAACTAGAAGATGGGAAGAAGCAGAAAGAAGAGAATGATGATAACGAGAGTGGGAATAACGGAAACGAAGGATCGATGCAGCCGCCGATGTATAATATGCCTCCTAATTTTATCCCAAATGGTCATCAAATGGCTCAACACGACGTGTATTGGGGTGGTCCTCCGCCTCGTGCTCCTCCTTCGTATTGATTAGTTAAATAGGCGGTGGTTGGTGCGTTCTTTTTACTGGAATGATTATATTTTCCATTAGGATGGTTAGGCTTTTGTTTATTAAAGCTATCAAGTTTCTTTTTTTTTTACGAATAATTCGGATGACAATTAGCTAGTGTTTGTTTGTTTGTTTTGTGGCGGCTTTTCTGACTTGACTATTTTGATCGTGGATAGCTTTGTATGAAAGTGAATTGATTGTAGAATCGTCTTTTGAATTTT

SEQ ID NO: 395 - DNA, 1577 bp, Arabidopsis thaliana
  misc_feature (1)..(1577): Ceres cDNA ID no. 12331009
  misc_feature (1)..(1577): Ceres CLONE  ID no. 206881
  misc_feature (1)..(1577): Also known as  Ceres CDNA ID no. 23365829
atttttgtcactgggagggaagggagagagtgaaaaattgaaaatatctagtttttttttctctctcttgcttttaggctttaggctttcactactaatactctcttagtttaagacattgccttcacatccaaacacaaatgcaaatctttgtctcctctcttccttcaaagtctttcattacaaaaccctaatatctctaatcttctctctgtctctcttaagggcaatatcttcaatagagttctgaactttggaagcatattaagatatcaaagtaattttctacttttagttgtgaagctagtctctcctctgtccccaaaccaagaaacaatttgcaaagagaaagcaaaaggtttttgaagaagacccaattaaaaaagatggaaattgcaagtcaagaagatcatgatatgcccatcccattaaacactacatttggtggtggtggtagtcatggtcacatgatccatcatcatgatcatcatgctgctaattctgctcctccaactcacaacaacaacaatactactcaaccacctccaatgccgttacatggtaatggtcatggcaacaattatgatcatcatcatcatcaagatcctcatcatgttggttacaacgctatcatcaagaagcctatgataaagtacaaggagtgtctcaagaaccatgcagcagctatgggaggcaatgctactgatgggtgtggagagtttatgccaagtggtgaagatggctccattgaggctctcacttgctcagcttgcaattgccacaggaacttccatagaaaagaagtggaaggcgaactcgcagccaccgccatgtccccttaccaccaacaccctccacaccgaaaactcatgctcaaccaccaaaagatcagatcagctatgccacaccaaatgatcatgcccattggagtctctaactaccggtacatgcataacaactccgagtccgaggactttatggaggaagatggcgtaaccaccgcatctagatcgctaccaaacctgccatacaaccagaagaagaggttcaggacaaagttcacgccggaacagaaggagaagatgcttagttttgctgagaaagttgggtggaaaatacaaaggcaagaagattgtgttgttcaaaggttttgtgaagagattggagtgaagagaagagtgcttaaggtttggatgcacaacaacaagatccatttctccaagaagaacaacattaacctcgaagacaacgacaacgaaaagatcaacaatctcaacaatgttgatctgtccggtaataacgacatgactaagatcgtcccatgatataattaataacgttatttttatatgatctttgataattatttagttatctttatgttagctactagggttttaattttatcttctagctggtttggttttattttatatatataagctcatttcgctatctctcgttaaacccatggattttatataattttctgctctttgttgtgttttatttatttggaagttatatatattaatcttgttgtaataaatgtatgaccagccgtatttttcttcttc

SEQ ID NO: 396 - protein, 1577 aa, Arabidopsis thaliana
  misc_feature: PFam Name: ZF-HD_dimer; PFam Description: ZF-HD protein
  misc_feature: PFam Name: Homeobox; PFam Description: Homeobox domain
  misc_feature: GI Number: 62733875; NR Description: ZF-HD protein dimerisation region, putative [Oryza sativa (japonica
  misc_feature: GI Number: 50900288; NR Description: putative ZF-HD homeobox protein [Oryza sativa (japonica cultivar-group)] >gi|46806323|dbj|BAD17515.1| putative ZF-HD homeobox protein [Oryza
  misc_feature: GI Number: 13374061; NR Description: ZF-HD homeobox protein
  misc_feature: GI Number: 50946893; NR Description: putative ZF-HD homeobox protein [Oryza sativa (japonica cultivar-group)] >gi|42408573|dbj|BAD09750.1| putative ZF-HD homeobox protein [Oryza
  misc_feature: GI Number: 13277218; NR Description: ZF-HD homeobox protein
ATTTTTGTCACTGGGAGGGAAGGGAGAGAGTGAAAAATTGAAAATATCTAGTTTTTTTTTCTCTCTCTTGCTTTTAGGCTTTAGGCTTTCACTACTAATACTCTCTTAGTTTAAGACATTGCCTTCACATCCAAACACAAATGCAAATCTTTGTCTCCTCTCTTCCTTCAAAGTCTTTCATTACAAAACCCTAATATCTCTAATCTTCTCTCTGTCTCTCTTAAGGGCAATATCTTCAATAGAGTTCTGAACTTTGGAAGCATATTAAGATATCAAAGTAATTTTCTACTTTTAGTTGTGAAGCTAGTCTCTCCTCTGTCCCCAAACCAAGAAACAATTTGCAAAGAGAAAGCAAAAGGTTTTTGAAGAAGACCCAATTAAAAAAGATGGAAATTGCAAGTCAAGAAGATCATGATATGCCCATCCCATTAAACACTACATTTGGTGGTGGTGGTAGTCATGGTCACATGATCCATCATCATGATCATCATGCTGCTAATTCTGCTCCTCCAACTCACAACAACAACAATACTACTCAACCACCTCCAATGCCGTTACATGGTAATGGTCATGGCAACAATTATGATCATCATCATCATCAAGATCCTCATCATGTTGGTTACAACGCTATCATCAAGAAGCCTATGATAAAGTACAAGGAGTGTCTCAAGAACCATGCAGCAGCTATGGGAGGCAATGCTACTGATGGGTGTGGAGAGTTTATGCCAAGTGGTGAAGATGGCTCCATTGAGGCTCTCACTTGCTCAGCTTGCAATTGCCACAGGAACTTCCATAGAAAAGAAGTGGAAGGCGAACTCGCAGCCACCGCCATGTCCCCTTACCACCAACACCCTCCACACCGAAAACTCATGCTCAACCACCAAAAGATCAGATCAGCTATGCCACACCAAATGATCATGCCCATTGGAGTCTCTAACTACCGGTACATGCATAACAACTCCGAGTCCGAGGACTTTATGGAGGAAGATGGCGTAACCACCGCATCTAGATCGCTACCAAACCTGCCATACAACCAGAAGAAGAGGTTCAGGACAAAGTTCACGCCGGAACAGAAGGAGAAGATGCTTAGTTTTGCTGAGAAAGTTGGGTGGAAAATACAAAGGCAAGAAGATTGTGTTGTTCAAAGGTTTTGTGAAGAGATTGGAGTGAAGAGAAGAGTGCTTAAGGTTTGGATGCACAACAACAAGATCCATTTCTCCAAGAAGAACAACATTAACCTCGAAGACAACGACAACGAAAAGATCAACAATCTCAACAATGTTGATCTGTCCGGTAATAACGACATGACTAAGATCGTCCCATGATATAATTAATAACGTTATTTTTATATGATCTTTGATAATTATTTAGTTATCTTTATGTTAGCTACTAGGGTTTTAATTTTATCTTCTAGCTGGTTTGGTTTTATTTTATATATATAAGCTCATTTCGCTATCTCTCGTTAAACCCATGGATTTTATATAATTTTCTGCTCTTTGTTGTGTTTTATTTATTTGGAAGTTATATATATTAATCTTGTTGTAATAAATGTATGACCAGCCGTATTTTTCTTCTTC

SEQ ID NO: 397 - DNA, 1703 bp, Arabidopsis thaliana
  misc_feature (1)..(1703): Ceres cDNA ID no. 12331068
  misc_feature (1)..(1703): Ceres CLONE  ID no. 122449
  misc_feature (1)..(1703): Also known as  Ceres CDNA ID no. 23365880
accgctccaacttactaagataaacactctcattctaaaatgtctcttccatatacaattctcattctatttatattttcaacatcttcatcttatttgatccccctcgcacactccaaaatcgctagacttgggatttcctcaaaaacgctaaagaatgaacctgatggatcaacgcaaaaagtagatgaatctgatcttaaaatgtactactttaatcagacactcgatcacttcacattcacaccggaaagctacatgacttttcaacaaagatacgccattgattccacgcactggggtggtgctaaagccaacgcgccaatcttagcatttcttggagaagaatcgtcgttagactctgatttggctgccatcggttttcttcgtgacaacggtcctcgcctaaatgcgctcctcgtctacatagagcataggtattatggggagacgatgccatttggatcagcagaagaagcactaaagaacgcaagtacgttggggtatttgaacgcagcacaagccctagcagactatgccgcgattctcttgcacgttaaggagaagtactccaccaatcacagccctatcattgtaattggaggatcctatggtggaatgttagcggcatggttcaggctaaaatatccacacatagcactcggagcattagcatcttcagctcctcttctctactttgaagatactcgtcctaaatttggttattattatattgtaaccaaagttttcaaggaagcaagtgaaagatgttataatacaatccgtaattcttggaaagaaatcgatagagttgctggcaaacccaatggtctctcgatccttagcaaacaattcaaaacttgcgatccattgaacggaagcttcgatatcaaagacttcttggacacaatatatgccgaagctgttcaatacaaccgaggtccgaatttttgggtggccaaagtgtgcaacgcaatcaacgccaatccaccaaaccgtagatacaatttactcgaccggatttttgctggtgttgtcgctttagtaggcaaccgaacttgctatgatacaaaaatgtttgcgcagccaacaaacaataacatcgcatggagatggcagagctgcagcgagatagtgatgcccgtgggatatgacaaacaagatacaatgttcccaacggcaccatttaacatgaccagttacattgatggatgtaagtcttatcatggtgtcactcctagaccacattggatcacaacttatttcggcattcaggaggtcaagttaatcctccaaaaatttggaagcaacatcattttctctaatggattgtctgatccttatagcgttggcggagttttggaggatatttcagatactttagttgccattacgacaaaaaatggttcacattgtctagatatcaccttgaagagcaaagaagatccggagtggctagtgattcaaagagagaaagagattaaagttattgattcttggatttcaacttatcaaaatgatctaagagatcttaacatgccagtctaggttcataagttatattaaatttatattatataagacgatggtaaccgcatccggtttcactcacgaccttaaattggagctctatcactttttgtgtgtttcaacactctcattctaatctctcaaaacattaagctaaaagatgcatttattgt

SEQ ID NO: 398 - protein, 1703 aa, Arabidopsis thaliana
  misc_feature: PFam Name: Peptidase_S28; PFam Description: Serine
  misc_feature: GI Number: 21537161; NR Description:
  misc_feature: GI Number: 10177233; NR Description: prolylcarboxypeptidase-like protein [Arabidopsis thaliana] >gi|30688688|ref|NP_851059.1| serine carboxypeptidase S28 family
  misc_feature: GI Number: 30688698; NR Description: serine carboxypeptidase
  misc_feature: GI Number: 22655366; NR Description: At2g24280/F27D4.19 [Arabidopsis thaliana] >gi|16648801|gb|AAL25591.1| At2g24280/F27D4.19 [Arabidopsis thaliana] >gi|30682358|ref|NP_850050.1| serine carboxypeptidase S28 family
  misc_feature: GI Number: 22328106; NR Description: serine carboxypeptidase
ACCGCTCCAACTTACTAAGATAAACACTCTCATTCTAAAATGTCTCTTCCATATACAATTCTCATTCTATTTATATTTTCAACATCTTCATCTTATTTGATCCCCCTCGCACACTCCAAAATCGCTAGACTTGGGATTTCCTCAAAAACGCTAAAGAATGAACCTGATGGATCAACGCAAAAAGTAGATGAATCTGATCTTAAAATGTACTACTTTAATCAGACACTCGATCACTTCACATTCACACCGGAAAGCTACATGACTTTTCAACAAAGATACGCCATTGATTCCACGCACTGGGGTGGTGCTAAAGCCAACGCGCCAATCTTAGCATTTCTTGGAGAAGAATCGTCGTTAGACTCTGATTTGGCTGCCATCGGTTTTCTTCGTGACAACGGTCCTCGCCTAAATGCGCTCCTCGTCTACATAGAGCATAGGTATTATGGGGAGACGATGCCATTTGGATCAGCAGAAGAAGCACTAAAGAACGCAAGTACGTTGGGGTATTTGAACGCAGCACAAGCCCTAGCAGACTATGCCGCGATTCTCTTGCACGTTAAGGAGAAGTACTCCACCAATCACAGCCCTATCATTGTAATTGGAGGATCCTATGGTGGAATGTTAGCGGCATGGTTCAGGCTAAAATATCCACACATAGCACTCGGAGCATTAGCATCTTCAGCTCCTCTTCTCTACTTTGAAGATACTCGTCCTAAATTTGGTTATTATTATATTGTAACCAAAGTTTTCAAGGAAGCAAGTGAAAGATGTTATAATACAATCCGTAATTCTTGGAAAGAAATCGATAGAGTTGCTGGCAAACCCAATGGTCTCTCGATCCTTAGCAAACAATTCAAAACTTGCGATCCATTGAACGGAAGCTTCGATATCAAAGACTTCTTGGACACAATATATGCCGAAGCTGTTCAATACAACCGAGGTCCGAATTTTTGGGTGGCCAAAGTGTGCAACGCAATCAACGCCAATCCACCAAACCGTAGATACAATTTACTCGACCGGATTTTTGCTGGTGTTGTCGCTTTAGTAGGCAACCGAACTTGCTATGATACAAAAATGTTTGCGCAGCCAACAAACAATAACATCGCATGGAGATGGCAGAGCTGCAGCGAGATAGTGATGCCCGTGGGATATGACAAACAAGATACAATGTTCCCAACGGCACCATTTAACATGACCAGTTACATTGATGGATGTAAGTCTTATCATGGTGTCACTCCTAGACCACATTGGATCACAACTTATTTCGGCATTCAGGAGGTCAAGTTAATCCTCCAAAAATTTGGAAGCAACATCATTTTCTCTAATGGATTGTCTGATCCTTATAGCGTTGGCGGAGTTTTGGAGGATATTTCAGATACTTTAGTTGCCATTACGACAAAAAATGGTTCACATTGTCTAGATATCACCTTGAAGAGCAAAGAAGATCCGGAGTGGCTAGTGATTCAAAGAGAGAAAGAGATTAAAGTTATTGATTCTTGGATTTCAACTTATCAAAATGATCTAAGAGATCTTAACATGCCAGTCTAGGTTCATAAGTTATATTAAATTTATATTATATAAGACGATGGTAACCGCATCCGGTTTCACTCACGACCTTAAATTGGAGCTCTATCACTTTTTGTGTGTTTCAACACTCTCATTCTAATCTCTCAAAACATTAAGCTAAAAGATGCATTTATTGT

SEQ ID NO: 399 - DNA, 1099 bp, Arabidopsis thaliana
  misc_feature (1)..(1099): Ceres cDNA ID no. 12331129
  misc_feature (1)..(1099): Ceres CLONE  ID no. 37280
  misc_feature (1)..(1099): Also known as  Ceres CDNA ID no. 23365939
acaacaaatcgtctccgtcttcctcgctcagcttcaacaaccagagccgacttgagattgagaatcaacgtaatcgatactctcgcaaagtctcatcctttctcagcaaaaaacactaggaaatggttgaaaggcatggagagttttgatttgctgcttaagatatatcatgtcgcagtgcgttgacggtatcaagcatttatgcacctctgttttagggtgttttgatcttgatttgtataaacaatctggtggccttggagatcctgaattgcttgcaagagacactgtttttagtgtgagtgaaatagaagctctttatgagctttttaagaaaatcagcagtgccgtgattgatgatgggctaataaacaaggaagagtttcagttggctttgtttaagacaaataaaaaagagagtttgtttgcagatcgggttttcgatttgtttgatacaaagcacaatggaatactggggtttgaggaatttgctcgtgctctctccgtctttcacccaaatgcgcctatagatgacaaaattcacttttcatttcagctatatgatcttaaacagcaagggtttatcgaacggcaagaggtgaaacaaatggttgtcgctacgcttgctgaatctggaatgaatttgaaggatactgtcattgaggatataatcgacaagacgtttgaggaagcagacacaaaacacgatggaaagatcgataaggaagagtggagaagccttgttcttagacatcccagccttctgaagaacatgactcttcaatatctcaaggatatcacgactacgtttccaagctttgtgttccattctcaggttgaagatacctgaaaaagcaaaagcaaaagcaagcagcggcaagacatcattgtattgttgaaggttgttctttcgttatggttctttatttgttacatttctaaatctctgaactcattttattttttattgagctttttttgtgaagcaaaattcttctttttagtttggtttttgtcctttttgatttcgctcggtctatctgtagatacaacttttgcatcttgatgttatggtaatgtaaagtttttcagtttattc

SEQ ID NO: 400 - protein, 1099 aa, Arabidopsis thaliana
  misc_feature: PFam Name: efhand; PFam Description: EF hand
  misc_feature: GI Number: 21593228; NR Description: calcineurin B-like
  misc_feature: GI Number: 22655046; NR Description: At5g55990/MDA7_3 [Arabidopsis thaliana] >gi|9758619|dbj|BAB09281.1| calcineurin B-like protein 2 [Arabidopsis thaliana] >gi|15450407|gb|AAK96497.1| AT5g55990/MDA7_3 [Arabidopsis
  misc_feature: GI Number: 56748807; NR Description: Calcineurin B-like protein 2 (SOS3-like calcium binding protein 1) gi|22655046|gb|AAM98114.1| At5g55990/MDA7_3 [Arabidopsis thaliana] gi|9758619|dbj|BAB09281.1| calcineurin B-like protein 2
  misc_feature: GI Number: 22136404; NR Description: calcineurin B-like protein 3 [Arabidopsis thaliana] >gi|7269509|emb|CAB79512.1| calcineurin B-like protein 3 [Arabidopsis thaliana] >gi|4938495|emb|CAB43853.1| calcineurin B-like protein 3
  misc_feature: GI Number: 56748808; NR Description: Calcineurin B-like protein 3 (SOS3-like calcium binding protein 6) gi|22136404|gb|AAM91280.1| calcineurin B-like protein 3 [Arabidopsis thaliana] gi|7269509|emb|CAB79512.1| calcineurin
ACAACAAATCGTCTCCGTCTTCCTCGCTCAGCTTCAACAACCAGAGCCGACTTGAGATTGAGAATCAACGTAATCGATACTCTCGCAAAGTCTCATCCTTTCTCAGCAAAAAACACTAGGAAATGGTTGAAAGGCATGGAGAGTTTTGATTTGCTGCTTAAGATATATCATGTCGCAGTGCGTTGACGGTATCAAGCATTTATGCACCTCTGTTTTAGGGTGTTTTGATCTTGATTTGTATAAACAATCTGGTGGCCTTGGAGATCCTGAATTGCTTGCAAGAGACACTGTTTTTAGTGTGAGTGAAATAGAAGCTCTTTATGAGCTTTTTAAGAAAATCAGCAGTGCCGTGATTGATGATGGGCTAATAAACAAGGAAGAGTTTCAGTTGGCTTTGTTTAAGACAAATAAAAAAGAGAGTTTGTTTGCAGATCGGGTTTTCGATTTGTTTGATACAAAGCACAATGGAATACTGGGGTTTGAGGAATTTGCTCGTGCTCTCTCCGTCTTTCACCCAAATGCGCCTATAGATGACAAAATTCACTTTTCATTTCAGCTATATGATCTTAAACAGCAAGGGTTTATCGAACGGCAAGAGGTGAAACAAATGGTTGTCGCTACGCTTGCTGAATCTGGAATGAATTTGAAGGATACTGTCATTGAGGATATAATCGACAAGACGTTTGAGGAAGCAGACACAAAACACGATGGAAAGATCGATAAGGAAGAGTGGAGAAGCCTTGTTCTTAGACATCCCAGCCTTCTGAAGAACATGACTCTTCAATATCTCAAGGATATCACGACTACGTTTCCAAGCTTTGTGTTCCATTCTCAGGTTGAAGATACCTGAAAAAGCAAAAGCAAAAGCAAGCAGCGGCAAGACATCATTGTATTGTTGAAGGTTGTTCTTTCGTTATGGTTCTTTATTTGTTACATTTCTAAATCTCTGAACTCATTTTATTTTTTATTGAGCTTTTTTTGTGAAGCAAAATTCTTCTTTTTAGTTTGGTTTTTGTCCTTTTTGATTTCGCTCGGTCTATCTGTAGATACAACTTTTGCATCTTGATGTTATGGTAATGTAAAGTTTTTCAGTTTATTC

SEQ ID NO: 401 - DNA, 1684 bp, Arabidopsis thaliana
  misc_feature (1)..(1684): Ceres cDNA ID no. 12331203
  misc_feature (1)..(1684): Ceres CLONE  ID no. 101388
  misc_feature (1)..(1684): Also known as  Ceres CDNA ID no. 23366009
gtttgtcactaagctctctctctctctccttctttttcgcaattcttctttcttcttcgacttttttttttcttcctctcttctctttggttttttggtgttgggttttatctgggttcctgatttcttcaacgaggaaggaaggaagaagaagagaaaagggacaagcgagaattactcttttctccttcaatttccgatgggttgtttcggatgcagtaagaaatcgagcaaacgatccgagactaacaaagatactgtcataaatagaaaaattgtcggtggtactacgagcgttgctaagagtgataagcgagacgatcagactcagcccagttcagattcaacaaaagtcagtccatatagagatgtaaacaatgaaggaggagttggtaaggaagatcagttatctttggatgtgaagggtttgaatctaaatgaccaagtcacagggaagaaagcacagacttttacttttcaagaacttgcagaagctacgggaaactttagatcggattgttttcttggtgaaggaggtttcggaaaagttttcaagggaactatagagaaattggatcaggttgttgcaatcaagcaacttgatcgtaatggggttcaaggaatcagggaatttgtggttgaggtattgactctaagtcttgctgaccatccgaatcttgtgaagcttattgggttttgtgctgagggtgatcagagactactggtgtacgagtatatgccgcaaggatcccttgaagatcatctacatgttctcccttctggtaaaaagcctcttgactggaacacccggatgaaaatagcagctggtgcagcaagaggtttagagtatctgcatgacagaatgacgccccctgtgatttaccgagatcttaaatgttcgaatattttgcttggtgaagactatcaaccgaaactatctgactttgggttggctaaagtaggaccaagcggggataaaacccatgtctcgacaagggttatgggaacgtacggatactgtgctcctgactacgctatgacgggtcagctcacatttaaatccgatatatacagttttggagtagtccttctcgagcttatcaccggaaggaaagcgattgacaatacaaaaacgcgtaaagatcagaatttggttggatgggcacgaccattgttcaaagacaggaggaacttcccaaaaatggttgatccattgcttcagggacaatacccagttagaggactgtaccaagcactagcaatatcagcaatgtgcgttcaagagcagcctaccatgagaccagtggtatctgatgtagtattggctctcaacttcttagcctcttctaaatatgatccgaatagccctagcagcagcagcgggaagaacccttcttttcacagagacagagatgatgaagagaaaagaccacacctcgtcaaggaaactgaatgtgaagggtcctcataggatatccaataagagagtggtaaaaaatcaaatctaattttggcttcaccaagaaattggggaaaaatataaaaccaactcaggtacatttttaacatctattgtggatgtaaatcttgactcggcttctttgtatgtagaatgtttctgttctgtagaaaaggagaaaaaaaaaaaccattttgttttgggacatatatacatatattgaac

SEQ ID NO: 402 - protein, 1684 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 7573596; NR Description: protein kinase 1 [Populus
  misc_feature: GI Number: 7573598; NR Description: protein kinase 2 [Populus
  misc_feature: GI Number: 37625033; NR Description: protein kinase-like
  misc_feature: GI Number: 34907210; NR Description: putative serine/threonine kinase PBS1 protein [Oryza sativa (japonica cultivar-group)] >gi|15408807|dbj|BAB64203.1| putative serine/threonine kinase PBS1 protein [Oryza sativa (japonica
  misc_feature: GI Number: 15238886; NR Description: protein kinase family
GTTTGTCACTAAGCTCTCTCTCTCTCTCCTTCTTTTTCGCAATTCTTCTTTCTTCTTCGACTTTTTTTTTTCTTCCTCTCTTCTCTTTGGTTTTTTGGTGTTGGGTTTTATCTGGGTTCCTGATTTCTTCAACGAGGAAGGAAGGAAGAAGAAGAGAAAAGGGACAAGCGAGAATTACTCTTTTCTCCTTCAATTTCCGATGGGTTGTTTCGGATGCAGTAAGAAATCGAGCAAACGATCCGAGACTAACAAAGATACTGTCATAAATAGAAAAATTGTCGGTGGTACTACGAGCGTTGCTAAGAGTGATAAGCGAGACGATCAGACTCAGCCCAGTTCAGATTCAACAAAAGTCAGTCCATATAGAGATGTAAACAATGAAGGAGGAGTTGGTAAGGAAGATCAGTTATCTTTGGATGTGAAGGGTTTGAATCTAAATGACCAAGTCACAGGGAAGAAAGCACAGACTTTTACTTTTCAAGAACTTGCAGAAGCTACGGGAAACTTTAGATCGGATTGTTTTCTTGGTGAAGGAGGTTTCGGAAAAGTTTTCAAGGGAACTATAGAGAAATTGGATCAGGTTGTTGCAATCAAGCAACTTGATCGTAATGGGGTTCAAGGAATCAGGGAATTTGTGGTTGAGGTATTGACTCTAAGTCTTGCTGACCATCCGAATCTTGTGAAGCTTATTGGGTTTTGTGCTGAGGGTGATCAGAGACTACTGGTGTACGAGTATATGCCGCAAGGATCCCTTGAAGATCATCTACATGTTCTCCCTTCTGGTAAAAAGCCTCTTGACTGGAACACCCGGATGAAAATAGCAGCTGGTGCAGCAAGAGGTTTAGAGTATCTGCATGACAGAATGACGCCCCCTGTGATTTACCGAGATCTTAAATGTTCGAATATTTTGCTTGGTGAAGACTATCAACCGAAACTATCTGACTTTGGGTTGGCTAAAGTAGGACCAAGCGGGGATAAAACCCATGTCTCGACAAGGGTTATGGGAACGTACGGATACTGTGCTCCTGACTACGCTATGACGGGTCAGCTCACATTTAAATCCGATATATACAGTTTTGGAGTAGTCCTTCTCGAGCTTATCACCGGAAGGAAAGCGATTGACAATACAAAAACGCGTAAAGATCAGAATTTGGTTGGATGGGCACGACCATTGTTCAAAGACAGGAGGAACTTCCCAAAAATGGTTGATCCATTGCTTCAGGGACAATACCCAGTTAGAGGACTGTACCAAGCACTAGCAATATCAGCAATGTGCGTTCAAGAGCAGCCTACCATGAGACCAGTGGTATCTGATGTAGTATTGGCTCTCAACTTCTTAGCCTCTTCTAAATATGATCCGAATAGCCCTAGCAGCAGCAGCGGGAAGAACCCTTCTTTTCACAGAGACAGAGATGATGAAGAGAAAAGACCACACCTCGTCAAGGAAACTGAATGTGAAGGGTCCTCATAGGATATCCAATAAGAGAGTGGTAAAAAATCAAATCTAATTTTGGCTTCACCAAGAAATTGGGGAAAAATATAAAACCAACTCAGGTACATTTTTAACATCTATTGTGGATGTAAATCTTGACTCGGCTTCTTTGTATGTAGAATGTTTCTGTTCTGTAGAAAAGGAGAAAAAAAAAAACCATTTTGTTTTGGGACATATATACATATATTGAAC

SEQ ID NO: 403 - DNA, 1418 bp, Arabidopsis thaliana
  misc_feature (1)..(1418): Ceres cDNA ID no. 12331445
  misc_feature (1)..(1418): Ceres CLONE  ID no. 6612
  misc_feature (1)..(1418): Also known as  Ceres CDNA ID no. 23366228
gtatccgactaactccaccgtttcgttcttcgttcttcatcggatctttcttcttcacgacgacaacattactgtatatctctttcgcaaaggaaaagttctgatctttgtattctcttatcattcgttatctaagtctcttcgattctcgaagcttttaaggcatttaaagagacgaaatgggtaataagctgggaaggaagagacagattgtggacgaaagatacacaaagccacaacaaggtttatacatgagcaaagatgttgacattaaaaagcttaagaaactcatcttagagtctaagcttgctccttgttatcctggtcttgaagaaaccccctcctcccatcatgatcttgaagaatgtcctatttgctttctgtattatccgagtcttaataggtcaagatgttgtatgaaaagcatttgtacagaatgctttctgcggatgaagagtcctaattcagctcaacctactcaatgccctttttgcaaaacatccaattatgctgtcgagtatcgtggagggaaaactaaagaggagaagagctttgaacaaattgaagagcagcgagttatagaagccaaaataaggatgaggcagaaggaagttgaagatgatgaagaaagaatgcagaaacgtctggagtcatattcttctagttctagcactagtgcagcgactcttgatacagagtatggttctgctgcagaggatgatgaggaaattgtttcatctcaagaatcatgtcttccatctcaccaccctcaggttacaagggacggtcagtttgactttgatcttgaagatataatggtcatggaagcaatatggctttcgatgcaggaaccaggaattcagagaaacacatcacctgatgatatttcagaaaaagatcgtaatgaggaaccatcaactccgtcatcatcatctccatcaggtgggctagcttgtgcaattgctgttcttgccgaacgtcagcaaatggttggcgtatcttcttcgaatcaaaacgttaaccttgcatcacaaaaccttgttccagacaatggtaacaacagtcattacaatgccatagaacaggatagtaaccattaccttcaaggagcaggaatcagctatacaagatcagatatgactgatgatagcggcggtgagacttccagggaagttacatggcaatagagagttcccaaaggtaaagaggaaagcttcaaagttgttatatagtcttttgtttatattatgttagcgggagtgaatggttttagattgttagttagttttgagggtgtatgttgatcacttcatacatgtgccaataagaaaaaccaaaacgattttcaattcctcctacagaaggttggttgtttggttgtattattatgaatggtaagcattgcacaaaaatgaaac

SEQ ID NO: 404 - protein, 1418 aa, Arabidopsis thaliana
  misc_feature: GI Number: 8052547; NR Description: F3F9.7 [Arabidopsis thaliana]
GTATCCGACTAACTCCACCGTTTCGTTCTTCGTTCTTCATCGGATCTTTCTTCTTCACGACGACAACATTACTGTATATCTCTTTCGCAAAGGAAAAGTTCTGATCTTTGTATTCTCTTATCATTCGTTATCTAAGTCTCTTCGATTCTCGAAGCTTTTAAGGCATTTAAAGAGACGAAATGGGTAATAAGCTGGGAAGGAAGAGACAGATTGTGGACGAAAGATACACAAAGCCACAACAAGGTTTATACATGAGCAAAGATGTTGACATTAAAAAGCTTAAGAAACTCATCTTAGAGTCTAAGCTTGCTCCTTGTTATCCTGGTCTTGAAGAAACCCCCTCCTCCCATCATGATCTTGAAGAATGTCCTATTTGCTTTCTGTATTATCCGAGTCTTAATAGGTCAAGATGTTGTATGAAAAGCATTTGTACAGAATGCTTTCTGCGGATGAAGAGTCCTAATTCAGCTCAACCTACTCAATGCCCTTTTTGCAAAACATCCAATTATGCTGTCGAGTATCGTGGAGGGAAAACTAAAGAGGAGAAGAGCTTTGAACAAATTGAAGAGCAGCGAGTTATAGAAGCCAAAATAAGGATGAGGCAGAAGGAAGTTGAAGATGATGAAGAAAGAATGCAGAAACGTCTGGAGTCATATTCTTCTAGTTCTAGCACTAGTGCAGCGACTCTTGATACAGAGTATGGTTCTGCTGCAGAGGATGATGAGGAAATTGTTTCATCTCAAGAATCATGTCTTCCATCTCACCACCCTCAGGTTACAAGGGACGGTCAGTTTGACTTTGATCTTGAAGATATAATGGTCATGGAAGCAATATGGCTTTCGATGCAGGAACCAGGAATTCAGAGAAACACATCACCTGATGATATTTCAGAAAAAGATCGTAATGAGGAACCATCAACTCCGTCATCATCATCTCCATCAGGTGGGCTAGCTTGTGCAATTGCTGTTCTTGCCGAACGTCAGCAAATGGTTGGCGTATCTTCTTCGAATCAAAACGTTAACCTTGCATCACAAAACCTTGTTCCAGACAATGGTAACAACAGTCATTACAATGCCATAGAACAGGATAGTAACCATTACCTTCAAGGAGCAGGAATCAGCTATACAAGATCAGATATGACTGATGATAGCGGCGGTGAGACTTCCAGGGAAGTTACATGGCAATAGAGAGTTCCCAAAGGTAAAGAGGAAAGCTTCAAAGTTGTTATATAGTCTTTTGTTTATATTATGTTAGCGGGAGTGAATGGTTTTAGATTGTTAGTTAGTTTTGAGGGTGTATGTTGATCACTTCATACATGTGCCAATAAGAAAAACCAAAACGATTTTCAATTCCTCCTACAGAAGGTTGGTTGTTTGGTTGTATTATTATGAATGGTAAGCATTGCACAAAAATGAAAC

SEQ ID NO: 405 - DNA, 1867 bp, Arabidopsis thaliana
  misc_feature (1)..(1867): Ceres cDNA ID no. 12331510
  misc_feature (1)..(1867): Ceres CLONE  ID no. 3190
  misc_feature (1)..(1867): Also known as  Ceres CDNA ID no. 23366295
acaaccttcgtcttctcttgaaactctcctcatctctctcaagaaagattcaagttcgagtcttagctatgtctggaaactcagaaggactgttagagagctcaggcggcggcgtgggaggttccgtcgaggaggaaaaagatatgaagatggaggaaaccggtgaaggagccggcagcggaggaaaccggtggccaagaccagagactttagctctattgagaatacgttcagagatggataaagcttttcgtgactctactctcaaagctcccttatgggaagaaatttccaggaaaatgatggagcttggttacaagagaagttcaaagaaatgcaaggagaagttcgagaacgtgtacaagtaccacaaacgtaccaaagaaggtcgtaccgggaaatccgaaggcaaaacttaccggtttttcgaagagttagaagctttcgagactctcagttcctatcaacctgaacctgagtcgcaacccgcgaaatcttctgcagtgatcacgaacgcgcccgcaacctcttccttgataccatggattagctctagcaatccatcaaccgaaaaaagttcttcaccgttgaaacatcatcatcaggttagtgtacaacccatcaccacaaaccctaccttcctcgccaagcaaccatcttccacgacgccttttcctttttatagcagcaacaatactactactgttagccagccgccaatttcaaatgacttgatgaacaatgtttcatcgctgaatcttttctcgagctcaacttcttcatctactgcatctgacgaggaagaagatcatcatcaggttaagagctcgagaaagaagaggaagtattggaaagggttgtttacgaagttgacaaaagagttaatggagaaacaagagaagatgcaaaaaaggttcttggaaacactggagtatcgtgagaaagagagaatctcaagagaagaagcttggagggtccaagagatagggagaatcaacagagaacacgaaacattaatccatgagaggtccaatgctgcagctaaagacgctgcaatcatatccttcttacacaaaatctcaggaggacaaccacaacaaccgcaacaacataatcataaaccatcacaaaggaaacaatatcaaagcgatcattcaataacgtttgagagtaaagagccgagggcggttctattggatacaacaataaagatggggaattacgataacaatcattcggtgtctcctagttcttcaagatggcctaaaaccgaggtcgaggccttgataaggataagaaagaatcttgaagctaactatcaagaaaacggtactaagggaccattatgggaagagatctctgcagggatgagaagattgggatacaatagaagcgcgaaacgatgcaaagagaagtgggaaaacatcaacaagtactttaagaaagtcaaagaaagcaacaagaaacgtccccttgattccaagacttgcccttattttcaccagctcgaagctttgtacaacgagaggaacaaaagtggggcaatgccattgccattgcctctaatggtgactccacagagacagttgcttctctcgcaagaaacccagaccgagtttgagactgatcagagggaaaaagttggtgataaagaagatgaagaagaaggagagagtgaagaagatgaatacgatgaagaagaagagggagaaggagacaatgagacaagtgagttcgagattgtgttgaacaaaacatcttcacctatggacattaacaataatcttttcacctaagtggttttataatcattttattatatacactttcctgtaaaatgaggttgaaggaaaaaaaaaaagcatat

SEQ ID NO: 406 - protein, 1867 aa, Arabidopsis thaliana
  misc_feature: PFam Name: Myb_DNA-binding; PFam Description: Myb-like
  misc_feature: GI Number: 416490; NR Description: GT-2 factor [Arabidopsis thaliana] >gi|481812|pir||S39484 DNA-binding protein GT-2 - Arabidopsis thaliana >gi|12322224|gb|AAG51145.1| trihelix DNA-binding protein (GT2) [Arabidopsis thaliana]
  misc_feature: GI Number: 2664202; NR Description: GT2 [Arabidopsis thaliana]
  misc_feature: GI Number: 21592726; NR Description: trihelix DNA-binding
  misc_feature: GI Number: 30699205; NR Description: trihelix DNA-binding
  misc_feature: GI Number: 15217472; NR Description: trihelix DNA-binding
ACAACCTTCGTCTTCTCTTGAAACTCTCCTCATCTCTCTCAAGAAAGATTCAAGTTCGAGTCTTAGCTATGTCTGGAAACTCAGAAGGACTGTTAGAGAGCTCAGGCGGCGGCGTGGGAGGTTCCGTCGAGGAGGAAAAAGATATGAAGATGGAGGAAACCGGTGAAGGAGCCGGCAGCGGAGGAAACCGGTGGCCAAGACCAGAGACTTTAGCTCTATTGAGAATACGTTCAGAGATGGATAAAGCTTTTCGTGACTCTACTCTCAAAGCTCCCTTATGGGAAGAAATTTCCAGGAAAATGATGGAGCTTGGTTACAAGAGAAGTTCAAAGAAATGCAAGGAGAAGTTCGAGAACGTGTACAAGTACCACAAACGTACCAAAGAAGGTCGTACCGGGAAATCCGAAGGCAAAACTTACCGGTTTTTCGAAGAGTTAGAAGCTTTCGAGACTCTCAGTTCCTATCAACCTGAACCTGAGTCGCAACCCGCGAAATCTTCTGCAGTGATCACGAACGCGCCCGCAACCTCTTCCTTGATACCATGGATTAGCTCTAGCAATCCATCAACCGAAAAAAGTTCTTCACCGTTGAAACATCATCATCAGGTTAGTGTACAACCCATCACCACAAACCCTACCTTCCTCGCCAAGCAACCATCTTCCACGACGCCTTTTCCTTTTTATAGCAGCAACAATACTACTACTGTTAGCCAGCCGCCAATTTCAAATGACTTGATGAACAATGTTTCATCGCTGAATCTTTTCTCGAGCTCAACTTCTTCATCTACTGCATCTGACGAGGAAGAAGATCATCATCAGGTTAAGAGCTCGAGAAAGAAGAGGAAGTATTGGAAAGGGTTGTTTACGAAGTTGACAAAAGAGTTAATGGAGAAACAAGAGAAGATGCAAAAAAGGTTCTTGGAAACACTGGAGTATCGTGAGAAAGAGAGAATCTCAAGAGAAGAAGCTTGGAGGGTCCAAGAGATAGGGAGAATCAACAGAGAACACGAAACATTAATCCATGAGAGGTCCAATGCTGCAGCTAAAGACGCTGCAATCATATCCTTCTTACACAAAATCTCAGGAGGACAACCACAACAACCGCAACAACATAATCATAAACCATCACAAAGGAAACAATATCAAAGCGATCATTCAATAACGTTTGAGAGTAAAGAGCCGAGGGCGGTTCTATTGGATACAACAATAAAGATGGGGAATTACGATAACAATCATTCGGTGTCTCCTAGTTCTTCAAGATGGCCTAAAACCGAGGTCGAGGCCTTGATAAGGATAAGAAAGAATCTTGAAGCTAACTATCAAGAAAACGGTACTAAGGGACCATTATGGGAAGAGATCTCTGCAGGGATGAGAAGATTGGGATACAATAGAAGCGCGAAACGATGCAAAGAGAAGTGGGAAAACATCAACAAGTACTTTAAGAAAGTCAAAGAAAGCAACAAGAAACGTCCCCTTGATTCCAAGACTTGCCCTTATTTTCACCAGCTCGAAGCTTTGTACAACGAGAGGAACAAAAGTGGGGCAATGCCATTGCCATTGCCTCTAATGGTGACTCCACAGAGACAGTTGCTTCTCTCGCAAGAAACCCAGACCGAGTTTGAGACTGATCAGAGGGAAAAAGTTGGTGATAAAGAAGATGAAGAAGAAGGAGAGAGTGAAGAAGATGAATACGATGAAGAAGAAGAGGGAGAAGGAGACAATGAGACAAGTGAGTTCGAGATTGTGTTGAACAAAACATCTTCACCTATGGACATTAACAATAATCTTTTCACCTAAGTGGTTTTATAATCATTTTATTATATACACTTTCCTGTAAAATGAGGTTGAAGGAAAAAAAAAAAGCATAT

SEQ ID NO: 407 - DNA, 660 bp, Arabidopsis thaliana
  misc_feature (1)..(660): Ceres cDNA ID no. 12331527
  misc_feature (1)..(660): Ceres CLONE  ID no. 927
  misc_feature (1)..(660): Also known as  Ceres CDNA ID no. 23366315
aactcattattgttatttttgacagagagaaatttctcagttacgcttcatcctcctctaagagatcttttttctatcttgggtagtagagagaaatggcgggtcggggaaaacaacttggatctggtgcagcgaagaagtctacttctcgtagtagcaaggctgggcttcaattccctgttggtcgtatcgctcgatttttgaaagccggtaagtacgccgagcgtgttggtgccggagctccggtctatctcgccgccgttcttgaatacctcgccgctgaggtacttgagcttgctgggaacgcagcgagagacaacaagaagacccgtatagttccacgacacattcagcttgctgtgaggaatgatgaggagctaagcaagttgcttgaagatgtgacaattgctaatggaggagtgatgcctaacatccacaatctccttctccccaagaaggctggttcatctaagcctactgaagaagattaggttcattacgaagatagggaaagctggaaactggttgatatcagataatgcttaggattgttttttttttcatttgcttttcctctgcagcaatggaagctgtgtggttgtactagttgttaaggttacctttgtttcactttatgtgaatatatgaagaaattgttcc

SEQ ID NO: 408 - protein, 660 aa, Arabidopsis thaliana
  misc_feature: PFam Name: Histone; PFam Description: Core histone H2A/H2B/H3/H4
  misc_feature: GI Number: 21617982; NR Description: histone H2A-like protein
  misc_feature: GI Number: 21593834; NR Description: histone H2A [Arabidopsis thaliana] >gi|9758956|dbj|BAB09343.1| histone H2A [Arabidopsis thaliana] >gi|28827756|gb|AAO50722.1| putative histone H2A protein [Arabidopsis thaliana] >gi|28393261|gb|AAO42059.1|
  misc_feature: GI Number: 17065594; NR Description: putative histone H2A protein [Arabidopsis thaliana] >gi|13877851|gb|AAK44003.1| putative histone H2A protein [Arabidopsis thaliana] >gi|12320785|gb|AAG50540.1| histone H2A, putative [Arabidopsis
  misc_feature: GI Number: 50945929; NR Description: putative histone H2A [Oryza sativa (japonica cultivar-group)] >gi|29837243|dbj|BAC75621.1| putative histone H2A [Oryza sativa (japonica cultivar-group)] >gi|38175493|dbj|BAD01189.1| putative
AACTCATTATTGTTATTTTTGACAGAGAGAAATTTCTCAGTTACGCTTCATCCTCCTCTAAGAGATCTTTTTTCTATCTTGGGTAGTAGAGAGAAATGGCGGGTCGGGGAAAACAACTTGGATCTGGTGCAGCGAAGAAGTCTACTTCTCGTAGTAGCAAGGCTGGGCTTCAATTCCCTGTTGGTCGTATCGCTCGATTTTTGAAAGCCGGTAAGTACGCCGAGCGTGTTGGTGCCGGAGCTCCGGTCTATCTCGCCGCCGTTCTTGAATACCTCGCCGCTGAGGTACTTGAGCTTGCTGGGAACGCAGCGAGAGACAACAAGAAGACCCGTATAGTTCCACGACACATTCAGCTTGCTGTGAGGAATGATGAGGAGCTAAGCAAGTTGCTTGAAGATGTGACAATTGCTAATGGAGGAGTGATGCCTAACATCCACAATCTCCTTCTCCCCAAGAAGGCTGGTTCATCTAAGCCTACTGAAGAAGATTAGGTTCATTACGAAGATAGGGAAAGCTGGAAACTGGTTGATATCAGATAATGCTTAGGATTGTTTTTTTTTTCATTTGCTTTTCCTCTGCAGCAATGGAAGCTGTGTGGTTGTACTAGTTGTTAAGGTTACCTTTGTTTCACTTTATGTGAATATATGAAGAAATTGTTCC

SEQ ID NO: 409 - DNA, 1242 bp, Arabidopsis thaliana
  misc_feature (1)..(1242): Ceres cDNA ID no. 12331564
  misc_feature (1)..(1242): Ceres CLONE  ID no. 60
  misc_feature (1)..(1242): Also known as  Ceres CDNA ID no. 23366348
agatttgagactatctatttacattctgattatttcttaagaagaaacggccatggaagtcaaaggagccacccggagctctatcatagttccttctgttcaagagatggtgaaggagaagatgatcacgacggttcctccgaggtatgtacggtctgatcaagacgtagctgagatagccgttgattctggtctaagaaaccagatcccaatcatagacttcagtcttctgtgttcttcaacctccatggattccgagattgacaagcttgactctgcttgcaaagagtggggattttttcagcttgtaaaccatggaatggagtcaagtttcttgaacaaagtaaagtcagaggttcaagacttcttcaaccttcccatggaagagaagaagaatttgtggcaacaacccgatgagatcgaagggtttagacaagtatttgtggtttcagaagagcagaaactcgattgggcagatatgttcttccttacaatgcaacctgttcgattacgcaagcctcacttgttccccaagttacctctgccctttagagatacactagacatgtattcgactgaagtgaaaagcattgctaagatcttacttgggaaaatagcggtagcactgaagatcaaacccgaggaaatggataggttgtttgatgatgagttagggcagagaattaggctgaattactacccgccttgtccagagcccgataaggttattggtctaactccgcattctgattctacaggactcaccatactgttgcaggctaatgaagttgaaggtctccaaatcaagaaaaatggcaagtgggtttctgtcaaacctctcccaaatgctttggttgtcaatgtcggagacatcttagagatcataacgaatagcacataccgaagtatagagcatcgtggagttgtgaactcagagaaagagagactttcggtggcggcattccacaatattggattgggtaaagaaattggtccgatgagaagtctcgtggaaaggcacaaggctgcatttttcaaaagcgtgactactgaagagtatttccatggcttgttttcccgtgagctcgatggaaaagcttaccttgatgttatgagactctaaaggaaacaattcataaaattattggcttgtgccccaagaaaacaatcacattttctgacccttcctattgtagtgtatatactctgtttctcctctgtttcatgcttttgcaaataggc

SEQ ID NO: 410 - protein, 1242 aa, Arabidopsis thaliana
  misc_feature: PFam Name: 2OG-FeII_Oxy; PFam Description: 2OG-Fe(II)
  misc_feature: GI Number: 5734767; NR Description: SRG1 Protein [Arabidopsis thaliana] >gi|22655018|gb|AAM98100.1| At1g17020/F6I1.30 [Arabidopsis thaliana] >gi|479047|emb|CAA55654.1| SRG1 [Arabidopsis thaliana] >gi|15081819|gb|AAK82564.1|
  misc_feature: GI Number: 26451337; NR Description: SRG1 like protein
  misc_feature: GI Number: 7269381; NR Description: SRG1-like protein [Arabidopsis thaliana] >gi|4454018|emb|CAA23071.1| SRG1-like protein [Arabidopsis thaliana] >gi|15235014|ref|NP_194260.1| oxidoreductase, 2OG-Fe(II) oxygenase family protein [Arabidopsis
  misc_feature: GI Number: 7269382; NR Description: SRG1-like protein [Arabidopsis thaliana] >gi|4454019|emb|CAA23072.1| SRG1-like protein [Arabidopsis thaliana] >gi|45752708|gb|AAS76252.1| At4g25310 [Arabidopsis thaliana] >gi|15235017|ref|NP_194261.1|
  misc_feature: GI Number: 15219986; NR Description: oxidoreductase,
AGATTTGAGACTATCTATTTACATTCTGATTATTTCTTAAGAAGAAACGGCCATGGAAGTCAAAGGAGCCACCCGGAGCTCTATCATAGTTCCTTCTGTTCAAGAGATGGTGAAGGAGAAGATGATCACGACGGTTCCTCCGAGGTATGTACGGTCTGATCAAGACGTAGCTGAGATAGCCGTTGATTCTGGTCTAAGAAACCAGATCCCAATCATAGACTTCAGTCTTCTGTGTTCTTCAACCTCCATGGATTCCGAGATTGACAAGCTTGACTCTGCTTGCAAAGAGTGGGGATTTTTTCAGCTTGTAAACCATGGAATGGAGTCAAGTTTCTTGAACAAAGTAAAGTCAGAGGTTCAAGACTTCTTCAACCTTCCCATGGAAGAGAAGAAGAATTTGTGGCAACAACCCGATGAGATCGAAGGGTTTAGACAAGTATTTGTGGTTTCAGAAGAGCAGAAACTCGATTGGGCAGATATGTTCTTCCTTACAATGCAACCTGTTCGATTACGCAAGCCTCACTTGTTCCCCAAGTTACCTCTGCCCTTTAGAGATACACTAGACATGTATTCGACTGAAGTGAAAAGCATTGCTAAGATCTTACTTGGGAAAATAGCGGTAGCACTGAAGATCAAACCCGAGGAAATGGATAGGTTGTTTGATGATGAGTTAGGGCAGAGAATTAGGCTGAATTACTACCCGCCTTGTCCAGAGCCCGATAAGGTTATTGGTCTAACTCCGCATTCTGATTCTACAGGACTCACCATACTGTTGCAGGCTAATGAAGTTGAAGGTCTCCAAATCAAGAAAAATGGCAAGTGGGTTTCTGTCAAACCTCTCCCAAATGCTTTGGTTGTCAATGTCGGAGACATCTTAGAGATCATAACGAATAGCACATACCGAAGTATAGAGCATCGTGGAGTTGTGAACTCAGAGAAAGAGAGACTTTCGGTGGCGGCATTCCACAATATTGGATTGGGTAAAGAAATTGGTCCGATGAGAAGTCTCGTGGAAAGGCACAAGGCTGCATTTTTCAAAAGCGTGACTACTGAAGAGTATTTCCATGGCTTGTTTTCCCGTGAGCTCGATGGAAAAGCTTACCTTGATGTTATGAGACTCTAAAGGAAACAATTCATAAAATTATTGGCTTGTGCCCCAAGAAAACAATCACATTTTCTGACCCTTCCTATTGTAGTGTATATACTCTGTTTCTCCTCTGTTTCATGCTTTTGCAAATAGGC

SEQ ID NO: 411 - DNA, 967 bp, Arabidopsis thaliana
  misc_feature (1)..(967): Ceres cDNA ID no. 12331784
  misc_feature (1)..(967): Ceres CLONE  ID no. 10035
  misc_feature (1)..(967): Also known as  Ceres CDNA ID no. 23366550
attttctaagttccttgaacggatgcggaccaataaatcgtctccaatggagcctacttatcttgcccagcatcctttgtttgatcagataaatgaactgagagatgatatatgtattcctgattactgttttgtcggtggtggggaactccaatcacttaatgcatggtttggcccggctgggacagttactccgttacaccatgatccacatcataatatacttgctcagcctgatcttctcgctggattgaagtttgatgactctttgactaaccaaagaaatcgtttggcctgcaattcatatgtttctagtttacggaaacttctttacttagatgctttctccttctactgaagttttgatatcatctgttcttcaggttgttggcaagaagtatataaggctttacccatccttcctgcaagacgaactttacccttactctgagacaatgctctgcaactctagtcaggttgatctagacaatatcgacgaaaccgagttcccaaaggccatggagttggagtttatggattgtattctagaagaaggtgaaatgttgtacatccctcccaaatggtggcactatgtcaggtccttaacaatgagtctctcggttagcttctggtggagcaatgaagcagaatcttctagctcgtagcgaatggatttatttttaatctctgtttcaggttctaagttcacgttgtgtctttatgtaagaagaaactatgtagagaagaaaacaactgctccgagcatgaagatgtttgtttggtttacgtctatgttgtaaaagacaattgagagctcttggtacagacattttttaggtattggtaatgtttgtctttgtttcaagtaagaaatggtttaatcaaaatctaatcttcaattagtatcttccttttagttggcttatgtcattgtaattgcacttatcttgttgatatcattcatttt

SEQ ID NO: 412 - protein, 967 aa, Arabidopsis thaliana
  misc_feature: PFam Name: JmjC; PFam Description: JmjC domain
  misc_feature: PFam Name: Cupin_4; PFam Description: Cupin superfamily protein
  misc_feature: GI Number: 21928039; NR Description: AT3g20810/MOE17_10 [Arabidopsis thaliana] >gi|20147203|gb|AAM10317.1| AT3g20810/MOE17_10 [Arabidopsis thaliana] >gi|30685945|ref|NP_850617.1| transcription factor jumonji (jmjC)
  misc_feature: GI Number: 50947487; NR Description: N-acetyltransferase and Transcription factor-like protein [Oryza sativa (japonica cultivar-group)] >gi|42408989|dbj|BAD10244.1| N-acetyltransferase and Transcription factor-like protein [Oryza sativa (japonica
  misc_feature: GI Number: 62641259; NR Description: PREDICTED: similar to
  misc_feature: GI Number: 31211123; NR Description: ENSANGP00000016264 [Anopheles gambiae] >gi|21297769|gb|EAA09914.1| ENSANGP00000016264
  misc_feature: GI Number: 28317179; NR Description: GM21055p [Drosophila
ATTTTCTAAGTTCCTTGAACGGATGCGGACCAATAAATCGTCTCCAATGGAGCCTACTTATCTTGCCCAGCATCCTTTGTTTGATCAGATAAATGAACTGAGAGATGATATATGTATTCCTGATTACTGTTTTGTCGGTGGTGGGGAACTCCAATCACTTAATGCATGGTTTGGCCCGGCTGGGACAGTTACTCCGTTACACCATGATCCACATCATAATATACTTGCTCAGCCTGATCTTCTCGCTGGATTGAAGTTTGATGACTCTTTGACTAACCAAAGAAATCGTTTGGCCTGCAATTCATATGTTTCTAGTTTACGGAAACTTCTTTACTTAGATGCTTTCTCCTTCTACTGAAGTTTTGATATCATCTGTTCTTCAGGTTGTTGGCAAGAAGTATATAAGGCTTTACCCATCCTTCCTGCAAGACGAACTTTACCCTTACTCTGAGACAATGCTCTGCAACTCTAGTCAGGTTGATCTAGACAATATCGACGAAACCGAGTTCCCAAAGGCCATGGAGTTGGAGTTTATGGATTGTATTCTAGAAGAAGGTGAAATGTTGTACATCCCTCCCAAATGGTGGCACTATGTCAGGTCCTTAACAATGAGTCTCTCGGTTAGCTTCTGGTGGAGCAATGAAGCAGAATCTTCTAGCTCGTAGCGAATGGATTTATTTTTAATCTCTGTTTCAGGTTCTAAGTTCACGTTGTGTCTTTATGTAAGAAGAAACTATGTAGAGAAGAAAACAACTGCTCCGAGCATGAAGATGTTTGTTTGGTTTACGTCTATGTTGTAAAAGACAATTGAGAGCTCTTGGTACAGACATTTTTTAGGTATTGGTAATGTTTGTCTTTGTTTCAAGTAAGAAATGGTTTAATCAAAATCTAATCTTCAATTAGTATCTTCCTTTTAGTTGGCTTATGTCATTGTAATTGCACTTATCTTGTTGATATCATTCATTTT

SEQ ID NO: 413 - DNA, 607 bp, Arabidopsis thaliana
  misc_feature (1)..(607): Ceres cDNA ID no. 12332180
  misc_feature (1)..(607): Ceres CLONE  ID no. 14470
  misc_feature (1)..(607): Also known as  Ceres CDNA ID no. 23366929
atcttaatttccctcgcattgagaattttcaactttttctatctctcttcccaaatcacaaatggcgggtcgcggcaaaactctcggatctggcgttgctaagaaatcaacatcgagaagcagcaaagccggtctccaattccccgttggtcgtatcgctcgttttctaaagaacggcaagtacgcaacacgtgttggtgccggagctccggtttacttagccgccgttctcgaatacctcgccgctgaggtattggaattggctggaaacgcagctagggataacaagaagactaggattgtgccacgtcacattcagctcgcggtgagaaacgatgaggagctgagtaaactgcttggagatgtgacgattgctaatggaggtgtgatgcctaacattcacagtcttcttcttcccaagaaagctggtgcttcaaaaccttccgctgatgaagattagattagggatttgtgttgtggttgtttagctaattaatgtgtagcttagtctttcattagattagatctgaattagttttcattaatggtgttgtgtagtctctcttttgcttcaaaaacaagtattaaaatcttattattttgaatt

SEQ ID NO: 414 - protein, 607 aa, Arabidopsis thaliana
  misc_feature: PFam Name: Histone; PFam Description: Core histone H2A/H2B/H3/H4
  misc_feature: GI Number: 17065594; NR Description: putative histone H2A protein [Arabidopsis thaliana] >gi|13877851|gb|AAK44003.1| putative histone H2A protein [Arabidopsis thaliana] >gi|12320785|gb|AAG50540.1| histone H2A, putative [Arabidopsis
  misc_feature: GI Number: 21593834; NR Description: histone H2A [Arabidopsis thaliana] >gi|9758956|dbj|BAB09343.1| histone H2A [Arabidopsis thaliana] >gi|28827756|gb|AAO50722.1| putative histone H2A protein [Arabidopsis thaliana] >gi|28393261|gb|AAO42059.1|
  misc_feature: GI Number: 21617982; NR Description: histone H2A-like protein
  misc_feature: GI Number: 536896; NR Description: protein H2A [Triticum aestivum] >gi|536892|dbj|BAA07278.1| protein H2A [Triticum
ATCTTAATTTCCCTCGCATTGAGAATTTTCAACTTTTTCTATCTCTCTTCCCAAATCACAAATGGCGGGTCGCGGCAAAACTCTCGGATCTGGCGTTGCTAAGAAATCAACATCGAGAAGCAGCAAAGCCGGTCTCCAATTCCCCGTTGGTCGTATCGCTCGTTTTCTAAAGAACGGCAAGTACGCAACACGTGTTGGTGCCGGAGCTCCGGTTTACTTAGCCGCCGTTCTCGAATACCTCGCCGCTGAGGTATTGGAATTGGCTGGAAACGCAGCTAGGGATAACAAGAAGACTAGGATTGTGCCACGTCACATTCAGCTCGCGGTGAGAAACGATGAGGAGCTGAGTAAACTGCTTGGAGATGTGACGATTGCTAATGGAGGTGTGATGCCTAACATTCACAGTCTTCTTCTTCCCAAGAAAGCTGGTGCTTCAAAACCTTCCGCTGATGAAGATTAGATTAGGGATTTGTGTTGTGGTTGTTTAGCTAATTAATGTGTAGCTTAGTCTTTCATTAGATTAGATCTGAATTAGTTTTCATTAATGGTGTTGTGTAGTCTCTCTTTTGCTTCAAAAACAAGTATTAAAATCTTATTATTTTGAATT

SEQ ID NO: 415 - DNA, 1681 bp, Arabidopsis thaliana
  misc_feature (1)..(1681): Ceres cDNA ID no. 12332449
  misc_feature (1)..(1681): Ceres CLONE  ID no. 7650
  misc_feature (1)..(1681): Also known as  Ceres CDNA ID no. 23367160
actacctccaaacttcccaagaatctctctttctctcctctcttctctctcgcctcttctttaatttcctctgaagagaatcctccttacgaaaatgttcaagaaagcaacattgaatctttcacttgctcctttgctacttgtttttcttttccttctctcgtgtgttgttcatggcgtcgatgagaagaagattctcagtgtacataacaacatctggtctcccaagaaatcatacgaagcttcaacttcatgtttttctcgcagtcttggaaaaggaagagaatccactacattggagatgaaacatagagaactttgctcaggaaagactatagatttgggtaagaagatgagaagagccttagttttggataacattcgagttcagtcacttcaactcaaaatcaaagcaatgacctcaagcaccactgaacaatctgtttccgaaactcagattccgttaacctcagggataaaacttgagtctttgaactacatcgttacagttgaattaggagggaaaaacatgagtttgatcgttgacactggaagtgacctgacttgggtccaatgccagccttgcagatcctgttacaaccaacaaggtcctttgtatgacccatcagtctcatcttcttacaagacggtgttctgtaactcatccacttgtcaggaccttgtggcagctaccagcaattccggcccttgtggaggtaacaatggtgttgtaaagacaccttgtgagtacgttgtcagctatggagatggatcatacactcgaggagacttggcaagtgaaagcatcctattgggcgacacaaaacttgaaaactttgtctttggttgtggccgaaacaacaaaggtctgtttgggggatcctctggtttaatgggtttgggaagaagttcagtctctttagtctcccaaactttgaaaactttcaacggagttttctcatactgtttaccttctcttgaggatggagcttctggctcattgtcctttggtaacgattcctctgtttacacgaattcaacttcagtttcctacacgccgttagtacaaaaccctcagcttcgttccttttacattctgaatctcactggtgctagcattggtggcgtggaactgaaatcttcaagctttggcagagggattctaatcgattcaggaacggttatcacaagattgccaccttccatttacaaagctgtgaagatagagtttctgaaacagttttccgggtttcctactgctcctggttattcaatcttagacacttgctttaacctcacaagttatgaagacataagcattcccattatcaaaatgatcttccaaggtaacgctgagctcgaagtggatgtcactggtgtgttctactttgtcaagcctgacgcatctctagtctgcttggccttagcaagtctgtcatatgaaaatgaagtcgggatcatcggaaattatcagcagaaaaaccagagagtaatatatgataccacacaagagaggctaggaattgtcggagaaaactgcagagtctgatgcctacaccataacttaatatccatttgtgtgctcccttcatatcatgaaagccaatcatctcttttggcaaagccaatttgaattctcccactaatcttataaataaatatatttctgtatcggtatagc

SEQ ID NO: 416 - protein, 1681 aa, Arabidopsis thaliana
  misc_feature: PFam Name: Asp; PFam Description: Eukaryotic aspartyl protease
  misc_feature: GI Number: 7715602; NR Description: F20B17.14 [Arabidopsis thaliana] >gi|25406599|pir||B96828 probable aspartyl proteinase, 105611-106921 [imported] - Arabidopsis thaliana >gi|12324588|gb|AAG52249.1| putative aspartyl protease;
  misc_feature: GI Number: 21595063; NR Description: putative aspartyl
  misc_feature: GI Number: 50943229; NR Description: putative 41 kD chloroplast nucleoid DNA binding protein [Oryza sativa (japonica cultivar-group)] >gi|37806402|dbj|BAC99940.1| putative 41 kD chloroplast nucleoid DNA binding protein [Oryza sativa (japonica
  misc_feature: GI Number: 24430421; NR Description: 41 kD chloroplast
  misc_feature: GI Number: 7489168; NR Description: nucleoid DNA-binding protein cnd41, chloroplast - common tobacco >gi|2541876|dbj|BAA22813.1| CND41, chloroplast nucleoid DNA binding
ACTACCTCCAAACTTCCCAAGAATCTCTCTTTCTCTCCTCTCTTCTCTCTCGCCTCTTCTTTAATTTCCTCTGAAGAGAATCCTCCTTACGAAAATGTTCAAGAAAGCAACATTGAATCTTTCACTTGCTCCTTTGCTACTTGTTTTTCTTTTCCTTCTCTCGTGTGTTGTTCATGGCGTCGATGAGAAGAAGATTCTCAGTGTACATAACAACATCTGGTCTCCCAAGAAATCATACGAAGCTTCAACTTCATGTTTTTCTCGCAGTCTTGGAAAAGGAAGAGAATCCACTACATTGGAGATGAAACATAGAGAACTTTGCTCAGGAAAGACTATAGATTTGGGTAAGAAGATGAGAAGAGCCTTAGTTTTGGATAACATTCGAGTTCAGTCACTTCAACTCAAAATCAAAGCAATGACCTCAAGCACCACTGAACAATCTGTTTCCGAAACTCAGATTCCGTTAACCTCAGGGATAAAACTTGAGTCTTTGAACTACATCGTTACAGTTGAATTAGGAGGGAAAAACATGAGTTTGATCGTTGACACTGGAAGTGACCTGACTTGGGTCCAATGCCAGCCTTGCAGATCCTGTTACAACCAACAAGGTCCTTTGTATGACCCATCAGTCTCATCTTCTTACAAGACGGTGTTCTGTAACTCATCCACTTGTCAGGACCTTGTGGCAGCTACCAGCAATTCCGGCCCTTGTGGAGGTAACAATGGTGTTGTAAAGACACCTTGTGAGTACGTTGTCAGCTATGGAGATGGATCATACACTCGAGGAGACTTGGCAAGTGAAAGCATCCTATTGGGCGACACAAAACTTGAAAACTTTGTCTTTGGTTGTGGCCGAAACAACAAAGGTCTGTTTGGGGGATCCTCTGGTTTAATGGGTTTGGGAAGAAGTTCAGTCTCTTTAGTCTCCCAAACTTTGAAAACTTTCAACGGAGTTTTCTCATACTGTTTACCTTCTCTTGAGGATGGAGCTTCTGGCTCATTGTCCTTTGGTAACGATTCCTCTGTTTACACGAATTCAACTTCAGTTTCCTACACGCCGTTAGTACAAAACCCTCAGCTTCGTTCCTTTTACATTCTGAATCTCACTGGTGCTAGCATTGGTGGCGTGGAACTGAAATCTTCAAGCTTTGGCAGAGGGATTCTAATCGATTCAGGAACGGTTATCACAAGATTGCCACCTTCCATTTACAAAGCTGTGAAGATAGAGTTTCTGAAACAGTTTTCCGGGTTTCCTACTGCTCCTGGTTATTCAATCTTAGACACTTGCTTTAACCTCACAAGTTATGAAGACATAAGCATTCCCATTATCAAAATGATCTTCCAAGGTAACGCTGAGCTCGAAGTGGATGTCACTGGTGTGTTCTACTTTGTCAAGCCTGACGCATCTCTAGTCTGCTTGGCCTTAGCAAGTCTGTCATATGAAAATGAAGTCGGGATCATCGGAAATTATCAGCAGAAAAACCAGAGAGTAATATATGATACCACACAAGAGAGGCTAGGAATTGTCGGAGAAAACTGCAGAGTCTGATGCCTACACCATAACTTAATATCCATTTGTGTGCTCCCTTCATATCATGAAAGCCAATCATCTCTTTTGGCAAAGCCAATTTGAATTCTCCCACTAATCTTATAAATAAATATATTTCTGTATCGGTATAGC

SEQ ID NO: 417 - DNA, 1205 bp, Arabidopsis thaliana
  misc_feature (1)..(1205): Ceres cDNA ID no. 12332476
  misc_feature (1)..(1205): Ceres CLONE  ID no. 6748
  misc_feature (1)..(1205): Also known as  Ceres CDNA ID no. 23660815
  misc_feature (1175)..(1175): n is a, c, t, g, unknown, or other
acgcattcgtcatttggtccctccacttagagagaagcagacagaacataactaaaatcgagaaaaatggcaaacagtggtgaaggtaaagtggtgtgtgtaacaggagcctccggttacatcgcctcatggctcgtcaagttcctacttagccgtggctacactgttaaggcctccgtccgtgatcccagtgatccgaaaaagacacaacacttagtttcactagaaggtgcaaaggaaagacttcacttgttcaaagcagaccttttggaacaaggttctttcgactctgctattgatggttgccatggagttttccacactgcttctccattttttaatgatgccaaagacccacaggctgaacttattgatcctgcggtcaaggggacgcttaacgttttgaattcgtgcgccaaagcctcttcggttaagagggttgttgtaacctcctccatggctgccgttggttacaatggaaaaccacgcacacctgatgttaccgtcgatgaaacttggttctctgatcctgagctttgcgaggcctccaagatgtggtatgttctatccaagactttggcggaagatgcagcttggaaactcgctaaagagaaaggcttagacattgttactattaacccggctatggtgatcggtcctctcctacagccaactctgaacacgagtgctgctgctatattaaacttaatcaatggtgcaaagactttcccaaacttgagtttcggatgggttaatgtaaaagacgtagccaatgcgcacatccaaacatttgaggtcccttcagctaatgggcgttattgtttggtcgagcgtgtcgttcaccactccgagattgttaacattctacgtgagctttacccaaatctcccactacctgaaaggtgtgtggacgagaatccctacgtgccaacgtatcaagtgtccaaggataaaacgaggagccttggcatagactacatacccttgaaggttagcatcaaggagaccgtcgagtccttgaaggaaaaaggtttcgcacagttctgagaaagcatttgagccaatggatttaatccagattagataaagtatttggaagactatttcaaaaataatatttggaacatgtcaatgttctcaaggagatattagtatgttcttgtgtactttattgntgttccatcaaatgagttacttttcctttt

SEQ ID NO: 418 - protein, 1205 aa, Arabidopsis thaliana
  misc_feature: PFam Name: Epimerase; PFam Description: NAD dependent
  misc_feature: PFam Name: 3Beta_HSD; PFam Description: 3-beta
  misc_feature: PFam Name: NmrA; PFam Description: NmrA-like family
  misc_feature: GI Number: 37029996; NR Description: NADPH-dependent cinnamyl
  misc_feature: GI Number: 1143445; NR Description: cinnamyl alcohol dehydrogenase [Eucalyptus gunnii] >gi|7431409|pir||T10736
  misc_feature: GI Number: 15239741; NR Description: cinnamyl-alcohol
  misc_feature: GI Number: 30694964; NR Description: cinnamyl-alcohol
  misc_feature: GI Number: 21594240; NR Description: cinnamyl-alcohol
ACGCATTCGTCATTTGGTCCCTCCACTTAGAGAGAAGCAGACAGAACATAACTAAAATCGAGAAAAATGGCAAACAGTGGTGAAGGTAAAGTGGTGTGTGTAACAGGAGCCTCCGGTTACATCGCCTCATGGCTCGTCAAGTTCCTACTTAGCCGTGGCTACACTGTTAAGGCCTCCGTCCGTGATCCCAGTGATCCGAAAAAGACACAACACTTAGTTTCACTAGAAGGTGCAAAGGAAAGACTTCACTTGTTCAAAGCAGACCTTTTGGAACAAGGTTCTTTCGACTCTGCTATTGATGGTTGCCATGGAGTTTTCCACACTGCTTCTCCATTTTTTAATGATGCCAAAGACCCACAGGCTGAACTTATTGATCCTGCGGTCAAGGGGACGCTTAACGTTTTGAATTCGTGCGCCAAAGCCTCTTCGGTTAAGAGGGTTGTTGTAACCTCCTCCATGGCTGCCGTTGGTTACAATGGAAAACCACGCACACCTGATGTTACCGTCGATGAAACTTGGTTCTCTGATCCTGAGCTTTGCGAGGCCTCCAAGATGTGGTATGTTCTATCCAAGACTTTGGCGGAAGATGCAGCTTGGAAACTCGCTAAAGAGAAAGGCTTAGACATTGTTACTATTAACCCGGCTATGGTGATCGGTCCTCTCCTACAGCCAACTCTGAACACGAGTGCTGCTGCTATATTAAACTTAATCAATGGTGCAAAGACTTTCCCAAACTTGAGTTTCGGATGGGTTAATGTAAAAGACGTAGCCAATGCGCACATCCAAACATTTGAGGTCCCTTCAGCTAATGGGCGTTATTGTTTGGTCGAGCGTGTCGTTCACCACTCCGAGATTGTTAACATTCTACGTGAGCTTTACCCAAATCTCCCACTACCTGAAAGGTGTGTGGACGAGAATCCCTACGTGCCAACGTATCAAGTGTCCAAGGATAAAACGAGGAGCCTTGGCATAGACTACATACCCTTGAAGGTTAGCATCAAGGAGACCGTCGAGTCCTTGAAGGAAAAAGGTTTCGCACAGTTCTGAGAAAGCATTTGAGCCAATGGATTTAATCCAGATTAGATAAAGTATTTGGAAGACTATTTCAAAAATAATATTTGGAACATGTCAATGTTCTCAAGGAGATATTAGTATGTTCTTGTGTACTTTATTGNTGTTCCATCAAATGAGTTACTTTTCCTTTT

SEQ ID NO: 419 - DNA, 1058 bp, Arabidopsis thaliana
  misc_feature (1)..(1058): Ceres cDNA ID no. 12333067
  misc_feature (1)..(1058): Ceres CLONE  ID no. 14713
  misc_feature (1)..(1058): Also known as  Ceres CDNA ID no. 23367728
gtcgaccttttttctctcacttacccaataagagcttttttcgcgttttccaccgcaaccaccgtcaccttcaaccgccggagccgccgcaaggaaggctcatcatccgccgtggcaattttttgaggtgtacaaagcattgcctatttgacgaaccaggaaatggttaaaaggcatggagagttttgatttacaagatatatcatgtcgcagtgcatagacggtttcaagcatgtatgctcctcttttttccggtgttttgatatcgatatttacaaacaatctggaggccttggtgaccctgaacttcttgcgagagagacagtttttagcgtgagtgaaatagaggctctctatgagctgtttaagaaaatcagcagtgctgtgattgatgatgggctaataaacaaggaagaatttcagttagccttgttcaagacaaataaaaaagagagcttgtttgcagaccggtaccaatcacaggtattcgatttgtttgacacaaagcataatggaatactggggtttgaggagtttgcgcgtgctctctctgtctttcatccaaatgctcccatagaagacaagattgacttttcgtttcagctatatgatcttaagcagcaaggtttcatagagaggcaagaggtgaagcaaatggtggtggctactcttgctgagtccggcatgaacctgtcagacgaaatcatagagagtataatcgacaagacatttgaggaagctgatacaaaacatgacgggaggatcgataaggaagagtggagaacccttgttctcaggcatccttcccttctaaagaatatgactctccagtatcttaaggatataacaactacatttccgagctttgtgttccactcgcaggtggaagatacctgagaaaaacaatagcatattagcagaggagacaatttgggaattgtgtttgttttctgattatgtatcatgtctatttgtttcaatctctctgaacattttcaagattttgttgttacttgtgtgaattaaaagtaaagaaaacaaatctgtatttttgctac

SEQ ID NO: 420 - protein, 1058 aa, Arabidopsis thaliana
  misc_feature: PFam Name: efhand; PFam Description: EF hand
  misc_feature: GI Number: 21553482; NR Description: calcineurin B-like protein 3 [Arabidopsis thaliana] >gi|30687272|ref|NP_849449.1|
  misc_feature: GI Number: 22136404; NR Description: calcineurin B-like protein 3 [Arabidopsis thaliana] >gi|7269509|emb|CAB79512.1| calcineurin B-like protein 3 [Arabidopsis thaliana] >gi|4938495|emb|CAB43853.1| calcineurin B-like protein 3
  misc_feature: GI Number: 56748808; NR Description: Calcineurin B-like protein 3 (SOS3-like calcium binding protein 6) gi|22136404|gb|AAM91280.1| calcineurin B-like protein 3 [Arabidopsis thaliana] gi|7269509|emb|CAB79512.1| calcineurin
  misc_feature: GI Number: 22655046; NR Description: At5g55990/MDA7_3 [Arabidopsis thaliana] >gi|9758619|dbj|BAB09281.1| calcineurin B-like protein 2 [Arabidopsis thaliana] >gi|15450407|gb|AAK96497.1| AT5g55990/MDA7_3 [Arabidopsis
  misc_feature: GI Number: 56748807; NR Description: Calcineurin B-like protein 2 (SOS3-like calcium binding protein 1) gi|22655046|gb|AAM98114.1| At5g55990/MDA7_3 [Arabidopsis thaliana] gi|9758619|dbj|BAB09281.1| calcineurin B-like protein 2
GTCGACCTTTTTTCTCTCACTTACCCAATAAGAGCTTTTTTCGCGTTTTCCACCGCAACCACCGTCACCTTCAACCGCCGGAGCCGCCGCAAGGAAGGCTCATCATCCGCCGTGGCAATTTTTTGAGGTGTACAAAGCATTGCCTATTTGACGAACCAGGAAATGGTTAAAAGGCATGGAGAGTTTTGATTTACAAGATATATCATGTCGCAGTGCATAGACGGTTTCAAGCATGTATGCTCCTCTTTTTTCCGGTGTTTTGATATCGATATTTACAAACAATCTGGAGGCCTTGGTGACCCTGAACTTCTTGCGAGAGAGACAGTTTTTAGCGTGAGTGAAATAGAGGCTCTCTATGAGCTGTTTAAGAAAATCAGCAGTGCTGTGATTGATGATGGGCTAATAAACAAGGAAGAATTTCAGTTAGCCTTGTTCAAGACAAATAAAAAAGAGAGCTTGTTTGCAGACCGGTACCAATCACAGGTATTCGATTTGTTTGACACAAAGCATAATGGAATACTGGGGTTTGAGGAGTTTGCGCGTGCTCTCTCTGTCTTTCATCCAAATGCTCCCATAGAAGACAAGATTGACTTTTCGTTTCAGCTATATGATCTTAAGCAGCAAGGTTTCATAGAGAGGCAAGAGGTGAAGCAAATGGTGGTGGCTACTCTTGCTGAGTCCGGCATGAACCTGTCAGACGAAATCATAGAGAGTATAATCGACAAGACATTTGAGGAAGCTGATACAAAACATGACGGGAGGATCGATAAGGAAGAGTGGAGAACCCTTGTTCTCAGGCATCCTTCCCTTCTAAAGAATATGACTCTCCAGTATCTTAAGGATATAACAACTACATTTCCGAGCTTTGTGTTCCACTCGCAGGTGGAAGATACCTGAGAAAAACAATAGCATATTAGCAGAGGAGACAATTTGGGAATTGTGTTTGTTTTCTGATTATGTATCATGTCTATTTGTTTCAATCTCTCTGAACATTTTCAAGATTTTGTTGTTACTTGTGTGAATTAAAAGTAAAGAAAACAAATCTGTATTTTTGCTAC

SEQ ID NO: 421 - DNA, 1272 bp, Arabidopsis thaliana
  misc_feature (1)..(1272): Ceres cDNA ID no. 12333884
  misc_feature (1)..(1272): Ceres CLONE  ID no. 32255
  misc_feature (1)..(1272): Also known as  Ceres CDNA ID no. 23368460
actactctcttaagccctttcataaccttgtaaaccattaagaggctttgctcaattacaagaagaagaaaaaatgcctgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccgcaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcgtgggagacggccaaagcaaaaggtgtggacttagtggtgctaaatccggttttggttctcggaccaccgctccagtcagcgatcaacgctagtctagtccatattctcaagtacctcaccggctcagccaagacctacgctaacttgactcaggtctacgtggacgtccgtgacgtggcactaggccatgttctggtctacgaagcaccctccgcctcaggccgttacatcctcgccgagaccgcacttcaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatatgtcaagagcttgcaagagaaaggtcatcttcctctacctcaagattcgaaccaaaacgaagtcatcatcgaaccttaggacacgatccacgaccctagaatctcttcatacctacatgaaaagctttattcttaagtaatacatacgttttggttttgactaaagtattgttaaatcttaaatcattatatatagctgattgttctttctttctttggttgtaattgagaatatgttacgcatatgtattatacgataatggaagcaatggttttatc

SEQ ID NO: 422 - protein, 1272 aa, Arabidopsis thaliana
  misc_feature: PFam Name: Epimerase; PFam Description: NAD dependent
  misc_feature: PFam Name: 3Beta_HSD; PFam Description: 3-beta
  misc_feature: PFam Name: NmrA; PFam Description: NmrA-like family
  misc_feature: PFam Name: Polysacc_synt_2; PFam Description: Polysaccharide
  misc_feature: GI Number: 29028764; NR Description: At1g80820 [Arabidopsis thaliana] >gi|6503293|gb|AAF14669.1| Similar to gb|X98083 cinnamoyl-CoA reductase from Zea mays. ESTs gb|Z24528 and gb|AI996461 come from this gene. [Arabidopsis putative
  misc_feature: GI Number: 52355804; NR Description: cinnamoyl CoA reductase 1 [Arabidopsis thaliana] >gi|12083326|gb|AAG48822.1| putative cinnamoyl CoA reductase [Arabidopsis thaliana] >gi|21592916|gb|AAM64866.1| cinnamoyl CoA reductase, puitative
  misc_feature: GI Number: 12407990; NR Description: cinnamoyl CoA reductase
  misc_feature: GI Number: 2960364; NR Description: cinnamoyl CoA reductase
  misc_feature: GI Number: 40233135; NR Description: cinnamoyl CoA reductase
ACTACTCTCTTAAGCCCTTTCATAACCTTGTAAACCATTAAGAGGCTTTGCTCAATTACAAGAAGAAGAAAAAATGCCTGTCGACGGGAAACTCGTCTGCGTCACCGGAGCCGGCGGCTACATTGCTTCTTGGATCGTTAAGTTACTCTTAGAGAGAGGCTACACCGTTAGAGGAACCGTAAGGAACCCAACTGATCCCAAGAACAACCATCTCAGAGAGCTTCAAGGAGCCAAGGAAAGACTCACTCTTCACAGTGCAGATCTTCTCGACTACGAAGCTCTCTGTGCCGCAATCGACGGTTGCGATGGCGTTTTCCACACTGCCTCTCCGATGACCGACGATCCCGAGACAATGTTGGAGCCGGCGGTGAACGGAGCCAAGTTCGTGATTGACGCAGCGGCTAAAGCCAAGGTCAAGCGCGTGGTTTTCACGTCATCAATTGGTGCAGTTTACATGAACCCTAACCGTGACACTCAAGCCATTGTTGACGAAAACTGCTGGAGTGATCTTGATTTCTGCAAAAACACTAAGAATTGGTATTGCTACGGGAAGATGTTGGCGGAACAATCGGCGTGGGAGACGGCCAAAGCAAAAGGTGTGGACTTAGTGGTGCTAAATCCGGTTTTGGTTCTCGGACCACCGCTCCAGTCAGCGATCAACGCTAGTCTAGTCCATATTCTCAAGTACCTCACCGGCTCAGCCAAGACCTACGCTAACTTGACTCAGGTCTACGTGGACGTCCGTGACGTGGCACTAGGCCATGTTCTGGTCTACGAAGCACCCTCCGCCTCAGGCCGTTACATCCTCGCCGAGACCGCACTTCACCGCGGAGAGGTTGTTGAGATTCTGGCCAAATTCTTCCCGGAGTATCCACTTCCCACCAAGTGTTCGGACGAGAAGAATCCGAGGGCTAAGCCATACAAGTTTACTACCCAAAAGATAAAAGACTTAGGCTTGGAATTTAAACCCATCAAGCAATCTCTTTACGAATATGTCAAGAGCTTGCAAGAGAAAGGTCATCTTCCTCTACCTCAAGATTCGAACCAAAACGAAGTCATCATCGAACCTTAGGACACGATCCACGACCCTAGAATCTCTTCATACCTACATGAAAAGCTTTATTCTTAAGTAATACATACGTTTTGGTTTTGACTAAAGTATTGTTAAATCTTAAATCATTATATATAGCTGATTGTTCTTTCTTTCTTTGGTTGTAATTGAGAATATGTTACGCATATGTATTATACGATAATGGAAGCAATGGTTTTATC

SEQ ID NO: 423 - DNA, 1484 bp, Arabidopsis thaliana
  misc_feature (1)..(1484): Ceres cDNA ID no. 12333979
  misc_feature (1)..(1484): Ceres CLONE  ID no. 18922
  misc_feature (1)..(1484): Also known as  Ceres CDNA ID no. 23368544
acggttcaatttgatttggataataattctctttttctctggaaagttcgaatttttttttgtttggaagcttggagaaaatattatactcttctcattgaatgatcaatttacaaatcctcatttgatcgatcttgtcaatttttgaaaaaaaaaatctgaactttgagaaaagttattgagtttcgatatctgtcggtcatggtttgattgtggctgttgggtaagacaacaaattagggtttttgaatagtttgtgtattgaagattgtctgaaatggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaattgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgagggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaatttgtatcgaggccttcgagcaagttctgagctttctagagaaagaagaaactatggagatcccagacggcgacctctaatttcccagccttctgttctccgtctcttcatttatctgtttaatcaactaaacgaagcaatcactcatcaccaggccattgagcaagttcagagacaaagaagacctctagttactggttccgggtcattggagcttacacgagcctaattttgactggaactatggtttattgaaagaagattcaatacatgtatatataaaatatatacttttttttttgtttcagtatcatccttcttctcttttccttacaataagaattaaggaaaagtagccgtgtttgttaacatgggcc

SEQ ID NO: 424 - protein, 1484 aa, Arabidopsis thaliana
  misc_feature: PFam Name: SKI; PFam Description: Shikimate kinase
  misc_feature: GI Number: 39104605; NR Description: putative shikimate
  misc_feature: GI Number: 4417286; NR Description: putative shikimate kinase precursor [Arabidopsis thaliana] >gi|25288007|pir||A84607 probable shikimate kinase precursor [imported] - Arabidopsis thaliana >gi|20137565|sp|Q9SJ05|AROK_ARATH Probable shikimate
  misc_feature: GI Number: 30681570; NR Description: shikimate kinase,
  misc_feature: GI Number: 42570867; NR Description: shikimate kinase,
  misc_feature: GI Number: 7270938; NR Description: shikimate kinase-like protein [Arabidopsis thaliana] >gi|5042170|emb|CAB44689.1| shikimate kinase-like protein [Arabidopsis thaliana] >gi|7434489|pir||T09370 shikimate kinase homolog F23K16.170 -
ACGGTTCAATTTGATTTGGATAATAATTCTCTTTTTCTCTGGAAAGTTCGAATTTTTTTTTGTTTGGAAGCTTGGAGAAAATATTATACTCTTCTCATTGAATGATCAATTTACAAATCCTCATTTGATCGATCTTGTCAATTTTTGAAAAAAAAAATCTGAACTTTGAGAAAAGTTATTGAGTTTCGATATCTGTCGGTCATGGTTTGATTGTGGCTGTTGGGTAAGACAACAAATTAGGGTTTTTGAATAGTTTGTGTATTGAAGATTGTCTGAAATGGAAGCAGCTATTACTCAGAGGATTCAGTACCCATCATGGGTTGATTGTAGAAAAGTTGAGTGTAAGCCGCAGCGTGGTTCATTGCGGTATTCTCAGCAGGTTAAGGTAGATAGAAGGTTTAGAGGTCTTTCTTTGGCTCGCTTGCAACCTGAAAGAAGAATTGATCAACGAAGAGCAGTTTCTCCAGCGGTTTCCTGTTCTGATAACAATTCCTCAGCGTTGTTGGAGACTGGAAGTGTTTATCCATTTGATGAAGATATTCTCAAGAGAAAAGCAGAAGAGGTTAAACCGTATTTGAATGGACGATCTATGTACCTTGTCGGAATGATGGGTTCTGGGAAAACAACTGTGGGAAAGTTAATGTCCAAAGTGCTCGGTTATACGTTCTTTGACTGCGACACTTTGATTGAGGGCGATGAATGGAACTTCTGTTGCAGAGATATTTGTTCATCACGGAGAGAATTTTTTTAGAGGAAAGGAGACCGATGCGCTTAAGAAGCTCTCTTCGAGGTATCAAGTTGTTGTTTCCACAGGTGGAGGTGCAGTTATAAGACCCATTAACTGGAAGTATATGCATAAAGGAATCAGCATTTGGCTAGATGTGCCTCTAGAAGCATTAGCCCATAGAATCGCTGCTGTTGGAACTGATTCACGACCACTGCTACACGATGAATCAGGAGATGCATACTCAGTGGCTTTCAAACGTCTCTCGGCTATTTGGGACGAGCGCGGTGAAGCATACACAAACGCAAATGCCAGAGTCTCCTTAGAAAATATTGCAGCAAAGCGTGGCTATAAAAATGTCTCAGATCTCACACCAACTGAAATTTGTATCGAGGCCTTCGAGCAAGTTCTGAGCTTTCTAGAGAAAGAAGAAACTATGGAGATCCCAGACGGCGACCTCTAATTTCCCAGCCTTCTGTTCTCCGTCTCTTCATTTATCTGTTTAATCAACTAAACGAAGCAATCACTCATCACCAGGCCATTGAGCAAGTTCAGAGACAAAGAAGACCTCTAGTTACTGGTTCCGGGTCATTGGAGCTTACACGAGCCTAATTTTGACTGGAACTATGGTTTATTGAAAGAAGATTCAATACATGTATATATAAAATATATACTTTTTTTTTTGTTTCAGTATCATCCTTCTTCTCTTTTCCTTACAATAAGAATTAAGGAAAAGTAGCCGTGTTTGTTAACATGGGCC

SEQ ID NO: 425 - DNA, 1251 bp, Arabidopsis thaliana
  misc_feature (1)..(1251): Ceres cDNA ID no. 12334113
  misc_feature (1)..(1251): Ceres CLONE  ID no. 148575
  misc_feature (1)..(1251): Also known as  Ceres CDNA ID no. 23368672
tgaaagttcttaagtggttccacgatgtttccattttgttctgacttccgaggccaacgagatgagtccaataaacaaagggcacggaaacattctttttaaattagtcttcttgagatcgaaggataacttcaattcaattcttttccaaggtacacacagctgatttttgtgataagaagattgattgagatgggtactagagctcagcagattcctttacttgaaggtgagactgataattacgatggtgttactgtaaccatggtggaacctatggattctgaggtttttactgaaagtcttagggcttctctttcgcattggagagaagaggggaagaagggaatttggataaagctgcctcttggattggctaatcttgtggaggctgcagttagtgaaggatttagatatcaccacgcggagcctgagtacttgatgcttgtatcttggatctctgaaactcctgatacaatcccagccaatgcttctcatgttgtaggtgctggtgctttggtcatcaacaaaaatactaaagaggtcctcgttgtccaggagaggagtgggtttttcaaagataaaaatgtgtggaagctgcctactggtgttatcaacgagggcgaggatatatggactggagtagctagggaagtggaagaagaaactggaattattgcagattttgtcgaagtactggctttcaggcaaagccacaaagccatcttaaaaaagaaaacagatatgtttttcctgtgtgtcttaagtccgcgctcttacgatattactgaacaaaaatctgagatcttgcaagctaagtggatgccgatccaagagtatgtagaccaaccatggaacaagaagaacgagatgttcaagttcatggctaacatttgccaaaagaagtgtgaggaagaatacttgggattcgccattgtgccaactaccacatcatctggtaaagagagctttatctactgcaatgcggatcatgccaagcgccttaaagtatcgcgtgaccaagcctctgcttctctctgaaaacattctcatctgattctgtttgatctcggcatgtgtgtgtccagtgtgtacaaaacaggaaactttcttctatattattccgattctacaaaattgcgtctaaatatttaagtttataccatctctatgagccactgtaaaacttgccatcgacttctagtctatttccagtgatggtttgattctcccaacgcttacgtgcttttt

SEQ ID NO: 426 - protein, 1251 aa, Arabidopsis thaliana
  misc_feature: PFam Name: NUDIX; PFam Description: NUDIX domain
  misc_feature: GI Number: 21553511; NR Description: growth factor like
  misc_feature: GI Number: 15810611; NR Description: putative growth factor [Arabidopsis thaliana] >gi|13877893|gb|AAK44024.1| putative growth factor [Arabidopsis thaliana] >gi|4586248|emb|CAB40989.1| growth factor like protein [Arabidopsis thaliana]
  misc_feature: GI Number: 4587605; NR Description: putative mutT domain protein [Arabidopsis thaliana] >gi|25387471|pir||G84457 probable mutT domain protein [imported] - Arabidopsis thaliana >gi|15228147|ref|NP_178526.1| MutT/nudix family protein
  misc_feature: GI Number: 38564302; NR Description: At2g04430 [Arabidopsis thaliana] >gi|40824275|gb|AAR92362.1| At2g04430 [Arabidopsis
  misc_feature: GI Number: 4587607; NR Description: putative mutT domain protein [Arabidopsis thaliana] >gi|25387501|pir||E84457 probable mutT domain protein [imported] - Arabidopsis thaliana >gi|15228145|ref|NP_178524.1| MutT/nudix family protein
TGAAAGTTCTTAAGTGGTTCCACGATGTTTCCATTTTGTTCTGACTTCCGAGGCCAACGAGATGAGTCCAATAAACAAAGGGCACGGAAACATTCTTTTTAAATTAGTCTTCTTGAGATCGAAGGATAACTTCAATTCAATTCTTTTCCAAGGTACACACAGCTGATTTTTGTGATAAGAAGATTGATTGAGATGGGTACTAGAGCTCAGCAGATTCCTTTACTTGAAGGTGAGACTGATAATTACGATGGTGTTACTGTAACCATGGTGGAACCTATGGATTCTGAGGTTTTTACTGAAAGTCTTAGGGCTTCTCTTTCGCATTGGAGAGAAGAGGGGAAGAAGGGAATTTGGATAAAGCTGCCTCTTGGATTGGCTAATCTTGTGGAGGCTGCAGTTAGTGAAGGATTTAGATATCACCACGCGGAGCCTGAGTACTTGATGCTTGTATCTTGGATCTCTGAAACTCCTGATACAATCCCAGCCAATGCTTCTCATGTTGTAGGTGCTGGTGCTTTGGTCATCAACAAAAATACTAAAGAGGTCCTCGTTGTCCAGGAGAGGAGTGGGTTTTTCAAAGATAAAAATGTGTGGAAGCTGCCTACTGGTGTTATCAACGAGGGCGAGGATATATGGACTGGAGTAGCTAGGGAAGTGGAAGAAGAAACTGGAATTATTGCAGATTTTGTCGAAGTACTGGCTTTCAGGCAAAGCCACAAAGCCATCTTAAAAAAGAAAACAGATATGTTTTTCCTGTGTGTCTTAAGTCCGCGCTCTTACGATATTACTGAACAAAAATCTGAGATCTTGCAAGCTAAGTGGATGCCGATCCAAGAGTATGTAGACCAACCATGGAACAAGAAGAACGAGATGTTCAAGTTCATGGCTAACATTTGCCAAAAGAAGTGTGAGGAAGAATACTTGGGATTCGCCATTGTGCCAACTACCACATCATCTGGTAAAGAGAGCTTTATCTACTGCAATGCGGATCATGCCAAGCGCCTTAAAGTATCGCGTGACCAAGCCTCTGCTTCTCTCTGAAAACATTCTCATCTGATTCTGTTTGATCTCGGCATGTGTGTGTCCAGTGTGTACAAAACAGGAAACTTTCTTCTATATTATTCCGATTCTACAAAATTGCGTCTAAATATTTAAGTTTATACCATCTCTATGAGCCACTGTAAAACTTGCCATCGACTTCTAGTCTATTTCCAGTGATGGTTTGATTCTCCCAACGCTTACGTGCTTTTT

SEQ ID NO: 427 - DNA, 1339 bp, Arabidopsis thaliana
  misc_feature (1)..(1339): Ceres cDNA ID no. 12334128
  misc_feature (1)..(1339): Ceres CLONE  ID no. 21724
  misc_feature (1)..(1339): Also known as  Ceres CDNA ID no. 23368688
agaatctgtttctttcttcacccaccaaaagtagcaaacctttgccacctaaaaatcttaccagttgggtgaaagttgccaaaatagagcttgcttttgtcgcaatcctatatttttcagattgattgttggtgggtttgtgtaaatggcggctcttttaggcagatcctgccggaaactgagttttccgagcttgactcacggagctaggagggtatcgacggaaactggaaaaccattgaatctatactctgctattaatcaagcgcttcacatcgctttggacaccgatcctcggtcttatgtctttggggaagacgttggctttggtggagtctttcgctgtacaactggtttagctgaacgattcgggaaaaaccgtgtcttcaatactcctctttgtgagcagggcattgttggatttggcattggtctagcagcaatgggtaatcgagcaattgtagagattcagtttgcagattatatatatcctgcttttgatcagattgttaatgaagctgcaaagttcagataccgaagtggtaaccaattcaactgtggaggacttacgataagagcaccatatggagcagttggtcatggtggacattaccattcacaatcccctgaagctttcttttgccatgtccctggtattaaggttgttatccctcggagtccacgagaagcaaagggactgttgttgtcatgtatccgtgatccaaatcccgttgttttcttcgaaccaaagtggctgtatcgtcaagcagtagaagaagtccctgagcatgactatatgatacctttatcagaagcagaggttataagagaaggcaatgacattacactggttggatggggagctcagcttaccgttatggaacaagcttgtctggacgcggaaaaggaaggaatatcatgtgaactgatagatctcaagacactgcttccttgggacaaagaaaccgttgaggcttcagttaaaaagactggcagacttcttataagccatgaagctcctgtaacaggaggttttggagcagagatctctgcaacaattctggaacgttgctttttgaagttagaagctccagtaagcagagtttgtggtctggatactccatttcctcttgtgtttgaaccattctacatgcccaccaagaacaagatattggatgcaatcaaatcgactgtgaattactagccgtactatctgtagtttactgtttacactaggactaatgtaatcgcatgtctttgttatcaattcgtctaatgtaacactaccgattaactttaatgaatttcaagataacgaaaacatgttataataggactg

SEQ ID NO: 428 - protein, 1339 aa, Arabidopsis thaliana
  misc_feature: PFam Name: Transket_pyr; PFam Description: Transketolase,
  misc_feature: PFam Name: Transketolase_C; PFam Description: Transketolase,
  misc_feature: GI Number: 9280297; NR Description: branched chain alpha-keto acid dehydrogenase E1 beta subunit [Arabidopsis thaliana] >gi|7021286|gb|AAF35281.1| branched chain alpha-keto acid dehydrogenase E1 beta subunit [Arabidopsis thaliana]
  misc_feature: GI Number: 3746568; NR Description: branched-chain alpha-keto acid decarboxylase E1 beta subunit [Arabidopsis thaliana] >gi|11252215|pir||T51835 3-methyl-2-oxobutanoate dehydrogenase (lipoamide) (EC 1.2.4.4) beta chain [imported] - Arabidopsis
  misc_feature: GI Number: 4204270; NR Description: branched-chain alpha-keto acid decarboxylase E1 beta subunit [Arabidopsis thaliana] >gi|15222731|ref|NP_175947.1| 2-oxoisovalerate dehydrogenase, putative / 3-methyl-2-oxobutanoate dehydrogenase, putative /
  misc_feature: GI Number: 45382817; NR Description: mitochondrial branched-chain alpha-keto acid dehydrogenase E1-beta subunit [Gallus gallus] >gi|12964600|dbj|BAB32666.1| branched-chain
  misc_feature: GI Number: 27806223; NR Description: branched chain keto acid dehydrogenase E1, beta polypeptide (maple syrup urine disease) [Bos taurus] >gi|129033|sp|P21839|ODBB_BOVIN 2-oxoisovalerate dehydrogenase beta subunit, mitochondrial precursor
AGAATCTGTTTCTTTCTTCACCCACCAAAAGTAGCAAACCTTTGCCACCTAAAAATCTTACCAGTTGGGTGAAAGTTGCCAAAATAGAGCTTGCTTTTGTCGCAATCCTATATTTTTCAGATTGATTGTTGGTGGGTTTGTGTAAATGGCGGCTCTTTTAGGCAGATCCTGCCGGAAACTGAGTTTTCCGAGCTTGACTCACGGAGCTAGGAGGGTATCGACGGAAACTGGAAAACCATTGAATCTATACTCTGCTATTAATCAAGCGCTTCACATCGCTTTGGACACCGATCCTCGGTCTTATGTCTTTGGGGAAGACGTTGGCTTTGGTGGAGTCTTTCGCTGTACAACTGGTTTAGCTGAACGATTCGGGAAAAACCGTGTCTTCAATACTCCTCTTTGTGAGCAGGGCATTGTTGGATTTGGCATTGGTCTAGCAGCAATGGGTAATCGAGCAATTGTAGAGATTCAGTTTGCAGATTATATATATCCTGCTTTTGATCAGATTGTTAATGAAGCTGCAAAGTTCAGATACCGAAGTGGTAACCAATTCAACTGTGGAGGACTTACGATAAGAGCACCATATGGAGCAGTTGGTCATGGTGGACATTACCATTCACAATCCCCTGAAGCTTTCTTTTGCCATGTCCCTGGTATTAAGGTTGTTATCCCTCGGAGTCCACGAGAAGCAAAGGGACTGTTGTTGTCATGTATCCGTGATCCAAATCCCGTTGTTTTCTTCGAACCAAAGTGGCTGTATCGTCAAGCAGTAGAAGAAGTCCCTGAGCATGACTATATGATACCTTTATCAGAAGCAGAGGTTATAAGAGAAGGCAATGACATTACACTGGTTGGATGGGGAGCTCAGCTTACCGTTATGGAACAAGCTTGTCTGGACGCGGAAAAGGAAGGAATATCATGTGAACTGATAGATCTCAAGACACTGCTTCCTTGGGACAAAGAAACCGTTGAGGCTTCAGTTAAAAAGACTGGCAGACTTCTTATAAGCCATGAAGCTCCTGTAACAGGAGGTTTTGGAGCAGAGATCTCTGCAACAATTCTGGAACGTTGCTTTTTGAAGTTAGAAGCTCCAGTAAGCAGAGTTTGTGGTCTGGATACTCCATTTCCTCTTGTGTTTGAACCATTCTACATGCCCACCAAGAACAAGATATTGGATGCAATCAAATCGACTGTGAATTACTAGCCGTACTATCTGTAGTTTACTGTTTACACTAGGACTAATGTAATCGCATGTCTTTGTTATCAATTCGTCTAATGTAACACTACCGATTAACTTTAATGAATTTCAAGATAACGAAAACATGTTATAATAGGACTG

SEQ ID NO: 429 - DNA, 1303 bp, Arabidopsis thaliana
  misc_feature (1)..(1303): Ceres cDNA ID no. 12334147
  misc_feature (1)..(1303): Ceres CLONE  ID no. 15781
  misc_feature (1)..(1303): Also known as  Ceres CDNA ID no. 23368707
attctttgtcgtgttcttttaattaaccttttgcaatttgtcttgtgtttctcacaacacaaaaacttgtaaaagtgttaaaaaatcaagatctgaaaaatcttatcaccgcttctaggtttttcagttttttttcttccttttcctgatctaaattaacttatatttcttagggtttcacttcttgaaacatttaatcagaattaattaacctctctagggctttcatggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaacgtgcgttaaaatggtttttaatttacagaagttaacaataagattataatgatgtttattatgatgttgaaaaccagtcagttgctacttgttactagtgagctatatagtttgtggacattatatt

SEQ ID NO: 430 - protein, 1303 aa, Arabidopsis thaliana
  misc_feature: PFam Name: GRP; PFam Description: Glycine rich protein family
  misc_feature: PFam Name: Bindin; PFam Description: Bindin
  misc_feature: GI Number: 21593180; NR Description: putative DNA-binding
  misc_feature: GI Number: 50915952; NR Description: DNA-binding protein-like [Oryza sativa (japonica cultivar-group)] >gi|48716263|dbj|BAD22878.1| DNA-binding protein-like [Oryza sativa (japonica cultivar-group)] >gi|48716505|dbj|BAD23110.1|
  misc_feature: GI Number: 50948561; NR Description: putative SAP1 protein [Oryza sativa (japonica cultivar-group)] >gi|42408442|dbj|BAD09624.1| putative SAP1 protein [Oryza sativa
  misc_feature: GI Number: 50912085; NR Description: DNA-binding protein-like [Oryza sativa (japonica cultivar-group)] >gi|41052877|dbj|BAD07790.1| DNA-binding protein-like [Oryza sativa
  misc_feature: GI Number: 30102700; NR Description: At1g20900 [Arabidopsis thaliana] >gi|6319180|gb|AAF07197.1| ESCAROLA [Arabidopsis thaliana] >gi|20532086|sp|Q9S7C9|ESCA_ARATH Putative DNA-binding protein ESCAROLA >gi|15218067|ref|NP_173514.1| [Arabidopsis
ATTCTTTGTCGTGTTCTTTTAATTAACCTTTTGCAATTTGTCTTGTGTTTCTCACAACACAAAAACTTGTAAAAGTGTTAAAAAATCAAGATCTGAAAAATCTTATCACCGCTTCTAGGTTTTTCAGTTTTTTTTCTTCCTTTTCCTGATCTAAATTAACTTATATTTCTTAGGGTTTCACTTCTTGAAACATTTAATCAGAATTAATTAACCTCTCTAGGGCTTTCATGGCGAATCCATGGTGGACAGGACAAGTGAACCTATCCGGCCTCGAAACGACGCCGCCTGGTTCCTCTCAGTTAAAGAAACCAGATCTCCACATCTCCATGAACATGGCCATGGACTCAGGTCACAATAATCATCACCATCACCAAGAAGTCGATAACAACAACAACGACGACGATAGAGACAACTTGAGTGGAGACGACCACGAGCCACGTGAAGGAGCCGTAGAAGCCCCCACGCGCCGTCCACGTGGACGTCCTGCTGGTTCCAAGAACAAACCAAAGCCACCGATCTTCGTCACTCGCGATTCTCCAAATGCTCTCAAGAGCCATGTCATGGAGATCGCTAGTGGGACTGACGTCATCGAAACCCTAGCTACTTTTGCTAGGCGGCGTCAACGTGGCATCTGCATCTTGAGCGGAAATGGCACAGTGGCTAACGTCACCCTCCGTCAACCCTCGACCGCTGCCGTTGCGGCGGCTCCTGGTGGTGCGGCTGTTTTGGCTTTACAAGGGAGGTTTGAGATTCTTTCTTTAACCGGTTCTTTCTTGCCAGGACCGGCTCCACCTGGTTCCACCGGTTTAACGATTTACTTAGCCGGTGGTCAAGGTCAGGTTGTTGGAGGAAGCGTGGTGGGCCCATTGATGGCAGCAGGTCCGGTGATGCTGATCGCCGCCACGTTCTCTAACGCGACTTACGAGAGATTGCCATTGGAGGAGGAAGAGGCAGCAGAGAGAGGCGGTGGTGGAGGCAGCGGAGGAGTGGTTCCGGGGCAGCTCGGAGGCGGAGGTTCGCCACTAAGCAGCGGTGCTGGTGGAGGCGACGGTAACCAAGGACTTCCGGTGTATAATATGCCGGGAAATCTTGTTTCTAATGGTGGCAGTGGTGGAGGAGGACAGATGAGCGGCCAAGAAGCTTATGGTTGGGCTCAAGCTAGGTCAGGATTTTAACGTGCGTTAAAATGGTTTTTAATTTACAGAAGTTAACAATAAGATTATAATGATGTTTATTATGATGTTGAAAACCAGTCAGTTGCTACTTGTTACTAGTGAGCTATATAGTTTGTGGACATTATATT

SEQ ID NO: 431 - DNA, 1378 bp, Arabidopsis thaliana
  misc_feature (1)..(1378): Ceres cDNA ID no. 12334204
  misc_feature (1)..(1378): Ceres CLONE  ID no. 22350
  misc_feature (1)..(1378): Also known as  Ceres CDNA ID no. 23368763
aagcaatccctctctagtaatggcggtcgcaatacctcaagccacttctcttacgaacctcgtcttcctcacgaaattaatcccacgaggaagcttcaccaccatactacctaagcatcatcggaaaccaatcttcgtattctctctccagactcaattttcttctccagtaaccacactcacctccaaaaaccctaaagatgatgagcaacagcaaaaactctccttcaccctcaactaccttatcgactcatgtggactatctccagattccgccaccgtagcctctcgtaagctcttactagattcaccagaacgacccaacacagttctcaaccttcttcgtgaccatggattcaccacagctcaaatctcatctctcgtcaagaaacgtcctgttctcttattagccaatgctgaatctgtcctcctcccgaaactcagcttctttctctcaattggtgtctcaaaatctttacttgctcgaactttagcttctgatccaaccattttgactagatcccttgttaatcagcttatcccttcttacaatttccttaaaagcgttcttgattccgatgagaagattgtggcggcgttgcggaggacgacttgggttttccttgaggatcacactaagaaccttgtcccaaacatcaactatatggcggagactggtgttcctgagaaatgtatcaagctgcttctcacgcattttcctgaagctgtgatgcagaagaaccatgagttccaagcaattgctaagcaagctcaagagatggggttcaatcctcaaaaatcaacatttgtgttggccattcatgctctctctgggaaaggaaacaaatcgatatgggacaaatgttttgaggtttatcagagatggggatggtcggaagatgatatcatgtgtgcgttcaagaagcaccctcattgtatgatgttgtctgagaggaagattaacagaacgatggaatattttgtgaatgagatgaatatggcgcctagatcgatcgcacagtgtccagtggtgctcttcttcagccttgagaagaggattatcccgaggtgttcggttactaaggttttggtatcgaacgggcttgtgaaagaggattggagcttgacgtctttgttggttccagtggagaaagtgttcttggagaagctcgtgatcaagtacgaagaggagttgcctgagttgatgaatctgtatctaggatgcaccaaactctgagcttttgtttttgactgttttcattatcaaatgtcagatgctgagagacatgaatctttgtgaaaagagtctagtgtgtaatccaattttggtagtgaaaggaaagctgattagcaagcccaacgtgtgttttaaagacag

SEQ ID NO: 432 - protein, 1378 aa, Arabidopsis thaliana
  misc_feature: PFam Name: mTERF; PFam Description: mTERF
  misc_feature: GI Number: 15218140; NR Description: mitochondrial transcription termination factor family protein / mTERF family
  misc_feature: GI Number: 25511650; NR Description: T22I11.2 protein - Arabidopsis thaliana >gi|8886986|gb|AAF80646.1| Contains similarity to F28O16.19 a putative translation initiation factor IF-2 gi|6143896 from Arabidopsis thaliana gb|AC010718. It is a
  misc_feature: GI Number: 51536072; NR Description: mitochondrial transcription termination factor-like [Oryza sativa (japonica cultivar-group)] >gi|51535002|dbj|BAD37286.1| mitochondrial transcription termination factor-like [Oryza sativa (japonica
  misc_feature: GI Number: 21553423; NR Description: unknown [Arabidopsis thaliana]
  misc_feature: GI Number: 51536067; NR Description: mitochondrial transcription termination factor-like [Oryza sativa (japonica
AAGCAATCCCTCTCTAGTAATGGCGGTCGCAATACCTCAAGCCACTTCTCTTACGAACCTCGTCTTCCTCACGAAATTAATCCCACGAGGAAGCTTCACCACCATACTACCTAAGCATCATCGGAAACCAATCTTCGTATTCTCTCTCCAGACTCAATTTTCTTCTCCAGTAACCACACTCACCTCCAAAAACCCTAAAGATGATGAGCAACAGCAAAAACTCTCCTTCACCCTCAACTACCTTATCGACTCATGTGGACTATCTCCAGATTCCGCCACCGTAGCCTCTCGTAAGCTCTTACTAGATTCACCAGAACGACCCAACACAGTTCTCAACCTTCTTCGTGACCATGGATTCACCACAGCTCAAATCTCATCTCTCGTCAAGAAACGTCCTGTTCTCTTATTAGCCAATGCTGAATCTGTCCTCCTCCCGAAACTCAGCTTCTTTCTCTCAATTGGTGTCTCAAAATCTTTACTTGCTCGAACTTTAGCTTCTGATCCAACCATTTTGACTAGATCCCTTGTTAATCAGCTTATCCCTTCTTACAATTTCCTTAAAAGCGTTCTTGATTCCGATGAGAAGATTGTGGCGGCGTTGCGGAGGACGACTTGGGTTTTCCTTGAGGATCACACTAAGAACCTTGTCCCAAACATCAACTATATGGCGGAGACTGGTGTTCCTGAGAAATGTATCAAGCTGCTTCTCACGCATTTTCCTGAAGCTGTGATGCAGAAGAACCATGAGTTCCAAGCAATTGCTAAGCAAGCTCAAGAGATGGGGTTCAATCCTCAAAAATCAACATTTGTGTTGGCCATTCATGCTCTCTCTGGGAAAGGAAACAAATCGATATGGGACAAATGTTTTGAGGTTTATCAGAGATGGGGATGGTCGGAAGATGATATCATGTGTGCGTTCAAGAAGCACCCTCATTGTATGATGTTGTCTGAGAGGAAGATTAACAGAACGATGGAATATTTTGTGAATGAGATGAATATGGCGCCTAGATCGATCGCACAGTGTCCAGTGGTGCTCTTCTTCAGCCTTGAGAAGAGGATTATCCCGAGGTGTTCGGTTACTAAGGTTTTGGTATCGAACGGGCTTGTGAAAGAGGATTGGAGCTTGACGTCTTTGTTGGTTCCAGTGGAGAAAGTGTTCTTGGAGAAGCTCGTGATCAAGTACGAAGAGGAGTTGCCTGAGTTGATGAATCTGTATCTAGGATGCACCAAACTCTGAGCTTTTGTTTTTGACTGTTTTCATTATCAAATGTCAGATGCTGAGAGACATGAATCTTTGTGAAAAGAGTCTAGTGTGTAATCCAATTTTGGTAGTGAAAGGAAAGCTGATTAGCAAGCCCAACGTGTGTTTTAAAGACAG

SEQ ID NO: 433 - DNA, 1289 bp, Arabidopsis thaliana
  misc_feature (1)..(1289): Ceres cDNA ID no. 12334274
  misc_feature (1)..(1289): Ceres CLONE  ID no. 21403
  misc_feature (1)..(1289): Also known as  Ceres CDNA ID no. 23368825
aattttctcccccacaccaaaagataaacctctctctctctatctatcttatgtcaaaagacagatttattaacaaacacaaatcataaatctttttcttcttccgagaaagaatgtctaaatcatcgtataatcacatcttcatcttgatcttgtgtttatgtttgagatcatcatcagccttcacgaatctcaacaccttaagctttgaagaatcactttctcctctctttggagatgccaatctcgtccgttcacctgatgatctctccgttcgtcttctcctcgatcgctataccggttctggtttcatatcatcgaatatgtatcaacatggattttacagctccatgattaagcttcccgctgattatactgccggcgtcgtcgtcgccttttatacatcaaacggagacgtgttcgagaaaacacacgacgagttagacatagagtttctagggaacataaaaggaaagccgtggaggtttcagacaaatctatacggaaatggaagtacacatagaggtcgtgaagagagatatcgtctctggtttgatccttctaaggagtttcatcgttatagcattctctggactcctcacaagatcatattttgggtagatgatgtgccaataagagaagtgatcagaaacgatgcaatgggagcagattatccggcaaagccaatggctctttacgccaccatttgggacgcttctgattgggctacttccggcggcaaatacaaagctaattacaaatttgcccctttcgtagctgaattcaaatctttctctctagacggttgctccgttgatcctattcaagaagtccccatggattgttccgactcagtcgatttccttgagtctcaagattactcttccattaattcccatcaacgcgccgccatgcgaagatttcgacaacgtttcatgtactattcttactgttacgatacacttaggtatcctgagcctctaccggaatgtgtgattgttccggctgagaaagataggtttaaggaaacgggaaggttgaagtttggtggtacggaggcgcgtgaacggcggagaaatcgccggcagcaacgtcggcctgagattgagattgagagtgatcctgacgacagaaaacttttataagatttgtttgtgccattctttttacttaaaattcgtttgtgagtataataaaataaagagtaaagatttgaaaaagaaagaaagaaatagaggataaatttgataggcctttgggctttcatgaattgtgaatgatttaagctc

SEQ ID NO: 434 - protein, 1289 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 21618261; NR Description: endoxyloglucan
  misc_feature: GI Number: 17065244; NR Description: endoxyloglucan transferase, putative [Arabidopsis thaliana] >gi|38605150|sp|Q38908|XT30_ARATH Probable xyloglucan endotransglucosylase/hydrolase protein 30 precursor (At-XTH30)
  misc_feature: GI Number: 1244754; NR Description: xyloglucan endotransglycosylase-related protein gi|2129774|pir||S71223 xyloglucan endo-1,4-beta-D-glucanase (EC 3.2.1.-) XTR-4 -
  misc_feature: GI Number: 7268693; NR Description: xyloglucan endo-transglycosylase-like protein [Arabidopsis thaliana] >gi|2832627|emb|CAA16756.1| xyloglucan endo-transglycosylase-like protein [Arabidopsis thaliana] >gi|7447409|pir||T05036 xyloglucan
  misc_feature: GI Number: 22136636; NR Description: putative xyloglucan endo-transglycosylase [Arabidopsis thaliana] >gi|38605337|sp|Q8L7H3|XT29_ARATH Probable xyloglucan endotransglucosylase/hydrolase protein 29 precursor (At-XTH29)
AATTTTCTCCCCCACACCAAAAGATAAACCTCTCTCTCTCTATCTATCTTATGTCAAAAGACAGATTTATTAACAAACACAAATCATAAATCTTTTTCTTCTTCCGAGAAAGAATGTCTAAATCATCGTATAATCACATCTTCATCTTGATCTTGTGTTTATGTTTGAGATCATCATCAGCCTTCACGAATCTCAACACCTTAAGCTTTGAAGAATCACTTTCTCCTCTCTTTGGAGATGCCAATCTCGTCCGTTCACCTGATGATCTCTCCGTTCGTCTTCTCCTCGATCGCTATACCGGTTCTGGTTTCATATCATCGAATATGTATCAACATGGATTTTACAGCTCCATGATTAAGCTTCCCGCTGATTATACTGCCGGCGTCGTCGTCGCCTTTTATACATCAAACGGAGACGTGTTCGAGAAAACACACGACGAGTTAGACATAGAGTTTCTAGGGAACATAAAAGGAAAGCCGTGGAGGTTTCAGACAAATCTATACGGAAATGGAAGTACACATAGAGGTCGTGAAGAGAGATATCGTCTCTGGTTTGATCCTTCTAAGGAGTTTCATCGTTATAGCATTCTCTGGACTCCTCACAAGATCATATTTTGGGTAGATGATGTGCCAATAAGAGAAGTGATCAGAAACGATGCAATGGGAGCAGATTATCCGGCAAAGCCAATGGCTCTTTACGCCACCATTTGGGACGCTTCTGATTGGGCTACTTCCGGCGGCAAATACAAAGCTAATTACAAATTTGCCCCTTTCGTAGCTGAATTCAAATCTTTCTCTCTAGACGGTTGCTCCGTTGATCCTATTCAAGAAGTCCCCATGGATTGTTCCGACTCAGTCGATTTCCTTGAGTCTCAAGATTACTCTTCCATTAATTCCCATCAACGCGCCGCCATGCGAAGATTTCGACAACGTTTCATGTACTATTCTTACTGTTACGATACACTTAGGTATCCTGAGCCTCTACCGGAATGTGTGATTGTTCCGGCTGAGAAAGATAGGTTTAAGGAAACGGGAAGGTTGAAGTTTGGTGGTACGGAGGCGCGTGAACGGCGGAGAAATCGCCGGCAGCAACGTCGGCCTGAGATTGAGATTGAGAGTGATCCTGACGACAGAAAACTTTTATAAGATTTGTTTGTGCCATTCTTTTTACTTAAAATTCGTTTGTGAGTATAATAAAATAAAGAGTAAAGATTTGAAAAAGAAAGAAAGAAATAGAGGATAAATTTGATAGGCCTTTGGGCTTTCATGAATTGTGAATGATTTAAGCTC

SEQ ID NO: 435 - DNA, 1205 bp, Arabidopsis thaliana
  misc_feature (1)..(1205): Ceres cDNA ID no. 12334500
  misc_feature (1)..(1205): Ceres CLONE  ID no. 25694
  misc_feature (1)..(1205): Also known as  Ceres CDNA ID no. 23369027
aacgccagttgccatccaggagaggggagaagaagaatttgtattctcaagttgtcgatatgagagagatgaagtcagaaacacgtttgtgagagaacagcttttagatgtgattgtggatcagattctcaaagacttttcgcgaagagtctctgatccttaaatcgcttctctctcgcttgacctcatttcgtcgtcgaaatcagatccttgtgaaaatgccgaaacaggatatggagaagatggagcttcgtaagaacttccgtaatgtttggcataccgatcttacccacagtatccagaacgatactccttattgttgcttcgcgttgtggtgtgccccttgtgcatcatacttgcttcgcaagcgtgcgctttacgatgatatgtcaaggtacgtctgctgtgccggttacatgccttgtagtggtaggtgtggagaagccaaatgtcctcaactttgtcttgccactgaggtcttctgctgctttgcaaactctgtggcctcaactcgctttcttctgcaagatgagttccaaattcaaacgacaaaatgtgacaactgcatcattggtttcatggtttgcctcagccaagtggcttgcatattctccatagttgcatgtattgtcggtatggatgagctttcagaagcttctcagatactcacatgttgctctgacatggtgtactgcacggtttgcgcatgtatgcagacacaacacaagatggaaatggacaagagggacggtaagttcgggccacagccaatggcagtgcctccggctcagcaaatgtcacggtttgatcaagccaccccacccgcagtcggttatcctccacaacaaggttatccaccttctggttatcctcaacaccctccacaaggttatccaccttctggctatcctcaaaaccctcctccctcagcttattctcaataccctcctggggcttatcctcctcctcccgcttacccaaagtgatcactctttgcctgttttctctcccgattggaaaattttatttcatctttttttaatgctgtcttgttacgggtcaagaattgaacgttcgctgattgttttgaggtcgttgtttgtatgagattttgacctcgcatgttgttgttgttttctgaaacgtccctcttggactaagagatttcatgactttttcctttccttttaaattctctctttttc

SEQ ID NO: 436 - protein, 1205 aa, Arabidopsis thaliana
  misc_feature: PFam Name: PLAC8; PFam Description: PLAC8 family
  misc_feature: PFam Name: Extensin_2; PFam Description: Extensin-like region
  misc_feature: GI Number: 21554542; NR Description: unknown [Arabidopsis thaliana]
  misc_feature: GI Number: 6469591; NR Description: unknown [Eufolliculina uhligi]
  misc_feature: GI Number: 13543234; NR Description: Unknown (protein for
  misc_feature: GI Number: 3337330; NR Description: rhodopsin [Sepia officinalis]
  misc_feature: GI Number: 33668156; NR Description: GPRP [Oryza sativa
AACGCCAGTTGCCATCCAGGAGAGGGGAGAAGAAGAATTTGTATTCTCAAGTTGTCGATATGAGAGAGATGAAGTCAGAAACACGTTTGTGAGAGAACAGCTTTTAGATGTGATTGTGGATCAGATTCTCAAAGACTTTTCGCGAAGAGTCTCTGATCCTTAAATCGCTTCTCTCTCGCTTGACCTCATTTCGTCGTCGAAATCAGATCCTTGTGAAAATGCCGAAACAGGATATGGAGAAGATGGAGCTTCGTAAGAACTTCCGTAATGTTTGGCATACCGATCTTACCCACAGTATCCAGAACGATACTCCTTATTGTTGCTTCGCGTTGTGGTGTGCCCCTTGTGCATCATACTTGCTTCGCAAGCGTGCGCTTTACGATGATATGTCAAGGTACGTCTGCTGTGCCGGTTACATGCCTTGTAGTGGTAGGTGTGGAGAAGCCAAATGTCCTCAACTTTGTCTTGCCACTGAGGTCTTCTGCTGCTTTGCAAACTCTGTGGCCTCAACTCGCTTTCTTCTGCAAGATGAGTTCCAAATTCAAACGACAAAATGTGACAACTGCATCATTGGTTTCATGGTTTGCCTCAGCCAAGTGGCTTGCATATTCTCCATAGTTGCATGTATTGTCGGTATGGATGAGCTTTCAGAAGCTTCTCAGATACTCACATGTTGCTCTGACATGGTGTACTGCACGGTTTGCGCATGTATGCAGACACAACACAAGATGGAAATGGACAAGAGGGACGGTAAGTTCGGGCCACAGCCAATGGCAGTGCCTCCGGCTCAGCAAATGTCACGGTTTGATCAAGCCACCCCACCCGCAGTCGGTTATCCTCCACAACAAGGTTATCCACCTTCTGGTTATCCTCAACACCCTCCACAAGGTTATCCACCTTCTGGCTATCCTCAAAACCCTCCTCCCTCAGCTTATTCTCAATACCCTCCTGGGGCTTATCCTCCTCCTCCCGCTTACCCAAAGTGATCACTCTTTGCCTGTTTTCTCTCCCGATTGGAAAATTTTATTTCATCTTTTTTTAATGCTGTCTTGTTACGGGTCAAGAATTGAACGTTCGCTGATTGTTTTGAGGTCGTTGTTTGTATGAGATTTTGACCTCGCATGTTGTTGTTGTTTTCTGAAACGTCCCTCTTGGACTAAGAGATTTCATGACTTTTTCCTTTCCTTTTAAATTCTCTCTTTTTC

SEQ ID NO: 437 - DNA, 1094 bp, Arabidopsis thaliana
  misc_feature (1)..(1094): Ceres cDNA ID no. 12334748
  misc_feature (1)..(1094): Ceres CLONE  ID no. 13930
  misc_feature (1)..(1094): Also known as  Ceres CDNA ID no. 23369276
atcgccggcgttagggttgtttttctcaacaatggtgtctctggccaagtttcactactgtgatcaaacactccacctccgactcgacactcaccgtaaaccgcagcctaaacctgtttcataccgaatcttacataaacctcctccttctcgcgtcatcagagcttcttcgttttcatcaaaccctaaaccctctttcctcaaaaccacctgcgtgaccttaacaacagccgccgctttactctccgcttccctccacctctccaccaaacccgtcaccgcagcaactctcgtctcacctcctcctccaccatccacggcggcggatctcacttccgatcaaatctcgtcgcgtccaaaggaagaagaagaagaagcagcgctggagaagcacctcactaagaatccaaacgacgtcgaagctcttcaatcactgatgaaaatcaaattccaaaccaaaaacatcgaccacgccttagagattctaaaccgtttgatcgaaatccaacccgaagaacaagaatggcggatcctaaaagctcaggtacaaacctacggcggcgatttcgattcagcgacgaaaggattcgaagaggttctatctaaagatccatttcgtgtagaagcttatcacggattagtaatggcttactccgaatccgaatcgaaattatcagagatcgagagtagaatcaacgaagcgattgagaaatgcaagaaggagaacaagaaagattttagagatttcatgttgttgattgctcagattagggttatcaaaggtaatccaattgaagcacttagggtttatcaagagttggtgaaagatgagcctaaagactttagaccatatctatgtcaaggtttgatttatacattgatgaagaagaaagatgaagcagagaagcaatttgcagagtttagaagattggttcctgagaatcatccttacaaagagtatttagatgctaatgtactcaatactaacaagcttttcgctaagaatcagtgaaaatttgtgtttttgtttgaatatgcttagaaatgtgactttgaacttttatttgtgatcactgcgaaattattctactacc

SEQ ID NO: 438 - protein, 1094 aa, Arabidopsis thaliana
  misc_feature: PFam Name: TPR_1; PFam Description: Tetratricopeptide repeat
  misc_feature: GI Number: 21553360; NR Description: unknown [Arabidopsis thaliana] >gi|18413971|ref|NP_568104.1| chloroplast lumen common
  misc_feature: GI Number: 21617936; NR Description: unknown [Arabidopsis thaliana]
  misc_feature: GI Number: 28416459; NR Description: At4g39470/F23K16_100 [Arabidopsis thaliana] >gi|15215656|gb|AAK91373.1| AT4g39470/F23K16_100 [Arabidopsis thaliana] >gi|18420460|ref|NP_568061.1| chloroplast lumen common family
  misc_feature: GI Number: 57900694; NR Description: unknow protein [Oryza
  misc_feature: GI Number: 13324598; NR Description: LMP1 [Borrelia burgdorferi]
ATCGCCGGCGTTAGGGTTGTTTTTCTCAACAATGGTGTCTCTGGCCAAGTTTCACTACTGTGATCAAACACTCCACCTCCGACTCGACACTCACCGTAAACCGCAGCCTAAACCTGTTTCATACCGAATCTTACATAAACCTCCTCCTTCTCGCGTCATCAGAGCTTCTTCGTTTTCATCAAACCCTAAACCCTCTTTCCTCAAAACCACCTGCGTGACCTTAACAACAGCCGCCGCTTTACTCTCCGCTTCCCTCCACCTCTCCACCAAACCCGTCACCGCAGCAACTCTCGTCTCACCTCCTCCTCCACCATCCACGGCGGCGGATCTCACTTCCGATCAAATCTCGTCGCGTCCAAAGGAAGAAGAAGAAGAAGCAGCGCTGGAGAAGCACCTCACTAAGAATCCAAACGACGTCGAAGCTCTTCAATCACTGATGAAAATCAAATTCCAAACCAAAAACATCGACCACGCCTTAGAGATTCTAAACCGTTTGATCGAAATCCAACCCGAAGAACAAGAATGGCGGATCCTAAAAGCTCAGGTACAAACCTACGGCGGCGATTTCGATTCAGCGACGAAAGGATTCGAAGAGGTTCTATCTAAAGATCCATTTCGTGTAGAAGCTTATCACGGATTAGTAATGGCTTACTCCGAATCCGAATCGAAATTATCAGAGATCGAGAGTAGAATCAACGAAGCGATTGAGAAATGCAAGAAGGAGAACAAGAAAGATTTTAGAGATTTCATGTTGTTGATTGCTCAGATTAGGGTTATCAAAGGTAATCCAATTGAAGCACTTAGGGTTTATCAAGAGTTGGTGAAAGATGAGCCTAAAGACTTTAGACCATATCTATGTCAAGGTTTGATTTATACATTGATGAAGAAGAAAGATGAAGCAGAGAAGCAATTTGCAGAGTTTAGAAGATTGGTTCCTGAGAATCATCCTTACAAAGAGTATTTAGATGCTAATGTACTCAATACTAACAAGCTTTTCGCTAAGAATCAGTGAAAATTTGTGTTTTTGTTTGAATATGCTTAGAAATGTGACTTTGAACTTTTATTTGTGATCACTGCGAAATTATTCTACTACC

SEQ ID NO: 439 - DNA, 1277 bp, Arabidopsis thaliana
  misc_feature (1)..(1277): Ceres cDNA ID no. 12334866
  misc_feature (1)..(1277): Ceres CLONE  ID no. 34876
  misc_feature (1)..(1277): Also known as  Ceres CDNA ID no. 23369384
atctgaaaccaatctgttcatatgatgaagaagtttctctcgttctcctccaacgcgtagaaaattctgacggcttaacgatgtggcgaagatctgttgtttctcgtttctcttcaagaatctctgtttcttcttcgttaccaaaccctagactgattccttggtcccgcgaattatgtgccgttaatagcttctcccagcctccggtctcgacggaatcaactgctaagttagggatcactggtgttagatctgatgccaatcgagtttttgccactgctactgccgccgctacagctacagctaccaccggtgagatttcgtctagagttgcggctttggctggattagggcatcactacgctcgttgttattgggagctttctaaagctaaacttagtatgcttgtggttgcaacttctggaactgggtatattctgggtacgggaaatgctgcaattagcttcccggggctttgttacacatgtgcaggaaccatgatgattgctgcatctgctaattccttgaatcagatttttgagataagcaatgattctaagatgaaaagaacgatgctaaggccattgccttcaggacgtattagtgttccacacgctgttgcatgggctactattgctggtgcttctggtgcttgtttgttggccagcaagactaatatgttggctgctggacttgcatctgccaatcttgtactttatgcgtttgtttatactccgttgaagcaacttcaccctatcaatacatgggttggcgctgttgttggtgctatcccacccttgcttgggtgggcggcagcgtctggtcagatttcatacaattcgatgattcttccagctgctctttacttttggcagatacctcattttatggcccttgcacatctctgccgcaatgattatgcagctggaggttacaagatgttgtcactctttgatccgtcagggaagagaatagcagcagtggctctaaggaactgcttttacatgatccctctcggtttcatcgcctatgactgggggttaacctcaagttggttttgcctcgaatcaacacttctcacactagcaatcgctgcaacagcattttcattctactctccatgataacctttaagcaagctattgaatttttggaaacagaaattaaaaaaaaaatctgaaaagttcttaagtttaatctttggttaataatgaagtggagaacgcatacaagtttatgtattttttctcatctccacataattgtattttttctcc

SEQ ID NO: 440 - protein, 1277 aa, Arabidopsis thaliana
  misc_feature: PFam Name: UbiA; PFam Description: UbiA prenyltransferase family
  misc_feature: GI Number: 7485006; NR Description: heme A farnesyltransferase homolog F16B22.1 - Arabidopsis thaliana
  misc_feature: GI Number: 25408912; NR Description: probable heme A
  misc_feature: GI Number: 21280973; NR Description: putative heme A [Arabidopsis thaliana] >gi|15028299|gb|AAK76626.1| putative heme A:farnesyltransferase [Arabidopsis thaliana] >gi|20197183|gb|AAM14960.1| putative heme A:farnesyltransferase
  misc_feature: GI Number: 34913400; NR Description: putative heme A farnesyltransferase homolog [Oryza sativa (japonica cultivar-group)] >gi|20161193|dbj|BAB90120.1| putative heme A farnesyltransferase homolog [Oryza sativa (japonica
  misc_feature: GI Number: 31237553; NR Description: ENSANGP00000013941 [Anopheles gambiae] >gi|21302745|gb|EAA14890.1| ENSANGP00000013941
ATCTGAAACCAATCTGTTCATATGATGAAGAAGTTTCTCTCGTTCTCCTCCAACGCGTAGAAAATTCTGACGGCTTAACGATGTGGCGAAGATCTGTTGTTTCTCGTTTCTCTTCAAGAATCTCTGTTTCTTCTTCGTTACCAAACCCTAGACTGATTCCTTGGTCCCGCGAATTATGTGCCGTTAATAGCTTCTCCCAGCCTCCGGTCTCGACGGAATCAACTGCTAAGTTAGGGATCACTGGTGTTAGATCTGATGCCAATCGAGTTTTTGCCACTGCTACTGCCGCCGCTACAGCTACAGCTACCACCGGTGAGATTTCGTCTAGAGTTGCGGCTTTGGCTGGATTAGGGCATCACTACGCTCGTTGTTATTGGGAGCTTTCTAAAGCTAAACTTAGTATGCTTGTGGTTGCAACTTCTGGAACTGGGTATATTCTGGGTACGGGAAATGCTGCAATTAGCTTCCCGGGGCTTTGTTACACATGTGCAGGAACCATGATGATTGCTGCATCTGCTAATTCCTTGAATCAGATTTTTGAGATAAGCAATGATTCTAAGATGAAAAGAACGATGCTAAGGCCATTGCCTTCAGGACGTATTAGTGTTCCACACGCTGTTGCATGGGCTACTATTGCTGGTGCTTCTGGTGCTTGTTTGTTGGCCAGCAAGACTAATATGTTGGCTGCTGGACTTGCATCTGCCAATCTTGTACTTTATGCGTTTGTTTATACTCCGTTGAAGCAACTTCACCCTATCAATACATGGGTTGGCGCTGTTGTTGGTGCTATCCCACCCTTGCTTGGGTGGGCGGCAGCGTCTGGTCAGATTTCATACAATTCGATGATTCTTCCAGCTGCTCTTTACTTTTGGCAGATACCTCATTTTATGGCCCTTGCACATCTCTGCCGCAATGATTATGCAGCTGGAGGTTACAAGATGTTGTCACTCTTTGATCCGTCAGGGAAGAGAATAGCAGCAGTGGCTCTAAGGAACTGCTTTTACATGATCCCTCTCGGTTTCATCGCCTATGACTGGGGGTTAACCTCAAGTTGGTTTTGCCTCGAATCAACACTTCTCACACTAGCAATCGCTGCAACAGCATTTTCATTCTACTCTCCATGATAACCTTTAAGCAAGCTATTGAATTTTTGGAAACAGAAATTAAAAAAAAAATCTGAAAAGTTCTTAAGTTTAATCTTTGGTTAATAATGAAGTGGAGAACGCATACAAGTTTATGTATTTTTTCTCATCTCCACATAATTGTATTTTTTCTCC

SEQ ID NO: 441 - DNA, 1426 bp, Arabidopsis thaliana
  misc_feature (1)..(1426): Ceres cDNA ID no. 12334899
  misc_feature (1)..(1426): Ceres CLONE  ID no. 33707
  misc_feature (1)..(1426): Also known as  Ceres CDNA ID no. 23369410
gtcagatatttttctcaacgtgaaagagagaaaagagaatctctcagaaggtgagcctccaacaaagcgtgaatctctctttctctctctatctctctatctctctgtctccgagatcgcatcaccggaaatctccttctacggtggtggtggtgacagttgaccagagatggcggcggagaatgagagaaaatctccttcagcagtctccgatatgggagcttgggcaatgaatgtaataagctccgttggaatcatcatggcgaataaacaacttatgtcctcttctggattcgcatttagtttcgctacaactctcaccggattccacttcgctttaaccgcattggtcggtatggtatcaaacgctaccggattctctgcttcgaagcatgttcctatgtgggagcttatttggttctccattgttgctaatgtctctattgctgctatgaacttcagtctcatgctcaattccgttggcttctaccaaatctcgaagctgagcatgattcctgtggtgtgtgtaatggaatggattctacatagcaagagatactcaagagaagtgaaaatatctgttgtggttgttgttgttggtgttggtatttgtactgtgactgatgttaaagttaatgccaaaggttttatctgtgcttgtgttgcgattttctcgtcatccttgcagcaaattttaataggttctctacagaagaaatattcaattgggtcctttgagttgttgagtaaaacagcgccgattcaagctttttcgcttcttgttgtcggtcctttagttgattatcttcttagtgggaagttcattatgaagtataatatgtcttccggttgctttctattcattcttctctcatgtggtctagctgtgttctgcaacataagccagtacctttgcatcgggcggttttcagcagtatcgttccaagttattggtcacatgaaaaccgtctgtatcctcacgcttggatggctcctatttgattctgcaatgactttcaaaaacgtagcggggatgattgttgcgattgttgggatggtaatctatagttgggcaatggaattggagaaacagtcgattattgcagcaaaggctttaaacagtgtgaaacatagcttaacagaggaagagtttgaacttttgaaggaaggtgtagaaactacacaatcaaaagatgttgaacttggccgcacaaaagattagagacagatggatagagaaagaaacatagtcttcaggtacaatttgttctgctataatttttgtatgttttgtgttatctaaaccaagagatcggatcctcggagattagtgtctaggcttcgatctaaagtttccttggttatacaaatgttttgtgttatttatatctttttacccaattccatggaaataacttcaatgacc

SEQ ID NO: 442 - protein, 1426 aa, Arabidopsis thaliana
  misc_feature: GI Number: 21536703; NR Description: unknown [Arabidopsis thaliana]
  misc_feature: GI Number: 51979016; NR Description: PREDICTED P0453G03.28 gene product [Oryza sativa (japonica cultivar-group)] >gi|51963502|ref|XP_506427.1| PREDICTED P0453G03.28 gene product [Oryza sativa (japonica cultivar-group)] (japonica
  misc_feature: GI Number: 50938707; NR Description: transporter-related-like
  misc_feature: GI Number: 50933293; NR Description: putative transmembrane protein [Oryza sativa (japonica cultivar-group)] >gi|48843759|gb|AAT47018.1| putative transmembrane protein [Oryza
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
GTCAGATATTTTTCTCAACGTGAAAGAGAGAAAAGAGAATCTCTCAGAAGGTGAGCCTCCAACAAAGCGTGAATCTCTCTTTCTCTCTCTATCTCTCTATCTCTCTGTCTCCGAGATCGCATCACCGGAAATCTCCTTCTACGGTGGTGGTGGTGACAGTTGACCAGAGATGGCGGCGGAGAATGAGAGAAAATCTCCTTCAGCAGTCTCCGATATGGGAGCTTGGGCAATGAATGTAATAAGCTCCGTTGGAATCATCATGGCGAATAAACAACTTATGTCCTCTTCTGGATTCGCATTTAGTTTCGCTACAACTCTCACCGGATTCCACTTCGCTTTAACCGCATTGGTCGGTATGGTATCAAACGCTACCGGATTCTCTGCTTCGAAGCATGTTCCTATGTGGGAGCTTATTTGGTTCTCCATTGTTGCTAATGTCTCTATTGCTGCTATGAACTTCAGTCTCATGCTCAATTCCGTTGGCTTCTACCAAATCTCGAAGCTGAGCATGATTCCTGTGGTGTGTGTAATGGAATGGATTCTACATAGCAAGAGATACTCAAGAGAAGTGAAAATATCTGTTGTGGTTGTTGTTGTTGGTGTTGGTATTTGTACTGTGACTGATGTTAAAGTTAATGCCAAAGGTTTTATCTGTGCTTGTGTTGCGATTTTCTCGTCATCCTTGCAGCAAATTTTAATAGGTTCTCTACAGAAGAAATATTCAATTGGGTCCTTTGAGTTGTTGAGTAAAACAGCGCCGATTCAAGCTTTTTCGCTTCTTGTTGTCGGTCCTTTAGTTGATTATCTTCTTAGTGGGAAGTTCATTATGAAGTATAATATGTCTTCCGGTTGCTTTCTATTCATTCTTCTCTCATGTGGTCTAGCTGTGTTCTGCAACATAAGCCAGTACCTTTGCATCGGGCGGTTTTCAGCAGTATCGTTCCAAGTTATTGGTCACATGAAAACCGTCTGTATCCTCACGCTTGGATGGCTCCTATTTGATTCTGCAATGACTTTCAAAAACGTAGCGGGGATGATTGTTGCGATTGTTGGGATGGTAATCTATAGTTGGGCAATGGAATTGGAGAAACAGTCGATTATTGCAGCAAAGGCTTTAAACAGTGTGAAACATAGCTTAACAGAGGAAGAGTTTGAACTTTTGAAGGAAGGTGTAGAAACTACACAATCAAAAGATGTTGAACTTGGCCGCACAAAAGATTAGAGACAGATGGATAGAGAAAGAAACATAGTCTTCAGGTACAATTTGTTCTGCTATAATTTTTGTATGTTTTGTGTTATCTAAACCAAGAGATCGGATCCTCGGAGATTAGTGTCTAGGCTTCGATCTAAAGTTTCCTTGGTTATACAAATGTTTTGTGTTATTTATATCTTTTTACCCAATTCCATGGAAATAACTTCAATGACC

SEQ ID NO: 443 - DNA, 1287 bp, Arabidopsis thaliana
  misc_feature (1)..(1287): Ceres cDNA ID no. 12335118
  misc_feature (1)..(1287): Ceres CLONE  ID no. 35675
  misc_feature (1)..(1287): Also known as  Ceres CDNA ID no. 23369626
atacattataaagatactgatgagtggttcttgtttaatggagttttaaatttaaaaatatttggtaaccgagtggatcatcatgttattgagaagcacatctgctccgatactgaactcgtggcttccacaacactgctcgagagaatcgtctccggaaccggagtcacagctctggcgccggtcaacatcattgtctcttttctcatcaaagtccatagatggacacactggggagcagctgcaccaagctctctctgacaacaaggagattattattcttaaatcaaaaagcaacgagcacagctacaaaactccaacatcaagcaggcaacgcaggtcatctttagatgaaacacgctacacaaaaaagactttggatcggtcatcacctttcttagtggagaggctcttctcgagctctggacagggagataaggccagtagtaatgatcgtctggagactcttgtgagtggtggtggtggcgggatgggaggcagcggcggcaatatttgtaacggcggcggtggtgtcggtggaagtggtgtggacggcggtaggagtgaggacgctaccgacacgtattaccgggagatgatcgactcgaatccaggaaactcgcttttgaccggaaactacgccaagttcttgaaagaggtgaaaggagacatgaaaaaagcagaagagtattgtgaaagagcaattttggggaacaccaacgatggaaacgttctatctctctatgctgatctcattttgcacaaccatcaagatcgtcaaagagcccactcttactataagcaagccgtcaagatgtccccggaagattgttatgtgcaagcttcatacgcaaggtttctgtgggatgtggatgaggacgaagaagatgaagcattaggagaagaagaagagaacttgagtgatgaaactggccatgtgcctccaactaccatgttccgtgattttccccaacacacttctattaccgcatcatcctaagacacatatgaacaccttcgtgaatgttcgtatttaggtaaataacatatatagaagcatatttaatacacatactcaaatgcaatatgcgtgtataatatatgttcagaatctttgtatatgttctgtagtcttcataataagggtatgtacttatatttgcagtatttatgtgtctttttgtattataaagtatgaaacttacccatgtcctatcgagatagacaaaatattaggcatttgtttgttaaaaaaaagtatgatgaaattgatgatacagatcgatc

SEQ ID NO: 444 - protein, 1287 aa, Arabidopsis thaliana
  misc_feature: GI Number: 21592868; NR Description: unknown [Arabidopsis thaliana]
  misc_feature: GI Number: 21555875; NR Description: unknown [Arabidopsis thaliana]
ATACATTATAAAGATACTGATGAGTGGTTCTTGTTTAATGGAGTTTTAAATTTAAAAATATTTGGTAACCGAGTGGATCATCATGTTATTGAGAAGCACATCTGCTCCGATACTGAACTCGTGGCTTCCACAACACTGCTCGAGAGAATCGTCTCCGGAACCGGAGTCACAGCTCTGGCGCCGGTCAACATCATTGTCTCTTTTCTCATCAAAGTCCATAGATGGACACACTGGGGAGCAGCTGCACCAAGCTCTCTCTGACAACAAGGAGATTATTATTCTTAAATCAAAAAGCAACGAGCACAGCTACAAAACTCCAACATCAAGCAGGCAACGCAGGTCATCTTTAGATGAAACACGCTACACAAAAAAGACTTTGGATCGGTCATCACCTTTCTTAGTGGAGAGGCTCTTCTCGAGCTCTGGACAGGGAGATAAGGCCAGTAGTAATGATCGTCTGGAGACTCTTGTGAGTGGTGGTGGTGGCGGGATGGGAGGCAGCGGCGGCAATATTTGTAACGGCGGCGGTGGTGTCGGTGGAAGTGGTGTGGACGGCGGTAGGAGTGAGGACGCTACCGACACGTATTACCGGGAGATGATCGACTCGAATCCAGGAAACTCGCTTTTGACCGGAAACTACGCCAAGTTCTTGAAAGAGGTGAAAGGAGACATGAAAAAAGCAGAAGAGTATTGTGAAAGAGCAATTTTGGGGAACACCAACGATGGAAACGTTCTATCTCTCTATGCTGATCTCATTTTGCACAACCATCAAGATCGTCAAAGAGCCCACTCTTACTATAAGCAAGCCGTCAAGATGTCCCCGGAAGATTGTTATGTGCAAGCTTCATACGCAAGGTTTCTGTGGGATGTGGATGAGGACGAAGAAGATGAAGCATTAGGAGAAGAAGAAGAGAACTTGAGTGATGAAACTGGCCATGTGCCTCCAACTACCATGTTCCGTGATTTTCCCCAACACACTTCTATTACCGCATCATCCTAAGACACATATGAACACCTTCGTGAATGTTCGTATTTAGGTAAATAACATATATAGAAGCATATTTAATACACATACTCAAATGCAATATGCGTGTATAATATATGTTCAGAATCTTTGTATATGTTCTGTAGTCTTCATAATAAGGGTATGTACTTATATTTGCAGTATTTATGTGTCTTTTTGTATTATAAAGTATGAAACTTACCCATGTCCTATCGAGATAGACAAAATATTAGGCATTTGTTTGTTAAAAAAAAGTATGATGAAATTGATGATACAGATCGATC

SEQ ID NO: 445 - DNA, 1400 bp, Arabidopsis thaliana
  misc_feature (1)..(1400): Ceres cDNA ID no. 12335141
  misc_feature (1)..(1400): Ceres CLONE  ID no. 7642
  misc_feature (1)..(1400): Also known as  Ceres CDNA ID no. 23369647
acgcttcccaaccgcctgcctttttcagattacctccggtttctaccactctcgccgtcgccgtcaccggtactccgatcacctccgcacgattcatttcctatttgcatttttcacctctctagcggaaagtgagtcttctggagaatgggagattgaagaagtaagagattcactgattgaggaagagagaaagttagttcagaaaaatggctccagtgagtaaagctgataagaaggcagccgtagatgctgctgcgtggatgttcaatgtcgtcacttctgttggtatcatcattgttaataaagctttaatggcgacttatggttatagctttgctacaacgttaaccggtttacatttcgctacaacgactctgatgacgcttgttttaagatgtcttggttacattcagccttctcatcttccgtttacggagcttttgagatttattctgtttgctaatttctccattgttggaatgaatgtcagtcttatgtggaactctgttggtttttatcagattgctaagctcagcatgattcctgtatcttgtttgttggaaatggttttcgataagattcgttattccagagatacaaagcttagcataggactggttcttgtgggtgttggtgtttgcactgtcactgatgttagtgtaaacactaaaagatttgtagccgctttcgttgctgtgtggagtactgctctgcaacaatactatgtacattaccttcagcgcaagtactcgcttaactcattcaacctattgggacataccgctccagcccaagccgcaacattactggtaattggcccgtttcttgattattggctgacagaaaaaagagtagacatgtacgattacaacttggtttcagtgctgtttataaccctgtcgtgcacaatagcgattggaaccaacctaagccagttcatctgcatcggaagattcacagctgtatcgttccaagtgctgggacacatgaagacgatcctggtgctgataatgggcttcttcttctttggtagagaaggtcttaacttgcacgtggttgttggaatgataattgcagtactgggtatgatctggtacggtaatgcctcttcgaagccaggaggcaaagagcgacgaaactattctcttccaactacccgtcaacagaaactcggagctgcttcggattctgacgacaacgaagacaaagcctagtagtaagtagtatattatcaggaacatcacatagttacgtctctgttttgagttgtttttttattagcttaatttatgattctcgtgctaaattttggtttggtacgaaagaaagcgaattttttcatacagacgtttgagatttttgtaatgcatttttgcggaatcaagttacatcaacgc

SEQ ID NO: 446 - protein, 1400 aa, Arabidopsis thaliana
  misc_feature: GI Number: 50933293; NR Description: putative transmembrane protein [Oryza sativa (japonica cultivar-group)] >gi|48843759|gb|AAT47018.1| putative transmembrane protein [Oryza
  misc_feature: GI Number: 30313364; NR Description: putative transmembrane
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
  misc_feature: GI Number: 21593003; NR Description: unknown [Arabidopsis thaliana]
  misc_feature: GI Number: 21595054; NR Description: unknown [Arabidopsis thaliana]
ACGCTTCCCAACCGCCTGCCTTTTTCAGATTACCTCCGGTTTCTACCACTCTCGCCGTCGCCGTCACCGGTACTCCGATCACCTCCGCACGATTCATTTCCTATTTGCATTTTTCACCTCTCTAGCGGAAAGTGAGTCTTCTGGAGAATGGGAGATTGAAGAAGTAAGAGATTCACTGATTGAGGAAGAGAGAAAGTTAGTTCAGAAAAATGGCTCCAGTGAGTAAAGCTGATAAGAAGGCAGCCGTAGATGCTGCTGCGTGGATGTTCAATGTCGTCACTTCTGTTGGTATCATCATTGTTAATAAAGCTTTAATGGCGACTTATGGTTATAGCTTTGCTACAACGTTAACCGGTTTACATTTCGCTACAACGACTCTGATGACGCTTGTTTTAAGATGTCTTGGTTACATTCAGCCTTCTCATCTTCCGTTTACGGAGCTTTTGAGATTTATTCTGTTTGCTAATTTCTCCATTGTTGGAATGAATGTCAGTCTTATGTGGAACTCTGTTGGTTTTTATCAGATTGCTAAGCTCAGCATGATTCCTGTATCTTGTTTGTTGGAAATGGTTTTCGATAAGATTCGTTATTCCAGAGATACAAAGCTTAGCATAGGACTGGTTCTTGTGGGTGTTGGTGTTTGCACTGTCACTGATGTTAGTGTAAACACTAAAAGATTTGTAGCCGCTTTCGTTGCTGTGTGGAGTACTGCTCTGCAACAATACTATGTACATTACCTTCAGCGCAAGTACTCGCTTAACTCATTCAACCTATTGGGACATACCGCTCCAGCCCAAGCCGCAACATTACTGGTAATTGGCCCGTTTCTTGATTATTGGCTGACAGAAAAAAGAGTAGACATGTACGATTACAACTTGGTTTCAGTGCTGTTTATAACCCTGTCGTGCACAATAGCGATTGGAACCAACCTAAGCCAGTTCATCTGCATCGGAAGATTCACAGCTGTATCGTTCCAAGTGCTGGGACACATGAAGACGATCCTGGTGCTGATAATGGGCTTCTTCTTCTTTGGTAGAGAAGGTCTTAACTTGCACGTGGTTGTTGGAATGATAATTGCAGTACTGGGTATGATCTGGTACGGTAATGCCTCTTCGAAGCCAGGAGGCAAAGAGCGACGAAACTATTCTCTTCCAACTACCCGTCAACAGAAACTCGGAGCTGCTTCGGATTCTGACGACAACGAAGACAAAGCCTAGTAGTAAGTAGTATATTATCAGGAACATCACATAGTTACGTCTCTGTTTTGAGTTGTTTTTTTATTAGCTTAATTTATGATTCTCGTGCTAAATTTTGGTTTGGTACGAAAGAAAGCGAATTTTTTCATACAGACGTTTGAGATTTTTGTAATGCATTTTTGCGGAATCAAGTTACATCAACGC

SEQ ID NO: 447 - DNA, 1403 bp, Arabidopsis thaliana
  misc_feature (1)..(1403): Ceres cDNA ID no. 12335179
  misc_feature (1)..(1403): Ceres CLONE  ID no. 21863
  misc_feature (1)..(1403): Also known as  Ceres CDNA ID no. 23369680
aaacctctctgtcattactctggtcagcgattcttctttcttcttcttctcagatcctttcaccgagtaagaagattttaaagatgccgtcaacgccgacgacgccgactacaacaacgccgatcacggcttcgtattggtgttacagctgtacgcgtttcgtcagcgtttgggctgatcaaggcacaacaaccgtcggtagcgtcgcttgccctcactgcgacggcggttttatcgaacagattaacgattcttcctccgccgctaccgaattaacgattccggcttctactgaagtaagatcgatcaataacaaccgtagatccgtgattagacgccggagatccggtcgtcgtccgtcctttaatccggtcatcgtacttcaaggaggcgccggcgagagagaagagggagaagaaggagatgcggctagagatcgacgcgcttttgagttttattacgatgacggatccggatcgggtcttagaccgcttccggattctgtatctgagatcttgatgggatctggattcgagcggttacttgaacagctaagccaaatcgaagcgtcggctactggaattggtagatctggaaaccctccggcgtctaaatcggcgattgagtctttacctagagtcgaaatctcggattgccacataggctcggaggctaattgcgctgtttgcacggagattttcgagacggagacggaggcgcgtgagatgccgtgtaaacaccttttccacgacgattgcatcgtaccgtggctatcgattcgaaactcttgtcccgtgtgcagattcgagctaccttcagagcctaatcgacggagcaacaacaacgaggaggataacgccgtggggatgacgatttggagacttcccggtggtggattcgccgtagggaggtttaacgcagcaatgagagacggagagagagttttgccagtggtgttaacagaaatggatggtggtgggattggtaatagccaggatggtcctagacggatctcatgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattgattcagaaatatatatatattattttttggtttgttcattcaacaatgtaaatataagattcagaagaaaaagattggtgcttcgttttctattacc

SEQ ID NO: 448 - protein, 1403 aa, Arabidopsis thaliana
  misc_feature: PFam Name: zf-C3HC4; PFam Description: Zinc finger, C3HC4
  misc_feature: GI Number: 17380612; NR Description: AT5g59550/f2o15_210 [Arabidopsis thaliana] >gi|15450687|gb|AAK96615.1| AT5g59550/f2o15_210 [Arabidopsis thaliana] >gi|18424254|ref|NP_568910.1| zinc finger (C3HC4-type RING
  misc_feature: GI Number: 50949043; NR Description: putative RING-H2 finger protein [Oryza sativa] >gi|14719329|gb|AAK73147.1| putative RING-H2
  misc_feature: GI Number: 52353630; NR Description: putative ring-H2 finger
  misc_feature: GI Number: 57899217; NR Description: RING-H2 finger
  misc_feature: GI Number: 34906008; NR Description: putative RING-H2 finger protein RHC2a [Oryza sativa (japonica cultivar-group)] >gi|15289983|dbj|BAB63678.1| putative RING-H2 finger protein RHC2a
AAACCTCTCTGTCATTACTCTGGTCAGCGATTCTTCTTTCTTCTTCTTCTCAGATCCTTTCACCGAGTAAGAAGATTTTAAAGATGCCGTCAACGCCGACGACGCCGACTACAACAACGCCGATCACGGCTTCGTATTGGTGTTACAGCTGTACGCGTTTCGTCAGCGTTTGGGCTGATCAAGGCACAACAACCGTCGGTAGCGTCGCTTGCCCTCACTGCGACGGCGGTTTTATCGAACAGATTAACGATTCTTCCTCCGCCGCTACCGAATTAACGATTCCGGCTTCTACTGAAGTAAGATCGATCAATAACAACCGTAGATCCGTGATTAGACGCCGGAGATCCGGTCGTCGTCCGTCCTTTAATCCGGTCATCGTACTTCAAGGAGGCGCCGGCGAGAGAGAAGAGGGAGAAGAAGGAGATGCGGCTAGAGATCGACGCGCTTTTGAGTTTTATTACGATGACGGATCCGGATCGGGTCTTAGACCGCTTCCGGATTCTGTATCTGAGATCTTGATGGGATCTGGATTCGAGCGGTTACTTGAACAGCTAAGCCAAATCGAAGCGTCGGCTACTGGAATTGGTAGATCTGGAAACCCTCCGGCGTCTAAATCGGCGATTGAGTCTTTACCTAGAGTCGAAATCTCGGATTGCCACATAGGCTCGGAGGCTAATTGCGCTGTTTGCACGGAGATTTTCGAGACGGAGACGGAGGCGCGTGAGATGCCGTGTAAACACCTTTTCCACGACGATTGCATCGTACCGTGGCTATCGATTCGAAACTCTTGTCCCGTGTGCAGATTCGAGCTACCTTCAGAGCCTAATCGACGGAGCAACAACAACGAGGAGGATAACGCCGTGGGGATGACGATTTGGAGACTTCCCGGTGGTGGATTCGCCGTAGGGAGGTTTAACGCAGCAATGAGAGACGGAGAGAGAGTTTTGCCAGTGGTGTTAACAGAAATGGATGGTGGTGGGATTGGTAATAGCCAGGATGGTCCTAGACGGATCTCATGGGTTAGGTCACACGGTACACTCGAATCGGATAGTAACGGTACTGGCTCAGGTTCCGGCTCCGGTGGAAGATTGAGGAGGATGGTTCGTGGAATGGTGTCGTTAATGAGGAGAGTGAGACCAAACCGTAGCTCTTCTTCTTCATCAGCTGCGATATCAACTTCTTCTGATAATCTGGATTTGAACATTGAAGTAGAATCTAGGGTTTTGGATAGGTCAAATTCAGTGATGAGAAGATACTTCAGAAGAAACAGAAGTAACAGGGATTCTTCGTCTTCAGTTCTTCATTGATTCAGAAATATATATATATTATTTTTTGGTTTGTTCATTCAACAATGTAAATATAAGATTCAGAAGAAAAAGATTGGTGCTTCGTTTTCTATTACC

SEQ ID NO: 449 - DNA, 1325 bp, Arabidopsis thaliana
  misc_feature (1)..(1325): Ceres cDNA ID no. 12335232
  misc_feature (1)..(1325): Ceres CLONE  ID no. 36486
  misc_feature (1)..(1325): Also known as  Ceres CDNA ID no. 23369733
ataagactcctctccaaatgctaccacacaattcctctatcacagccgcccaatcctccatccaaaaatggcttatttccggcgagcagccaccgcattggttctcattttccagctccacctctttctctccctctcaaatgcacataacataacccgtcgataactcagcaatgtcctccatcctctctaacggatactcactctaccaaatccgcaacattctctctctccacgtcctggtcgattacttcggcaccaagaaacttcaccagatcaccgacggctccacctccactgcctccatgtttcaatccaccggatccgccaccggaacttctggatacatcaacatcaccgatataaaaggcggtaaagtcgcttttggtgtccaagacgacgatagcaagctcacagctcactacgtcaaatccgtctttgaaaagccttacaacatctctgttcttcacatcagccaagtcttaacctcgccggaagcagaagctcccacggcgagtcccagcgacctcatcctcaccacaatcctcgaaaaacaagggtgcaaagctttctccgacatcttgaagtcaaccggcgccgacaaaacgttccaagataccgtagacggaggcttaacggtgttctgtccctccgacagcgctgtcggtaagttcatgccgaaattcaaatccctttctccggcgaacaagactgcgttagtgctttaccacggcatgccggtttaccagtcgttacaaatgcttagatcaggtaacggcgccgttaacacgttagcgacggaaggtaacaacaagtttgatttcaccgttcaaaataacggagaagacgtgacgctggagacggacgttgtgacggcgaaggtaatggggacgttaaaggatcaagagcctttgatagtttacaagattgataaagtgttgttgcctagagaaatctataaggccgttaagacgtccgctccagctcctaagtcgagtaagaaaaagcctaagaacgcggaggctgacgccgacggacctagcgccgatgctccgtcagatgatgatggtgaggtggctgacgataaaaacggcgccgtatcagcgatgattactcgaacaagtagtgtcgtaacggccattgtcgggctctgtttcggagtttggcttatgtgaagtgacgtggcatttacctcgctttgggaatcttgtttttctttttttctttgtgatctgtcggtttaatttattttacatattcttttttttgttcacgttgatacttggtgtggagatttggaataattaattgttccacttgtgttg

SEQ ID NO: 450 - protein, 1325 aa, Arabidopsis thaliana
  misc_feature: PFam Name: Fasciclin; PFam Description: Fasciclin domain
  misc_feature: GI Number: 22655474; NR Description: At4g12730/T20K18_80 [Arabidopsis thaliana] >gi|4586249|emb|CAB40990.1| putative pollen surface protein [Arabidopsis thaliana] >gi|7267974|emb|CAB78315.1| putative pollen surface protein
  misc_feature: GI Number: 13377778; NR Description: fasciclin-like
  misc_feature: GI Number: 21593810; NR Description: putative pollen surface
  misc_feature: GI Number: 21595125; NR Description: endosperm-specific
  misc_feature: GI Number: 14190409; NR Description: AT3g60900/T4C21_310
ATAAGACTCCTCTCCAAATGCTACCACACAATTCCTCTATCACAGCCGCCCAATCCTCCATCCAAAAATGGCTTATTTCCGGCGAGCAGCCACCGCATTGGTTCTCATTTTCCAGCTCCACCTCTTTCTCTCCCTCTCAAATGCACATAACATAACCCGTCGATAACTCAGCAATGTCCTCCATCCTCTCTAACGGATACTCACTCTACCAAATCCGCAACATTCTCTCTCTCCACGTCCTGGTCGATTACTTCGGCACCAAGAAACTTCACCAGATCACCGACGGCTCCACCTCCACTGCCTCCATGTTTCAATCCACCGGATCCGCCACCGGAACTTCTGGATACATCAACATCACCGATATAAAAGGCGGTAAAGTCGCTTTTGGTGTCCAAGACGACGATAGCAAGCTCACAGCTCACTACGTCAAATCCGTCTTTGAAAAGCCTTACAACATCTCTGTTCTTCACATCAGCCAAGTCTTAACCTCGCCGGAAGCAGAAGCTCCCACGGCGAGTCCCAGCGACCTCATCCTCACCACAATCCTCGAAAAACAAGGGTGCAAAGCTTTCTCCGACATCTTGAAGTCAACCGGCGCCGACAAAACGTTCCAAGATACCGTAGACGGAGGCTTAACGGTGTTCTGTCCCTCCGACAGCGCTGTCGGTAAGTTCATGCCGAAATTCAAATCCCTTTCTCCGGCGAACAAGACTGCGTTAGTGCTTTACCACGGCATGCCGGTTTACCAGTCGTTACAAATGCTTAGATCAGGTAACGGCGCCGTTAACACGTTAGCGACGGAAGGTAACAACAAGTTTGATTTCACCGTTCAAAATAACGGAGAAGACGTGACGCTGGAGACGGACGTTGTGACGGCGAAGGTAATGGGGACGTTAAAGGATCAAGAGCCTTTGATAGTTTACAAGATTGATAAAGTGTTGTTGCCTAGAGAAATCTATAAGGCCGTTAAGACGTCCGCTCCAGCTCCTAAGTCGAGTAAGAAAAAGCCTAAGAACGCGGAGGCTGACGCCGACGGACCTAGCGCCGATGCTCCGTCAGATGATGATGGTGAGGTGGCTGACGATAAAAACGGCGCCGTATCAGCGATGATTACTCGAACAAGTAGTGTCGTAACGGCCATTGTCGGGCTCTGTTTCGGAGTTTGGCTTATGTGAAGTGACGTGGCATTTACCTCGCTTTGGGAATCTTGTTTTTCTTTTTTTCTTTGTGATCTGTCGGTTTAATTTATTTTACATATTCTTTTTTTTGTTCACGTTGATACTTGGTGTGGAGATTTGGAATAATTAATTGTTCCACTTGTGTTG

SEQ ID NO: 451 - DNA, 1075 bp, Arabidopsis thaliana
  misc_feature (1)..(1075): Ceres cDNA ID no. 12335495
  misc_feature (1)..(1075): Ceres CLONE  ID no. 20941
  misc_feature (1)..(1075): Also known as  Ceres CDNA ID no. 23369975
aaaggaaaaggcaatgcaagaagattttgatatcgaaaactctgatatgttgtcttcaagaaatgggcctttattcaacctgtctagttcccccaaattccaagctacctcatcccctggacctagagagaaagagatcgtggagcttttcagaaaggttcaagctcagctccgagctcgtgctgcagcaaagaaagaagaaaaaaagattgaagaagcttctaaagggcagggaaaagaaagtgaaactgttgactctcttcttaagttactaaggaagcactcgggagagcaaagcaagaggcaagttagcaaatttagcagccagggagaagtacaaggagatactgttgacaaacaagatcgcaccggaaatcttgtcacttcagggaacaaagataataatgcatcatcctttaccagaccaacatcaagcttcagaagaaagtcgccagtaccaagatctcaatcaccgccagcttattctagcgaggcaacttttgatcaatcatcaagttacagtgtaacctggacccagaagaaggatacagtagagttgcatgatgagcctgaacatgagcctgcgtatgagcatgagcatgagcctgaaaatgagtcagaacctgggcctgtgacaactatgcttgaaccagattcagagctgaaaccaaagtcatcatcattttatcaagaggaggaggatgatgatgttacttttgatgtgttatcacaggatgatggtattttagatgtgttatcagatgatgatgagtctctcgatgatgctgatgaagatagtgatgaagctgaggaagaagccgtgaaagacttgagtgaattgaagctggtcgaacttagaggcatagcaaagtcacggggactaaaagggttgtcaaagatgaagaaagccgaattagtggagttgcttggtagtgattccagctgaaccttgctctagtatgcaccagttaaaatgagttactttctctgtattttgtttgtttggaaaatgctggctttgatgttcttgatttactaggattaccttcttctcttttaagttattattattacc

SEQ ID NO: 452 - protein, 1075 aa, Arabidopsis thaliana
  misc_feature: PFam Name: Rho_N; PFam Description: Rho termination factor,
  misc_feature: GI Number: 21536878; NR Description: unknown [Arabidopsis thaliana]
  misc_feature: GI Number: 21727822; NR Description: SAP-like protein [Oryza sativa] >gi|21727820|emb|CAC86222.1| SAP-like protein [Oryza
  misc_feature: GI Number: 50920397; NR Description: Putative plasma membrane proton ATPase [Oryza sativa] >gi|15217290|gb|AAK92634.1| Putative
AAAGGAAAAGGCAATGCAAGAAGATTTTGATATCGAAAACTCTGATATGTTGTCTTCAAGAAATGGGCCTTTATTCAACCTGTCTAGTTCCCCCAAATTCCAAGCTACCTCATCCCCTGGACCTAGAGAGAAAGAGATCGTGGAGCTTTTCAGAAAGGTTCAAGCTCAGCTCCGAGCTCGTGCTGCAGCAAAGAAAGAAGAAAAAAAGATTGAAGAAGCTTCTAAAGGGCAGGGAAAAGAAAGTGAAACTGTTGACTCTCTTCTTAAGTTACTAAGGAAGCACTCGGGAGAGCAAAGCAAGAGGCAAGTTAGCAAATTTAGCAGCCAGGGAGAAGTACAAGGAGATACTGTTGACAAACAAGATCGCACCGGAAATCTTGTCACTTCAGGGAACAAAGATAATAATGCATCATCCTTTACCAGACCAACATCAAGCTTCAGAAGAAAGTCGCCAGTACCAAGATCTCAATCACCGCCAGCTTATTCTAGCGAGGCAACTTTTGATCAATCATCAAGTTACAGTGTAACCTGGACCCAGAAGAAGGATACAGTAGAGTTGCATGATGAGCCTGAACATGAGCCTGCGTATGAGCATGAGCATGAGCCTGAAAATGAGTCAGAACCTGGGCCTGTGACAACTATGCTTGAACCAGATTCAGAGCTGAAACCAAAGTCATCATCATTTTATCAAGAGGAGGAGGATGATGATGTTACTTTTGATGTGTTATCACAGGATGATGGTATTTTAGATGTGTTATCAGATGATGATGAGTCTCTCGATGATGCTGATGAAGATAGTGATGAAGCTGAGGAAGAAGCCGTGAAAGACTTGAGTGAATTGAAGCTGGTCGAACTTAGAGGCATAGCAAAGTCACGGGGACTAAAAGGGTTGTCAAAGATGAAGAAAGCCGAATTAGTGGAGTTGCTTGGTAGTGATTCCAGCTGAACCTTGCTCTAGTATGCACCAGTTAAAATGAGTTACTTTCTCTGTATTTTGTTTGTTTGGAAAATGCTGGCTTTGATGTTCTTGATTTACTAGGATTACCTTCTTCTCTTTTAAGTTATTATTATTACC

SEQ ID NO: 453 - DNA, 1325 bp, Arabidopsis thaliana
  misc_feature (1)..(1325): Ceres cDNA ID no. 12335697
  misc_feature (1)..(1325): Ceres CLONE  ID no. 37034
  misc_feature (1)..(1325): Also known as  Ceres CDNA ID no. 23370149
atcaaatttgtgtgatcttctccagaagaaacttgaggaactttaagctaaacctctgtagttttcagattgattcgttggtggaaagcgtctaaattttgcgtaaatggcggcagctcttgtacgcagattctgccggggatcatcttttccggtctctggtcatggatataggatgctatcgacggttgaaaatgtatctgaaagtggtaaatcgatgaatctatactctgctattaatcaagctcttcacatcgctttagagaccgatcctcggtcttatgtttttggggaagatgttggatttggtggtgtcttccgatgtacaacaggattagctgaacgttttgggaaatctcgagttttcaacactcctctctgcgagcaaggcattgttggctttggcattggtttagctgcaatgggaaatcgagttattgcggaaattcagtttgcggattatattttcccggcttttgatcagattgttaatgaggctgcaaagttcagataccgaagtggaaaccagtttaactgtggaggactcactattagggcaccgtacggagcagttggtcacggtggacattaccactcgcagtcccctgaagctttcttttgtcatgtccctggtatcaaagttgttattcctcgaagtccacgggaagctaagggattattattgtcatccatccgtgatccgaatcccgttgtctttttcgaaccaaagtggctatatcgtcaagcggtagaggatgtccctgaagatgactatatgatacctttatctgaggcagaggttatgcgagaaggttccgacataactcttgttggatggggagcacagctcactatcatggaacaagcatgtcttgacgcagaaaacgaaggaatatcgtgtgaattgatagatctcaagactctgatcccttgggataaggaaatcgttgagacctcagtgagaaagactggcagacttcttattagccatgaagctcctgttacaggaggctttggggccgagatcgctgcaactatagttgagcgttgcttcttgaggttagaagcacctgtaagcagagtttgtggcctggacactcctttccctctagtgttcgaacctttctacatgccaaccaagaacaagatattggatgcaatcagatccactgtgaattactagcccatcttagcattgtacacatgattctctgtctcctatcttcgaaataattattgatgctggtggttcagacatgtaatggatactgtaatcaccacttttgttatttaatctatgatcttgaaactctccatctttgttc

SEQ ID NO: 454 - protein, 1325 aa, Arabidopsis thaliana
  misc_feature: PFam Name: Transket_pyr; PFam Description: Transketolase,
  misc_feature: PFam Name: Transketolase_C; PFam Description: Transketolase,
  misc_feature: GI Number: 9280297; NR Description: branched chain alpha-keto acid dehydrogenase E1 beta subunit [Arabidopsis thaliana] >gi|7021286|gb|AAF35281.1| branched chain alpha-keto acid dehydrogenase E1 beta subunit [Arabidopsis thaliana]
  misc_feature: GI Number: 3746568; NR Description: branched-chain alpha-keto acid decarboxylase E1 beta subunit [Arabidopsis thaliana] >gi|11252215|pir||T51835 3-methyl-2-oxobutanoate dehydrogenase (lipoamide) (EC 1.2.4.4) beta chain [imported] - Arabidopsis
  misc_feature: GI Number: 4204270; NR Description: branched-chain alpha-keto acid decarboxylase E1 beta subunit [Arabidopsis thaliana] >gi|15222731|ref|NP_175947.1| 2-oxoisovalerate dehydrogenase, putative / 3-methyl-2-oxobutanoate dehydrogenase, putative /
  misc_feature: GI Number: 60475528; NR Description: 3-methyl-2-oxobutanoate
  misc_feature: GI Number: 45382817; NR Description: mitochondrial branched-chain alpha-keto acid dehydrogenase E1-beta subunit [Gallus gallus] >gi|12964600|dbj|BAB32666.1| branched-chain
ATCAAATTTGTGTGATCTTCTCCAGAAGAAACTTGAGGAACTTTAAGCTAAACCTCTGTAGTTTTCAGATTGATTCGTTGGTGGAAAGCGTCTAAATTTTGCGTAAATGGCGGCAGCTCTTGTACGCAGATTCTGCCGGGGATCATCTTTTCCGGTCTCTGGTCATGGATATAGGATGCTATCGACGGTTGAAAATGTATCTGAAAGTGGTAAATCGATGAATCTATACTCTGCTATTAATCAAGCTCTTCACATCGCTTTAGAGACCGATCCTCGGTCTTATGTTTTTGGGGAAGATGTTGGATTTGGTGGTGTCTTCCGATGTACAACAGGATTAGCTGAACGTTTTGGGAAATCTCGAGTTTTCAACACTCCTCTCTGCGAGCAAGGCATTGTTGGCTTTGGCATTGGTTTAGCTGCAATGGGAAATCGAGTTATTGCGGAAATTCAGTTTGCGGATTATATTTTCCCGGCTTTTGATCAGATTGTTAATGAGGCTGCAAAGTTCAGATACCGAAGTGGAAACCAGTTTAACTGTGGAGGACTCACTATTAGGGCACCGTACGGAGCAGTTGGTCACGGTGGACATTACCACTCGCAGTCCCCTGAAGCTTTCTTTTGTCATGTCCCTGGTATCAAAGTTGTTATTCCTCGAAGTCCACGGGAAGCTAAGGGATTATTATTGTCATCCATCCGTGATCCGAATCCCGTTGTCTTTTTCGAACCAAAGTGGCTATATCGTCAAGCGGTAGAGGATGTCCCTGAAGATGACTATATGATACCTTTATCTGAGGCAGAGGTTATGCGAGAAGGTTCCGACATAACTCTTGTTGGATGGGGAGCACAGCTCACTATCATGGAACAAGCATGTCTTGACGCAGAAAACGAAGGAATATCGTGTGAATTGATAGATCTCAAGACTCTGATCCCTTGGGATAAGGAAATCGTTGAGACCTCAGTGAGAAAGACTGGCAGACTTCTTATTAGCCATGAAGCTCCTGTTACAGGAGGCTTTGGGGCCGAGATCGCTGCAACTATAGTTGAGCGTTGCTTCTTGAGGTTAGAAGCACCTGTAAGCAGAGTTTGTGGCCTGGACACTCCTTTCCCTCTAGTGTTCGAACCTTTCTACATGCCAACCAAGAACAAGATATTGGATGCAATCAGATCCACTGTGAATTACTAGCCCATCTTAGCATTGTACACATGATTCTCTGTCTCCTATCTTCGAAATAATTATTGATGCTGGTGGTTCAGACATGTAATGGATACTGTAATCACCACTTTTGTTATTTAATCTATGATCTTGAAACTCTCCATCTTTGTTC

SEQ ID NO: 455 - DNA, 1119 bp, Arabidopsis thaliana
  misc_feature (1)..(1119): Ceres cDNA ID no. 12335788
  misc_feature (1)..(1119): Ceres CLONE  ID no. 39757
  misc_feature (1)..(1119): Also known as  Ceres CDNA ID no. 24374773
attattcccctaacgaatttcaaatcaaaatctctctctttctcttatctctaatggcgttgaggaacattgaaaacgctcttccgatctcacaggaacgacctaagaagctggccaaactctcaaagcaaccggagattggtctaaatgacgaaaacaaccctgtcgctgtggctgaatcgaccgtcgaatacgttgcttctgagaatctcaaaccattttcagatcctgaatcttctgtccagagattacttgaagaattagcatcaaaggattggattaaagtatgtgaatcattgaacaacacaaggagatttgcaattcatcactcttctctgttgctaccaattctagaaaagcttatagttgtgatggtgaaggcgatgaagaatcctagaagtgcattgtgcaagacttcgattatgacttgttctgatatcttcactgcttatggagaaaagttgctggaaggacctcatttgaaatctatggacgatctgctgttgcagttgctgatgaaagcttcacaagacaagaagtttgtgtgtgaagaagcagagaaagcgctgaacacgatggttaactcggtggctcgcttgccgcttctgcgtaagcttcagagttatgtccgtcacagtaaccctcgtgtcagggccaaagctgctgtgtctacttccaactgcgtttctaaaatggaggtaaatgaaatggaagaatttgggatggttctgctcgcacaaatggctgcggatcagttgagtgacaagttgccagaggcaagggaagctgcaaggagtatggtgaactcgcttttcgagaaatttacatggaatgaagaagaagacgaagaaggaagcaagcaagaagcttggaagaagttttgtgagaagaatgtaacagggctcaatgcacaagccatgatcaagattgttgcatctcaataaatttctgaagatgaaatgttgttctctctgattcatgtaaaatacgtttttacatgataaaaacaatcttttttttatttctactggatctgtcctctcaattccaatgttactaccataatacgccagaggctcagtggttctttaagcttcatgaaaaattgttgttgtggct

SEQ ID NO: 456 - protein, 1119 aa, Arabidopsis thaliana
  misc_feature: PFam Name: HEAT; PFam Description: HEAT repeat
  misc_feature: GI Number: 21593517; NR Description: unknown [Arabidopsis thaliana]
  misc_feature: GI Number: 51979208; NR Description: PREDICTED P0543C11.17-3 gene product [Oryza sativa (japonica cultivar-group)] >gi|51979206|ref|XP_507469.1| PREDICTED P0543C11.17-3 gene product [Oryza sativa (japonica cultivar-group)] [Oryza sativa
  misc_feature: GI Number: 51979707; NR Description: PREDICTED P0702C09.23 gene product [Oryza sativa (japonica cultivar-group)] >gi|51979705|ref|XP_507599.1| PREDICTED P0702C09.23 gene product [Oryza sativa (japonica cultivar-group)] [Oryza sativa (japonica
  misc_feature: GI Number: 21537265; NR Description: unknown [Arabidopsis thaliana]
  misc_feature: GI Number: 34865276; NR Description: similar to KIAA0423
ATTATTCCCCTAACGAATTTCAAATCAAAATCTCTCTCTTTCTCTTATCTCTAATGGCGTTGAGGAACATTGAAAACGCTCTTCCGATCTCACAGGAACGACCTAAGAAGCTGGCCAAACTCTCAAAGCAACCGGAGATTGGTCTAAATGACGAAAACAACCCTGTCGCTGTGGCTGAATCGACCGTCGAATACGTTGCTTCTGAGAATCTCAAACCATTTTCAGATCCTGAATCTTCTGTCCAGAGATTACTTGAAGAATTAGCATCAAAGGATTGGATTAAAGTATGTGAATCATTGAACAACACAAGGAGATTTGCAATTCATCACTCTTCTCTGTTGCTACCAATTCTAGAAAAGCTTATAGTTGTGATGGTGAAGGCGATGAAGAATCCTAGAAGTGCATTGTGCAAGACTTCGATTATGACTTGTTCTGATATCTTCACTGCTTATGGAGAAAAGTTGCTGGAAGGACCTCATTTGAAATCTATGGACGATCTGCTGTTGCAGTTGCTGATGAAAGCTTCACAAGACAAGAAGTTTGTGTGTGAAGAAGCAGAGAAAGCGCTGAACACGATGGTTAACTCGGTGGCTCGCTTGCCGCTTCTGCGTAAGCTTCAGAGTTATGTCCGTCACAGTAACCCTCGTGTCAGGGCCAAAGCTGCTGTGTCTACTTCCAACTGCGTTTCTAAAATGGAGGTAAATGAAATGGAAGAATTTGGGATGGTTCTGCTCGCACAAATGGCTGCGGATCAGTTGAGTGACAAGTTGCCAGAGGCAAGGGAAGCTGCAAGGAGTATGGTGAACTCGCTTTTCGAGAAATTTACATGGAATGAAGAAGAAGACGAAGAAGGAAGCAAGCAAGAAGCTTGGAAGAAGTTTTGTGAGAAGAATGTAACAGGGCTCAATGCACAAGCCATGATCAAGATTGTTGCATCTCAATAAATTTCTGAAGATGAAATGTTGTTCTCTCTGATTCATGTAAAATACGTTTTTACATGATAAAAACAATCTTTTTTTTATTTCTACTGGATCTGTCCTCTCAATTCCAATGTTACTACCATAATACGCCAGAGGCTCAGTGGTTCTTTAAGCTTCATGAAAAATTGTTGTTGTGGCT

SEQ ID NO: 457 - DNA, 1248 bp, Arabidopsis thaliana
  misc_feature (1)..(1248): Ceres cDNA ID no. 12335840
  misc_feature (1)..(1248): Ceres CLONE  ID no. 7883
  misc_feature (1)..(1248): Also known as  Ceres CDNA ID no. 23370280
aacgccatttgttgtcactcactctgtaaagtataaaccctaaaaatcgaatcttttaaccgattagccgatccctccaccggaaaatcggaagtagaagcgtaaatggcggatgttgaagatcgtgcggcgaaggggatctctgactacgatcaaggtggtgtaaagacgacggaactggaaaggaagattgaggatatggagaacaagaatcaggagctcacgagagagaatcgtgaattgaaggagaggttagagaggcttacgggagaaattgaagagatgaaagacgtagaagcggagatgaatcagagattcggagagatggagaaagagatcgaggagtacgaggaagagaagaaggctttggaagctatttctactagagctgtggagcttgaaactgaggtgtcgaatcttcatgacgatctgatcacttccttgaacggagtggataagacggcggaagaagtggcggagctgaagaaagcgttggcggagatagtggagaagctggaggggtgtgagaaggaagctgagggtttaaggaaagatagagctgaggttgagaagagggttagggatttggaaaggaagattggggttttggaagtgagggaaatggaggagaagagtaagaaacttagatcagaagaggaaatgagggagatagatgatgagaaaaagagagagattgaggaattgcagaagacagtcattgttttgaatctggaattggtgaagaatgtagaagaattgaagaaatggaagtctgagaagaagctcacggaggaagctttgagtgaaactcaaaaacgagagaaggagctggagttgaagaaggacgagttactgaagaaggttgaggaaggtaacaagacggtttttgctttgaatgagagaaccatgaagcctagtaatggagtaagagacacaaatggtggtgaccaaaagggttccttggaagctgagtatcagtggccagtggttgctgctggatcagttggagctgctggtttggttgcagcgacctttttcgtctgctattctaagctaaggtgattttgatgaatagttagtgaaagaataactgatgaccaagttcttaagattgatatctgggatggaattatataggttggctacaaatttgttttgggtttggatttgagtttgtgatgtttgttggttgttggctatcatacttttgttgatgagatcagcatttggtaactgttctttatcact

SEQ ID NO: 458 - protein, 1248 aa, Arabidopsis thaliana
  misc_feature: PFam Name: Plasmodium_HRP; PFam Description: Plasmodium
  misc_feature: PFam Name: Myosin_tail_1; PFam Description: Myosin tail
  misc_feature: PFam Name: HOOK; PFam Description: HOOK protein
  misc_feature: PFam Name: Surface_Ag_2; PFam Description: Surface antigen
  misc_feature: PFam Name: Tropomyosin; PFam Description: Tropomyosin
  misc_feature: GI Number: 21595387; NR Description: unknown [Arabidopsis thaliana]
  misc_feature: GI Number: 6692690; NR Description: F12K11.14 [Arabidopsis thaliana] >gi|15221511|ref|NP_172140.1| myosin heavy chain-related
  misc_feature: GI Number: 50261849; NR Description: AT1G06530 [Arabidopsis
  misc_feature: GI Number: 2129174; NR Description: P115 homolog -
  misc_feature: GI Number: 15669839; NR Description: chromosome segretation protein (smc1) [Methanocaldococcus jannaschii DSM 2661] >gi|18202582|sp|Q59037|SMC_METJA Chromosome partition protein smc
AACGCCATTTGTTGTCACTCACTCTGTAAAGTATAAACCCTAAAAATCGAATCTTTTAACCGATTAGCCGATCCCTCCACCGGAAAATCGGAAGTAGAAGCGTAAATGGCGGATGTTGAAGATCGTGCGGCGAAGGGGATCTCTGACTACGATCAAGGTGGTGTAAAGACGACGGAACTGGAAAGGAAGATTGAGGATATGGAGAACAAGAATCAGGAGCTCACGAGAGAGAATCGTGAATTGAAGGAGAGGTTAGAGAGGCTTACGGGAGAAATTGAAGAGATGAAAGACGTAGAAGCGGAGATGAATCAGAGATTCGGAGAGATGGAGAAAGAGATCGAGGAGTACGAGGAAGAGAAGAAGGCTTTGGAAGCTATTTCTACTAGAGCTGTGGAGCTTGAAACTGAGGTGTCGAATCTTCATGACGATCTGATCACTTCCTTGAACGGAGTGGATAAGACGGCGGAAGAAGTGGCGGAGCTGAAGAAAGCGTTGGCGGAGATAGTGGAGAAGCTGGAGGGGTGTGAGAAGGAAGCTGAGGGTTTAAGGAAAGATAGAGCTGAGGTTGAGAAGAGGGTTAGGGATTTGGAAAGGAAGATTGGGGTTTTGGAAGTGAGGGAAATGGAGGAGAAGAGTAAGAAACTTAGATCAGAAGAGGAAATGAGGGAGATAGATGATGAGAAAAAGAGAGAGATTGAGGAATTGCAGAAGACAGTCATTGTTTTGAATCTGGAATTGGTGAAGAATGTAGAAGAATTGAAGAAATGGAAGTCTGAGAAGAAGCTCACGGAGGAAGCTTTGAGTGAAACTCAAAAACGAGAGAAGGAGCTGGAGTTGAAGAAGGACGAGTTACTGAAGAAGGTTGAGGAAGGTAACAAGACGGTTTTTGCTTTGAATGAGAGAACCATGAAGCCTAGTAATGGAGTAAGAGACACAAATGGTGGTGACCAAAAGGGTTCCTTGGAAGCTGAGTATCAGTGGCCAGTGGTTGCTGCTGGATCAGTTGGAGCTGCTGGTTTGGTTGCAGCGACCTTTTTCGTCTGCTATTCTAAGCTAAGGTGATTTTGATGAATAGTTAGTGAAAGAATAACTGATGACCAAGTTCTTAAGATTGATATCTGGGATGGAATTATATAGGTTGGCTACAAATTTGTTTTGGGTTTGGATTTGAGTTTGTGATGTTTGTTGGTTGTTGGCTATCATACTTTTGTTGATGAGATCAGCATTTGGTAACTGTTCTTTATCACT

SEQ ID NO: 459 - DNA, 1479 bp, Arabidopsis thaliana
  misc_feature (1)..(1479): Ceres cDNA ID no. 12335872
  misc_feature (1)..(1479): Ceres CLONE  ID no. 7709
  misc_feature (1)..(1479): Also known as  Ceres CDNA ID no. 23370305
ccacttcctctgctccacactgacacttgaaaaaactcaaaaccgtctcatcatggcggcgtcacagacattctcactcctcgccttcactttctccctcctcgcctttgcttccaccgtgagtagccacaacatcactcaaatcctcgctgattctccagattactcttccttcaacagctacctttctcagacgaagctcgccgacgagatcaacagccgcacgacgattacagttctcgtccttaacaatggcgcaatgtctgctctcgccggaaaacatccactctccgttattaaaagcgctttaagcctcctcgtcctcctcgattactacgatccacaaaaactccacaagatctccaaaggcacaactctctccaccacactttaccaaaccaccggaaacgctcccggaaacctaggattcgtcaacatcaccgatcttaaaggaggcaaagtcggatttggctccgccgcttcaggttccaaactcgattcatcttacaccaaatccgttaaacaaatcccttacaacatctcaatcctcgagattgatgctccgatcatcgctcccggagttttaaccgctcctgctccttccgcctccttgtcaaacatcaccggattactcgaaaaagccggttgcaaaacctttgctaatttgcttgtctcaagtggagtactcaagacttacgaatccgccgttgaaaaaggcttgacggtttttgcaccgtccgatgaagcttttaaagctgaaggtgtaccagatctgacgaagctcacacaagctgaggtagtctcgctcttagagtatcacgccctcgctgagtataaacctaaaggctcattgaagactaacaagaacaatatctccacgttagccactaacggcgccggaaaattcgatctaacgacctctacctccggcgacgaagttattctccacaccggcgttgctccgtcgagactcgcggacactgtgctcgacgcgactccggttgtgatattcactgtggataatgtccttctccctgctgagctattcggaaaatctaaatctccatctccggcaccggcgcctgagccagttaccgcaccgacaccatctccagcggatgcaccttcacccaccgcagcttcaccaccggcacctccgacggacgagtcaccggaaagtgctccttcagactcgccaacaggttcagcgaacagtaagtcagctaacgcagcggttggcgtgagcacaccgtcgttgttcaccgcattggtcacgatcgccgccatagccgtctccgtgtctctctgctcttaaaacctttcgtaattacgcaggctgccactccctttgtttatttttaatttaattatcttttcaatttttatttttgtggttatgtgttgttgagtttgaaaacatgggattagtgagtgaggttttatttaaatcgtttgttaatcacattttcattattgctt

SEQ ID NO: 460 - protein, 1479 aa, Arabidopsis thaliana
  misc_feature: PFam Name: Fasciclin; PFam Description: Fasciclin domain
  misc_feature: PFam Name: Lipoprotein_5; PFam Description: Transferrin
  misc_feature: PFam Name: Trypan_PARP; PFam Description: Procyclic acidic
  misc_feature: GI Number: 14190409; NR Description: AT3g60900/T4C21_310
  misc_feature: GI Number: 21593224; NR Description: endosperm specific protein-like [Arabidopsis thaliana] >gi|7329700|emb|CAB82694.1| endosperm specific protein-like [Arabidopsis thaliana] >gi|38257776|sp|Q9LZX4|FA10_ARATH Fasciclin-like arabinogalactan
  misc_feature: GI Number: 21595125; NR Description: endosperm-specific
  misc_feature: GI Number: 10880493; NR Description: fasciclin-like
  misc_feature: GI Number: 34902266; NR Description: Putative endosperm specific protein [Oryza sativa (japonica cultivar-group)] >gi|20330756|gb|AAM19119.1| Putative endosperm specific protein
CCACTTCCTCTGCTCCACACTGACACTTGAAAAAACTCAAAACCGTCTCATCATGGCGGCGTCACAGACATTCTCACTCCTCGCCTTCACTTTCTCCCTCCTCGCCTTTGCTTCCACCGTGAGTAGCCACAACATCACTCAAATCCTCGCTGATTCTCCAGATTACTCTTCCTTCAACAGCTACCTTTCTCAGACGAAGCTCGCCGACGAGATCAACAGCCGCACGACGATTACAGTTCTCGTCCTTAACAATGGCGCAATGTCTGCTCTCGCCGGAAAACATCCACTCTCCGTTATTAAAAGCGCTTTAAGCCTCCTCGTCCTCCTCGATTACTACGATCCACAAAAACTCCACAAGATCTCCAAAGGCACAACTCTCTCCACCACACTTTACCAAACCACCGGAAACGCTCCCGGAAACCTAGGATTCGTCAACATCACCGATCTTAAAGGAGGCAAAGTCGGATTTGGCTCCGCCGCTTCAGGTTCCAAACTCGATTCATCTTACACCAAATCCGTTAAACAAATCCCTTACAACATCTCAATCCTCGAGATTGATGCTCCGATCATCGCTCCCGGAGTTTTAACCGCTCCTGCTCCTTCCGCCTCCTTGTCAAACATCACCGGATTACTCGAAAAAGCCGGTTGCAAAACCTTTGCTAATTTGCTTGTCTCAAGTGGAGTACTCAAGACTTACGAATCCGCCGTTGAAAAAGGCTTGACGGTTTTTGCACCGTCCGATGAAGCTTTTAAAGCTGAAGGTGTACCAGATCTGACGAAGCTCACACAAGCTGAGGTAGTCTCGCTCTTAGAGTATCACGCCCTCGCTGAGTATAAACCTAAAGGCTCATTGAAGACTAACAAGAACAATATCTCCACGTTAGCCACTAACGGCGCCGGAAAATTCGATCTAACGACCTCTACCTCCGGCGACGAAGTTATTCTCCACACCGGCGTTGCTCCGTCGAGACTCGCGGACACTGTGCTCGACGCGACTCCGGTTGTGATATTCACTGTGGATAATGTCCTTCTCCCTGCTGAGCTATTCGGAAAATCTAAATCTCCATCTCCGGCACCGGCGCCTGAGCCAGTTACCGCACCGACACCATCTCCAGCGGATGCACCTTCACCCACCGCAGCTTCACCACCGGCACCTCCGACGGACGAGTCACCGGAAAGTGCTCCTTCAGACTCGCCAACAGGTTCAGCGAACAGTAAGTCAGCTAACGCAGCGGTTGGCGTGAGCACACCGTCGTTGTTCACCGCATTGGTCACGATCGCCGCCATAGCCGTCTCCGTGTCTCTCTGCTCTTAAAACCTTTCGTAATTACGCAGGCTGCCACTCCCTTTGTTTATTTTTAATTTAATTATCTTTTCAATTTTTATTTTTGTGGTTATGTGTTGTTGAGTTTGAAAACATGGGATTAGTGAGTGAGGTTTTATTTAAATCGTTTGTTAATCACATTTTCATTATTGCTT

SEQ ID NO: 461 - DNA, 1408 bp, Arabidopsis thaliana
  misc_feature (1)..(1408): Ceres cDNA ID no. 12335876
  misc_feature (1)..(1408): Ceres CLONE  ID no. 2343
  misc_feature (1)..(1408): Also known as  Ceres CDNA ID no. 23370309
gttccctttttcattgtattcctcaaatctctttacttgatcgttggttctctcaaaaatcagatttttatttctgggttttgttcgattttgtgatcatggcggtcattgagagcgtcggagctaatactactgtggaagctggtggtttgatctcgccgtcgccgccgtcttccgtcaccagtcaagaatcaggagcttcttctaacaacgatcacggtggaaatggaatccatgatgagatcggagtccacgtggcgagatccgacggtggtgagagttttaagcgtgatatgagagagcttcacgagctcttgtctaagcttaatcctatggctaaagagtttattcctccttcacttactaagccagttgttaatggttttaacggcggtttcttcgccgttaataatggctttgttgctgccggaaatttccccgtcaacgaagacggtagctttcgtcggaagaagtcgttcggacaacaagggaaacggagaatgaatcctaggacaagtttggctcagcgtgaagagatcataagaagaactgtctatgtgtctgatattgaccaacaggtcactgaggagcagcttgctggtttgtttatcggctttggacaggttgttgactgtcgtatatgtggtgatcccaactcagtacttaggtttgctttcatcgagttcactgatgaagtgggtgcaaggactgctctgaatttgtctgggacgatgcttggattctatcctgtgaaggttatgccgtctaagacagctattgcaccggttaacccaaccttcttgccaaggactgaagatgagcgtgagatgtgtgcaagaactatctactgcactaacattgacaagaagctcactcaaaccgacattaaactcttctttgagtctgtgtgtggcgaggtgtaccgtctgaggctactgggcgattatcatcatccaactcgcatcggcttcgtggagtttgtcatggctgaaagcgcgatagcggctctcaactgcagtggtgtccttcttggttctttaccgataagggtgagtccatcaaagacaccggttcgttcccgtgctatcccgcgacatcaaatgcattaaccgtagctacaagttttatatatatttctgctcctcacagacatgtaaagaatgtttgtctgaaacttctggttcttctgttttcccgtatgtaatgctagaagcttgatgatgcttctgttgccttttgcttttgggtaaatctcttagggagagttttttcgatttgggttcctacgtttagtagtttacacagagcagaagagtaaaacactgagagaggcttttgaagattgtctctgttttttagttatttatactcttacccctgaagttattagaaacttgctttggtgctt

SEQ ID NO: 462 - protein, 1408 aa, Arabidopsis thaliana
  misc_feature: PFam Name: RRM_1; PFam Description: RNA recognition motif.
  misc_feature: GI Number: 1174153; NR Description: RNA-binding protein
  misc_feature: GI Number: 21592407; NR Description: RNA-binding protein [Arabidopsis thaliana] >gi|4539439|emb|CAB40027.1| RNA-binding protein [Arabidopsis thaliana] >gi|7267758|emb|CAB78184.1| RNA-binding protein [Arabidopsis thaliana]
  misc_feature: GI Number: 6714278; NR Description: F6N18.17 [Arabidopsis thaliana] gi|25403416|pir||F86452 protein F6N18.17 [imported] - Arabidopsis thaliana gi|15223304|ref|NP_174556.1| RNA-binding
  misc_feature: GI Number: 50940511; NR Description: putative RNA-binding protein RBP37 [Oryza sativa (japonica cultivar-group)] >gi|50725622|dbj|BAD33089.1| putative RNA-binding protein RBP37
  misc_feature: GI Number: 6723409; NR Description: RNA-binding-like protein [Arabidopsis thaliana] >gi|11358815|pir||T45844 RNA-binding-like protein - Arabidopsis thaliana >gi|12324442|gb|AAG52182.1| putative RNA-binding protein; 38450-35693 [Arabidopsis thaliana]
GTTCCCTTTTTCATTGTATTCCTCAAATCTCTTTACTTGATCGTTGGTTCTCTCAAAAATCAGATTTTTATTTCTGGGTTTTGTTCGATTTTGTGATCATGGCGGTCATTGAGAGCGTCGGAGCTAATACTACTGTGGAAGCTGGTGGTTTGATCTCGCCGTCGCCGCCGTCTTCCGTCACCAGTCAAGAATCAGGAGCTTCTTCTAACAACGATCACGGTGGAAATGGAATCCATGATGAGATCGGAGTCCACGTGGCGAGATCCGACGGTGGTGAGAGTTTTAAGCGTGATATGAGAGAGCTTCACGAGCTCTTGTCTAAGCTTAATCCTATGGCTAAAGAGTTTATTCCTCCTTCACTTACTAAGCCAGTTGTTAATGGTTTTAACGGCGGTTTCTTCGCCGTTAATAATGGCTTTGTTGCTGCCGGAAATTTCCCCGTCAACGAAGACGGTAGCTTTCGTCGGAAGAAGTCGTTCGGACAACAAGGGAAACGGAGAATGAATCCTAGGACAAGTTTGGCTCAGCGTGAAGAGATCATAAGAAGAACTGTCTATGTGTCTGATATTGACCAACAGGTCACTGAGGAGCAGCTTGCTGGTTTGTTTATCGGCTTTGGACAGGTTGTTGACTGTCGTATATGTGGTGATCCCAACTCAGTACTTAGGTTTGCTTTCATCGAGTTCACTGATGAAGTGGGTGCAAGGACTGCTCTGAATTTGTCTGGGACGATGCTTGGATTCTATCCTGTGAAGGTTATGCCGTCTAAGACAGCTATTGCACCGGTTAACCCAACCTTCTTGCCAAGGACTGAAGATGAGCGTGAGATGTGTGCAAGAACTATCTACTGCACTAACATTGACAAGAAGCTCACTCAAACCGACATTAAACTCTTCTTTGAGTCTGTGTGTGGCGAGGTGTACCGTCTGAGGCTACTGGGCGATTATCATCATCCAACTCGCATCGGCTTCGTGGAGTTTGTCATGGCTGAAAGCGCGATAGCGGCTCTCAACTGCAGTGGTGTCCTTCTTGGTTCTTTACCGATAAGGGTGAGTCCATCAAAGACACCGGTTCGTTCCCGTGCTATCCCGCGACATCAAATGCATTAACCGTAGCTACAAGTTTTATATATATTTCTGCTCCTCACAGACATGTAAAGAATGTTTGTCTGAAACTTCTGGTTCTTCTGTTTTCCCGTATGTAATGCTAGAAGCTTGATGATGCTTCTGTTGCCTTTTGCTTTTGGGTAAATCTCTTAGGGAGAGTTTTTTCGATTTGGGTTCCTACGTTTAGTAGTTTACACAGAGCAGAAGAGTAAAACACTGAGAGAGGCTTTTGAAGATTGTCTCTGTTTTTTAGTTATTTATACTCTTACCCCTGAAGTTATTAGAAACTTGCTTTGGTGCTT

SEQ ID NO: 463 - DNA, 1407 bp, Arabidopsis thaliana
  misc_feature (1)..(1407): Ceres cDNA ID no. 12336104
  misc_feature (1)..(1407): Ceres CLONE  ID no. 40998
  misc_feature (1)..(1407): Also known as  Ceres CDNA ID no. 23370511
atgctgattcctctccttttcttcctcaactcataaacccgatcggccgattccttcacaattatccttaaaattttcgattttgattattgggtttctctctgatcatggcggttgttgagactggagcagcagctactgctgctgatgcaggaggagtcgtgatccagccgccgccgtcttcaccaccatcttcaatgactagtcaagattccggcgtttcttccgatgatcagaaccatcactctaggatcgatcaagttctccggcacgatcaaggtctttacagcaagatcgggtcacacgtggcgagatccgacggcgttgacggtggtgagagctttaagcgtgatatgagagagcttcaggagcttttctctaagcttaatcctatggctgaagagttgttcctccttctctgaataaacaaggaggtaacggtgttaacggtggtttcttcacctctgctggttccttcttccgcaacaatggctttgctggtaccggaaatggcggatacggtaacgaaaacggtggtttccgacggaagaagagttttggtcaagggaaacgaaggatgaatgctcgaacaagcatggctcagcgagaagatgttatccgtagaaccgtctacgtctctgatctcgatcaacaggtcactgaagagcagcttgctggtttgtttgtgagctgtggacaggttgttgactgtcgcatatgcggtgacccaaactcggtccttcggtttgcattcatagagttcactgatgaagagggtgcgatgactgctctaaatttatcggggactatgttgggattctatcctgtgaaagttttaccatccaaaacagctatagcaccggttaacccgacatttttgcctaggactgaagatgagagtgagatgtgtgcaagaactatctactgtactaacatagacaagaaggtgactcaatcagacgtgaagatcttttttgagtacttctgcggagaggtttatcgcctgaggctgcttggagattatcaacactcgactcgtattgcttttgtagagttcgtaatggcggaaagcgcaatagctgctctcaactgcagtggagttgttcttggttctttacctataagggtgagtccttcaaagacgcctgttcgtccgagatcaccgaggcatccaatgcattgatcttagctttacaggttttcacatatctcatgtctccgcaatatatatatcgctgtgtcgtcttaaaaacagcattacacagacatgtaaagatgtttgtctgcatctctcatctcttgttttcgaaatgtaactctgggatctgatgatgcttctttcttcttcctttacctgagaatcttttgggtaaaaaaaacctcgtagagagtttttatttatctctt

SEQ ID NO: 464 - protein, 1407 aa, Arabidopsis thaliana
  misc_feature: PFam Name: RRM_1; PFam Description: RNA recognition motif.
  misc_feature: GI Number: 6714278; NR Description: F6N18.17 [Arabidopsis thaliana] gi|25403416|pir||F86452 protein F6N18.17 [imported] - Arabidopsis thaliana gi|15223304|ref|NP_174556.1| RNA-binding
  misc_feature: GI Number: 21592407; NR Description: RNA-binding protein [Arabidopsis thaliana] >gi|4539439|emb|CAB40027.1| RNA-binding protein [Arabidopsis thaliana] >gi|7267758|emb|CAB78184.1| RNA-binding protein [Arabidopsis thaliana]
  misc_feature: GI Number: 1174153; NR Description: RNA-binding protein
  misc_feature: GI Number: 50940511; NR Description: putative RNA-binding protein RBP37 [Oryza sativa (japonica cultivar-group)] >gi|50725622|dbj|BAD33089.1| putative RNA-binding protein RBP37
  misc_feature: GI Number: 14030687; NR Description: At1g32790 [Arabidopsis thaliana] >gi|25090128|gb|AAN72236.1| At1g32790/F6N18_9
ATGCTGATTCCTCTCCTTTTCTTCCTCAACTCATAAACCCGATCGGCCGATTCCTTCACAATTATCCTTAAAATTTTCGATTTTGATTATTGGGTTTCTCTCTGATCATGGCGGTTGTTGAGACTGGAGCAGCAGCTACTGCTGCTGATGCAGGAGGAGTCGTGATCCAGCCGCCGCCGTCTTCACCACCATCTTCAATGACTAGTCAAGATTCCGGCGTTTCTTCCGATGATCAGAACCATCACTCTAGGATCGATCAAGTTCTCCGGCACGATCAAGGTCTTTACAGCAAGATCGGGTCACACGTGGCGAGATCCGACGGCGTTGACGGTGGTGAGAGCTTTAAGCGTGATATGAGAGAGCTTCAGGAGCTTTTCTCTAAGCTTAATCCTATGGCTGAAGAGTTGTTCCTCCTTCTCTGAATAAACAAGGAGGTAACGGTGTTAACGGTGGTTTCTTCACCTCTGCTGGTTCCTTCTTCCGCAACAATGGCTTTGCTGGTACCGGAAATGGCGGATACGGTAACGAAAACGGTGGTTTCCGACGGAAGAAGAGTTTTGGTCAAGGGAAACGAAGGATGAATGCTCGAACAAGCATGGCTCAGCGAGAAGATGTTATCCGTAGAACCGTCTACGTCTCTGATCTCGATCAACAGGTCACTGAAGAGCAGCTTGCTGGTTTGTTTGTGAGCTGTGGACAGGTTGTTGACTGTCGCATATGCGGTGACCCAAACTCGGTCCTTCGGTTTGCATTCATAGAGTTCACTGATGAAGAGGGTGCGATGACTGCTCTAAATTTATCGGGGACTATGTTGGGATTCTATCCTGTGAAAGTTTTACCATCCAAAACAGCTATAGCACCGGTTAACCCGACATTTTTGCCTAGGACTGAAGATGAGAGTGAGATGTGTGCAAGAACTATCTACTGTACTAACATAGACAAGAAGGTGACTCAATCAGACGTGAAGATCTTTTTTGAGTACTTCTGCGGAGAGGTTTATCGCCTGAGGCTGCTTGGAGATTATCAACACTCGACTCGTATTGCTTTTGTAGAGTTCGTAATGGCGGAAAGCGCAATAGCTGCTCTCAACTGCAGTGGAGTTGTTCTTGGTTCTTTACCTATAAGGGTGAGTCCTTCAAAGACGCCTGTTCGTCCGAGATCACCGAGGCATCCAATGCATTGATCTTAGCTTTACAGGTTTTCACATATCTCATGTCTCCGCAATATATATATCGCTGTGTCGTCTTAAAAACAGCATTACACAGACATGTAAAGATGTTTGTCTGCATCTCTCATCTCTTGTTTTCGAAATGTAACTCTGGGATCTGATGATGCTTCTTTCTTCTTCCTTTACCTGAGAATCTTTTGGGTAAAAAAAACCTCGTAGAGAGTTTTTATTTATCTCTT

SEQ ID NO: 465 - DNA, 1396 bp, Arabidopsis thaliana
  misc_feature (1)..(1396): Ceres cDNA ID no. 12336234
  misc_feature (1)..(1396): Ceres CLONE  ID no. 120122
  misc_feature (1)..(1396): Also known as  Ceres CDNA ID no. 23370633
attattatttccagagaagcttctcttttgattctctcgctctctctttcttcatcgcctcttcgagcttcgatggttgggaatattctggtgaccggtggtgctggttacatcggaagtcacacggttcttcagcttcttctcggaggctataacaccgtcgttatagacaacctcgacaattcctctctcgtttcgatccaacgcgtcaaggatctcgccggagatcatggacaaaatctcaccgtccaccaggtggaccttcgcgataaacccgcacttgagaaggttttctccgaaacaaagtttgatgcagtaatgcattttgctggattgaaagcagttggtgagagcgtggcgaaaccacttctgtattataacaataacttgattgcgactattacacttttggaagtaatggctgcacacggatgtaaaaagcttgtattttcttcgtccgctactgtgtatggctggccaaaggaggttccttgtacagaagagtctcccctgtctggaatgagtccttatggacggacaaagctgttcatagaggacatttgccgtgatgtacaacgtggtgatcctgaatggagaatcataatgctgaggtactttaaccctgtgggagctcaccctagcggtcgcattggtgaggatccttgtgggactccaaataatctcatgccttatgtccagcaagtcgttgttgggaggctacctaacctaaaaatttatggaactgactataccactaaagatggcactggtgtacgagactatattcatgttgttgatctagcagatggccatatatttgcgcttcaaaagctagacgatactgaaataggttgtgaggtatacaacctgggaaccggaaaaggaacaacagtgttggagatggttgatgcatttgagaaagcttctggaatgaaaatcccactggtgaaggttggaaggagaccaggtgatgcagaaaccgtctatgcgtcaacagaaaaagctgaacgcgaactaaactggaaggcaaattttggaatcgaagaaatgtgtagggatcagtggaactgggcaagcaacaatcctttcggttacggttcttcaccaaactcaacataacgaagctaacgtatccaacactccattctttttcttttgggtcgtcggctgttatctttatgttacacactcaggttttagctttaaagcctaaacacagtgagggagaagttacttctctattcatatatctgctttctccttttgtaatttatatatatcttatatacgcataggtttaacttaagcggatccttttgttttttggatttgtataatctctcttaggaaattaattgtcatgggattatatttgtattaaatagaaactgaattc

SEQ ID NO: 466 - protein, 1396 aa, Arabidopsis thaliana
  misc_feature: PFam Name: Epimerase; PFam Description: NAD dependent
  misc_feature: GI Number: 45752702; NR Description: At1g64440 [Arabidopsis thaliana] >gi|12323470|gb|AAG51709.1| UDP-galactose 4-epimerase, putative; 6572-4109 [Arabidopsis thaliana] >gi|15217653|ref|NP_176625.1| UDP-glucose 4-epimerase, At1g64440
  misc_feature: GI Number: 6633809; NR Description: F1N19.2 [Arabidopsis thaliana]
  misc_feature: GI Number: 12643850; NR Description: Probable UDP-glucose 4-epimerase At4g10960 (Galactowaldenase) (UDP-galactose 4-epimerase) >gi|7437224|pir||T01881 UDPglucose 4-epimerase (EC 5.1.3.2) F8M12.10 - Arabidopsis thaliana epimerase; F8M12.10
  misc_feature: GI Number: 3021357; NR Description: UDP-galactose 4-epimerase [Cyamopsis tetragonoloba] >gi|7437270|pir||T10498 UDPglucose 4-epimerase (EC 5.1.3.2) (clone GEPI48) - guar
  misc_feature: GI Number: 21553659; NR Description: UDP-galactose
ATTATTATTTCCAGAGAAGCTTCTCTTTTGATTCTCTCGCTCTCTCTTTCTTCATCGCCTCTTCGAGCTTCGATGGTTGGGAATATTCTGGTGACCGGTGGTGCTGGTTACATCGGAAGTCACACGGTTCTTCAGCTTCTTCTCGGAGGCTATAACACCGTCGTTATAGACAACCTCGACAATTCCTCTCTCGTTTCGATCCAACGCGTCAAGGATCTCGCCGGAGATCATGGACAAAATCTCACCGTCCACCAGGTGGACCTTCGCGATAAACCCGCACTTGAGAAGGTTTTCTCCGAAACAAAGTTTGATGCAGTAATGCATTTTGCTGGATTGAAAGCAGTTGGTGAGAGCGTGGCGAAACCACTTCTGTATTATAACAATAACTTGATTGCGACTATTACACTTTTGGAAGTAATGGCTGCACACGGATGTAAAAAGCTTGTATTTTCTTCGTCCGCTACTGTGTATGGCTGGCCAAAGGAGGTTCCTTGTACAGAAGAGTCTCCCCTGTCTGGAATGAGTCCTTATGGACGGACAAAGCTGTTCATAGAGGACATTTGCCGTGATGTACAACGTGGTGATCCTGAATGGAGAATCATAATGCTGAGGTACTTTAACCCTGTGGGAGCTCACCCTAGCGGTCGCATTGGTGAGGATCCTTGTGGGACTCCAAATAATCTCATGCCTTATGTCCAGCAAGTCGTTGTTGGGAGGCTACCTAACCTAAAAATTTATGGAACTGACTATACCACTAAAGATGGCACTGGTGTACGAGACTATATTCATGTTGTTGATCTAGCAGATGGCCATATATTTGCGCTTCAAAAGCTAGACGATACTGAAATAGGTTGTGAGGTATACAACCTGGGAACCGGAAAAGGAACAACAGTGTTGGAGATGGTTGATGCATTTGAGAAAGCTTCTGGAATGAAAATCCCACTGGTGAAGGTTGGAAGGAGACCAGGTGATGCAGAAACCGTCTATGCGTCAACAGAAAAAGCTGAACGCGAACTAAACTGGAAGGCAAATTTTGGAATCGAAGAAATGTGTAGGGATCAGTGGAACTGGGCAAGCAACAATCCTTTCGGTTACGGTTCTTCACCAAACTCAACATAACGAAGCTAACGTATCCAACACTCCATTCTTTTTCTTTTGGGTCGTCGGCTGTTATCTTTATGTTACACACTCAGGTTTTAGCTTTAAAGCCTAAACACAGTGAGGGAGAAGTTACTTCTCTATTCATATATCTGCTTTCTCCTTTTGTAATTTATATATATCTTATATACGCATAGGTTTAACTTAAGCGGATCCTTTTGTTTTTTGGATTTGTATAATCTCTCTTAGGAAATTAATTGTCATGGGATTATATTTGTATTAAATAGAAACTGAATTC

SEQ ID NO: 467 - DNA, 1049 bp, Arabidopsis thaliana
  misc_feature (1)..(1049): Ceres cDNA ID no. 12336306
  misc_feature (1)..(1049): Ceres CLONE  ID no. 231096
  misc_feature (1)..(1049): Also known as  Ceres CDNA ID no. 23370701
actttgtaataataaccacaacttcccaatcttcttcatcagattttgctagttcgtcacacacacggatcaacgtcatcatcttctcttcttcttctccacaagcccacctacaatttccatttcgccgcttcctctgttcccacttacatcaattccgctcgatttcgaatttcgagctcaatcttccctttggatcgaagaagaagaagaagaatctggtctgtctctggctttaaatctatggccgatttagtaaaaaccaatgctcgcagagacggtgaagaacgatttcaagcgcttgagcaagaggctttcatcaataattcgtctccggagctccagaacgagttggtatccgacgccggaggtgggattgaagcaatcgctaatcgtctgactgcatttttgtcaaatggcagagcaaatggattgtagcagctctgtttggatccgttctgcttctacgacatgatggtgcagctttgtgggctgtgattggatcggtttcaaattccgtgctctcagtagctttgaaacgtatacttaaccaagagagacctgttgctactctccgttctgatcctgggatgccttcttctcatgcccaatccatttctttcatctctgtgttttctgtcttctccgttatggagtggcttggaaccaatgtactctctctgttccttagcggcttcatcctcgcattgggttcttatttcacgtggttaagggtttctcagaagcttcacacgacaagtcaagtggtcgtaggtgcaatcgtgggttctgtttactccaccttatggtatgtaacttggaactctcttgttcttgaagcctttacctcaacattctcagtacaaatagctgtctttctggttgctgctgcgtctgctttaggttttgcagtttatgtgctacttaactggtttaaagatgacagatgacagatgacagaatgataattttcagtacttaggatgtataaggaatgcatttgattctccttataattcatattgattgagctattttaacattcaatg

SEQ ID NO: 468 - protein, 1049 aa, Arabidopsis thaliana
  misc_feature: PFam Name: PAP2; PFam Description: PAP2 superfamily
  misc_feature: GI Number: 42565815; NR Description: phosphatidic acid
  misc_feature: GI Number: 51964288; NR Description: PREDICTED P0724B10.35
  misc_feature: GI Number: 50911907; NR Description: phosphatidic acid phosphatase-like [Oryza sativa (japonica cultivar-group)] >gi|41053139|dbj|BAD08082.1| phosphatidic acid phosphatase-like
ACTTTGTAATAATAACCACAACTTCCCAATCTTCTTCATCAGATTTTGCTAGTTCGTCACACACACGGATCAACGTCATCATCTTCTCTTCTTCTTCTCCACAAGCCCACCTACAATTTCCATTTCGCCGCTTCCTCTGTTCCCACTTACATCAATTCCGCTCGATTTCGAATTTCGAGCTCAATCTTCCCTTTGGATCGAAGAAGAAGAAGAAGAATCTGGTCTGTCTCTGGCTTTAAATCTATGGCCGATTTAGTAAAAACCAATGCTCGCAGAGACGGTGAAGAACGATTTCAAGCGCTTGAGCAAGAGGCTTTCATCAATAATTCGTCTCCGGAGCTCCAGAACGAGTTGGTATCCGACGCCGGAGGTGGGATTGAAGCAATCGCTAATCGTCTGACTGCATTTTTGTCAAATGGCAGAGCAAATGGATTGTAGCAGCTCTGTTTGGATCCGTTCTGCTTCTACGACATGATGGTGCAGCTTTGTGGGCTGTGATTGGATCGGTTTCAAATTCCGTGCTCTCAGTAGCTTTGAAACGTATACTTAACCAAGAGAGACCTGTTGCTACTCTCCGTTCTGATCCTGGGATGCCTTCTTCTCATGCCCAATCCATTTCTTTCATCTCTGTGTTTTCTGTCTTCTCCGTTATGGAGTGGCTTGGAACCAATGTACTCTCTCTGTTCCTTAGCGGCTTCATCCTCGCATTGGGTTCTTATTTCACGTGGTTAAGGGTTTCTCAGAAGCTTCACACGACAAGTCAAGTGGTCGTAGGTGCAATCGTGGGTTCTGTTTACTCCACCTTATGGTATGTAACTTGGAACTCTCTTGTTCTTGAAGCCTTTACCTCAACATTCTCAGTACAAATAGCTGTCTTTCTGGTTGCTGCTGCGTCTGCTTTAGGTTTTGCAGTTTATGTGCTACTTAACTGGTTTAAAGATGACAGATGACAGATGACAGAATGATAATTTTCAGTACTTAGGATGTATAAGGAATGCATTTGATTCTCCTTATAATTCATATTGATTGAGCTATTTTAACATTCAATG

SEQ ID NO: 469 - DNA, 1732 bp, Zea mays
  misc_feature (1)..(1732): Ceres cDNA ID no. 12336960
  misc_feature (1)..(1732): Ceres CLONE  ID no. 304653
  misc_feature (1)..(1732): Also known as  Ceres CDNA ID no. 23764004
attcttagactaaaaacactatgagttagtgctaccaactgaaggatacgccatggctgttctgacactggttaatatccttatcagcttcgctgcttgtgctgaagctctaaggagagcagacttccctcaaggtttcgtctttggcactgcttcttcagcttaccagtatgaaggtgctgtcaacgagggtcaacgtggacctacaatatgggatactctcacaagacgacccggacgggtgatagatttcagcaatgcagatgttgccgttgatcactaccatcgttataaggaagatgtggacttgattaaggacattggcatggatgcataccggttctctatctcgtggtcacgtatctttccaaatggaactggtgaacctaatgaagaaggattgaattactataacagcctcataaatactctattagacaaaggtatacaaccatatgtaacactctttcactgggaccttccgcaagcactagaagacagatatggtggatggttaaacccccaaatcgtggatgattttgttcactatgcctctacttgcttcaaggaatttggagatagagtgaaacactggatcactttcaatgagccccataattttgcgattgaaggctatgaccttggcatccaggcacctgggaggtgttctattctgtctcatatattttgcagggagggcaaatcatcgactgagccttatgtcgtagctcacaacatactcttagcgcatgctggtgcctttcatacttataagcagcatttcaagaaagaacaaggaggtatcattggcattgcactcgattctaagtggtatgagccactgtcagatgttgatgaggacacagaggcagcagcacgagcaatggactttgagcttggatggttcctggatcccttaatgtttggccactatcctccttctatgcagaaacttgtgggcgacaggctgcctcagttttcagctcgggcttccgatgttagtgtcaggctcactagattttgtgggcataaaccattacaccacactgtatgttaggaacgacagaatgcggatcaggaaacttgtaatgaatgatgcttcaactgatgctgcggtcatacctactgcttatagacatggaaagaaaataggagaaacggcagcgtcaggatggctgcacatagtgccctggggcatgttcaagctgatgaagcacatcaaagaaaagtacgggaatccgcccgtgatcattactgaaaacggcatggatgatgcgaacaaccggttttcgaaattagaggatgatctgcaggatgataaacggatacagtaccacaaggactacatgtctaacctcctagacgcaattaggaaggaaggctgcaacgtccatggctacttcgtctggtcgctgctcgacaactgggagtggaactccgggtacacggtgcggtttgggctctactacatcgactacaacaacaatttgacacggatacccaaggcgtccgtggagtggttcaggcaggtcttggcccagaagacggctggtggagtacagtggttctacagtggccagtagttgagtgtatataacatacacggcacggctaccatcgatctgtacatgcgtacgtagctttagattagattgtgattattctcgatgtatatagactcaccatttggacgaccttcaaccgcacagttgaatgtgtcgttatgcttgct

SEQ ID NO: 470 - protein, 1732 aa, Zea mays
  misc_feature: PFam Name: Glyco_hydro_1; PFam Description: Glycosyl
  misc_feature: GI Number: 15778634; NR Description: amygdalin hydrolase
  misc_feature: GI Number: 9758949; NR Description: beta-glucosidase
  misc_feature: GI Number: 22658440; NR Description: beta-glucosidase [Oryza
  misc_feature: GI Number: 21537259; NR Description: beta-glucosidase,
  misc_feature: GI Number: 42568534; NR Description: glycosyl hydrolase
ATTCTTAGACTAAAAACACTATGAGTTAGTGCTACCAACTGAAGGATACGCCATGGCTGTTCTGACACTGGTTAATATCCTTATCAGCTTCGCTGCTTGTGCTGAAGCTCTAAGGAGAGCAGACTTCCCTCAAGGTTTCGTCTTTGGCACTGCTTCTTCAGCTTACCAGTATGAAGGTGCTGTCAACGAGGGTCAACGTGGACCTACAATATGGGATACTCTCACAAGACGACCCGGACGGGTGATAGATTTCAGCAATGCAGATGTTGCCGTTGATCACTACCATCGTTATAAGGAAGATGTGGACTTGATTAAGGACATTGGCATGGATGCATACCGGTTCTCTATCTCGTGGTCACGTATCTTTCCAAATGGAACTGGTGAACCTAATGAAGAAGGATTGAATTACTATAACAGCCTCATAAATACTCTATTAGACAAAGGTATACAACCATATGTAACACTCTTTCACTGGGACCTTCCGCAAGCACTAGAAGACAGATATGGTGGATGGTTAAACCCCCAAATCGTGGATGATTTTGTTCACTATGCCTCTACTTGCTTCAAGGAATTTGGAGATAGAGTGAAACACTGGATCACTTTCAATGAGCCCCATAATTTTGCGATTGAAGGCTATGACCTTGGCATCCAGGCACCTGGGAGGTGTTCTATTCTGTCTCATATATTTTGCAGGGAGGGCAAATCATCGACTGAGCCTTATGTCGTAGCTCACAACATACTCTTAGCGCATGCTGGTGCCTTTCATACTTATAAGCAGCATTTCAAGAAAGAACAAGGAGGTATCATTGGCATTGCACTCGATTCTAAGTGGTATGAGCCACTGTCAGATGTTGATGAGGACACAGAGGCAGCAGCACGAGCAATGGACTTTGAGCTTGGATGGTTCCTGGATCCCTTAATGTTTGGCCACTATCCTCCTTCTATGCAGAAACTTGTGGGCGACAGGCTGCCTCAGTTTTCAGCTCGGGCTTCCGATGTTAGTGTCAGGCTCACTAGATTTTGTGGGCATAAACCATTACACCACACTGTATGTTAGGAACGACAGAATGCGGATCAGGAAACTTGTAATGAATGATGCTTCAACTGATGCTGCGGTCATACCTACTGCTTATAGACATGGAAAGAAAATAGGAGAAACGGCAGCGTCAGGATGGCTGCACATAGTGCCCTGGGGCATGTTCAAGCTGATGAAGCACATCAAAGAAAAGTACGGGAATCCGCCCGTGATCATTACTGAAAACGGCATGGATGATGCGAACAACCGGTTTTCGAAATTAGAGGATGATCTGCAGGATGATAAACGGATACAGTACCACAAGGACTACATGTCTAACCTCCTAGACGCAATTAGGAAGGAAGGCTGCAACGTCCATGGCTACTTCGTCTGGTCGCTGCTCGACAACTGGGAGTGGAACTCCGGGTACACGGTGCGGTTTGGGCTCTACTACATCGACTACAACAACAATTTGACACGGATACCCAAGGCGTCCGTGGAGTGGTTCAGGCAGGTCTTGGCCCAGAAGACGGCTGGTGGAGTACAGTGGTTCTACAGTGGCCAGTAGTTGAGTGTATATAACATACACGGCACGGCTACCATCGATCTGTACATGCGTACGTAGCTTTAGATTAGATTGTGATTATTCTCGATGTATATAGACTCACCATTTGGACGACCTTCAACCGCACAGTTGAATGTGTCGTTATGCTTGCT

SEQ ID NO: 471 - DNA, 823 bp, Arabidopsis thaliana
  misc_feature (1)..(823): Ceres cDNA ID no. 12337127
  misc_feature (1)..(823): Ceres CLONE  ID no. 250382
  misc_feature (1)..(823): Also known as  Ceres CDNA ID no. 23371053
gtatcgagatcgaatcggcaatggctgcttcaagctccgttttcacagtatccccgtcgcgaaatcttgcagctattcctcttcatcagtccctatctccaccgttgcttagatccagctccgtcgcgtttcgtcccaaacgaagatccagctcactcgtcttatgctcaactgatgaaacaaagagcaccgcagagaaagagatcccaatcgaactaaggtatgaggcgtttccgacagtgatggacatcaataagatacaagagattttgcctcacagattcccatttctgttagttgatagagtgatagagtacacagctggtgtatctgcggtagctattaaaaacgttaccattaatgacaatttctttcctgggcatttccctgagagacctataatgcctggagttctcatggttgaggcaatggctcaagtgggaggtatagtgatgctacaaccagaagttggcggatctagaagcaacttcttctttgctggaatcgacaaagtcagattcaggaagccagtgattgcaggtgatacgctggtgatgaggatgacacttgtgaagttgcagaagcggtttgggatagcgaaaatggaagggaaagcatatgtagggaactctgtggtatgtgaaggagagttcttgatggctatgggaaaagaagagtgatcacgcctttgtttctttcttcttcatacgggccttgtggctgctaattagttgtcacatcctaagttgagtctcatttctatcttcaatttatgatgtttgtttgcacattatgattatattaaaaaagcaacttcagtttt

SEQ ID NO: 472 - protein, 823 aa, Arabidopsis thaliana
  misc_feature: PFam Name: FabA; PFam Description: FabA-like domain
  misc_feature: PFam Name: 4HBT; PFam Description: Thioesterase superfamily
  misc_feature: GI Number: 14334124; NR Description: putative 3-keto-acyl-ACP
  misc_feature: GI Number: 21928166; NR Description: At2g22230/T26C19.11 [Arabidopsis thaliana] >gi|20198153|gb|AAD23619.2| putative beta-hydroxyacyl-ACP dehydratase [Arabidopsis thaliana] >gi|25090441|gb|AAN72302.1| At2g22230/T26C19.11 [Arabidopsis
  misc_feature: GI Number: 21592599; NR Description: putative
  misc_feature: GI Number: 50931539; NR Description: putative beta-hydroxyacyl-ACP dehydratase [Oryza sativa (japonica cultivar-group)] >gi|49328184|gb|AAT58880.1| putative beta-hydroxyacyl-ACP dehydratase [Oryza sativa (japonica
  misc_feature: GI Number: 25319393; NR Description: probable
GTATCGAGATCGAATCGGCAATGGCTGCTTCAAGCTCCGTTTTCACAGTATCCCCGTCGCGAAATCTTGCAGCTATTCCTCTTCATCAGTCCCTATCTCCACCGTTGCTTAGATCCAGCTCCGTCGCGTTTCGTCCCAAACGAAGATCCAGCTCACTCGTCTTATGCTCAACTGATGAAACAAAGAGCACCGCAGAGAAAGAGATCCCAATCGAACTAAGGTATGAGGCGTTTCCGACAGTGATGGACATCAATAAGATACAAGAGATTTTGCCTCACAGATTCCCATTTCTGTTAGTTGATAGAGTGATAGAGTACACAGCTGGTGTATCTGCGGTAGCTATTAAAAACGTTACCATTAATGACAATTTCTTTCCTGGGCATTTCCCTGAGAGACCTATAATGCCTGGAGTTCTCATGGTTGAGGCAATGGCTCAAGTGGGAGGTATAGTGATGCTACAACCAGAAGTTGGCGGATCTAGAAGCAACTTCTTCTTTGCTGGAATCGACAAAGTCAGATTCAGGAAGCCAGTGATTGCAGGTGATACGCTGGTGATGAGGATGACACTTGTGAAGTTGCAGAAGCGGTTTGGGATAGCGAAAATGGAAGGGAAAGCATATGTAGGGAACTCTGTGGTATGTGAAGGAGAGTTCTTGATGGCTATGGGAAAAGAAGAGTGATCACGCCTTTGTTTCTTTCTTCTTCATACGGGCCTTGTGGCTGCTAATTAGTTGTCACATCCTAAGTTGAGTCTCATTTCTATCTTCAATTTATGATGTTTGTTTGCACATTATGATTATATTAAAAAAGCAACTTCAGTTTT

SEQ ID NO: 473 - DNA, 1374 bp, Arabidopsis thaliana
  misc_feature (1)..(1374): Ceres cDNA ID no. 12337294
  misc_feature (1)..(1374): Ceres CLONE  ID no. 6263
  misc_feature (1)..(1374): Also known as  Ceres CDNA ID no. 23371182
aatttctgctaagatcaaatcaggaatggtgctcagaaacttaaccatttcttacgaaatcatcaaatctctgaaacatgccaaagaacatagtttagggattcaaatccgatggatctcgagcctgaaagtggtatggaagaaagacacgaggctagacgaagccatcgagcaggacaagcgttacaagctctgtgctcgggttgtgaaagaagtcctgaacgagccaggtcaagtcattcctctcagatacctcgaaaaacggcgcgagaggctacgtctcactttcaaagctaagagctttgttgaaatgaacccttccctgttcgagatctactacgatcggatcaaacccaagtccgatcccgtccaattcctccgccccacgcctcgtctcagagctttcctcgacgaagagcagaggatttactctgagaatgagcctttacttgtttccaagctctgccaattgctgatgatggctaaagataaggttatcagtgcagataaactggttcatgtgaagagagatttcggatttccgaacgattttctgatgaaattggttcagaaataccctaattacttcaggctaaccggtttacctgaagaaggtaagtcctttcttgagctagtctcttggaaccctgatttcgccaaatcgaagattgagctgagagcagaagacgagacccttaaaaccggtgtccggattcgacccaattacaatgtgaaattgccgtctggttttttcctaaggaaggagatgagagagtggactagggattggttagagcaagactacatatcaccatatgaggatgtgtctcatttagaccaagcttctaaggaaatggagaaacgaactgttggtgttgtgcacgaattgctttctctgtcactgttgaaaagagtccctgtgcctacacttggcaagttctgcgatgagttccggttttccaacgcgttctcgagtgttttcactcgtcattcaggtatattctacttgtcgttaaaaggagggatcaagactgcagtgttgagagaagcttataaagacgatgagcttgttgatagagatcctttgcttgctattaaggataagttcctgaggttattagaggaaggatggcaagaaaggaaagatagactgaagctgcagagggaacaagttcagaaagacagggagatgatgttagcagcgaaaagcaatgaaccgatagagcgtctctgtgattaactttacaatcaagactctgtttatgtcctctgttttttctctaggcatagttcttggcctggtttggtctttagggtggatggttaagtttgtaagtttttggctaataagagataaataatcaaatgttaatc

SEQ ID NO: 474 - protein, 1374 aa, Arabidopsis thaliana
  misc_feature: GI Number: 21593983; NR Description: unknown [Arabidopsis thaliana]
  misc_feature: GI Number: 7239512; NR Description: Strong similarity to the higher plant tyrosine-specific protein phosphatases (PTPs) from A. thaliana gi|3413424 expressed during embryogenesis. [Arabidopsis
  misc_feature: GI Number: 34912696; NR Description: P0686E09.18 [Oryza sativa (japonica cultivar-group)] >gi|13365580|dbj|BAB39125.1|
AATTTCTGCTAAGATCAAATCAGGAATGGTGCTCAGAAACTTAACCATTTCTTACGAAATCATCAAATCTCTGAAACATGCCAAAGAACATAGTTTAGGGATTCAAATCCGATGGATCTCGAGCCTGAAAGTGGTATGGAAGAAAGACACGAGGCTAGACGAAGCCATCGAGCAGGACAAGCGTTACAAGCTCTGTGCTCGGGTTGTGAAAGAAGTCCTGAACGAGCCAGGTCAAGTCATTCCTCTCAGATACCTCGAAAAACGGCGCGAGAGGCTACGTCTCACTTTCAAAGCTAAGAGCTTTGTTGAAATGAACCCTTCCCTGTTCGAGATCTACTACGATCGGATCAAACCCAAGTCCGATCCCGTCCAATTCCTCCGCCCCACGCCTCGTCTCAGAGCTTTCCTCGACGAAGAGCAGAGGATTTACTCTGAGAATGAGCCTTTACTTGTTTCCAAGCTCTGCCAATTGCTGATGATGGCTAAAGATAAGGTTATCAGTGCAGATAAACTGGTTCATGTGAAGAGAGATTTCGGATTTCCGAACGATTTTCTGATGAAATTGGTTCAGAAATACCCTAATTACTTCAGGCTAACCGGTTTACCTGAAGAAGGTAAGTCCTTTCTTGAGCTAGTCTCTTGGAACCCTGATTTCGCCAAATCGAAGATTGAGCTGAGAGCAGAAGACGAGACCCTTAAAACCGGTGTCCGGATTCGACCCAATTACAATGTGAAATTGCCGTCTGGTTTTTTCCTAAGGAAGGAGATGAGAGAGTGGACTAGGGATTGGTTAGAGCAAGACTACATATCACCATATGAGGATGTGTCTCATTTAGACCAAGCTTCTAAGGAAATGGAGAAACGAACTGTTGGTGTTGTGCACGAATTGCTTTCTCTGTCACTGTTGAAAAGAGTCCCTGTGCCTACACTTGGCAAGTTCTGCGATGAGTTCCGGTTTTCCAACGCGTTCTCGAGTGTTTTCACTCGTCATTCAGGTATATTCTACTTGTCGTTAAAAGGAGGGATCAAGACTGCAGTGTTGAGAGAAGCTTATAAAGACGATGAGCTTGTTGATAGAGATCCTTTGCTTGCTATTAAGGATAAGTTCCTGAGGTTATTAGAGGAAGGATGGCAAGAAAGGAAAGATAGACTGAAGCTGCAGAGGGAACAAGTTCAGAAAGACAGGGAGATGATGTTAGCAGCGAAAAGCAATGAACCGATAGAGCGTCTCTGTGATTAACTTTACAATCAAGACTCTGTTTATGTCCTCTGTTTTTTCTCTAGGCATAGTTCTTGGCCTGGTTTGGTCTTTAGGGTGGATGGTTAAGTTTGTAAGTTTTTGGCTAATAAGAGATAAATAATCAAATGTTAATC

SEQ ID NO: 475 - DNA, 1146 bp, Arabidopsis thaliana
  misc_feature (1)..(1146): Ceres cDNA ID no. 12337382
  misc_feature (1)..(1146): Ceres CLONE  ID no. 13730
  misc_feature (1)..(1146): Also known as  Ceres CDNA ID no. 23371254
atctggatttgttcttttttcatttttattcgagcggcttatctttctcggatccatctgatatcgatttgattctctttggtcaatcgttgaaatggcggatgcgtggaaggatttagcttcagggacagttggaggagcggctcagctagttgttggtcatccatttgacacaatcaaagtcaaacttcagagccaaccgactccagcaccaggccaacttccaaggtacaccggtgcaatcgatgcggttaaacagaccgttgcttctgaaggaactaaaggtttgtacaaaggtatgggagctccactggcaaccgttgctgccttcaatgcggttttgttcactgtgagaggtcaaatggaagggctgcttaggtctgaagctggaattcctttgaccattagtcaacagtttgtggccggtgcaggcgctggttccctgtttcgttccttgcttgtcctactgagttgatcaaatgcaggttgcaagcacaaggtgcattagctggtgcctctactacaagctcagtggttgcagccgtgaaatacggtggaccaatggatgtagcccgtcatgtcctacgatcagaaggcggagcacgaggtctattcaaaggtttattcccgacattcgcccgtgaagtcccgggaaatgcaacaatgtttgcagcctacgaagctttcaagcggtttttagccggtggttcagacacttcaagcttaggacaagggtcattgatcatggcgggtggagtcgctggtgcgtcgttttggggaattgtatatccgacagatgttgtgaagagtgttcttcaagtcgacgattacaaaaacccgaaatacacggggtcgatggatgctttccggaagattctgaaatctgaaggagttaaaggtttgtataaaggatttggtccagctatggctaggagtgttcctgctaatgctgcttgcttcttggcttatgagatgacaaggtcaagcttgggataaaccggttcgttttgggtttaactgttggtcctatttctggatgttccattgtcattaacctctctgtttttagatttgattcttttgaaatttctgcaaaaattatgtatctcttacacagtttatttcaactatctcttacacagaagc

SEQ ID NO: 476 - protein, 1146 aa, Arabidopsis thaliana
  misc_feature: PFam Name: Mito_carr; PFam Description: Mitochondrial
  misc_feature: GI Number: 9758516; NR Description: carnitine/acylcarnitine
  misc_feature: GI Number: 22531072; NR Description: carnitine/acylcarnitine translocase-like protein [Arabidopsis thaliana] >gi|23197914|gb|AAN15484.1| carnitine/acylcarnitine translocase-like protein [Arabidopsis thaliana]
  misc_feature: GI Number: 37537070; NR Description: putative carnitine/acylcarnitine translocase [Oryza sativa (japonica cultivar-group)] >gi|12643054|gb|AAK00443.1| putative carnitine/acylcarnitine translocase [Oryza sativa]
  misc_feature: GI Number: 37537072; NR Description: putative carnitine/acylcarnitine translocase [Oryza sativa (japonica cultivar-group)] >gi|12643066|gb|AAK00455.1| putative carnitine/acylcarnitine translocase; tRNA-Gly; tRNA-Met [Oryza
  misc_feature: GI Number: 17539560; NR Description: mitochondrial carrier protein family, embryonic tissue differentiation factor, DIFferentiation abnormal DIF-1 (33.1 kD) (dif-1) [Caenorhabditis elegans] >gi|21542027|sp|Q27257|DIF1_CAEEL [Caenorhabditis
ATCTGGATTTGTTCTTTTTTCATTTTTATTCGAGCGGCTTATCTTTCTCGGATCCATCTGATATCGATTTGATTCTCTTTGGTCAATCGTTGAAATGGCGGATGCGTGGAAGGATTTAGCTTCAGGGACAGTTGGAGGAGCGGCTCAGCTAGTTGTTGGTCATCCATTTGACACAATCAAAGTCAAACTTCAGAGCCAACCGACTCCAGCACCAGGCCAACTTCCAAGGTACACCGGTGCAATCGATGCGGTTAAACAGACCGTTGCTTCTGAAGGAACTAAAGGTTTGTACAAAGGTATGGGAGCTCCACTGGCAACCGTTGCTGCCTTCAATGCGGTTTTGTTCACTGTGAGAGGTCAAATGGAAGGGCTGCTTAGGTCTGAAGCTGGAATTCCTTTGACCATTAGTCAACAGTTTGTGGCCGGTGCAGGCGCTGGTTCCCTGTTTCGTTCCTTGCTTGTCCTACTGAGTTGATCAAATGCAGGTTGCAAGCACAAGGTGCATTAGCTGGTGCCTCTACTACAAGCTCAGTGGTTGCAGCCGTGAAATACGGTGGACCAATGGATGTAGCCCGTCATGTCCTACGATCAGAAGGCGGAGCACGAGGTCTATTCAAAGGTTTATTCCCGACATTCGCCCGTGAAGTCCCGGGAAATGCAACAATGTTTGCAGCCTACGAAGCTTTCAAGCGGTTTTTAGCCGGTGGTTCAGACACTTCAAGCTTAGGACAAGGGTCATTGATCATGGCGGGTGGAGTCGCTGGTGCGTCGTTTTGGGGAATTGTATATCCGACAGATGTTGTGAAGAGTGTTCTTCAAGTCGACGATTACAAAAACCCGAAATACACGGGGTCGATGGATGCTTTCCGGAAGATTCTGAAATCTGAAGGAGTTAAAGGTTTGTATAAAGGATTTGGTCCAGCTATGGCTAGGAGTGTTCCTGCTAATGCTGCTTGCTTCTTGGCTTATGAGATGACAAGGTCAAGCTTGGGATAAACCGGTTCGTTTTGGGTTTAACTGTTGGTCCTATTTCTGGATGTTCCATTGTCATTAACCTCTCTGTTTTTAGATTTGATTCTTTTGAAATTTCTGCAAAAATTATGTATCTCTTACACAGTTTATTTCAACTATCTCTTACACAGAAGC

SEQ ID NO: 477 - DNA, 1266 bp, Arabidopsis thaliana
  misc_feature (1)..(1266): Ceres cDNA ID no. 12338255
  misc_feature (1)..(1266): Ceres CLONE  ID no. 33790
  misc_feature (1)..(1266): Also known as  Ceres CDNA ID no. 23371995
acccatcacacaatcctcaaaacagagtaacccaaaaaacagagcaatctctaaaaaatctcaagaaacctcactaaaatgggttcaacggcggagacacaattaactccggtgcaagtcaccgacgacgaagctgccctcttcgccatgcaactagccagtgcttccgttcttccgatggctttaaaatccgccttagagcttgaccttcttgagattatggccaagaatggttctcccatgtctcctaccgagatcgcttctaaacttccgaccaaaaaccctgaagctccggtcatgctcgaccgtatcctccgtcttcttacgtcttactccgtcttaacctgctccaaccgtaaactttccggtgatggcgttgaacggatttacgggcttggtccggtttgcaagtatttgaccaagaacgaagatggtgtttccattgctgctctttgtcttatgaaccaagacaaggttctcatggaaagctggtaccatttgaaggatgcaattcttgatggtgggattccattcaacaaggcttatggaatgagcgcgttcgagtaccacgggactgaccctagattcaacaaggtctttaacaatggaatgtctaaccattccacaatcaccatgaagaagattcttgagacctataagggttttgaaggattgacttctttggttgatgttggtggtggcattggtgctacactcaaaatgattgtctccaagtaccctaatcttaaaggcatcaactttgatctcccacatgtcattgaagatgctccttctcatcctggtattgagcatgttggaggagatatgtttgtaagtgtccctaaaggtgatgccatattcatgaagtggatatgtcatgactggagtgacgaacattgcgtgaaattcttgaaaaactgctacgagtcacttccagaggatggaaaagtgatattagcagagtgtatacttccagagacaccagactcaagcctctcaaccaaacaagtagtccatgtcgattgcattatgttggctcacaatcccggaggcaaagaacgaaccgagaaagagtttgaggcattagccaaagcatcaggcttcaagggcatcaaagttgtctgcgacgcttttggtgttaaccttattgagttactcaagaagctctaaaaacaaacaatgttcctatgaagatgatttatatgtaaacattatctcatatctccttccacggttccaaaactatgctgtttaataatggttttt

SEQ ID NO: 478 - protein, 1266 aa, Arabidopsis thaliana
  misc_feature: PFam Name: Methyltransf_2; PFam Description: O-methyltransferase
  misc_feature: PFam Name: Dimerisation; PFam Description: Dimerisation domain
  misc_feature: GI Number: 29839288; NR Description: Caffeic acid 3-O-methyltransferase 1 (S-adenosysl-L-methionine:caffeic acid 3-O-methyltransferase 1) (COMT-1) (CAOMT-1) >gi|762870|dbj|BAA08558.1| caffeic acid O-methyltransferase
  misc_feature: GI Number: 444327; NR Description: O-methyltransferase
  misc_feature: GI Number: 2781394; NR Description: O-methyltransferase 1
  misc_feature: GI Number: 21592899; NR Description: O-methyltransferase [Arabidopsis thaliana] >gi|10178165|dbj|BAB11578.1| O-methyltransferase [Arabidopsis thaliana] >gi|20148473|gb|AAM10127.1| O-methyltransferase [Arabidopsis
  misc_feature: GI Number: 6760443; NR Description: O-methyltransferase
ACCCATCACACAATCCTCAAAACAGAGTAACCCAAAAAACAGAGCAATCTCTAAAAAATCTCAAGAAACCTCACTAAAATGGGTTCAACGGCGGAGACACAATTAACTCCGGTGCAAGTCACCGACGACGAAGCTGCCCTCTTCGCCATGCAACTAGCCAGTGCTTCCGTTCTTCCGATGGCTTTAAAATCCGCCTTAGAGCTTGACCTTCTTGAGATTATGGCCAAGAATGGTTCTCCCATGTCTCCTACCGAGATCGCTTCTAAACTTCCGACCAAAAACCCTGAAGCTCCGGTCATGCTCGACCGTATCCTCCGTCTTCTTACGTCTTACTCCGTCTTAACCTGCTCCAACCGTAAACTTTCCGGTGATGGCGTTGAACGGATTTACGGGCTTGGTCCGGTTTGCAAGTATTTGACCAAGAACGAAGATGGTGTTTCCATTGCTGCTCTTTGTCTTATGAACCAAGACAAGGTTCTCATGGAAAGCTGGTACCATTTGAAGGATGCAATTCTTGATGGTGGGATTCCATTCAACAAGGCTTATGGAATGAGCGCGTTCGAGTACCACGGGACTGACCCTAGATTCAACAAGGTCTTTAACAATGGAATGTCTAACCATTCCACAATCACCATGAAGAAGATTCTTGAGACCTATAAGGGTTTTGAAGGATTGACTTCTTTGGTTGATGTTGGTGGTGGCATTGGTGCTACACTCAAAATGATTGTCTCCAAGTACCCTAATCTTAAAGGCATCAACTTTGATCTCCCACATGTCATTGAAGATGCTCCTTCTCATCCTGGTATTGAGCATGTTGGAGGAGATATGTTTGTAAGTGTCCCTAAAGGTGATGCCATATTCATGAAGTGGATATGTCATGACTGGAGTGACGAACATTGCGTGAAATTCTTGAAAAACTGCTACGAGTCACTTCCAGAGGATGGAAAAGTGATATTAGCAGAGTGTATACTTCCAGAGACACCAGACTCAAGCCTCTCAACCAAACAAGTAGTCCATGTCGATTGCATTATGTTGGCTCACAATCCCGGAGGCAAAGAACGAACCGAGAAAGAGTTTGAGGCATTAGCCAAAGCATCAGGCTTCAAGGGCATCAAAGTTGTCTGCGACGCTTTTGGTGTTAACCTTATTGAGTTACTCAAGAAGCTCTAAAAACAAACAATGTTCCTATGAAGATGATTTATATGTAAACATTATCTCATATCTCCTTCCACGGTTCCAAAACTATGCTGTTTAATAATGGTTTTT

SEQ ID NO: 479 - DNA, 1172 bp, Arabidopsis thaliana
  misc_feature (1)..(1172): Ceres cDNA ID no. 12338524
  misc_feature (1)..(1172): Ceres CLONE  ID no. 38287
  misc_feature (1)..(1172): Also known as  Ceres CDNA ID no. 23372205
acaatgccacttctcctccgtcgatttccctctccctccgtcgtctcctccttcttcctccgtcgctcaatggcttcctcaacaatctcctcggatataatcactccatcaaacaccaaaatcggatggatcggaaccggagtcatgggccgatcaatgtgtggacacttaatcaaagccggttacacagtcaccgtcttcaatcgaaccatctccaaagctcaaactctcatcgacatgggtgctaacgtcgccgactcaccaaactcagtcgctgaacaatccgacgtcgttttcaccatcgttggttatccttccgatgtccgtcacgtccttctcgatccaaagtccggagctttatctggtctccgtcaaggaggtgttctcgttgatatgactacttctgagccttctttagcagaggagatagctaaagctgcttcctttaagaattgtttctcaatagacgctcctgtctcaggtggagatttaggagctaagaatgggaagctatctatattcgccggaggtgatgaaaccaccgtgaaacgtttagatccgttgttttcgttaatgggtaaagtcaacttcatgggaacaagtgggaaaggtcaatttgcgaaattggctaatcagataactattgcttcgactatgttaggacttgtggaaggtttgatttatgctcataaagctggacttgatgttaagaagtttcttgaagcgatttctactggtgctgctggttctaagtctatagatttgtatggagataggattctgaagagggattttgatcctggtttttatgtgaatcattttgtgaaagatttagggatttgtttgaatgaatgtcagaggatgggtttggctttgcctggtttagctcttgctcaacagctttacttgtctcttaaggctcatggtgaaggtgatcttggtactcaagctcttctcttggctcttgaacgtctcaacaatgtctctgttcaatcatctgactcttgatttaggttctgttccactttctgataatgcatctgttggagattttatgttgttatgaagtaaagatttgatcttttgtgtacccatttgttggtaaaacatgatttgaagtaaacttttgtgtacgcatatgagattcatacacagtagttttatgtgtaccc

SEQ ID NO: 480 - protein, 1172 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
ACAATGCCACTTCTCCTCCGTCGATTTCCCTCTCCCTCCGTCGTCTCCTCCTTCTTCCTCCGTCGCTCAATGGCTTCCTCAACAATCTCCTCGGATATAATCACTCCATCAAACACCAAAATCGGATGGATCGGAACCGGAGTCATGGGCCGATCAATGTGTGGACACTTAATCAAAGCCGGTTACACAGTCACCGTCTTCAATCGAACCATCTCCAAAGCTCAAACTCTCATCGACATGGGTGCTAACGTCGCCGACTCACCAAACTCAGTCGCTGAACAATCCGACGTCGTTTTCACCATCGTTGGTTATCCTTCCGATGTCCGTCACGTCCTTCTCGATCCAAAGTCCGGAGCTTTATCTGGTCTCCGTCAAGGAGGTGTTCTCGTTGATATGACTACTTCTGAGCCTTCTTTAGCAGAGGAGATAGCTAAAGCTGCTTCCTTTAAGAATTGTTTCTCAATAGACGCTCCTGTCTCAGGTGGAGATTTAGGAGCTAAGAATGGGAAGCTATCTATATTCGCCGGAGGTGATGAAACCACCGTGAAACGTTTAGATCCGTTGTTTTCGTTAATGGGTAAAGTCAACTTCATGGGAACAAGTGGGAAAGGTCAATTTGCGAAATTGGCTAATCAGATAACTATTGCTTCGACTATGTTAGGACTTGTGGAAGGTTTGATTTATGCTCATAAAGCTGGACTTGATGTTAAGAAGTTTCTTGAAGCGATTTCTACTGGTGCTGCTGGTTCTAAGTCTATAGATTTGTATGGAGATAGGATTCTGAAGAGGGATTTTGATCCTGGTTTTTATGTGAATCATTTTGTGAAAGATTTAGGGATTTGTTTGAATGAATGTCAGAGGATGGGTTTGGCTTTGCCTGGTTTAGCTCTTGCTCAACAGCTTTACTTGTCTCTTAAGGCTCATGGTGAAGGTGATCTTGGTACTCAAGCTCTTCTCTTGGCTCTTGAACGTCTCAACAATGTCTCTGTTCAATCATCTGACTCTTGATTTAGGTTCTGTTCCACTTTCTGATAATGCATCTGTTGGAGATTTTATGTTGTTATGAAGTAAAGATTTGATCTTTTGTGTACCCATTTGTTGGTAAAACATGATTTGAAGTAAACTTTTGTGTACGCATATGAGATTCATACACAGTAGTTTTATGTGTACCC

SEQ ID NO: 481 - DNA, 1365 bp, Arabidopsis thaliana
  misc_feature (1)..(1365): Ceres cDNA ID no. 12338560
  misc_feature (1)..(1365): Ceres CLONE  ID no. 36855
  misc_feature (1)..(1365): Also known as  Ceres CDNA ID no. 23372224
aaactctaatctaaaccactattaatggagacaaatttgctaatgtcagacgattctttaggcaaatccaactgcaactttgaatgaaaagtcccaaactttaatgagacgttgatcttttcaacctctaaaatccttattttcccaattcttcttcataatcacacattttcacctcagaaacatatctagctaattctctgaagcatccatggaagctcctccaccttcaagcgatccatacaagttcctcaacattacacttaactcagatggatctctcaccagacaccgtgatttccccaaactgcccccaacagagcaatccaaagacataccattaaaccaaaccaacaataccttcatccgaatcttcaagccacggaatattccgccggaatccaaacttccgatcctcgtttactttcacggcggtggatttatcctctacagcgccgcttcagctcctttccatgaatcttgcaccaaaatggctgatcgtcttcaaactataatcctctccgtcgaataccgtctagctcccgaacaccgtctcccggcggcgtacgaagacgccgtcgaagctatcttatggctccgtgatcaagctcgtgggccaatcaacggtggtgattgcgacacgtggttaaaagacggtgtcgatttctcgaaatgctacgtcatgggttcaagctctggaggaaatattgtctacaacgtggcgttgcgtgtagttgacacagatctttctcctgttaagatccaagggctgataatgaaccaagctttcttcggtggcgttgagccgtcggattctgagtcacggcttaaagacgataagatctgtccgttaccagctactcacttgttgtggtcactttgtttaccggacggtgtagatcgtgaccacgtgtacagtaatccaattaagagcagtgggcctcaggaaaaagataagatgggacgttttccgtcgactcttatcaacggttacggtggggatcctttagtggatcgtcagagacacgtggcggagatgttaaagggacgtggagttcacgtggagacgaggtttgataaagatgggtttcatgcttgtgagttgtttgatgggaacaaagctaaggccctgtacgaaaccgttgaggcctttatgaagagttgttcatcaactggcccatcgtccaactccaacatgtagtagtctgatctaatcatgttttacgaactatatatatatctagctaataattaaattcctacaactattacgcaatttttgttgttttaagtcacatatgatatgtgtggtgcaatggaaaaatgtataccctttcaataaatatagtggatgcaatttaatct

SEQ ID NO: 482 - protein, 1365 aa, Arabidopsis thaliana
  misc_feature: PFam Name: Abhydrolase_3; PFam Description: alpha/beta
  misc_feature: PFam Name: COesterase; PFam Description: Carboxylesterase
  misc_feature: GI Number: 21593183; NR Description: unknown [Arabidopsis thaliana]
  misc_feature: GI Number: 48714603; NR Description: putative esterase [Cicer
  misc_feature: GI Number: 50948247; NR Description: putative pepper esterase [Oryza sativa (japonica cultivar-group)] >gi|42407543|dbj|BAD10748.1| putative pepper esterase [Oryza sativa (japonica cultivar-group)] >gi|42408724|dbj|BAD09942.1|
  misc_feature: GI Number: 8574455; NR Description: pepper esterase [Capsicum
  misc_feature: GI Number: 50919067; NR Description: putative esterase [Oryza sativa (japonica cultivar-group)] >gi|27819508|gb|AAO24912.1|
AAACTCTAATCTAAACCACTATTAATGGAGACAAATTTGCTAATGTCAGACGATTCTTTAGGCAAATCCAACTGCAACTTTGAATGAAAAGTCCCAAACTTTAATGAGACGTTGATCTTTTCAACCTCTAAAATCCTTATTTTCCCAATTCTTCTTCATAATCACACATTTTCACCTCAGAAACATATCTAGCTAATTCTCTGAAGCATCCATGGAAGCTCCTCCACCTTCAAGCGATCCATACAAGTTCCTCAACATTACACTTAACTCAGATGGATCTCTCACCAGACACCGTGATTTCCCCAAACTGCCCCCAACAGAGCAATCCAAAGACATACCATTAAACCAAACCAACAATACCTTCATCCGAATCTTCAAGCCACGGAATATTCCGCCGGAATCCAAACTTCCGATCCTCGTTTACTTTCACGGCGGTGGATTTATCCTCTACAGCGCCGCTTCAGCTCCTTTCCATGAATCTTGCACCAAAATGGCTGATCGTCTTCAAACTATAATCCTCTCCGTCGAATACCGTCTAGCTCCCGAACACCGTCTCCCGGCGGCGTACGAAGACGCCGTCGAAGCTATCTTATGGCTCCGTGATCAAGCTCGTGGGCCAATCAACGGTGGTGATTGCGACACGTGGTTAAAAGACGGTGTCGATTTCTCGAAATGCTACGTCATGGGTTCAAGCTCTGGAGGAAATATTGTCTACAACGTGGCGTTGCGTGTAGTTGACACAGATCTTTCTCCTGTTAAGATCCAAGGGCTGATAATGAACCAAGCTTTCTTCGGTGGCGTTGAGCCGTCGGATTCTGAGTCACGGCTTAAAGACGATAAGATCTGTCCGTTACCAGCTACTCACTTGTTGTGGTCACTTTGTTTACCGGACGGTGTAGATCGTGACCACGTGTACAGTAATCCAATTAAGAGCAGTGGGCCTCAGGAAAAAGATAAGATGGGACGTTTTCCGTCGACTCTTATCAACGGTTACGGTGGGGATCCTTTAGTGGATCGTCAGAGACACGTGGCGGAGATGTTAAAGGGACGTGGAGTTCACGTGGAGACGAGGTTTGATAAAGATGGGTTTCATGCTTGTGAGTTGTTTGATGGGAACAAAGCTAAGGCCCTGTACGAAACCGTTGAGGCCTTTATGAAGAGTTGTTCATCAACTGGCCCATCGTCCAACTCCAACATGTAGTAGTCTGATCTAATCATGTTTTACGAACTATATATATATCTAGCTAATAATTAAATTCCTACAACTATTACGCAATTTTTGTTGTTTTAAGTCACATATGATATGTGTGGTGCAATGGAAAAATGTATACCCTTTCAATAAATATAGTGGATGCAATTTAATCT

SEQ ID NO: 483 - DNA, 1618 bp, Arabidopsis thaliana
  misc_feature (1)..(1618): Ceres cDNA ID no. 12338866
  misc_feature (1)..(1618): Ceres CLONE  ID no. 27482
  misc_feature (1)..(1618): Also known as  Ceres CDNA ID no. 23372421
aaaactagtcctagtcctagtccacgcgcgaatatacaaacgtcttaaagccatttgatagaaccgatttccaagggttttgctcagaaaaaacacagagagagattttggaattcgatgaatagtggtgataccttatcgacgttagctcaatttatctcctcttccgagagatttttccggcgagctgacggtgatgtagtcttttgttattgctgggccaccgtgctcgcacttgtcttcattcttctctaccaattcttcctttcccggaaattccgattcttcagtcatgcttcttcttcttcccctgtcgtctcggtttctcaatctctcagctcccaatcaggaatatctactacacttgtttctgatgaagatctaaagggtctgattcaaaaattgggggaaagaagtgaggatgctgagatatgggaagatgttattaagaaaagcaaccctcgtatctcctacactgctaaatgctgcaaaccaacagatggtagtcccatgaagtatctgagtacaactgtgtttgaggattgctccccagaggttttgagggacttttacatggacaatgaatacaggaaacaatgggacaagactgtggttgagcatgagcaattgcaggttgacagtaatagtgggattgagattggtcgcactataaaaaagtttcccttgttgactccaagggagtatgtattagcgtggaaattgtgggaggggaaggataagttttactgtttcatcaaggaatgtgatcacaatatggtgccgcaacagaggaagtatgtacgtgtaagttatttcagatctggttggcgaattaggaaagttcctggtaggaacgcttgtgagatacacatggttcaccaggaggatgctggattaaatgttgagatggcaaagcttgctttctcaagaggcatatggagttacgtttgtaagatggaaaatgcacttcgcaagtacattgcaaccagtcatcgaccccaagggcccacattatctgctgtaagcttaatgaaaaagattccatcggagttagaaagtcagacagacgacattacaaactcctcgggaactaccactagtggtatgcacacaggtgaaggagccaaacggaagaaactgttgagaaagccttcaaagaaactgatagcaaatggtatgttacttgtgggcggtgccgttggtggtgcaatctgcctgtctcgtggtcactccgccttaggggcaaaggtcgcgttggcttacttcttgtcgaagatgagaaagcgtggagctcaactgagtcaaacttcccaaaacgctggtatttaagtcatgcatagatttggttttgatgaagcatgtgcaacttacttagattaagcttgtgtgatagggagtgtctgtaaaagtgattaaacgtgtgaatagaaaagttctatttctgcaatgtctctgatcacatgagctctggggtcttcaaagttttgtatacgtgtcgtggaagactttatatttgtgttaatgtgaatgtaaaaacttgtattttacagtcaagcccttgtttttctcaccaaatttcagaccaattgaatgaaattgttgtaatttttgtttgttc

SEQ ID NO: 484 - protein, 1618 aa, Arabidopsis thaliana
  misc_feature: PFam Name: START; PFam Description: START domain
  misc_feature: GI Number: 8778323; NR Description: F14J16.24 [Arabidopsis thaliana] >gi|25406013|pir||G96600 protein F14J16.24 [imported] -
  misc_feature: GI Number: 50908121; NR Description: putative membrane related protein [Oryza sativa (japonica cultivar-group)] >gi|47497322|dbj|BAD19363.1| putative membrane related protein
  misc_feature: GI Number: 18033654; NR Description: putative nodule membrane
  misc_feature: GI Number: 23197608; NR Description: membrane related protein CP5, putative [Arabidopsis thaliana] >gi|22135902|gb|AAM91533.1|
  misc_feature: GI Number: 21593272; NR Description: membrane related
AAAACTAGTCCTAGTCCTAGTCCACGCGCGAATATACAAACGTCTTAAAGCCATTTGATAGAACCGATTTCCAAGGGTTTTGCTCAGAAAAAACACAGAGAGAGATTTTGGAATTCGATGAATAGTGGTGATACCTTATCGACGTTAGCTCAATTTATCTCCTCTTCCGAGAGATTTTTCCGGCGAGCTGACGGTGATGTAGTCTTTTGTTATTGCTGGGCCACCGTGCTCGCACTTGTCTTCATTCTTCTCTACCAATTCTTCCTTTCCCGGAAATTCCGATTCTTCAGTCATGCTTCTTCTTCTTCCCCTGTCGTCTCGGTTTCTCAATCTCTCAGCTCCCAATCAGGAATATCTACTACACTTGTTTCTGATGAAGATCTAAAGGGTCTGATTCAAAAATTGGGGGAAAGAAGTGAGGATGCTGAGATATGGGAAGATGTTATTAAGAAAAGCAACCCTCGTATCTCCTACACTGCTAAATGCTGCAAACCAACAGATGGTAGTCCCATGAAGTATCTGAGTACAACTGTGTTTGAGGATTGCTCCCCAGAGGTTTTGAGGGACTTTTACATGGACAATGAATACAGGAAACAATGGGACAAGACTGTGGTTGAGCATGAGCAATTGCAGGTTGACAGTAATAGTGGGATTGAGATTGGTCGCACTATAAAAAAGTTTCCCTTGTTGACTCCAAGGGAGTATGTATTAGCGTGGAAATTGTGGGAGGGGAAGGATAAGTTTTACTGTTTCATCAAGGAATGTGATCACAATATGGTGCCGCAACAGAGGAAGTATGTACGTGTAAGTTATTTCAGATCTGGTTGGCGAATTAGGAAAGTTCCTGGTAGGAACGCTTGTGAGATACACATGGTTCACCAGGAGGATGCTGGATTAAATGTTGAGATGGCAAAGCTTGCTTTCTCAAGAGGCATATGGAGTTACGTTTGTAAGATGGAAAATGCACTTCGCAAGTACATTGCAACCAGTCATCGACCCCAAGGGCCCACATTATCTGCTGTAAGCTTAATGAAAAAGATTCCATCGGAGTTAGAAAGTCAGACAGACGACATTACAAACTCCTCGGGAACTACCACTAGTGGTATGCACACAGGTGAAGGAGCCAAACGGAAGAAACTGTTGAGAAAGCCTTCAAAGAAACTGATAGCAAATGGTATGTTACTTGTGGGCGGTGCCGTTGGTGGTGCAATCTGCCTGTCTCGTGGTCACTCCGCCTTAGGGGCAAAGGTCGCGTTGGCTTACTTCTTGTCGAAGATGAGAAAGCGTGGAGCTCAACTGAGTCAAACTTCCCAAAACGCTGGTATTTAAGTCATGCATAGATTTGGTTTTGATGAAGCATGTGCAACTTACTTAGATTAAGCTTGTGTGATAGGGAGTGTCTGTAAAAGTGATTAAACGTGTGAATAGAAAAGTTCTATTTCTGCAATGTCTCTGATCACATGAGCTCTGGGGTCTTCAAAGTTTTGTATACGTGTCGTGGAAGACTTTATATTTGTGTTAATGTGAATGTAAAAACTTGTATTTTACAGTCAAGCCCTTGTTTTTCTCACCAAATTTCAGACCAATTGAATGAAATTGTTGTAATTTTTGTTTGTTC

SEQ ID NO: 485 - DNA, 1227 bp, Arabidopsis thaliana
  misc_feature (1)..(1227): Ceres cDNA ID no. 12338983
  misc_feature (1)..(1227): Ceres CLONE  ID no. 12971
  misc_feature (1)..(1227): Also known as  Ceres CDNA ID no. 23372502
atcagattcaagatcagtagtaacaatggagaagccaaagttcaagactgtccaagaggtggttgcagcaggcgaaggaataccggagagatacctccaaccaccagccgtcgacgacaatggtcaacatcttaacgctgccgtgccggtgatggatattccggccatcgatttgagtcttctcctctctccttctgatgacggtcgagaagagttgagtaaacttcactcggcactctctacatggggagttgttcaggtgataaatcatggaattacaaaagcgttgctcgacaagatttacaagctaaccaaggagttctgtgcacttccgtccgaagagaaacaaaagtacgcgagagagattggtagtatccaaggatatggtaacgatatgattctgtgggatgatcaagttcttgattggatcgaccgtttgtatatcactacttaccctgaagatcagagacaacttaagttctggcctgatgtccctgtcggattcagggaaactttacatgaatacacaatgaagcaacatctagtgtttaatcaagtctttaaagcgatggctatatcgttggaattggaagagaattgctttctagacatgtgtggagaaaatgctacgatggatacaagattcaacatgtatcctccatgtccgaggccggacaaggttattggcgttagaccgcacgctgataagtcggctttcactcttctcttgcctgacaaaaatgtcgaagggcttcagttccttaaagatgggaagtggtataaagctccagttgtcgcttcagatacaattctgatcaatgttggagatcagatggagataatgagcaatgggatatacaagagcccggttcatagagtggtgactaatacagaaaaagaaaggatatctgtggcaacgttttgcattccaggtgcagacaaagagattcagcctgttgatgggcttgtgtctgaggcaagaccaagattgtataagccagtaaaaaactatgtggacctcttaaacaagtactatatacagggtcaaagaccaattgcagcgtcattgatctgatcatatttttcaagtctcctttattggtttcacaaatgaatctgtttctttcgttacttgatcctttataagaataataataatgttgctttgtttgttggaatgtgagaatgtaagactgcattgtgttatttgtgttacaattctgagac

SEQ ID NO: 486 - protein, 1227 aa, Arabidopsis thaliana
  misc_feature: PFam Name: 2OG-FeII_Oxy; PFam Description: 2OG-Fe(II)
  misc_feature: GI Number: 5430761; NR Description: Similar to ethylene-forming-enzyme-like dioxygenase [Arabidopsis thaliana] >gi|15222131|ref|NP_175364.1| oxidoreductase, 2OG-Fe(II) oxygenase
  misc_feature: GI Number: 10177262; NR Description: ethylene-forming-enzyme-like dioxygenase [Arabidopsis thaliana] >gi|15239524|ref|NP_200211.1| oxidoreductase, 2OG-Fe(II) oxygenase
  misc_feature: GI Number: 21537316; NR Description: ethylene-forming-enzyme-like dioxygenase-like [Arabidopsis thaliana] >gi|15241383|ref|NP_197555.1| oxidoreductase, 2OG-Fe(II)
  misc_feature: GI Number: 21593366; NR Description: ethylene-forming-enzyme-like dioxygenase-like protein [Arabidopsis
  misc_feature: GI Number: 28827734; NR Description: putative ethylene-forming dioxygenase [Arabidopsis thaliana] >gi|27754538|gb|AAO22716.1| putative ethylene-forming dioxygenase
ATCAGATTCAAGATCAGTAGTAACAATGGAGAAGCCAAAGTTCAAGACTGTCCAAGAGGTGGTTGCAGCAGGCGAAGGAATACCGGAGAGATACCTCCAACCACCAGCCGTCGACGACAATGGTCAACATCTTAACGCTGCCGTGCCGGTGATGGATATTCCGGCCATCGATTTGAGTCTTCTCCTCTCTCCTTCTGATGACGGTCGAGAAGAGTTGAGTAAACTTCACTCGGCACTCTCTACATGGGGAGTTGTTCAGGTGATAAATCATGGAATTACAAAAGCGTTGCTCGACAAGATTTACAAGCTAACCAAGGAGTTCTGTGCACTTCCGTCCGAAGAGAAACAAAAGTACGCGAGAGAGATTGGTAGTATCCAAGGATATGGTAACGATATGATTCTGTGGGATGATCAAGTTCTTGATTGGATCGACCGTTTGTATATCACTACTTACCCTGAAGATCAGAGACAACTTAAGTTCTGGCCTGATGTCCCTGTCGGATTCAGGGAAACTTTACATGAATACACAATGAAGCAACATCTAGTGTTTAATCAAGTCTTTAAAGCGATGGCTATATCGTTGGAATTGGAAGAGAATTGCTTTCTAGACATGTGTGGAGAAAATGCTACGATGGATACAAGATTCAACATGTATCCTCCATGTCCGAGGCCGGACAAGGTTATTGGCGTTAGACCGCACGCTGATAAGTCGGCTTTCACTCTTCTCTTGCCTGACAAAAATGTCGAAGGGCTTCAGTTCCTTAAAGATGGGAAGTGGTATAAAGCTCCAGTTGTCGCTTCAGATACAATTCTGATCAATGTTGGAGATCAGATGGAGATAATGAGCAATGGGATATACAAGAGCCCGGTTCATAGAGTGGTGACTAATACAGAAAAAGAAAGGATATCTGTGGCAACGTTTTGCATTCCAGGTGCAGACAAAGAGATTCAGCCTGTTGATGGGCTTGTGTCTGAGGCAAGACCAAGATTGTATAAGCCAGTAAAAAACTATGTGGACCTCTTAAACAAGTACTATATACAGGGTCAAAGACCAATTGCAGCGTCATTGATCTGATCATATTTTTCAAGTCTCCTTTATTGGTTTCACAAATGAATCTGTTTCTTTCGTTACTTGATCCTTTATAAGAATAATAATAATGTTGCTTTGTTTGTTGGAATGTGAGAATGTAAGACTGCATTGTGTTATTTGTGTTACAATTCTGAGAC

SEQ ID NO: 487 - DNA, 1244 bp, Arabidopsis thaliana
  misc_feature (1)..(1244): Ceres cDNA ID no. 12339383
  misc_feature (1)..(1244): Ceres CLONE  ID no. 12704
  misc_feature (1)..(1244): Also known as  Ceres CDNA ID no. 23372775
actttctcagtctttcttcttcttcttcgttgtgataggtcaggtcagggaacaacaatggcttcttctgcaacagcaccaaattcgctatctttcttctcatcttctctctttttatcctcctctcaccaaatccctaaaacctacatttccgtttcaaaactcggctccggcagagtctcgaagccgctttctgtctcttcccagctagcgactctaccgattctatcattcgaaggagagaaggtcggagagacgtatctagacctcaaagcggcgccggaggataccgcgcgtgccgttgtgcaccgagccatcgtgacggacctgaataacaagcggcgaggtactgcttccacactgactcgcggtgaagttcgtggtggtggaattaaaccttactcacagaagaaaactggccacgcgaggcgtggatctcagagaacaccgttacgtcccggtggaggtgtggtgtttgggccaagacctaaggattggtcaattaaaatcaataggaaggagaagaagctagcgatatctacggcgttatcgagtgcggcatctgcggaaggtggtgcgatagtggtggaggaatttggggagaagtttgagaagcccaagactaaagatttcttagctgcgatgcaaaggtggggattggatcccaaggagaaagctatgttcttgatgattgatgtggatgagaatgtggcgaaatcgagtaggaacattggaaccttgaggatgttgacgcctaggacactgaatctgtttgatattttgaacgctgataagcttgttctgactcctgcggctgtggagttcttgaatgcgaggtacggtgttgatgcggtggaggaagaagatgacgatgaagatgagacggaagggtcagaggaagcttaagaatgagtagcacccgtagttccaattgcttcaagtgtggcttaattatgagtttaatcttgagtacatcttctcactctccttgatgaggtcttctctttcctttttgtgtcacaacaagagaaatgtgtatttacttttagagtttttcttaagagatcatcctcaatttcttgtcatactgattttgtgtccaactctcaatgaaggagtaaggagtgaaattagatatcatgagtaacgttgattgtgtgtgtatcagttaagattgagcaacaaagattgactttagtcatcaagttaacaagaaagagtggctattataagctttaagcgct

SEQ ID NO: 488 - protein, 1244 aa, Arabidopsis thaliana
  misc_feature: PFam Name: Ribosomal_L4; PFam Description: Ribosomal protein
  misc_feature: GI Number: 30680078; NR Description: 50S ribosomal protein
  misc_feature: GI Number: 8778555; NR Description: F22G5.34 [Arabidopsis thaliana] >gi|25294989|pir||D86208 protein F22G5.34 [imported] -
  misc_feature: GI Number: 21537296; NR Description: ribosomal protein L4
  misc_feature: GI Number: 2791998; NR Description: ribosomal protein L4 [Arabidopsis thaliana] >gi|2792000|emb|CAA74894.1| ribosomal
  misc_feature: GI Number: 2792007; NR Description: chloroplast ribosomal protein L4 [Spinacia oleracea] >gi|3914665|sp|O49937|RK4_SPIOL 50S ribosomal protein L4, chloroplast precursor (R-protein L4)
ACTTTCTCAGTCTTTCTTCTTCTTCTTCGTTGTGATAGGTCAGGTCAGGGAACAACAATGGCTTCTTCTGCAACAGCACCAAATTCGCTATCTTTCTTCTCATCTTCTCTCTTTTTATCCTCCTCTCACCAAATCCCTAAAACCTACATTTCCGTTTCAAAACTCGGCTCCGGCAGAGTCTCGAAGCCGCTTTCTGTCTCTTCCCAGCTAGCGACTCTACCGATTCTATCATTCGAAGGAGAGAAGGTCGGAGAGACGTATCTAGACCTCAAAGCGGCGCCGGAGGATACCGCGCGTGCCGTTGTGCACCGAGCCATCGTGACGGACCTGAATAACAAGCGGCGAGGTACTGCTTCCACACTGACTCGCGGTGAAGTTCGTGGTGGTGGAATTAAACCTTACTCACAGAAGAAAACTGGCCACGCGAGGCGTGGATCTCAGAGAACACCGTTACGTCCCGGTGGAGGTGTGGTGTTTGGGCCAAGACCTAAGGATTGGTCAATTAAAATCAATAGGAAGGAGAAGAAGCTAGCGATATCTACGGCGTTATCGAGTGCGGCATCTGCGGAAGGTGGTGCGATAGTGGTGGAGGAATTTGGGGAGAAGTTTGAGAAGCCCAAGACTAAAGATTTCTTAGCTGCGATGCAAAGGTGGGGATTGGATCCCAAGGAGAAAGCTATGTTCTTGATGATTGATGTGGATGAGAATGTGGCGAAATCGAGTAGGAACATTGGAACCTTGAGGATGTTGACGCCTAGGACACTGAATCTGTTTGATATTTTGAACGCTGATAAGCTTGTTCTGACTCCTGCGGCTGTGGAGTTCTTGAATGCGAGGTACGGTGTTGATGCGGTGGAGGAAGAAGATGACGATGAAGATGAGACGGAAGGGTCAGAGGAAGCTTAAGAATGAGTAGCACCCGTAGTTCCAATTGCTTCAAGTGTGGCTTAATTATGAGTTTAATCTTGAGTACATCTTCTCACTCTCCTTGATGAGGTCTTCTCTTTCCTTTTTGTGTCACAACAAGAGAAATGTGTATTTACTTTTAGAGTTTTTCTTAAGAGATCATCCTCAATTTCTTGTCATACTGATTTTGTGTCCAACTCTCAATGAAGGAGTAAGGAGTGAAATTAGATATCATGAGTAACGTTGATTGTGTGTGTATCAGTTAAGATTGAGCAACAAAGATTGACTTTAGTCATCAAGTTAACAAGAAAGAGTGGCTATTATAAGCTTTAAGCGCT

SEQ ID NO: 489 - DNA, 1306 bp, Arabidopsis thaliana
  misc_feature (1)..(1306): Ceres cDNA ID no. 12339414
  misc_feature (1)..(1306): Ceres CLONE  ID no. 121628
  misc_feature (1)..(1306): Also known as  Ceres CDNA ID no. 23372800
atcaacttcagatcctttcaccagcaacacaagttattttcaaaagatgatgccaaattctagatcggcgacaataactccgacgacagaatcaaccaccacaacaacaacaacaacaacgactctaacgacgtcgtattggtgttacagttgtacacgattcatcagcgtttgggaagatcaagacgcaaacgctggagtcttatgtccttattgcaacggtggattcatcgaagagattgaagattcttctaattccaccgtcgcggcgattccggcttcgactccggaagttagatcggttgaggaaacacatagatctataattagacgtcgtagatctaatcgccggacgtcctttaatccggtaatcgtcttacacggcggaggaggaggaggagccggtgagagagttgagaacgaagaaggtgacggagctactagagaacgacgagcttatgagttttattacgatgatggatctggttcaggtctaagacctcttcctgattctgtatctgagatcttgatgggatctggattcgaacggttacttgaacaattgagtcagatcgaagcgtcaggtaacggaatcggtagatctgggaatccaccggcgtcgaaatcagcgattgaatctttacctagagtcgaaatctcagattgtcatacgaaagcagaagctaattgcgccgtgtgtacggaggttttcgaagccggaatcgaaggtcgtgagatgccgtgtaaacacatatttcacggtgattgtattgttccatggctttcgattcggaattcgtgtcctgtgtgtagatttgagttaccttcagatccaatccaacggagtaatgaagaagaacatgccgttgggatgacgatttggagattacctggtggtggtttcgctgttggtaggtttaacgcgggagtgagagaaggtgagaggatattgccggtggtattgacggagatggatggtggtggacttggtagtaatgaaggaccgagaaggatatcttgggttagagctcatgagacaccggagatgagtaggaatggtggtcgttctggtaatggtggtagattgagaagagctgttcgtggaatggtttcgtttatgagaagagttagaccaagtcgtggctcttcgaattcgaatgttattgatttggatagtgatggtgaaactagagttatgaatcgatcaacttcgttgatcagaagatttttctgatgaaactaggtgagatttttttgtttgttgattcaacaatgtatatatatttatttagatgaacttatttgg

SEQ ID NO: 490 - protein, 1306 aa, Arabidopsis thaliana
  misc_feature: GI Number: 17380612; NR Description: AT5g59550/f2o15_210 [Arabidopsis thaliana] >gi|15450687|gb|AAK96615.1| AT5g59550/f2o15_210 [Arabidopsis thaliana] >gi|18424254|ref|NP_568910.1| zinc finger (C3HC4-type RING
  misc_feature: GI Number: 50949043; NR Description: putative RING-H2 finger protein [Oryza sativa] >gi|14719329|gb|AAK73147.1| putative RING-H2
  misc_feature: GI Number: 52353630; NR Description: putative ring-H2 finger
ATCAACTTCAGATCCTTTCACCAGCAACACAAGTTATTTTCAAAAGATGATGCCAAATTCTAGATCGGCGACAATAACTCCGACGACAGAATCAACCACCACAACAACAACAACAACAACGACTCTAACGACGTCGTATTGGTGTTACAGTTGTACACGATTCATCAGCGTTTGGGAAGATCAAGACGCAAACGCTGGAGTCTTATGTCCTTATTGCAACGGTGGATTCATCGAAGAGATTGAAGATTCTTCTAATTCCACCGTCGCGGCGATTCCGGCTTCGACTCCGGAAGTTAGATCGGTTGAGGAAACACATAGATCTATAATTAGACGTCGTAGATCTAATCGCCGGACGTCCTTTAATCCGGTAATCGTCTTACACGGCGGAGGAGGAGGAGGAGCCGGTGAGAGAGTTGAGAACGAAGAAGGTGACGGAGCTACTAGAGAACGACGAGCTTATGAGTTTTATTACGATGATGGATCTGGTTCAGGTCTAAGACCTCTTCCTGATTCTGTATCTGAGATCTTGATGGGATCTGGATTCGAACGGTTACTTGAACAATTGAGTCAGATCGAAGCGTCAGGTAACGGAATCGGTAGATCTGGGAATCCACCGGCGTCGAAATCAGCGATTGAATCTTTACCTAGAGTCGAAATCTCAGATTGTCATACGAAAGCAGAAGCTAATTGCGCCGTGTGTACGGAGGTTTTCGAAGCCGGAATCGAAGGTCGTGAGATGCCGTGTAAACACATATTTCACGGTGATTGTATTGTTCCATGGCTTTCGATTCGGAATTCGTGTCCTGTGTGTAGATTTGAGTTACCTTCAGATCCAATCCAACGGAGTAATGAAGAAGAACATGCCGTTGGGATGACGATTTGGAGATTACCTGGTGGTGGTTTCGCTGTTGGTAGGTTTAACGCGGGAGTGAGAGAAGGTGAGAGGATATTGCCGGTGGTATTGACGGAGATGGATGGTGGTGGACTTGGTAGTAATGAAGGACCGAGAAGGATATCTTGGGTTAGAGCTCATGAGACACCGGAGATGAGTAGGAATGGTGGTCGTTCTGGTAATGGTGGTAGATTGAGAAGAGCTGTTCGTGGAATGGTTTCGTTTATGAGAAGAGTTAGACCAAGTCGTGGCTCTTCGAATTCGAATGTTATTGATTTGGATAGTGATGGTGAAACTAGAGTTATGAATCGATCAACTTCGTTGATCAGAAGATTTTTCTGATGAAACTAGGTGAGATTTTTTTGTTTGTTGATTCAACAATGTATATATATTTATTTAGATGAACTTATTTGG

SEQ ID NO: 491 - DNA, 1143 bp, Arabidopsis thaliana
  misc_feature (1)..(1143): Ceres cDNA ID no. 12339577
  misc_feature (1)..(1143): Ceres CLONE  ID no. 231432
  misc_feature (1)..(1143): Also known as  Ceres CDNA ID no. 23372910
gagaccaacacgaaaccgacgataggaacgccggtgaacgaagcaatgcttgggctttcttacggtgagctcttactcatcgtcggcgccacagctgctcttgtaggacccaaggatcttccgattattgctagagcaggaggaagattattcggacgagccattggttacatcaatatggctcgtggtcacttggatggtgtcatgaaacaacctcagatgcaagagatatcgaaagaagttcaagatttacgagcacaagtagatgcgattagccatggagcaagattttctctatttgattctagtcctttgactcgaagagtggataaccaaaaaactcaagaacctagtccaagcaccaccaatgggattgttacatccgttaatgttgaagaaaaacagaagcctgtagatcattatacaaaggctcaagaatttagtggctcgtcgtcagcttctgttaacctgcacgctcaagcaacatcatttgcacgattatctgagacagtcaatggaaaaactcacagtctaaacagtgattcacctgttcttccagtatcagctgagatggcaaagttgcttcctcaacgcaaagagagtgcaagaggatctgatttaatgttagaggcggttcttgaagcggaagtagcacacaaggcgaaaagctttttcgcacaagccgagaaagaaactccagctttgaaagggaagtttttcagtgacaggaaaggagaaaattgaactcaaaagttttggggaccatcatcgatcacaagacaccggcaaggtacaaaagagtaggccttgttatttaactgttttttttttttatgttcgatgagccaagaatctgagggacctttgtttctgatgcggcaacaagtgagctaaacttggagcgaagtcagttcactctttcatcttgtaattaatgcttccgctttataggtttaggttttgttgtttacttcggaggtttagtgtgagttggatttgcatagagttggttgggtttttttaaagagtagagatctattaaattttataaaattttgtgtatttttacaagtgtagttataaaaatccaatggacatccatggttttctcaaagttttcctttataaaagaaaattaaggtt

SEQ ID NO: 492 - protein, 1143 aa, Arabidopsis thaliana
  misc_feature: PFam Name: MttA_Hcf106; PFam Description: mttA/Hcf106 family
GAGACCAACACGAAACCGACGATAGGAACGCCGGTGAACGAAGCAATGCTTGGGCTTTCTTACGGTGAGCTCTTACTCATCGTCGGCGCCACAGCTGCTCTTGTAGGACCCAAGGATCTTCCGATTATTGCTAGAGCAGGAGGAAGATTATTCGGACGAGCCATTGGTTACATCAATATGGCTCGTGGTCACTTGGATGGTGTCATGAAACAACCTCAGATGCAAGAGATATCGAAAGAAGTTCAAGATTTACGAGCACAAGTAGATGCGATTAGCCATGGAGCAAGATTTTCTCTATTTGATTCTAGTCCTTTGACTCGAAGAGTGGATAACCAAAAAACTCAAGAACCTAGTCCAAGCACCACCAATGGGATTGTTACATCCGTTAATGTTGAAGAAAAACAGAAGCCTGTAGATCATTATACAAAGGCTCAAGAATTTAGTGGCTCGTCGTCAGCTTCTGTTAACCTGCACGCTCAAGCAACATCATTTGCACGATTATCTGAGACAGTCAATGGAAAAACTCACAGTCTAAACAGTGATTCACCTGTTCTTCCAGTATCAGCTGAGATGGCAAAGTTGCTTCCTCAACGCAAAGAGAGTGCAAGAGGATCTGATTTAATGTTAGAGGCGGTTCTTGAAGCGGAAGTAGCACACAAGGCGAAAAGCTTTTTCGCACAAGCCGAGAAAGAAACTCCAGCTTTGAAAGGGAAGTTTTTCAGTGACAGGAAAGGAGAAAATTGAACTCAAAAGTTTTGGGGACCATCATCGATCACAAGACACCGGCAAGGTACAAAAGAGTAGGCCTTGTTATTTAACTGTTTTTTTTTTTTATGTTCGATGAGCCAAGAATCTGAGGGACCTTTGTTTCTGATGCGGCAACAAGTGAGCTAAACTTGGAGCGAAGTCAGTTCACTCTTTCATCTTGTAATTAATGCTTCCGCTTTATAGGTTTAGGTTTTGTTGTTTACTTCGGAGGTTTAGTGTGAGTTGGATTTGCATAGAGTTGGTTGGGTTTTTTTAAAGAGTAGAGATCTATTAAATTTTATAAAATTTTGTGTATTTTTACAAGTGTAGTTATAAAAATCCAATGGACATCCATGGTTTTCTCAAAGTTTTCCTTTATAAAAGAAAATTAAGGTT

SEQ ID NO: 493 - DNA, 1507 bp, Arabidopsis thaliana
  misc_feature (1)..(1507): Ceres cDNA ID no. 12339912
  misc_feature (1)..(1507): Ceres CLONE  ID no. 39404
  misc_feature (1)..(1507): Also known as  Ceres CDNA ID no. 23373168
atgtcgaatctgttggctctcgtcgtcggattcgtaatcgtaattggtcatttgggtattttggtaaatgggttgggtgtgaattggggaacaatggctacacataagctacctccaaagacagtggttcagatgcttaaagacaataacatcaacaaagttaagctttttgatgcggacgagacaaccatgggtgcactcgctggatcgggtcttgaagtgatggtcgctattcccaatgatcagcttaaggttatgactagttacgaccgagccaaagattgggttcgtaagaatgtcactcgttataacttcgatggtggtgtcaatatcacgtttgtagctgttgggaatgagccattcctcaaatcatacaatggatcgttcataaacctcacattccctgcacttgcgaacattcaaaacgctttaaatgaagccggactaggaaactctgtcaaagcaacagtccctttaaacgcggatgtatacgattcaccagcaagcaatcccgttccatctgcaggaagattccgtcccgatatcatcggtcaaatgactcagattgttgactttcttggcaagaacaatgctcccatcacaattaacatctaccctttcttaagtctctatgggaatgatgatttcccactcaactacgccttcttcgatggtgctgaaccgataaacgacaacggtattgattatacaaacgttttcgatgccaatttcgatactttggtgtcgtctttgaaagctgttggtcacggagatatgccaataatcgttggagaagttggttggccaacagagggtgacaaacacgctaatgcaggcagtgcttacagattctacaacgggcttttaccgaggcttggaacaaacaaaggaactccattgagaccaacctacattgaggtatacttgttcggattactcgacgaggatgcaaaaagtatagcaccgggaccgttcgaacgccattggggaatatttaaattcgacgggcaaccaaagtttcctatagatctttcaggtcaaggacagagtaagttcttgattggtgcacaaaacgtgccgtatctacccaacaagtggtgtacgtttaatccagaagccaaggacttgacaaaactcgcggctaatatagattacgcctgcactttctctgattgcacggcgcttggatacggatcttcttgcaatactcttgatgcaaatggaaacgcgtcgtatgcgtttaacatgttctttcaagtgaagaatcaagatgagagtgcttgctattttcaaggtttggccaccattacaacgcagaatatatctcaaggacaatgcaatttccctattcagattgtggcttcctcagcctcttctttttcttgttcgtcttattctttggttgtgttgatcgtttggtttctgttatcagggatgatgttttgaggttagattgaacttgttgaacttagtgagattttgtgagcctaattgttttcttacacat

SEQ ID NO: 494 - protein, 1507 aa, Arabidopsis thaliana
  misc_feature: PFam Name: Glyco_hydro_17; PFam Description: Glycosyl
  misc_feature: PFam Name: X8; PFam Description: X8 domain
  misc_feature: GI Number: 46518473; NR Description: At1g64760 [Arabidopsis
  misc_feature: GI Number: 37223500; NR Description: beta-1,3-glucanase,
  misc_feature: GI Number: 9758904; NR Description: beta-1,3-glucanase-like protein [Arabidopsis thaliana] >gi|15238768|ref|NP_197323.1|
  misc_feature: GI Number: 48374979; NR Description: putative 3-glucanase
  misc_feature: GI Number: 50919115; NR Description: putative beta-1,3 glucanase [Oryza sativa (japonica cultivar-group)] >gi|28269434|gb|AAO37977.1| putative beta-1,3 glucanase [Oryza
ATGTCGAATCTGTTGGCTCTCGTCGTCGGATTCGTAATCGTAATTGGTCATTTGGGTATTTTGGTAAATGGGTTGGGTGTGAATTGGGGAACAATGGCTACACATAAGCTACCTCCAAAGACAGTGGTTCAGATGCTTAAAGACAATAACATCAACAAAGTTAAGCTTTTTGATGCGGACGAGACAACCATGGGTGCACTCGCTGGATCGGGTCTTGAAGTGATGGTCGCTATTCCCAATGATCAGCTTAAGGTTATGACTAGTTACGACCGAGCCAAAGATTGGGTTCGTAAGAATGTCACTCGTTATAACTTCGATGGTGGTGTCAATATCACGTTTGTAGCTGTTGGGAATGAGCCATTCCTCAAATCATACAATGGATCGTTCATAAACCTCACATTCCCTGCACTTGCGAACATTCAAAACGCTTTAAATGAAGCCGGACTAGGAAACTCTGTCAAAGCAACAGTCCCTTTAAACGCGGATGTATACGATTCACCAGCAAGCAATCCCGTTCCATCTGCAGGAAGATTCCGTCCCGATATCATCGGTCAAATGACTCAGATTGTTGACTTTCTTGGCAAGAACAATGCTCCCATCACAATTAACATCTACCCTTTCTTAAGTCTCTATGGGAATGATGATTTCCCACTCAACTACGCCTTCTTCGATGGTGCTGAACCGATAAACGACAACGGTATTGATTATACAAACGTTTTCGATGCCAATTTCGATACTTTGGTGTCGTCTTTGAAAGCTGTTGGTCACGGAGATATGCCAATAATCGTTGGAGAAGTTGGTTGGCCAACAGAGGGTGACAAACACGCTAATGCAGGCAGTGCTTACAGATTCTACAACGGGCTTTTACCGAGGCTTGGAACAAACAAAGGAACTCCATTGAGACCAACCTACATTGAGGTATACTTGTTCGGATTACTCGACGAGGATGCAAAAAGTATAGCACCGGGACCGTTCGAACGCCATTGGGGAATATTTAAATTCGACGGGCAACCAAAGTTTCCTATAGATCTTTCAGGTCAAGGACAGAGTAAGTTCTTGATTGGTGCACAAAACGTGCCGTATCTACCCAACAAGTGGTGTACGTTTAATCCAGAAGCCAAGGACTTGACAAAACTCGCGGCTAATATAGATTACGCCTGCACTTTCTCTGATTGCACGGCGCTTGGATACGGATCTTCTTGCAATACTCTTGATGCAAATGGAAACGCGTCGTATGCGTTTAACATGTTCTTTCAAGTGAAGAATCAAGATGAGAGTGCTTGCTATTTTCAAGGTTTGGCCACCATTACAACGCAGAATATATCTCAAGGACAATGCAATTTCCCTATTCAGATTGTGGCTTCCTCAGCCTCTTCTTTTTCTTGTTCGTCTTATTCTTTGGTTGTGTTGATCGTTTGGTTTCTGTTATCAGGGATGATGTTTTGAGGTTAGATTGAACTTGTTGAACTTAGTGAGATTTTGTGAGCCTAATTGTTTTCTTACACAT

SEQ ID NO: 495 - DNA, 1097 bp, Arabidopsis thaliana
  misc_feature (1)..(1097): Ceres cDNA ID no. 12340203
  misc_feature (1)..(1097): Ceres CLONE  ID no. 30652
  misc_feature (1)..(1097): Also known as  Ceres CDNA ID no. 23373441
gcattaactgatttcacattcttcgataaggattttactctccaaagaaagaaaaaaaaacctcctctgcttttgtgatcctttaaggaaaaagacgaaatggcaacggaatcgtacgaagccgccattaaaggactcaatgatcttctcagtacgaaagcggatctcggaaacgtcgccgccgcgaagatcaaagcgttgacggcggagctaaaggagcttgactcaagcaattcagacgcaattgaacgaatcaagaccggttttactcaattcaaaaccgagaaatatttgaagaatagtactttgttcaatcatcttgccaagactcagaccccaaagtttctggtgtttgcttgctctgattctcgagtttgtccatctcacatcttgaatttccaacctggtgaggcttttgttgtcagaaacatagccaatatggttccaccttttgaccagaagagacactctggagttggcgccgccgttgaatacgcagttgtacatctcaaggtggagaacattttggtgataggccatagctgctgtggtggtattaagggactcatgtccattgaagatgatgctgccccaactcaaagtgacttcattgaaaattgggtgaagataggcgcatcagcgaggaacaagatcaaggaggaacataaagacttgagctacgatgatcaatgcaacaagtgtgagaaggaagctgtgaacgtatcgcttggaaacttgctttcgtacccattcgtgagagctgaggtggtgaagaacacacttgcaataagaggaggtcactacaatttcgtcaaaggaacgtttgatctctgggagctcgatttcaagaccactcctgcttttgccttctcttaagaaagaaagctaccggaacatataaaactcttttgagataaaaaaagacactttgactcatctttcttcattctctcatgttgatgattcctctccaacttctttgatttctttttgttaattcaaaacttcaactttgctgcttctatttcaaaagctcaaacaataaagctgtaaccaacgtttgaaacttctatatttgtctaattgatgtttgaacc

SEQ ID NO: 496 - protein, 1097 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
GCATTAACTGATTTCACATTCTTCGATAAGGATTTTACTCTCCAAAGAAAGAAAAAAAAACCTCCTCTGCTTTTGTGATCCTTTAAGGAAAAAGACGAAATGGCAACGGAATCGTACGAAGCCGCCATTAAAGGACTCAATGATCTTCTCAGTACGAAAGCGGATCTCGGAAACGTCGCCGCCGCGAAGATCAAAGCGTTGACGGCGGAGCTAAAGGAGCTTGACTCAAGCAATTCAGACGCAATTGAACGAATCAAGACCGGTTTTACTCAATTCAAAACCGAGAAATATTTGAAGAATAGTACTTTGTTCAATCATCTTGCCAAGACTCAGACCCCAAAGTTTCTGGTGTTTGCTTGCTCTGATTCTCGAGTTTGTCCATCTCACATCTTGAATTTCCAACCTGGTGAGGCTTTTGTTGTCAGAAACATAGCCAATATGGTTCCACCTTTTGACCAGAAGAGACACTCTGGAGTTGGCGCCGCCGTTGAATACGCAGTTGTACATCTCAAGGTGGAGAACATTTTGGTGATAGGCCATAGCTGCTGTGGTGGTATTAAGGGACTCATGTCCATTGAAGATGATGCTGCCCCAACTCAAAGTGACTTCATTGAAAATTGGGTGAAGATAGGCGCATCAGCGAGGAACAAGATCAAGGAGGAACATAAAGACTTGAGCTACGATGATCAATGCAACAAGTGTGAGAAGGAAGCTGTGAACGTATCGCTTGGAAACTTGCTTTCGTACCCATTCGTGAGAGCTGAGGTGGTGAAGAACACACTTGCAATAAGAGGAGGTCACTACAATTTCGTCAAAGGAACGTTTGATCTCTGGGAGCTCGATTTCAAGACCACTCCTGCTTTTGCCTTCTCTTAAGAAAGAAAGCTACCGGAACATATAAAACTCTTTTGAGATAAAAAAAGACACTTTGACTCATCTTTCTTCATTCTCTCATGTTGATGATTCCTCTCCAACTTCTTTGATTTCTTTTTGTTAATTCAAAACTTCAACTTTGCTGCTTCTATTTCAAAAGCTCAAACAATAAAGCTGTAACCAACGTTTGAAACTTCTATATTTGTCTAATTGATGTTTGAACC

SEQ ID NO: 497 - DNA, 1218 bp, Arabidopsis thaliana
  misc_feature (1)..(1218): Ceres cDNA ID no. 12340206
  misc_feature (1)..(1218): Ceres CLONE  ID no. 38715
  misc_feature (1)..(1218): Also known as  Ceres CDNA ID no. 23557350
acttatttcaattcccaaaatcctctgcctcatcatcttcaaactgttaccacgtccatagggttgtcgaagagctaggaagagccttaccaagagcttcttcttcccctaacatttaggttggtaggagaagcaaaggaagagatcatttataatggctcctgcattcggaaaatgtttcatgttctgctgcgctaaaacctccccggaaaaagacgaaatggcaacggaatcgtacgaagccgccattaaaggactcaatgatcttctcagtacgaaagcggatctcggaaacgtcgccgccgcgaagatcaaagcgttgacggcggagctaaaggagcttgactcaagcaattcagacgcaattgaacgaatcaagaccggttttactcaattcaaaaccgagaaatatttgaagaatagtactttgttcaatcatcttgccaagactcagaccccaaagtttctggtgtttgcttgctctgattctcgagtttgtccatctcacatcttgaatttccaacctggtgaggcttttgttgtcagaaacatagccaatatggttccaccttttgaccagaagagacactctggagttggcgccgccgttgaatacgcagttgtacatctcaaggtggagaacattttggtgataggccatagctgctgtggtggtattaagggactcatgtccattgaagatgatgctgccccaactcaaagtgacttcattgaaaattgggtgaagataggcgcatcagcgaggaacaagatcaaggaggaacataaagacttgagctacgatgatcaatgcaacaagtgtgagaaggaagctgtgaacgtatcgcttggaaacttgctttcgtacccattcgtgagagctgaggtggtgaagaacacacttgcaataagaggaggtcactacaatttcgtcaaaggaacgtttgatctctgggagctcgatttcaagaccactcctgcttttgccttctcttaagaaagaaagctaccggaacatataaaactcttttgagataaaaaaagacactttgactcatctttcttcattctctcatgttgatgattcctctccaacttctttgatttctttttgttaattcaaaacttcaactttgctgcttctatttcaaaagctcaaacaataaagctgtaaccaacgtttgaaacttctatatttgtctaattgatgtttgaacc

SEQ ID NO: 498 - protein, 1218 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
ACTTATTTCAATTCCCAAAATCCTCTGCCTCATCATCTTCAAACTGTTACCACGTCCATAGGGTTGTCGAAGAGCTAGGAAGAGCCTTACCAAGAGCTTCTTCTTCCCCTAACATTTAGGTTGGTAGGAGAAGCAAAGGAAGAGATCATTTATAATGGCTCCTGCATTCGGAAAATGTTTCATGTTCTGCTGCGCTAAAACCTCCCCGGAAAAAGACGAAATGGCAACGGAATCGTACGAAGCCGCCATTAAAGGACTCAATGATCTTCTCAGTACGAAAGCGGATCTCGGAAACGTCGCCGCCGCGAAGATCAAAGCGTTGACGGCGGAGCTAAAGGAGCTTGACTCAAGCAATTCAGACGCAATTGAACGAATCAAGACCGGTTTTACTCAATTCAAAACCGAGAAATATTTGAAGAATAGTACTTTGTTCAATCATCTTGCCAAGACTCAGACCCCAAAGTTTCTGGTGTTTGCTTGCTCTGATTCTCGAGTTTGTCCATCTCACATCTTGAATTTCCAACCTGGTGAGGCTTTTGTTGTCAGAAACATAGCCAATATGGTTCCACCTTTTGACCAGAAGAGACACTCTGGAGTTGGCGCCGCCGTTGAATACGCAGTTGTACATCTCAAGGTGGAGAACATTTTGGTGATAGGCCATAGCTGCTGTGGTGGTATTAAGGGACTCATGTCCATTGAAGATGATGCTGCCCCAACTCAAAGTGACTTCATTGAAAATTGGGTGAAGATAGGCGCATCAGCGAGGAACAAGATCAAGGAGGAACATAAAGACTTGAGCTACGATGATCAATGCAACAAGTGTGAGAAGGAAGCTGTGAACGTATCGCTTGGAAACTTGCTTTCGTACCCATTCGTGAGAGCTGAGGTGGTGAAGAACACACTTGCAATAAGAGGAGGTCACTACAATTTCGTCAAAGGAACGTTTGATCTCTGGGAGCTCGATTTCAAGACCACTCCTGCTTTTGCCTTCTCTTAAGAAAGAAAGCTACCGGAACATATAAAACTCTTTTGAGATAAAAAAAGACACTTTGACTCATCTTTCTTCATTCTCTCATGTTGATGATTCCTCTCCAACTTCTTTGATTTCTTTTTGTTAATTCAAAACTTCAACTTTGCTGCTTCTATTTCAAAAGCTCAAACAATAAAGCTGTAACCAACGTTTGAAACTTCTATATTTGTCTAATTGATGTTTGAACC

SEQ ID NO: 499 - DNA, 1153 bp, Arabidopsis thaliana
  misc_feature (1)..(1153): Ceres cDNA ID no. 12340272
  misc_feature (1)..(1153): Ceres CLONE  ID no. 39827
  misc_feature (1)..(1153): Also known as  Ceres CDNA ID no. 23373501
aatcatccgcggttcacttccttcgtttcgaaattattagggttactgcgtatttgcactctccttcttcgtctctccagcttgacaatgcctcgctatgatgatcgctatggaaacactcgcctctatgttggtcgcttatcatctagaactcgtaccagagaccttgagcgtctctttagcagatacggaagagtacgagatgtggatatgaagcgtgattatgcctttgttgaatttagtgatcctcgtgatgctgatgacgcaagatattacttggatggacgggatttcgatggaagtcgcatcactgtggaggcatcaagaggggctcctcgtggttcgcgggacaatggtagcagaggcccacctcctggttctggtcgctgttttaattgtggtgtcgatggccactgggcccgagactgcacagcaggagactggaagaataaatgttaccgctgtggtgaaagaggacacattgagagaaactgcaaaaacagtcctagtccaaagaaggccaggcagggtggaagctattccaggtcaccagtcaaatcccgctcccctcgtcgccgaaggagcccaagccgtagccgtagttacagtcgaggtcgcagctacagtcgatcgcgatccccagtgagaagagagaaaagcgtggaggacagatcacgcagtcctaaggcaatggagcgatctgtatctcccaaaggtagggaccaaagcctgagtccagaccgaaaagtgatagatgcaagcccaaagcgtggatcagactatgatggtagcccaaaagagaatggtaatggcaggaactctgcgagtcccattgttggaggtggtgaaagtcctgttggacttaatggtcaagacaggagcccgattgatgatgaggctgagcttagccgtcgttcccctaaaggcagtgagtcaccttgatggttcacaggttaaaagctctatgtagcattctgtactgaaggatgttgtttcctttccctttctttctgcgtgatacttttcttttcgttgcgtgacaatcctggatgttactttgccttctctcttgatgactcttggtttgttttccgacaactttcaaactctgcgatgttacttttcattgtttagtaagaatcatgcatttacg

SEQ ID NO: 500 - protein, 1153 aa, Arabidopsis thaliana
  misc_feature: PFam Name: RRM_1; PFam Description: RNA recognition motif.
  misc_feature: PFam Name: zf-CCHC; PFam Description: Zinc knuckle
  misc_feature: GI Number: 24111329; NR Description: At3g53500/F4P12_200 [Arabidopsis thaliana] >gi|20465265|gb|AAM19952.1| AT3g53500/F4P12_200 [Arabidopsis thaliana] >gi|30693836|ref|NP_851015.1| zinc knuckle (CCHC-type) family
  misc_feature: GI Number: 9795142; NR Description: splicing factor-like protein [Arabidopsis thaliana] >gi|30693839|ref|NP_190918.3| zinc
  misc_feature: GI Number: 11346381; NR Description: splicing factor-like
  misc_feature: GI Number: 9843663; NR Description: splicing factor RSZ33
  misc_feature: GI Number: 42571091; NR Description: splicing factor RSZ33
AATCATCCGCGGTTCACTTCCTTCGTTTCGAAATTATTAGGGTTACTGCGTATTTGCACTCTCCTTCTTCGTCTCTCCAGCTTGACAATGCCTCGCTATGATGATCGCTATGGAAACACTCGCCTCTATGTTGGTCGCTTATCATCTAGAACTCGTACCAGAGACCTTGAGCGTCTCTTTAGCAGATACGGAAGAGTACGAGATGTGGATATGAAGCGTGATTATGCCTTTGTTGAATTTAGTGATCCTCGTGATGCTGATGACGCAAGATATTACTTGGATGGACGGGATTTCGATGGAAGTCGCATCACTGTGGAGGCATCAAGAGGGGCTCCTCGTGGTTCGCGGGACAATGGTAGCAGAGGCCCACCTCCTGGTTCTGGTCGCTGTTTTAATTGTGGTGTCGATGGCCACTGGGCCCGAGACTGCACAGCAGGAGACTGGAAGAATAAATGTTACCGCTGTGGTGAAAGAGGACACATTGAGAGAAACTGCAAAAACAGTCCTAGTCCAAAGAAGGCCAGGCAGGGTGGAAGCTATTCCAGGTCACCAGTCAAATCCCGCTCCCCTCGTCGCCGAAGGAGCCCAAGCCGTAGCCGTAGTTACAGTCGAGGTCGCAGCTACAGTCGATCGCGATCCCCAGTGAGAAGAGAGAAAAGCGTGGAGGACAGATCACGCAGTCCTAAGGCAATGGAGCGATCTGTATCTCCCAAAGGTAGGGACCAAAGCCTGAGTCCAGACCGAAAAGTGATAGATGCAAGCCCAAAGCGTGGATCAGACTATGATGGTAGCCCAAAAGAGAATGGTAATGGCAGGAACTCTGCGAGTCCCATTGTTGGAGGTGGTGAAAGTCCTGTTGGACTTAATGGTCAAGACAGGAGCCCGATTGATGATGAGGCTGAGCTTAGCCGTCGTTCCCCTAAAGGCAGTGAGTCACCTTGATGGTTCACAGGTTAAAAGCTCTATGTAGCATTCTGTACTGAAGGATGTTGTTTCCTTTCCCTTTCTTTCTGCGTGATACTTTTCTTTTCGTTGCGTGACAATCCTGGATGTTACTTTGCCTTCTCTCTTGATGACTCTTGGTTTGTTTTCCGACAACTTTCAAACTCTGCGATGTTACTTTTCATTGTTTAGTAAGAATCATGCATTTACG

SEQ ID NO: 501 - DNA, 1293 bp, Arabidopsis thaliana
  misc_feature (1)..(1293): Ceres cDNA ID no. 12340507
  misc_feature (1)..(1293): Ceres CLONE  ID no. 41359
  misc_feature (1)..(1293): Also known as  Ceres CDNA ID no. 23373592
agtttcaatcaaattctgttttcttcatctccacaaagataactaaatccgatctcgtcttcgcaatcatcaaccatcaatggaagttgaagaagaagttaaacaaatcatagatgaggtcaaagagcttcatgactccgccgcttctttcatctcatcttcttctcaacaagagctctctctccgtcaaaaagcctccgccgttgattcctctatccgtcgtctccactctactatcgtctccaacaaaaatctcgatcctaagctcgtcgaaaagcttgaggaagatctgcatcgtgctagatgcatgcttgttgacggagaaacatcttcatttctcccatccaaaccacaaggacgctttgtgagaatgttttgtggacctgtgaatgttcgagctttgcgtaaagatgttcagcttaaagttaaagaagaatacaatcgttacagagacaagactgctcttctttttctttttttccctgccacacttttaatccttaggtcttattattggggtggatgtttgcctgcgtttcctgtccagctctatgaggcttggctgttgtttctctatgctgggttggctatgcgtgagaatatattaagagctaacggaagcgatattcgtccatggtggctatatcatcattattgtgccatggctatggcccttgtcagcctcacatgggaaatcaaaggtcaaccaaactgtgtccagaaacagagaggagtccatcttttcctacaatgggctatgatgcaaggtgtcgccatgcttttacaaaacagatatcaacgccaaagattatacactcgcattgcactaggaaaggctaagagaatggatgttgtttggggagaaacggctggagttgatggacaactatggctgttatgtcctatactgttcattttacaggtgtttgaagcatacgttggactgctgttgctaagaaaaacagtaactggagttgttaatgaatggcaggtgatggtttgtgggattcttctggtagtgatggcagttgggaacttcataaatacagtagagacactgatggcaaagtcaagagttaaggcaaagatgaagagaagtaaaagcagagcagagcttaattagacttcacaggtctctcatctgttcaaaatcttgctttttttgcagttcataaatttttgtcctttttgtttttaggccacggataaaataaaactgtgaccatcctttttctgtgtaaatggaagtggcagttgatatttgataattgatgttgtatttgtacaattttc

SEQ ID NO: 502 - protein, 1293 aa, Arabidopsis thaliana
  misc_feature: PFam Name: TMPIT; PFam Description: TMPIT-like protein
  misc_feature: GI Number: 30354641; NR Description: Transmembrane protein
  misc_feature: GI Number: 13994300; NR Description: transmembrane protein induced by tumor necrosis factor alpha [Homo sapiens] >gi|13241761|gb|AAK16442.1| transmembrane protein induced by tumor
  misc_feature: GI Number: 34871732; NR Description: similar to transmembrane
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 52354734; NR Description: Unknown (protein for
AGTTTCAATCAAATTCTGTTTTCTTCATCTCCACAAAGATAACTAAATCCGATCTCGTCTTCGCAATCATCAACCATCAATGGAAGTTGAAGAAGAAGTTAAACAAATCATAGATGAGGTCAAAGAGCTTCATGACTCCGCCGCTTCTTTCATCTCATCTTCTTCTCAACAAGAGCTCTCTCTCCGTCAAAAAGCCTCCGCCGTTGATTCCTCTATCCGTCGTCTCCACTCTACTATCGTCTCCAACAAAAATCTCGATCCTAAGCTCGTCGAAAAGCTTGAGGAAGATCTGCATCGTGCTAGATGCATGCTTGTTGACGGAGAAACATCTTCATTTCTCCCATCCAAACCACAAGGACGCTTTGTGAGAATGTTTTGTGGACCTGTGAATGTTCGAGCTTTGCGTAAAGATGTTCAGCTTAAAGTTAAAGAAGAATACAATCGTTACAGAGACAAGACTGCTCTTCTTTTTCTTTTTTTCCCTGCCACACTTTTAATCCTTAGGTCTTATTATTGGGGTGGATGTTTGCCTGCGTTTCCTGTCCAGCTCTATGAGGCTTGGCTGTTGTTTCTCTATGCTGGGTTGGCTATGCGTGAGAATATATTAAGAGCTAACGGAAGCGATATTCGTCCATGGTGGCTATATCATCATTATTGTGCCATGGCTATGGCCCTTGTCAGCCTCACATGGGAAATCAAAGGTCAACCAAACTGTGTCCAGAAACAGAGAGGAGTCCATCTTTTCCTACAATGGGCTATGATGCAAGGTGTCGCCATGCTTTTACAAAACAGATATCAACGCCAAAGATTATACACTCGCATTGCACTAGGAAAGGCTAAGAGAATGGATGTTGTTTGGGGAGAAACGGCTGGAGTTGATGGACAACTATGGCTGTTATGTCCTATACTGTTCATTTTACAGGTGTTTGAAGCATACGTTGGACTGCTGTTGCTAAGAAAAACAGTAACTGGAGTTGTTAATGAATGGCAGGTGATGGTTTGTGGGATTCTTCTGGTAGTGATGGCAGTTGGGAACTTCATAAATACAGTAGAGACACTGATGGCAAAGTCAAGAGTTAAGGCAAAGATGAAGAGAAGTAAAAGCAGAGCAGAGCTTAATTAGACTTCACAGGTCTCTCATCTGTTCAAAATCTTGCTTTTTTTGCAGTTCATAAATTTTTGTCCTTTTTGTTTTTAGGCCACGGATAAAATAAAACTGTGACCATCCTTTTTCTGTGTAAATGGAAGTGGCAGTTGATATTTGATAATTGATGTTGTATTTGTACAATTTTC

SEQ ID NO: 503 - DNA, 1424 bp, Zea mays
  misc_feature (1)..(1424): Ceres cDNA ID no. 12340535
  misc_feature (1)..(1424): Ceres CLONE  ID no. 218097
  misc_feature (1)..(1424): Also known as  Ceres CDNA ID no. 23770188
  misc_feature (132)..(132): n is a, c, t, g, unknown, or other
  misc_feature (215)..(215): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (268)..(268): n is a, c, t, g, unknown, or other
  misc_feature (697)..(697): n is a, c, t, g, unknown, or other
  misc_feature (990)..(990): n is a, c, t, g, unknown, or other
  misc_feature (1240)..(1240): n is a, c, t, g, unknown, or other
aaaaagagacctgggcaggacgacacaggcagagccgccggccctcgcttcttggtggggtctagtttctttctcgcctctgcctgtgcctgctggtggtaagtaataacagcgacacggtacccacgcacngcggcggcggcggcgacgacgaagacgacatgaccgtcggcgacgacgcggcggcgccggggcgggggcagacggtgtgcgtnaccggcgccggcggctacgtcgggtcgtggatcgtcaagctcctgctcnnncngggctacgccgtccgcggcaccgtgcgcaaccctgacgacgcgaagaacgcgcacctgctggcgctccccggcgcggcggagcggctggcgctgtgcaaggccgacctgctcgactacggcgcgctaagggcggccgtcgccggctgccacaagcgtcttccacgccgcgtcgccggtcaccgacgacccggaggagatggtggagccggcggtgcgggggacgcggtacgtcatcgacgcggcggccgaggccggcacggtccgccgcgtcgtcctgacgtcgtcgatcggcgcggtggccatggacccccgccgcgagccggacgccgtcgtcgacgagtcgtgctggagcgacctcgacttctgcaagaagaccaagaactggtactgctacggcaaggcggcggcggagcgggcggcgtgggagncggcggcggcgcgcggggtggacctggtggtggtggtgccggtgctggtgcagggcccggcgctgcagccgtcggtgaacgccagcctgatgcacgtgctcaagtacctgaacgggtccgccaagacgtacgccaacgcggtgcaggcgtacgtgcacgtccgcgacgccgccgacgcgcacgtccgcgtcttcgaggcgccccgcgccgccggccgctacatctgcgccgacgccgtgctccaccgcgaggacgtcgtccgcaccctccgcaagtccttcccgggctacccngtcccggagaggtgctctgacgaggtgaacccgaggaagcagccgtacaagatctccaaccagcggctgagggagctgggcctggagttcaccccggcggcgcaggcgctgtacgacaccgtcgtgtgcttccaggagaagggcatcctccctctccctgtccccgccccaacgccggcgtcaccggacgcctgagctagctgatgagctggcccagaaccaacgaagaaacatgtttggcacgcaaacngctattataacagtcgctgcttcgatcattctgccgctagagatagaatgtggagtgtgtgctactcgttgtgggcgtaagagtgtcagaagagtgcagcagtaactatatcgatgcgactttttatatgttgctatatcatgtgtgacaatctcctaataataaatatatggagtatcgtcct

SEQ ID NO: 504 - protein, 1424 aa, Zea mays
  misc_feature: PFam Name: Epimerase; PFam Description: NAD dependent
  misc_feature: PFam Name: Transferase; PFam Description: Transferase family
  misc_feature: PFam Name: 3Beta_HSD; PFam Description: 3-beta
  misc_feature: PFam Name: Cupin_1; PFam Description: Cupin
  misc_feature: PFam Name: GRP; PFam Description: Glycine rich protein family
  misc_feature: GI Number: 25140432; NR Description: cinnamoyl CoA reductase
  misc_feature: GI Number: 3341511; NR Description: cinnamoyl-CoA reductase
  misc_feature: GI Number: 9964087; NR Description: cinnamoyl CoA reductase
  misc_feature: GI Number: 3242328; NR Description: cinnamoyl-CoA reductase
  misc_feature: GI Number: 2239260; NR Description: cinnamoyl CoA reductase
AAAAAGAGACCTGGGCAGGACGACACAGGCAGAGCCGCCGGCCCTCGCTTCTTGGTGGGGTCTAGTTTCTTTCTCGCCTCTGCCTGTGCCTGCTGGTGGTAAGTAATAACAGCGACACGGTACCCACGCACNGCGGCGGCGGCGGCGACGACGAAGACGACATGACCGTCGGCGACGACGCGGCGGCGCCGGGGCGGGGGCAGACGGTGTGCGTNACCGGCGCCGGCGGCTACGTCGGGTCGTGGATCGTCAAGCTCCTGCTCNNNCNGGGCTACGCCGTCCGCGGCACCGTGCGCAACCCTGACGACGCGAAGAACGCGCACCTGCTGGCGCTCCCCGGCGCGGCGGAGCGGCTGGCGCTGTGCAAGGCCGACCTGCTCGACTACGGCGCGCTAAGGGCGGCCGTCGCCGGCTGCCACAAGCGTCTTCCACGCCGCGTCGCCGGTCACCGACGACCCGGAGGAGATGGTGGAGCCGGCGGTGCGGGGGACGCGGTACGTCATCGACGCGGCGGCCGAGGCCGGCACGGTCCGCCGCGTCGTCCTGACGTCGTCGATCGGCGCGGTGGCCATGGACCCCCGCCGCGAGCCGGACGCCGTCGTCGACGAGTCGTGCTGGAGCGACCTCGACTTCTGCAAGAAGACCAAGAACTGGTACTGCTACGGCAAGGCGGCGGCGGAGCGGGCGGCGTGGGAGNCGGCGGCGGCGCGCGGGGTGGACCTGGTGGTGGTGGTGCCGGTGCTGGTGCAGGGCCCGGCGCTGCAGCCGTCGGTGAACGCCAGCCTGATGCACGTGCTCAAGTACCTGAACGGGTCCGCCAAGACGTACGCCAACGCGGTGCAGGCGTACGTGCACGTCCGCGACGCCGCCGACGCGCACGTCCGCGTCTTCGAGGCGCCCCGCGCCGCCGGCCGCTACATCTGCGCCGACGCCGTGCTCCACCGCGAGGACGTCGTCCGCACCCTCCGCAAGTCCTTCCCGGGCTACCCNGTCCCGGAGAGGTGCTCTGACGAGGTGAACCCGAGGAAGCAGCCGTACAAGATCTCCAACCAGCGGCTGAGGGAGCTGGGCCTGGAGTTCACCCCGGCGGCGCAGGCGCTGTACGACACCGTCGTGTGCTTCCAGGAGAAGGGCATCCTCCCTCTCCCTGTCCCCGCCCCAACGCCGGCGTCACCGGACGCCTGAGCTAGCTGATGAGCTGGCCCAGAACCAACGAAGAAACATGTTTGGCACGCAAACNGCTATTATAACAGTCGCTGCTTCGATCATTCTGCCGCTAGAGATAGAATGTGGAGTGTGTGCTACTCGTTGTGGGCGTAAGAGTGTCAGAAGAGTGCAGCAGTAACTATATCGATGCGACTTTTTATATGTTGCTATATCATGTGTGACAATCTCCTAATAATAAATATATGGAGTATCGTCCT

SEQ ID NO: 505 - DNA, 1144 bp, Zea mays
  misc_feature (1)..(1144): Ceres cDNA ID no. 12340765
  misc_feature (1)..(1144): Ceres CLONE  ID no. 277054
  misc_feature (1)..(1144): Also known as  Ceres CDNA ID no. 23749053
aaatcgagctcggaggcgaatctctcgctaactgtcatcaatggcggccgagcccaagatcctagagctctccaacggcaagatcaccgcgaggatctccaactggggcgccaccatcacctccctcctcgtccccgacgcccaggggagtgtcgctgatgtggtgctcggattcgatggcttggatccgtacgtgaaaggcatgtcaccttattttggctgcatagttggccgtgtcgcgaataggatcaaggatgggaagtttacactaaacggacttgagtattcattacctgtcaacaatggacctaacagccttcatggtgggttgaagggatttgataaggtcgtgtgggatgtcgtggagcacaaagatggcgaatgcccttcaataacttttcagtatcacagcaaggacggggaagaaggctatccaggcgatgtaaccattcgagcaacatactctcttcctgaagctactactctaaggcttgacatggaagctacaccagagaacaaagcaactcctataagcctggcgcagcacacctactggaacctcgcaggtcacgcctgcggcgacatcttaaaccactcgctgcagatctggggcaagcacatcactccggtcgacgagaacacaattcccaccggcgagataatgcccgtcgatggcaccccttttgacttcacgacggagcgcaggattggcgagcgcatcgacggtgttcctggagggtatgatcataactacgtgctggactgtggcgacgagaaggacggcctgaagcgtgcggccaggctgaaagatccgtcgagcttgcggaccctggacctgtggactgacgcacccggcatgcagctgtacactgccaactacgtggatggcatcggtggcaaggcgggcgctgtctacgcgaagcatgctggagtgtgcttggaaacccaggggttcccgaatgccatcaaccagcctgagtttccctctgtggttgttcggcccggtgagaagtataagcatactatgctgtttgagttctcgggatgttgaatagtgactggacagcataaattgatgtaaaacatgttgaatgaataaacaagcagaaggataagctgtgataataatgcactagtttgctcc

SEQ ID NO: 506 - protein, 1144 aa, Zea mays
  misc_feature: PFam Name: Aldose_epim; PFam Description: Aldose 1-epimerase
  misc_feature: GI Number: 9294498; NR Description: aldose 1-epimerase-like protein [Arabidopsis thaliana] >gi|30684727|ref|NP_566594.2| aldose
  misc_feature: GI Number: 31430258; NR Description: putative aldose 1-epimerase - like protein [Oryza sativa (japonica cultivar-group)] gi|37531218|ref|NP_919911.1| putative aldose 1-epimerase - like protein [Oryza sativa (japonica cultivar-group)] protein [Oryza
  misc_feature: GI Number: 14532616; NR Description: putative aldose 1-epimerase [Arabidopsis thaliana] >gi|25054834|gb|AAN71907.1|
  misc_feature: GI Number: 15824567; NR Description: non-cell-autonomous
  misc_feature: GI Number: 50909807; NR Description: putative non-cell-autonomous protein pathway2; plasmodesmal receptor [Oryza sativa (japonica cultivar-group)] >gi|50725243|dbj|BAD34245.1| putative non-cell-autonomous protein pathway2; plasmodesmal
AAATCGAGCTCGGAGGCGAATCTCTCGCTAACTGTCATCAATGGCGGCCGAGCCCAAGATCCTAGAGCTCTCCAACGGCAAGATCACCGCGAGGATCTCCAACTGGGGCGCCACCATCACCTCCCTCCTCGTCCCCGACGCCCAGGGGAGTGTCGCTGATGTGGTGCTCGGATTCGATGGCTTGGATCCGTACGTGAAAGGCATGTCACCTTATTTTGGCTGCATAGTTGGCCGTGTCGCGAATAGGATCAAGGATGGGAAGTTTACACTAAACGGACTTGAGTATTCATTACCTGTCAACAATGGACCTAACAGCCTTCATGGTGGGTTGAAGGGATTTGATAAGGTCGTGTGGGATGTCGTGGAGCACAAAGATGGCGAATGCCCTTCAATAACTTTTCAGTATCACAGCAAGGACGGGGAAGAAGGCTATCCAGGCGATGTAACCATTCGAGCAACATACTCTCTTCCTGAAGCTACTACTCTAAGGCTTGACATGGAAGCTACACCAGAGAACAAAGCAACTCCTATAAGCCTGGCGCAGCACACCTACTGGAACCTCGCAGGTCACGCCTGCGGCGACATCTTAAACCACTCGCTGCAGATCTGGGGCAAGCACATCACTCCGGTCGACGAGAACACAATTCCCACCGGCGAGATAATGCCCGTCGATGGCACCCCTTTTGACTTCACGACGGAGCGCAGGATTGGCGAGCGCATCGACGGTGTTCCTGGAGGGTATGATCATAACTACGTGCTGGACTGTGGCGACGAGAAGGACGGCCTGAAGCGTGCGGCCAGGCTGAAAGATCCGTCGAGCTTGCGGACCCTGGACCTGTGGACTGACGCACCCGGCATGCAGCTGTACACTGCCAACTACGTGGATGGCATCGGTGGCAAGGCGGGCGCTGTCTACGCGAAGCATGCTGGAGTGTGCTTGGAAACCCAGGGGTTCCCGAATGCCATCAACCAGCCTGAGTTTCCCTCTGTGGTTGTTCGGCCCGGTGAGAAGTATAAGCATACTATGCTGTTTGAGTTCTCGGGATGTTGAATAGTGACTGGACAGCATAAATTGATGTAAAACATGTTGAATGAATAAACAAGCAGAAGGATAAGCTGTGATAATAATGCACTAGTTTGCTCC

SEQ ID NO: 507 - DNA, 1179 bp, Zea mays
  misc_feature (1)..(1179): Ceres cDNA ID no. 12340811
  misc_feature (1)..(1179): Ceres CLONE  ID no. 291736
  misc_feature (1)..(1179): Also known as  Ceres CDNA ID no. 23743203
acaacaacttagcataacaaaagcccttgcccacgccatgacgctcagcaagaagcaaggcgcaggcactgatcagcaggccttgctggatgctcagctgcagctctggcaccacaccatcgcttttgtcaagtccatggcgctcaaggccgccgtagacctccgcatagcggacgccatccacctgcacggcggctcagccaccctctcgcagatagtcaccaaggtcacactccacccgtccaagataccatgcctgcgacgcctcatgcgcgtgctcactctcaccggcgtcttcagcgtcaacaccggcgccgttgtcgacgagcccgtttacgggctcacgccggcgtctcgccttctggtcggcccggggctgaaccagaccccgttcctgaccttgatgctcagcactttcttcgtgtcctccttcctcggcctcgacgagtggttccagcacgagacgggtccgtccccgttcgagctggccaatggccgggacatatggaccctgtccggccacgaccgagcttcggcaagctcttcgacgacgggatggtcgcggacagcggtttcatcatggacgtcgtggtcaaggagtgcggcgacgtgttccgaggggtcggctccctcgtcgacgtcgccggcgggctcggtggtgccacccagaccatcgcgaaggctttcccggacgtggcgtgcagcgtgctggacctcccacacgtcgtcgccaatgctcccaccgacaccaccgtgaagtacatcgccggcgacatgttcgagagcattccgtcggcaaacgttgtcttcctcaagtggattctgcatgactggggtgatgccgaatgcgtgaagatactgaagaactgcaagaaggctatatcatctcaagaagaagggaaggtagtgatactggatatggttgttggagcagggtcatccgacgagaagcatgtggagacgcaaatcgtattcgatctctttatgatgtttatcaatggcactgagcgagatgagacggagtggaagaagatcattttcgaagccgggtttagccgttacaagatcatacctgttctcggtgttcggtcgataatcgaggtctacccataaaaatctatgcaactcaagtatactgcatgcgtgaataatctgcgtgtgaaatcaaaactaggtgtg

SEQ ID NO: 508 - protein, 1179 aa, Zea mays
  misc_feature: PFam Name: Methyltransf_2; PFam Description: O-methyltransferase
  misc_feature: PFam Name: Dimerisation; PFam Description: Dimerisation domain
  misc_feature: GI Number: 51451358; NR Description: putative o-methyltransferase ZRP4 [Oryza sativa (japonica cultivar-group)] >gi|46575943|gb|AAT01304.1| putative o-methyltransferase ZRP4
  misc_feature: GI Number: 51451359; NR Description: putative o-methyltransferase ZRP4 [Oryza sativa (japonica cultivar-group)] >gi|46575944|gb|AAT01305.1| putative o-methyltransferase ZRP4
  misc_feature: GI Number: 50253195; NR Description: flavonoid 7-O-methyltransferase-like [Oryza sativa (japonica cultivar-group)] >gi|50252861|dbj|BAD29092.1| flavonoid 7-O-methyltransferase-like
  misc_feature: GI Number: 55297348; NR Description: putative o-methyltransferase [Oryza sativa (japonica cultivar-group)] gi|55297295|dbj|BAD69125.1| putative o-methyltransferase [Oryza
  misc_feature: GI Number: 20514369; NR Description: orcinol O-methyltransferase [Rosa hybrid cultivar] >gi|53748112|emb|CAH05078.1| orcinol O-methyltransferase 2 [Rosa chinensis] >gi|27527924|emb|CAD29459.1| orcinol O-methyltransferase
ACAACAACTTAGCATAACAAAAGCCCTTGCCCACGCCATGACGCTCAGCAAGAAGCAAGGCGCAGGCACTGATCAGCAGGCCTTGCTGGATGCTCAGCTGCAGCTCTGGCACCACACCATCGCTTTTGTCAAGTCCATGGCGCTCAAGGCCGCCGTAGACCTCCGCATAGCGGACGCCATCCACCTGCACGGCGGCTCAGCCACCCTCTCGCAGATAGTCACCAAGGTCACACTCCACCCGTCCAAGATACCATGCCTGCGACGCCTCATGCGCGTGCTCACTCTCACCGGCGTCTTCAGCGTCAACACCGGCGCCGTTGTCGACGAGCCCGTTTACGGGCTCACGCCGGCGTCTCGCCTTCTGGTCGGCCCGGGGCTGAACCAGACCCCGTTCCTGACCTTGATGCTCAGCACTTTCTTCGTGTCCTCCTTCCTCGGCCTCGACGAGTGGTTCCAGCACGAGACGGGTCCGTCCCCGTTCGAGCTGGCCAATGGCCGGGACATATGGACCCTGTCCGGCCACGACCGAGCTTCGGCAAGCTCTTCGACGACGGGATGGTCGCGGACAGCGGTTTCATCATGGACGTCGTGGTCAAGGAGTGCGGCGACGTGTTCCGAGGGGTCGGCTCCCTCGTCGACGTCGCCGGCGGGCTCGGTGGTGCCACCCAGACCATCGCGAAGGCTTTCCCGGACGTGGCGTGCAGCGTGCTGGACCTCCCACACGTCGTCGCCAATGCTCCCACCGACACCACCGTGAAGTACATCGCCGGCGACATGTTCGAGAGCATTCCGTCGGCAAACGTTGTCTTCCTCAAGTGGATTCTGCATGACTGGGGTGATGCCGAATGCGTGAAGATACTGAAGAACTGCAAGAAGGCTATATCATCTCAAGAAGAAGGGAAGGTAGTGATACTGGATATGGTTGTTGGAGCAGGGTCATCCGACGAGAAGCATGTGGAGACGCAAATCGTATTCGATCTCTTTATGATGTTTATCAATGGCACTGAGCGAGATGAGACGGAGTGGAAGAAGATCATTTTCGAAGCCGGGTTTAGCCGTTACAAGATCATACCTGTTCTCGGTGTTCGGTCGATAATCGAGGTCTACCCATAAAAATCTATGCAACTCAAGTATACTGCATGCGTGAATAATCTGCGTGTGAAATCAAAACTAGGTGTG

SEQ ID NO: 509 - DNA, 1367 bp, Zea mays
  misc_feature (1)..(1367): Ceres cDNA ID no. 12341058
  misc_feature (1)..(1367): Ceres CLONE  ID no. 219744
  misc_feature (1)..(1367): Also known as  Ceres CDNA ID no. 23753622
agcagtctcgatggccgccgccgactcctccccgctccacatcgtcattttcccttggctcgcgttcggccacttgatccccggcctcgagttcgccgagcgcctcgctcatcgacttggtggccctcccgttcccgcgcattgacggcctccccgatggcgccgaggccactagcgacctcccgcccggcacggccgagctccacgtgcaggccatggaccgcctcgccccggccttctccgccttcctcggtgccgcctgcgccgacgggagcgaccgtaaggtggactgggtgctcctcgacaacttccacgcgtccatggcggacgtcgccagcgagcacaaggttccctgcatactgaacatgccctactcctcggcgacgacagaggatttcggcattccagacccgtcggttctaccaatgttccggccatttgtcgagaccttcaagagatgcaaagtcatcgctgctcgtagcagcttcgagttggaaccggagtccctgcctctcatgacaaagatcctcgggaagccggtcatccccgtgggcctacttcctccggcgcccgccggaggcaacacgcagcgcgacgacagcgcagccctgtcgtggctcgacgagcagccgtccaagtccgtggtctacgtcgccttcgggagcgagtacccgatgaccgtcaagcagctgcacgagatcgcgcgcgggctggagctcgccgggacgcgcttcctctgggccctcaagaggcctagcgtcgcccaccccgacgaggacctcctgccgccaggtttcgaggagcgcacgcgcggccgtggctccgtcgtcacgggctgggttcctcagaccagcatactggggcatggcgccgtcgccgcgttcatgatgcactgcggctggggctccaccatcgaggcgcttcagtacggccatcctctggtcatgatgccagttctcgtcgaccacctgtccaccgcgcgggtgatggagcagcggaaggtcggagtcaaggtgcggaaggagaagagtgacgaagcgttccttggtgacaacatcgccacagcgatacgggctgtcatgtgcgaagaagagagcaagaggatctttgtggccaatgctaagaggatgcaggagattgtggcagacgacgagtgccacaagaggtacatagacgaattcgttcagagcctgagaacctacaagaactgaaacatgcatggtattggtcagtgcactcagcatacttggcattggcgttacacaagtgattcgctggactccagcttatacgatgtatcttattttgctgcaatatgcaactttatcattgtttggttgtaaaaagatttgaatttgtttctcgtg

SEQ ID NO: 510 - protein, 1367 aa, Zea mays
  misc_feature: PFam Name: UDPGT; PFam Description: UDP-glucoronosyl and
  misc_feature: PFam Name: Glyco_transf_28; PFam Description:
  misc_feature: GI Number: 50909939; NR Description: putative UDP-glucosyltransferase [Oryza sativa (japonica cultivar-group)] >gi|46806235|dbj|BAD17459.1| putative UDP-glucosyltransferase
  misc_feature: GI Number: 51091136; NR Description: putative UDP-glucosyltransferase [Oryza sativa (japonica cultivar-group)] >gi|51090402|dbj|BAD35324.1| putative UDP-glucosyltransferase
  misc_feature: GI Number: 50918061; NR Description: putative UDP-glucoronosyl and UDP-glucosyl transferase [Oryza sativa (japonica cultivar-group)] >gi|41469452|gb|AAS07253.1| putative UDP-glucoronosyl and UDP-glucosyl transferase [Oryza protein
  misc_feature: GI Number: 50918067; NR Description: putative UDP-glucoronosyl and UDP-glucosyl transferase [Oryza sativa (japonica cultivar-group)] >gi|41469442|gb|AAS07243.1| putative UDP-glucoronosyl and UDP-glucosyl transferase [Oryza protein
  misc_feature: GI Number: 50934999; NR Description: putative UDP-glucosyltransferase [Oryza sativa (japonica cultivar-group)] >gi|34393978|dbj|BAC83826.1| putative UDP-glucosyltransferase [Oryza sativa (japonica cultivar-group)]
AGCAGTCTCGATGGCCGCCGCCGACTCCTCCCCGCTCCACATCGTCATTTTCCCTTGGCTCGCGTTCGGCCACTTGATCCCCGGCCTCGAGTTCGCCGAGCGCCTCGCTCATCGACTTGGTGGCCCTCCCGTTCCCGCGCATTGACGGCCTCCCCGATGGCGCCGAGGCCACTAGCGACCTCCCGCCCGGCACGGCCGAGCTCCACGTGCAGGCCATGGACCGCCTCGCCCCGGCCTTCTCCGCCTTCCTCGGTGCCGCCTGCGCCGACGGGAGCGACCGTAAGGTGGACTGGGTGCTCCTCGACAACTTCCACGCGTCCATGGCGGACGTCGCCAGCGAGCACAAGGTTCCCTGCATACTGAACATGCCCTACTCCTCGGCGACGACAGAGGATTTCGGCATTCCAGACCCGTCGGTTCTACCAATGTTCCGGCCATTTGTCGAGACCTTCAAGAGATGCAAAGTCATCGCTGCTCGTAGCAGCTTCGAGTTGGAACCGGAGTCCCTGCCTCTCATGACAAAGATCCTCGGGAAGCCGGTCATCCCCGTGGGCCTACTTCCTCCGGCGCCCGCCGGAGGCAACACGCAGCGCGACGACAGCGCAGCCCTGTCGTGGCTCGACGAGCAGCCGTCCAAGTCCGTGGTCTACGTCGCCTTCGGGAGCGAGTACCCGATGACCGTCAAGCAGCTGCACGAGATCGCGCGCGGGCTGGAGCTCGCCGGGACGCGCTTCCTCTGGGCCCTCAAGAGGCCTAGCGTCGCCCACCCCGACGAGGACCTCCTGCCGCCAGGTTTCGAGGAGCGCACGCGCGGCCGTGGCTCCGTCGTCACGGGCTGGGTTCCTCAGACCAGCATACTGGGGCATGGCGCCGTCGCCGCGTTCATGATGCACTGCGGCTGGGGCTCCACCATCGAGGCGCTTCAGTACGGCCATCCTCTGGTCATGATGCCAGTTCTCGTCGACCACCTGTCCACCGCGCGGGTGATGGAGCAGCGGAAGGTCGGAGTCAAGGTGCGGAAGGAGAAGAGTGACGAAGCGTTCCTTGGTGACAACATCGCCACAGCGATACGGGCTGTCATGTGCGAAGAAGAGAGCAAGAGGATCTTTGTGGCCAATGCTAAGAGGATGCAGGAGATTGTGGCAGACGACGAGTGCCACAAGAGGTACATAGACGAATTCGTTCAGAGCCTGAGAACCTACAAGAACTGAAACATGCATGGTATTGGTCAGTGCACTCAGCATACTTGGCATTGGCGTTACACAAGTGATTCGCTGGACTCCAGCTTATACGATGTATCTTATTTTGCTGCAATATGCAACTTTATCATTGTTTGGTTGTAAAAAGATTTGAATTTGTTTCTCGTG

SEQ ID NO: 511 - DNA, 657 bp, Zea mays
  misc_feature (1)..(657): Ceres cDNA ID no. 12341116
  misc_feature (1)..(657): Ceres CLONE  ID no. 224895
  misc_feature (1)..(657): Also known as  Ceres CDNA ID no. 23769244
actagaaaagaggatcttgagagtgttgttggcatggcttcgtcagcaacagcaagcggtgggaagtttgacgagaagttgcctggcgagaaacctccaaagcaccctggcaaacatagaaagttcctcccagttgctgaggggaagggaatgggcagcctggagaaacagcagaatgacaaaatcctgagctctctacttgccagaaactctgatgaaccgcttgatgtcagcaaggcaattacaatgtacaaggtgaaaaaggaaaagcagagaaggaaagagaaaaatatgccatcaaaatctgataagcttaagccccagaagaaaccccacaagaaatcatcgaagaaaagggcttaggtccacgtctttcagttgaccacagttttgaaagctgaagcaaggaggcctgtcacatattggattgtatttgtgagctttgaatctctgggagaaatattgttattccgtctaatggttatgatacaaaaacctgaatgctttgccatggtatgcgcccatcttgtacttttcaaattatgtttgggatgtggtttgtagcttggtaagagtccctccctttggttctgaaacctgttcaaaggagctgtcctggaaacagtaccaatgaagctactgtctagtgtcgatggt

SEQ ID NO: 512 - protein, 657 aa, Zea mays
  misc_feature: GI Number: 18404610; NR Description: ribosome biogenesis
  misc_feature: GI Number: 21593609; NR Description: unknown [Arabidopsis thaliana]
  misc_feature: GI Number: 41056045; NR Description: Ribosome biogenesis regulatory protein homolog; wu:fj66c04 [Danio rerio] >gi|33585885|gb|AAH55615.1| Ribosome biogenesis regulatory protein
  misc_feature: GI Number: 45709905; NR Description: Unknown (protein for
ACTAGAAAAGAGGATCTTGAGAGTGTTGTTGGCATGGCTTCGTCAGCAACAGCAAGCGGTGGGAAGTTTGACGAGAAGTTGCCTGGCGAGAAACCTCCAAAGCACCCTGGCAAACATAGAAAGTTCCTCCCAGTTGCTGAGGGGAAGGGAATGGGCAGCCTGGAGAAACAGCAGAATGACAAAATCCTGAGCTCTCTACTTGCCAGAAACTCTGATGAACCGCTTGATGTCAGCAAGGCAATTACAATGTACAAGGTGAAAAAGGAAAAGCAGAGAAGGAAAGAGAAAAATATGCCATCAAAATCTGATAAGCTTAAGCCCCAGAAGAAACCCCACAAGAAATCATCGAAGAAAAGGGCTTAGGTCCACGTCTTTCAGTTGACCACAGTTTTGAAAGCTGAAGCAAGGAGGCCTGTCACATATTGGATTGTATTTGTGAGCTTTGAATCTCTGGGAGAAATATTGTTATTCCGTCTAATGGTTATGATACAAAAACCTGAATGCTTTGCCATGGTATGCGCCCATCTTGTACTTTTCAAATTATGTTTGGGATGTGGTTTGTAGCTTGGTAAGAGTCCCTCCCTTTGGTTCTGAAACCTGTTCAAAGGAGCTGTCCTGGAAACAGTACCAATGAAGCTACTGTCTAGTGTCGATGGT

SEQ ID NO: 513 - DNA, 1292 bp, Zea mays
  misc_feature (1)..(1292): Ceres cDNA ID no. 12341218
  misc_feature (1)..(1292): Ceres CLONE  ID no. 230763
  misc_feature (1)..(1292): Also known as  Ceres CDNA ID no. 23770163
aatcctccgggaaccatttgcgcggctacgattcgctcctgcaactgcagcatagaaagtgacgtcgccgtcgccgcattcgcgccgccctgggctccgtccaactaccgttgcaaacccaggcttgcctgacaccagaagctgctcccctctccgatccagcggcgccctgttcgactgcggcggcggcggctaccatcccgatccggtggcgccccggccttgctcgattcctacagctgctatccttttctacctgcggcgccctgctccactctagtggctgctcccctcccaatctgagccccgagatgcctgagtccagggacggcaggagtgaggacctagctgacctttctggtggtgttggtggtggagggttctttatcaggagggtggcctcgccgggagccctagcggtgaggggtgtcaggaagccgttggcgcggcgttatatttcaccctcgaggaacaaggagaacctgctgccggtttgggcgttgagggtcacaccgacaaagaggagcccgcttcctggatggtaccccaggacgccgctccgtgatattacggccattgcaaaggctattcagagaagtcgttcaaggattgctgcagctcagcagcgaagccaaaggatcgagcagtcttcacaatctgtgaacgtgactactccagcacaagcagagcaggatgctcacattgctgaagcctcccatgctgttgcatctggctccggctcaactgaaagagaagctgtagcaaaccctgctactgttttggctgatgacaatttgaatgtgtcttctttgccagcagaaggctcattgaatactccatccaaaccaatggatcctgcccttgctgacaagaaactttccggttcaatagagaaggtagagaagttggtgaggaaaaacctgaagcgaacatcgagggctgcccaggcctccaggagggccacccaaaggcgcaatcttatgtccatgcgatgaatttattgctgtactttgctgggggaagagaaagtccacttcaggcttgtcctccttcctcttgtctgtgctgctcttcttccaatacttgccgtggcgtgatgctcacggccattccttgttcccttctcgaggacaagaatatggaagccattggctctctgcttgaggttctaggactgcagctactagtgtgaggtgtgatctggttcatgctattgctgatgtatgcatacttttctgtgtatccctgtgggccgttgaacaaataaaatctttaatttacttttctgccgc

SEQ ID NO: 514 - protein, 1292 aa, Zea mays
AATCCTCCGGGAACCATTTGCGCGGCTACGATTCGCTCCTGCAACTGCAGCATAGAAAGTGACGTCGCCGTCGCCGCATTCGCGCCGCCCTGGGCTCCGTCCAACTACCGTTGCAAACCCAGGCTTGCCTGACACCAGAAGCTGCTCCCCTCTCCGATCCAGCGGCGCCCTGTTCGACTGCGGCGGCGGCGGCTACCATCCCGATCCGGTGGCGCCCCGGCCTTGCTCGATTCCTACAGCTGCTATCCTTTTCTACCTGCGGCGCCCTGCTCCACTCTAGTGGCTGCTCCCCTCCCAATCTGAGCCCCGAGATGCCTGAGTCCAGGGACGGCAGGAGTGAGGACCTAGCTGACCTTTCTGGTGGTGTTGGTGGTGGAGGGTTCTTTATCAGGAGGGTGGCCTCGCCGGGAGCCCTAGCGGTGAGGGGTGTCAGGAAGCCGTTGGCGCGGCGTTATATTTCACCCTCGAGGAACAAGGAGAACCTGCTGCCGGTTTGGGCGTTGAGGGTCACACCGACAAAGAGGAGCCCGCTTCCTGGATGGTACCCCAGGACGCCGCTCCGTGATATTACGGCCATTGCAAAGGCTATTCAGAGAAGTCGTTCAAGGATTGCTGCAGCTCAGCAGCGAAGCCAAAGGATCGAGCAGTCTTCACAATCTGTGAACGTGACTACTCCAGCACAAGCAGAGCAGGATGCTCACATTGCTGAAGCCTCCCATGCTGTTGCATCTGGCTCCGGCTCAACTGAAAGAGAAGCTGTAGCAAACCCTGCTACTGTTTTGGCTGATGACAATTTGAATGTGTCTTCTTTGCCAGCAGAAGGCTCATTGAATACTCCATCCAAACCAATGGATCCTGCCCTTGCTGACAAGAAACTTTCCGGTTCAATAGAGAAGGTAGAGAAGTTGGTGAGGAAAAACCTGAAGCGAACATCGAGGGCTGCCCAGGCCTCCAGGAGGGCCACCCAAAGGCGCAATCTTATGTCCATGCGATGAATTTATTGCTGTACTTTGCTGGGGGAAGAGAAAGTCCACTTCAGGCTTGTCCTCCTTCCTCTTGTCTGTGCTGCTCTTCTTCCAATACTTGCCGTGGCGTGATGCTCACGGCCATTCCTTGTTCCCTTCTCGAGGACAAGAATATGGAAGCCATTGGCTCTCTGCTTGAGGTTCTAGGACTGCAGCTACTAGTGTGAGGTGTGATCTGGTTCATGCTATTGCTGATGTATGCATACTTTTCTGTGTATCCCTGTGGGCCGTTGAACAAATAAAATCTTTAATTTACTTTTCTGCCGC

SEQ ID NO: 515 - DNA, 2052 bp, Zea mays
  misc_feature (1)..(2052): Ceres cDNA ID no. 12341362
  misc_feature (1)..(2052): Ceres CLONE  ID no. 239437
  misc_feature (1)..(2052): Also known as  Ceres CDNA ID no. 23755642
tctcacctccctcgcactccattggatttgggggagctcggggggcgcgggccactgatgatccccggaacgagcaccgatccgtggcgaggaaactccaccgggtagccggcccgggagcgcggggcacggcgatggcgggcgccggggcagcggccaatggcggcaggaacaagtacgcggttctcgatcggagcgaggagcgacagacggacgctaggacggagcggcggaggaggccgttggcgcccgagagcgagagggggagaagggagcggttcgtgtacgcctgcgcggtcttcgcctccctcaacgccgtcctgctcggctacgatgttggcgtaatgagtggcgcgatcatctacatgcagaaagacctccacataaccgagtttcagcaagaaatcctagtaggctgtctgagcgtggtctcactcttgggaagcctatcaggggggcgaacatctgacgcaattggcagaaaatggacaatgggcctcggtgcaattgtgttccagataggcgcgaccatcatgacgtttgctccatcattcactgtgcttatgatagggaggctccttgctggggttggcattggctttggtgccatggtatctggagtgtacattgctgagatctcccccgcaggtgcccgagggacgctcacatcccttcctgagatctgcatcaattttgggatccttcttggctacgtttccaattatgccttctcaggcctttctgagcacatcaattggaggattatgcttggtgtcggtatcctcccatcagtcttcattggctttgcgcttttcgtgatcccggagtcccctaggtggttgatgatggagaagagagtttcagaagcaagggcagtgctgctgcagattagcgagtctgaagctgaagctgaagaacggctggctgagatcgaggaagccgcaggtctgatgaaatcaatgaaatctgaggacaaagaagtgtggagggaacttttgaacccgtctcccgccgtccgtcggatgctgtacgctggttgcggtattcagttgttccaacagatcacaggaattgatgctactgtctattacagcccaacaattttcaaagatgctggcatcaagtctgatcaggagcttctcgctgcaactgttgctgtgggtttcactaagacagtgttcatcttggttgcaattttcctaattgatagagttggacggaagccacttctttatgtgagcaccattggcatgaccatctgcttatttctcttgggggttgcacttacactgcaaaaccatgcggtggggcttatgtctccacgtgttggtatcgacctagcaattttcgcagtttgtggcaacgtggcattcttttcaattggcatgggaccaatatgttgggtcttgtcctcagaggtatttcctttaagattacgagctcaagggtcagcgcttggtcaagtaggtggtagagtgagcagtggtttggtttccatgtcattcctttctatggcccgtgctatatcagtggcaggaatgttcttcgtctttgctgcaatatccactatctctgtactgtttgtgtacttttgtgtgccagaaacaaaagggaaaacactggagcagatcgaaatgatgtttgaaagtggggacgaatggggaggaggtgaaattgagcttgaggatacacagcatttaataccgagtatcaagaagtctgtgcctcttggttgatatttgtagcatcaataaaattcttattagctccatgtttcaatgacgagccaaccaaaccagctggattctgaactttggtttcgagtgatctggccacactgagccacgaccgatctgataaaagataagcttgatagacataggtgcaacgtagaagattaattgtgatgttagttcaaaatgtcaatgattttactgggaggcggtctgtaatgtatgatcttacatctcttgtaccttcttacatctctcgtacctcccagcggaagaatatactcgcagaaaagttttctactgtgcatttttttataac

SEQ ID NO: 516 - protein, 2052 aa, Zea mays
  misc_feature: PFam Name: Sugar_tr; PFam Description: Sugar (and other)
  misc_feature: PFam Name: MFS_1; PFam Description: Major Facilitator Superfamily
  misc_feature: GI Number: 42569195; NR Description: mannitol transporter,
  misc_feature: GI Number: 4454470; NR Description: putative sugar transporter [Arabidopsis thaliana] >gi|25309029|pir||C84593
  misc_feature: GI Number: 30025133; NR Description: putative sorbitol
  misc_feature: GI Number: 51849623; NR Description: sorbitol transporter
  misc_feature: GI Number: 33636088; NR Description: sorbitol-like
TCTCACCTCCCTCGCACTCCATTGGATTTGGGGGAGCTCGGGGGGCGCGGGCCACTGATGATCCCCGGAACGAGCACCGATCCGTGGCGAGGAAACTCCACCGGGTAGCCGGCCCGGGAGCGCGGGGCACGGCGATGGCGGGCGCCGGGGCAGCGGCCAATGGCGGCAGGAACAAGTACGCGGTTCTCGATCGGAGCGAGGAGCGACAGACGGACGCTAGGACGGAGCGGCGGAGGAGGCCGTTGGCGCCCGAGAGCGAGAGGGGGAGAAGGGAGCGGTTCGTGTACGCCTGCGCGGTCTTCGCCTCCCTCAACGCCGTCCTGCTCGGCTACGATGTTGGCGTAATGAGTGGCGCGATCATCTACATGCAGAAAGACCTCCACATAACCGAGTTTCAGCAAGAAATCCTAGTAGGCTGTCTGAGCGTGGTCTCACTCTTGGGAAGCCTATCAGGGGGGCGAACATCTGACGCAATTGGCAGAAAATGGACAATGGGCCTCGGTGCAATTGTGTTCCAGATAGGCGCGACCATCATGACGTTTGCTCCATCATTCACTGTGCTTATGATAGGGAGGCTCCTTGCTGGGGTTGGCATTGGCTTTGGTGCCATGGTATCTGGAGTGTACATTGCTGAGATCTCCCCCGCAGGTGCCCGAGGGACGCTCACATCCCTTCCTGAGATCTGCATCAATTTTGGGATCCTTCTTGGCTACGTTTCCAATTATGCCTTCTCAGGCCTTTCTGAGCACATCAATTGGAGGATTATGCTTGGTGTCGGTATCCTCCCATCAGTCTTCATTGGCTTTGCGCTTTTCGTGATCCCGGAGTCCCCTAGGTGGTTGATGATGGAGAAGAGAGTTTCAGAAGCAAGGGCAGTGCTGCTGCAGATTAGCGAGTCTGAAGCTGAAGCTGAAGAACGGCTGGCTGAGATCGAGGAAGCCGCAGGTCTGATGAAATCAATGAAATCTGAGGACAAAGAAGTGTGGAGGGAACTTTTGAACCCGTCTCCCGCCGTCCGTCGGATGCTGTACGCTGGTTGCGGTATTCAGTTGTTCCAACAGATCACAGGAATTGATGCTACTGTCTATTACAGCCCAACAATTTTCAAAGATGCTGGCATCAAGTCTGATCAGGAGCTTCTCGCTGCAACTGTTGCTGTGGGTTTCACTAAGACAGTGTTCATCTTGGTTGCAATTTTCCTAATTGATAGAGTTGGACGGAAGCCACTTCTTTATGTGAGCACCATTGGCATGACCATCTGCTTATTTCTCTTGGGGGTTGCACTTACACTGCAAAACCATGCGGTGGGGCTTATGTCTCCACGTGTTGGTATCGACCTAGCAATTTTCGCAGTTTGTGGCAACGTGGCATTCTTTTCAATTGGCATGGGACCAATATGTTGGGTCTTGTCCTCAGAGGTATTTCCTTTAAGATTACGAGCTCAAGGGTCAGCGCTTGGTCAAGTAGGTGGTAGAGTGAGCAGTGGTTTGGTTTCCATGTCATTCCTTTCTATGGCCCGTGCTATATCAGTGGCAGGAATGTTCTTCGTCTTTGCTGCAATATCCACTATCTCTGTACTGTTTGTGTACTTTTGTGTGCCAGAAACAAAAGGGAAAACACTGGAGCAGATCGAAATGATGTTTGAAAGTGGGGACGAATGGGGAGGAGGTGAAATTGAGCTTGAGGATACACAGCATTTAATACCGAGTATCAAGAAGTCTGTGCCTCTTGGTTGATATTTGTAGCATCAATAAAATTCTTATTAGCTCCATGTTTCAATGACGAGCCAACCAAACCAGCTGGATTCTGAACTTTGGTTTCGAGTGATCTGGCCACACTGAGCCACGACCGATCTGATAAAAGATAAGCTTGATAGACATAGGTGCAACGTAGAAGATTAATTGTGATGTTAGTTCAAAATGTCAATGATTTTACTGGGAGGCGGTCTGTAATGTATGATCTTACATCTCTTGTACCTTCTTACATCTCTCGTACCTCCCAGCGGAAGAATATACTCGCAGAAAAGTTTTCTACTGTGCATTTTTTTATAAC

SEQ ID NO: 517 - DNA, 1377 bp, Zea mays
  misc_feature (1)..(1377): Ceres cDNA ID no. 12341432
  misc_feature (1)..(1377): Ceres CLONE  ID no. 240613
  misc_feature (1)..(1377): Also known as  Ceres CDNA ID no. 23782725
acaatccatgcggcggcatatggcgcccatcaaggagcaaaaacacacgacaagcgcagaacagcaggtgatgctggatgccgagctccagctgtggaaccacaccttcggctacgtcaagtccatggcgctcaaggccgcgatcgacctcggcatacccgaggccatccaccagcacggcggcacggccaccctcccacaaatagtcaccagggtcacgctccacccgtccaagacaccatgcctgcggcgcctcatgcgcgtgctcaccctcaccggcgtcttcggcgcgcaggaggcgcacgacgacgacggcggctgtgacgacgagctcgtctacacgctcacgccggcatcccgtctcctcgtcggctcaccggggcagaacgtgggccctttcctgaccgtgatgctcggccccatcttcatgtcgtccttcctcgacctccgcgggtggttccagcacgagacgccggacccgtcccccttcaagatgacgcacgggcgggacatatgggagctggccgcccacgacgccgccttcggcaggctcttcgacgccggcatggtcgctgacagcagcttcatcatggacgtcgtggtcagggagtgtggtggcgtgttcgaggggatcagctccctcgtcgacgtcgccggcgggctcggtggcgccacacagaccatcgcgaaggcgttcccgaacctggagtgcagcgtgctggatctcccaaacgtcgtcgccagcgctcccactgataccgccgtgaagtatgtcgccggtgacatgttcgagagcgttccggcggcagacgctgtcttcctcaagggtgatgccgactgtgtcaagatactgaagaactgcaagaaggccataccggctcaaggaggcaaggtgataatactggatatcgtggttggagcagggtcgtcatgcgaccggaagaatgtggagacgcaatgcttgtttgatctcttcatcatgtttatcaacggtgccgaacgagatgagcgacagtggaagaagatcatctttgaagctggctttacatcttacaagatcatacctgtcctaggcattagatccataattgaagtctgcctatagaaactaatataattaaggatgaaaacgggtcaggttcgggttgagttgagcaaaattctacccgggatggcatccttaaagtctacataaacccactcacgatcgtacccacgagtgcaattctaaacccgcacgtaaaccggtcaggtttgaggtattgtatacttttaaataataattcaactctctctactactgtacgtcacaccttttccttcgttcacctctccttgctcccccatatttaaatagtaataaagttaaaattattc

SEQ ID NO: 518 - protein, 1377 aa, Zea mays
  misc_feature: PFam Name: Methyltransf_2; PFam Description: O-methyltransferase
  misc_feature: PFam Name: Dimerisation; PFam Description: Dimerisation domain
  misc_feature: GI Number: 51451359; NR Description: putative o-methyltransferase ZRP4 [Oryza sativa (japonica cultivar-group)] >gi|46575944|gb|AAT01305.1| putative o-methyltransferase ZRP4
  misc_feature: GI Number: 51451358; NR Description: putative o-methyltransferase ZRP4 [Oryza sativa (japonica cultivar-group)] >gi|46575943|gb|AAT01304.1| putative o-methyltransferase ZRP4
  misc_feature: GI Number: 50253195; NR Description: flavonoid 7-O-methyltransferase-like [Oryza sativa (japonica cultivar-group)] >gi|50252861|dbj|BAD29092.1| flavonoid 7-O-methyltransferase-like
  misc_feature: GI Number: 51535782; NR Description: putative O-methyltransferase [Oryza sativa (japonica cultivar-group)] >gi|51535174|dbj|BAD37886.1| putative O-methyltransferase [Oryza
  misc_feature: GI Number: 50936943; NR Description: putative o-methyltransferase [Oryza sativa (japonica cultivar-group)] >gi|22093735|dbj|BAC07028.1| putative o-methyltransferase [Oryza
ACAATCCATGCGGCGGCATATGGCGCCCATCAAGGAGCAAAAACACACGACAAGCGCAGAACAGCAGGTGATGCTGGATGCCGAGCTCCAGCTGTGGAACCACACCTTCGGCTACGTCAAGTCCATGGCGCTCAAGGCCGCGATCGACCTCGGCATACCCGAGGCCATCCACCAGCACGGCGGCACGGCCACCCTCCCACAAATAGTCACCAGGGTCACGCTCCACCCGTCCAAGACACCATGCCTGCGGCGCCTCATGCGCGTGCTCACCCTCACCGGCGTCTTCGGCGCGCAGGAGGCGCACGACGACGACGGCGGCTGTGACGACGAGCTCGTCTACACGCTCACGCCGGCATCCCGTCTCCTCGTCGGCTCACCGGGGCAGAACGTGGGCCCTTTCCTGACCGTGATGCTCGGCCCCATCTTCATGTCGTCCTTCCTCGACCTCCGCGGGTGGTTCCAGCACGAGACGCCGGACCCGTCCCCCTTCAAGATGACGCACGGGCGGGACATATGGGAGCTGGCCGCCCACGACGCCGCCTTCGGCAGGCTCTTCGACGCCGGCATGGTCGCTGACAGCAGCTTCATCATGGACGTCGTGGTCAGGGAGTGTGGTGGCGTGTTCGAGGGGATCAGCTCCCTCGTCGACGTCGCCGGCGGGCTCGGTGGCGCCACACAGACCATCGCGAAGGCGTTCCCGAACCTGGAGTGCAGCGTGCTGGATCTCCCAAACGTCGTCGCCAGCGCTCCCACTGATACCGCCGTGAAGTATGTCGCCGGTGACATGTTCGAGAGCGTTCCGGCGGCAGACGCTGTCTTCCTCAAGGGTGATGCCGACTGTGTCAAGATACTGAAGAACTGCAAGAAGGCCATACCGGCTCAAGGAGGCAAGGTGATAATACTGGATATCGTGGTTGGAGCAGGGTCGTCATGCGACCGGAAGAATGTGGAGACGCAATGCTTGTTTGATCTCTTCATCATGTTTATCAACGGTGCCGAACGAGATGAGCGACAGTGGAAGAAGATCATCTTTGAAGCTGGCTTTACATCTTACAAGATCATACCTGTCCTAGGCATTAGATCCATAATTGAAGTCTGCCTATAGAAACTAATATAATTAAGGATGAAAACGGGTCAGGTTCGGGTTGAGTTGAGCAAAATTCTACCCGGGATGGCATCCTTAAAGTCTACATAAACCCACTCACGATCGTACCCACGAGTGCAATTCTAAACCCGCACGTAAACCGGTCAGGTTTGAGGTATTGTATACTTTTAAATAATAATTCAACTCTCTCTACTACTGTACGTCACACCTTTTCCTTCGTTCACCTCTCCTTGCTCCCCCATATTTAAATAGTAATAAAGTTAAAATTATTC

SEQ ID NO: 519 - DNA, 1881 bp, Zea mays
  misc_feature (1)..(1881): Ceres cDNA ID no. 12341608
  misc_feature (1)..(1881): Ceres CLONE  ID no. 247522
  misc_feature (1)..(1881): Also known as  Ceres CDNA ID no. 23764396
aggcagagcactgcacgccaccttatctctaaccggagatcaaagaagtagccgttaacgatggcttccgacgagctcgcaaaggccgtcgagcccaggaagaagggcaacgtcaagtatgcctccatatgtgccatcctggcctccatggcctctgtcatccttggctatgacattggggtgatgagtggagcggccatgtacatcaagaaggacctgaatatcacggacgtgcagctggagatcctgatcgggatcctcagtctctactcgctgttcggatccttcgctggcgcgcggacgtccgacaggatcgggcgccgcttgaccgtcgtgttcgccgctgtcatcttcttcgtgggctcgttgctcatgggtttcgccgtcaactacggcatgctcatggcgggccgcttcgtggccggagtcggtgtgggctacgggggcatgatcgcgcccgtgtacacggccgagatctcgcctgcggcgtcccgtggcttcctgaccaccttcccggaggtgttcatcaacatcggcatcctgcttggctacctgtccaacttcgcgttcgcgcgcctcccgctccacctcggctggcgcgtcatgctcgccattggcgcagttccgtccggcctgctcgcgctcctggtgttctgcatgcccgagtcgcctcggtggctggtcttgaagggccgcctcgcggacgccagggctgtgctagagaagacctctgccacgccagaggaggccgccgagcggctggccgacatcaaggccgcggcggggattccgaagggcctcgacggggacgtagtcaccgtacccggcaaggagcaaggcggcggtgagttgcaggtgtggaagaagctcatcctgtccccgaccccggctgtccgacgcatactgctctcggccgtgggtctccacttcttccagcaggcttctggcagcgactccgtcgtccagtacagcgcccgcctgttcaagagcgcggggatcaccgacgacaacaagctcctgggcgtcacctgcgcggtgggcgtgaccaagacgttcttcatcctggtggccacgttcctgctggaccgcgcggggcgtcggcctctgctgctgatcagcacgggcgggatgatcgtctcgctcatctgcctcgggtcggggctcaccgtcgcggggcatcacccggacaccaaggtcgcgtgggccgtcgccctgtgcatcgcgtccaccctgtcctacatcgccttcttctccatcggcctcgggcccatcacgggcgtgtacacctcggaaatattcccgctgcaggtgcgcgcgctgggcttcgcggtgggtgtggcgagcaaccgcgtcaccagcgccgtcatctccatgaccttcctgtccctctccaaggccatcaccatcggcggcagcttcttcctctactccggcatcgccgcggtcgcttgggttttcttcttcacgtgcctcccggagacacgcggccggacgctggaggagatgggcaagctgttcggcatgccagacacgggcatggctgaagaagcagaagacgccgcagccaaggagaaggtggtggaactgcctagcagcaagtaggtggctatcccagagcacaggtcaagtgaagtagatggacaagatcattgtcttttcaactaattagatgggcaagaataactaagactgccctatgaggtgtcgtggttcaaccagagatcattctgctccttttcttttcccttcctttttcgagtaccattcccattcgtcgtggtcagtacgatgttgggtcgttgggagttagtggtgtcagagtccgcgtgtgctttgcaagccagggctgaacccacaatcatcagtaacaaaaattcttcc

SEQ ID NO: 520 - protein, 1881 aa, Zea mays
  misc_feature: PFam Name: Sugar_tr; PFam Description: Sugar (and other)
  misc_feature: PFam Name: MFS_1; PFam Description: Major Facilitator Superfamily
  misc_feature: GI Number: 34392081; NR Description: polyol transporter
  misc_feature: GI Number: 50938731; NR Description: putative sorbitol transporter [Oryza sativa (japonica cultivar-group)] >gi|34393631|dbj|BAC83311.1| putative sorbitol transporter [Oryza
  misc_feature: GI Number: 30025133; NR Description: putative sorbitol
  misc_feature: GI Number: 16118827; NR Description: putative sugar
  misc_feature: GI Number: 34905902; NR Description: similar to myo-inositol transporter 2 [Oryza sativa (japonica cultivar-group)] >gi|21902079|dbj|BAC05627.1| similar to myo-inositol transporter 2
AGGCAGAGCACTGCACGCCACCTTATCTCTAACCGGAGATCAAAGAAGTAGCCGTTAACGATGGCTTCCGACGAGCTCGCAAAGGCCGTCGAGCCCAGGAAGAAGGGCAACGTCAAGTATGCCTCCATATGTGCCATCCTGGCCTCCATGGCCTCTGTCATCCTTGGCTATGACATTGGGGTGATGAGTGGAGCGGCCATGTACATCAAGAAGGACCTGAATATCACGGACGTGCAGCTGGAGATCCTGATCGGGATCCTCAGTCTCTACTCGCTGTTCGGATCCTTCGCTGGCGCGCGGACGTCCGACAGGATCGGGCGCCGCTTGACCGTCGTGTTCGCCGCTGTCATCTTCTTCGTGGGCTCGTTGCTCATGGGTTTCGCCGTCAACTACGGCATGCTCATGGCGGGCCGCTTCGTGGCCGGAGTCGGTGTGGGCTACGGGGGCATGATCGCGCCCGTGTACACGGCCGAGATCTCGCCTGCGGCGTCCCGTGGCTTCCTGACCACCTTCCCGGAGGTGTTCATCAACATCGGCATCCTGCTTGGCTACCTGTCCAACTTCGCGTTCGCGCGCCTCCCGCTCCACCTCGGCTGGCGCGTCATGCTCGCCATTGGCGCAGTTCCGTCCGGCCTGCTCGCGCTCCTGGTGTTCTGCATGCCCGAGTCGCCTCGGTGGCTGGTCTTGAAGGGCCGCCTCGCGGACGCCAGGGCTGTGCTAGAGAAGACCTCTGCCACGCCAGAGGAGGCCGCCGAGCGGCTGGCCGACATCAAGGCCGCGGCGGGGATTCCGAAGGGCCTCGACGGGGACGTAGTCACCGTACCCGGCAAGGAGCAAGGCGGCGGTGAGTTGCAGGTGTGGAAGAAGCTCATCCTGTCCCCGACCCCGGCTGTCCGACGCATACTGCTCTCGGCCGTGGGTCTCCACTTCTTCCAGCAGGCTTCTGGCAGCGACTCCGTCGTCCAGTACAGCGCCCGCCTGTTCAAGAGCGCGGGGATCACCGACGACAACAAGCTCCTGGGCGTCACCTGCGCGGTGGGCGTGACCAAGACGTTCTTCATCCTGGTGGCCACGTTCCTGCTGGACCGCGCGGGGCGTCGGCCTCTGCTGCTGATCAGCACGGGCGGGATGATCGTCTCGCTCATCTGCCTCGGGTCGGGGCTCACCGTCGCGGGGCATCACCCGGACACCAAGGTCGCGTGGGCCGTCGCCCTGTGCATCGCGTCCACCCTGTCCTACATCGCCTTCTTCTCCATCGGCCTCGGGCCCATCACGGGCGTGTACACCTCGGAAATATTCCCGCTGCAGGTGCGCGCGCTGGGCTTCGCGGTGGGTGTGGCGAGCAACCGCGTCACCAGCGCCGTCATCTCCATGACCTTCCTGTCCCTCTCCAAGGCCATCACCATCGGCGGCAGCTTCTTCCTCTACTCCGGCATCGCCGCGGTCGCTTGGGTTTTCTTCTTCACGTGCCTCCCGGAGACACGCGGCCGGACGCTGGAGGAGATGGGCAAGCTGTTCGGCATGCCAGACACGGGCATGGCTGAAGAAGCAGAAGACGCCGCAGCCAAGGAGAAGGTGGTGGAACTGCCTAGCAGCAAGTAGGTGGCTATCCCAGAGCACAGGTCAAGTGAAGTAGATGGACAAGATCATTGTCTTTTCAACTAATTAGATGGGCAAGAATAACTAAGACTGCCCTATGAGGTGTCGTGGTTCAACCAGAGATCATTCTGCTCCTTTTCTTTTCCCTTCCTTTTTCGAGTACCATTCCCATTCGTCGTGGTCAGTACGATGTTGGGTCGTTGGGAGTTAGTGGTGTCAGAGTCCGCGTGTGCTTTGCAAGCCAGGGCTGAACCCACAATCATCAGTAACAAAAATTCTTCC

SEQ ID NO: 521 - DNA, 619 bp, Zea mays
  misc_feature (1)..(619): Ceres cDNA ID no. 12341827
  misc_feature (1)..(619): Ceres CLONE  ID no. 303874
  misc_feature (1)..(619): Also known as  Ceres CDNA ID no. 23750225
cattgcttattggaggtgtcagtggaattactgttgccttatttttgctgtcctcctactacactttactgaaagatgcctcctatgtggctgtaatagcgcttctactatatgttggttgttatcagctctcatttggtcctattggctggcttatgatctcagaggttttcccgctgaggctgcgagggcgtggactgggcgttgctgttcttgtcaattttgcgtccaacgctctggtcacctttgctttctctccactggaggatttgattggaacgggagcgctcttctctggattcggggtgattgcagtggcatctcttgcattcatattctggatcgtccctgagacaaaaggactcaccctggaagagattgaagcgagtttgtagttgactgatccagacgtcacgttcttccgtcctagtttcactgaactgaagggacttctggtatccttctgtagtttgctgccgtagttagccttctataaacgttctacaagctgttgtagcaataatacttctttccttccgggtataaaccgagatggtcggttgctgcaaagtgtgttctttaccgcagttcatccgattagtcacaattaattttcctg

SEQ ID NO: 522 - protein, 619 aa, Zea mays
  misc_feature: PFam Name: Sugar_tr; PFam Description: Sugar (and other)
  misc_feature: GI Number: 37537174; NR Description: putative sugar transporter protein [Oryza sativa (japonica cultivar-group)] >gi|12039393|gb|AAG46179.1| putative sugar transporter protein [Oryza sativa] >gi|31433692|gb|AAP55176.1| putative sugar
  misc_feature: GI Number: 50897170; NR Description: At5g17010 [Arabidopsis thaliana] >gi|42570524|ref|NP_850835.2| sugar transporter family
  misc_feature: GI Number: 34897404; NR Description: putative sugar transporter protein [Oryza sativa (japonica cultivar-group)] >gi|27545039|gb|AAO18445.1| putative sugar transporter protein
  misc_feature: GI Number: 9755702; NR Description: sugar transporter-like protein [Arabidopsis thaliana] >gi|11358865|pir||T51556 sugar transporter-like protein - Arabidopsis thaliana >gi|30686158|ref|NP_850836.1| sugar transporter family protein
  misc_feature: GI Number: 29653696; NR Description: d-xylose-proton symporter, putative [Coxiella burnetii RSA 493] >gi|29540959|gb|AAO89902.1| d-xylose-proton symporter, putative
CATTGCTTATTGGAGGTGTCAGTGGAATTACTGTTGCCTTATTTTTGCTGTCCTCCTACTACACTTTACTGAAAGATGCCTCCTATGTGGCTGTAATAGCGCTTCTACTATATGTTGGTTGTTATCAGCTCTCATTTGGTCCTATTGGCTGGCTTATGATCTCAGAGGTTTTCCCGCTGAGGCTGCGAGGGCGTGGACTGGGCGTTGCTGTTCTTGTCAATTTTGCGTCCAACGCTCTGGTCACCTTTGCTTTCTCTCCACTGGAGGATTTGATTGGAACGGGAGCGCTCTTCTCTGGATTCGGGGTGATTGCAGTGGCATCTCTTGCATTCATATTCTGGATCGTCCCTGAGACAAAAGGACTCACCCTGGAAGAGATTGAAGCGAGTTTGTAGTTGACTGATCCAGACGTCACGTTCTTCCGTCCTAGTTTCACTGAACTGAAGGGACTTCTGGTATCCTTCTGTAGTTTGCTGCCGTAGTTAGCCTTCTATAAACGTTCTACAAGCTGTTGTAGCAATAATACTTCTTTCCTTCCGGGTATAAACCGAGATGGTCGGTTGCTGCAAAGTGTGTTCTTTACCGCAGTTCATCCGATTAGTCACAATTAATTTTCCTG

SEQ ID NO: 523 - DNA, 1232 bp, Zea mays
  misc_feature (1)..(1232): Ceres cDNA ID no. 12341884
  misc_feature (1)..(1232): Ceres CLONE  ID no. 219247
  misc_feature (1)..(1232): Also known as  Ceres CDNA ID no. 23745854
atccacaagaggagaagaaacaatcaaccagcaacactcttctcttataacatagtacagcgaaggtaactcacatggcaacttccatgggttgtctcgtcttgctctgccttgtttcttctctccttcccagtgccgtccttggccacccatggggtggcttgttcccacagttctatgaccattcgtgccccaaggcgaaggagattgtgcagtccattgtggcacaggctgtggccaaggagaccaggatggcggcatctttagtcagactgcatttccatgactgctttgtcaagggctgcgatgcttcggtgctgttggacaacagcagcagcatagttagtgagaaagggtccaacccgaacaggaactccctcagggggtttgaggtgatcgaccagattaaggctgctcttgaggctgcctgcccaggcacagtctcctgtgccgacattgttgcccttgcggctcgtgattccaccgccctggttggtggaccatactgggacgtgccacttggccggagagactcgctcggtgcaagcatccagggctccaacaatgacatcccagcccccaacaacacactccccactatcatcaccaagttcaagcgccagggcctcaatgttgttgatgttgtcgccctctcaggtggtcacaccattggtatgtctcggtgcactagtttccggcagaggctatacaaccagacaggcaatggcatggctgacagcacactggatgtatcctacgccgcaaagctgaggcagggatgcccccgctctggtggtgacaacaacctcttccccttggacttcatcacccctgccaagtttgacaatttttactacaagaacctcctggccggcaagggccttctaagctctgatgagattctgttaaccaagagcgctgagacagcggccctcgtgaaggcatatgctgctgatgtcaatctcttcttccagcactttgcacagtctatggtgaatatgggaaacatctcgccactgacagggtcacaaggtgagatcaggaagaactgcaggaggctcaacaatgaccactgagggcactgaagtcgcttgatgtgctgaattgtttgtgatgttggtggcgtattttgtttaaataagtaagcatggctgtgattttatcatatgatcgatctttggggttttatttaacacattgtaaaatgtgtatctattaataactcaatgtat

SEQ ID NO: 524 - protein, 1232 aa, Zea mays
  misc_feature: PFam Name: peroxidase; PFam Description: Peroxidase
  misc_feature: GI Number: 25044849; NR Description: peroxidase [Ananas comosus]
  misc_feature: GI Number: 34913714; NR Description: putative peroxidase [Oryza sativa (japonica cultivar-group)] >gi|20146478|dbj|BAB89258.1| putative peroxidase [Oryza sativa
  misc_feature: GI Number: 7453855; NR Description: peroxidase prx15
  misc_feature: GI Number: 7453853; NR Description: peroxidase prx14
  misc_feature: GI Number: 7658147; NR Description: peroxidase [Asparagus
ATCCACAAGAGGAGAAGAAACAATCAACCAGCAACACTCTTCTCTTATAACATAGTACAGCGAAGGTAACTCACATGGCAACTTCCATGGGTTGTCTCGTCTTGCTCTGCCTTGTTTCTTCTCTCCTTCCCAGTGCCGTCCTTGGCCACCCATGGGGTGGCTTGTTCCCACAGTTCTATGACCATTCGTGCCCCAAGGCGAAGGAGATTGTGCAGTCCATTGTGGCACAGGCTGTGGCCAAGGAGACCAGGATGGCGGCATCTTTAGTCAGACTGCATTTCCATGACTGCTTTGTCAAGGGCTGCGATGCTTCGGTGCTGTTGGACAACAGCAGCAGCATAGTTAGTGAGAAAGGGTCCAACCCGAACAGGAACTCCCTCAGGGGGTTTGAGGTGATCGACCAGATTAAGGCTGCTCTTGAGGCTGCCTGCCCAGGCACAGTCTCCTGTGCCGACATTGTTGCCCTTGCGGCTCGTGATTCCACCGCCCTGGTTGGTGGACCATACTGGGACGTGCCACTTGGCCGGAGAGACTCGCTCGGTGCAAGCATCCAGGGCTCCAACAATGACATCCCAGCCCCCAACAACACACTCCCCACTATCATCACCAAGTTCAAGCGCCAGGGCCTCAATGTTGTTGATGTTGTCGCCCTCTCAGGTGGTCACACCATTGGTATGTCTCGGTGCACTAGTTTCCGGCAGAGGCTATACAACCAGACAGGCAATGGCATGGCTGACAGCACACTGGATGTATCCTACGCCGCAAAGCTGAGGCAGGGATGCCCCCGCTCTGGTGGTGACAACAACCTCTTCCCCTTGGACTTCATCACCCCTGCCAAGTTTGACAATTTTTACTACAAGAACCTCCTGGCCGGCAAGGGCCTTCTAAGCTCTGATGAGATTCTGTTAACCAAGAGCGCTGAGACAGCGGCCCTCGTGAAGGCATATGCTGCTGATGTCAATCTCTTCTTCCAGCACTTTGCACAGTCTATGGTGAATATGGGAAACATCTCGCCACTGACAGGGTCACAAGGTGAGATCAGGAAGAACTGCAGGAGGCTCAACAATGACCACTGAGGGCACTGAAGTCGCTTGATGTGCTGAATTGTTTGTGATGTTGGTGGCGTATTTTGTTTAAATAAGTAAGCATGGCTGTGATTTTATCATATGATCGATCTTTGGGGTTTTATTTAACACATTGTAAAATGTGTATCTATTAATAACTCAATGTAT

SEQ ID NO: 525 - DNA, 1775 bp, Zea mays
  misc_feature (1)..(1775): Ceres cDNA ID no. 12342268
  misc_feature (1)..(1775): Ceres CLONE  ID no. 228119
  misc_feature (1)..(1775): Also known as  Ceres CDNA ID no. 23772014
ctcggtgctctcgagtctcgagagtcgagactcaggggacctgatttcctcgtccggccatggcgaccggtggcaagtccgctgcccctcagccacctcccgccgcgtcctcctcctccgaacgcgcgctggagtcagtccacttctcttccggaaaccctcgcatcgaggagacccgcggcgtcgtcgtcctccaccccgacccgcccgcggccgcctcctggtctcatgtcccgttggggagtaagccgcgggtgtgcgtgctcgccgtgcccaaccacatgacctacgccgacttctgccgtttctgcggcgccttcgtccctcacacactcgagatgcgcatcgtcagaactgatggagcagaggaccagtacagcgttcttataaattttgacactcagagctccacagacagcttctataagcacttcaacgggaagcagttctcttcgctggaggggggtgtctgccatgtccgttttgtggaagaggtgcactacactgaattgattgagcatgcacatacctcagttacaaacttggctgagcaacctacatgcccagtatgtcttgaacgacttgaccaagatcctggaggtattctcacaacaatctgcaaccattctttccactgctcgtgcatatcaaaatggacagactcctcatgcccggtctgtagatattgtcagcagcaaccagagaaatccatgtgttctatttgcggaacttcggagaatctttggatatgtctaatctgtggccatgttggctgtggaaggtacaagggtggacatgctattgaacactggaaggaaactcaacattgttattcacttgagttagagacacaaaaagtgtgggactatgctggggacaactatgtacatcggcttattcagtcaaaaacagatggaaagctagttgagtacaatttccatggtgatcacacagcagagagcacgtgttcactatgcagtggtgatgccgcaatggatgaagctctactgaacagtaaatttgaagctattgttgaagagtacaatgatctcgtcacatttcaacttgaaaagcaaagaaattactatgagtcacttctactagaagtcaaggaggaaactgagaaagaaatttctgctgctactgagaaagccatgagcacaaaactccaaaagttggaagtaaagtttgacaagtgtatggaagagaaaaaatttcttgatgaagtaaatggcaatcttgtcaagaatcaggagatgtggattgaaactatacgaaaagcacaagcaagggagcaagctgcgctcagattaaaagatgagaagatcgaaaaacttcaggaagagctaagaggtttgatagcccatttcgactgccaaagtgacactgcacaagcttcaaatgcgatctcgagcgatataccagggggcatgattcttccggtagcatcagaatcgtcctcgagcggcggcgttgttggtggcactggaaacggggagcaaaattgagtaaactgcgccctgtataaagcacgtttggatcttagggacctaggtatattcttgcttccaaacccccaccgttgtaggttcagttagggtaatacacacttgttagctgtcacctcactgcccctcgattctactgtcactagccgctagtagtgtggtactagggatgaaaacgatttcatttttttttggtttttcgaaattcgtttccgatttttcgaccgtatttaatggttatggtatttttcgaaaacataattggtc

SEQ ID NO: 526 - protein, 1775 aa, Zea mays
  misc_feature: PFam Name: BRAP2; PFam Description: BRCA1-associated protein 2
  misc_feature: PFam Name: zf-UBP; PFam Description: Zn-finger in
  misc_feature: PFam Name: zf-C3HC4; PFam Description: Zinc finger, C3HC4
  misc_feature: GI Number: 50905721; NR Description: BRAP2-like protein [Oryza sativa (japonica cultivar-group)] >gi|49387526|dbj|BAD25059.1| BRAP2-like protein [Oryza sativa
  misc_feature: GI Number: 42569332; NR Description: zinc finger (C3HC4-type
  misc_feature: GI Number: 42569859; NR Description: zinc finger (ubiquitin-hydrolase) domain-containing protein [Arabidopsis
  misc_feature: GI Number: 50539992; NR Description: zgc:92894 [Danio rerio]
  misc_feature: GI Number: 13492095; NR Description: BRAP2 variant 2 [Mus musculus]
CTCGGTGCTCTCGAGTCTCGAGAGTCGAGACTCAGGGGACCTGATTTCCTCGTCCGGCCATGGCGACCGGTGGCAAGTCCGCTGCCCCTCAGCCACCTCCCGCCGCGTCCTCCTCCTCCGAACGCGCGCTGGAGTCAGTCCACTTCTCTTCCGGAAACCCTCGCATCGAGGAGACCCGCGGCGTCGTCGTCCTCCACCCCGACCCGCCCGCGGCCGCCTCCTGGTCTCATGTCCCGTTGGGGAGTAAGCCGCGGGTGTGCGTGCTCGCCGTGCCCAACCACATGACCTACGCCGACTTCTGCCGTTTCTGCGGCGCCTTCGTCCCTCACACACTCGAGATGCGCATCGTCAGAACTGATGGAGCAGAGGACCAGTACAGCGTTCTTATAAATTTTGACACTCAGAGCTCCACAGACAGCTTCTATAAGCACTTCAACGGGAAGCAGTTCTCTTCGCTGGAGGGGGGTGTCTGCCATGTCCGTTTTGTGGAAGAGGTGCACTACACTGAATTGATTGAGCATGCACATACCTCAGTTACAAACTTGGCTGAGCAACCTACATGCCCAGTATGTCTTGAACGACTTGACCAAGATCCTGGAGGTATTCTCACAACAATCTGCAACCATTCTTTCCACTGCTCGTGCATATCAAAATGGACAGACTCCTCATGCCCGGTCTGTAGATATTGTCAGCAGCAACCAGAGAAATCCATGTGTTCTATTTGCGGAACTTCGGAGAATCTTTGGATATGTCTAATCTGTGGCCATGTTGGCTGTGGAAGGTACAAGGGTGGACATGCTATTGAACACTGGAAGGAAACTCAACATTGTTATTCACTTGAGTTAGAGACACAAAAAGTGTGGGACTATGCTGGGGACAACTATGTACATCGGCTTATTCAGTCAAAAACAGATGGAAAGCTAGTTGAGTACAATTTCCATGGTGATCACACAGCAGAGAGCACGTGTTCACTATGCAGTGGTGATGCCGCAATGGATGAAGCTCTACTGAACAGTAAATTTGAAGCTATTGTTGAAGAGTACAATGATCTCGTCACATTTCAACTTGAAAAGCAAAGAAATTACTATGAGTCACTTCTACTAGAAGTCAAGGAGGAAACTGAGAAAGAAATTTCTGCTGCTACTGAGAAAGCCATGAGCACAAAACTCCAAAAGTTGGAAGTAAAGTTTGACAAGTGTATGGAAGAGAAAAAATTTCTTGATGAAGTAAATGGCAATCTTGTCAAGAATCAGGAGATGTGGATTGAAACTATACGAAAAGCACAAGCAAGGGAGCAAGCTGCGCTCAGATTAAAAGATGAGAAGATCGAAAAACTTCAGGAAGAGCTAAGAGGTTTGATAGCCCATTTCGACTGCCAAAGTGACACTGCACAAGCTTCAAATGCGATCTCGAGCGATATACCAGGGGGCATGATTCTTCCGGTAGCATCAGAATCGTCCTCGAGCGGCGGCGTTGTTGGTGGCACTGGAAACGGGGAGCAAAATTGAGTAAACTGCGCCCTGTATAAAGCACGTTTGGATCTTAGGGACCTAGGTATATTCTTGCTTCCAAACCCCCACCGTTGTAGGTTCAGTTAGGGTAATACACACTTGTTAGCTGTCACCTCACTGCCCCTCGATTCTACTGTCACTAGCCGCTAGTAGTGTGGTACTAGGGATGAAAACGATTTCATTTTTTTTTGGTTTTTCGAAATTCGTTTCCGATTTTTCGACCGTATTTAATGGTTATGGTATTTTTCGAAAACATAATTGGTC

SEQ ID NO: 527 - DNA, 2012 bp, Zea mays
  misc_feature (1)..(2012): Ceres cDNA ID no. 12342287
  misc_feature (1)..(2012): Ceres CLONE  ID no. 229402
  misc_feature (1)..(2012): Also known as  Ceres CDNA ID no. 24395618
gcaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaacgaggaaaaggcacaaggttccgtcccactgcatgcgtcaagagcctgtctggttttcttgttctgatttgtcatttgctggtgctcagagccggcttggtttcctcgaaggatcagcaactactcttgattgtggactttgtcacatctgatatcaacttcatagatttttatccaagatggcgctgcaaaacattggtgcttcaaacagggatgatgccttctacaggtacaagatgcccagaatgattactaagatagaaggccgtggtaatggtatcaagacaaatgttgtgaacatggttgacatagcaaaagcacttgccaggccagcttcgtacaccaccaagtactttggatgtgagcttggtgcacagtccaaattcgatgagaagacagggatttccttggttaatggggctcatgatactgcaaagctggctggtctccttgaggtattcatcaagaagtatgtccaatgctatgggtgtgggaatcccgagactgagattctcatctcaaagacccagatgatatcactgaaatgtgcagcctgtgggtttgtctcagatgttgatatgagggacaagctcacaaccttcatcctgaaaaacccaccagaacagaagaagggcggaaaagacaagaaggccatgaggagagctgagaaggaacgcctgaaggaaggtgaggctgctgatgaggagcagaagaaactgaagaaggatgcaaagaagaagggttccaaggattccactgctaagggtttgaagaagaaggctactactgctactggctctgatgaggaccactcatcctctccaactcgcagccatgatggtgacaaagcagctgcagatgatgatgacgatgatgtccagtggcagactgacacttcaattgaggctgcgaagcagcgcatgcaagagcagctgagtgcagcaactgctgaaatggtgatgctgtcgactgaggagactgagaagaagatgaaacagccaacccacaaagatggaagcactaatggttcagcaaaagaaatccctaatgacaagcctgccgtcactaagcctagtccctatgaagaactgattggagacatcaaggctagcctaggaagtgctccgaccccttcccagctcaaggctgtgctggcctcatcaacccttcccccccaggacgtgatgaatgctcccctggaggctctctttggtggtgtgggtaagggattcaccaaagaggttgtgaagaacaagaagtaccttgcagttgctgtgccagatgagggtgcccagacccttctggttcaggccattgaggcttttggtgggaagtgcaaccctgaggcgctgaaggaggttcccgttgtcctcaaagccctctacgatggagatatcctggacgaggaaaccattgtggactggtacaatgatgctgtcgcagctgggaaggactcccaggttgtcaagaatgccaagccgttcgtcgagtggctccagagtgccgagtctgatgaagagggtgacgacgagtgaagaggccacgctgctctactgctaatggccgaacttgataatattatttcaataagtttgttttgcttgcctggtgtcggtgtttaaaactgttaattgtcgtgtggcgcagcatactcttctgttgctgcatgtgtcgtcgtcagtttggttgtctgttggatgtcacagtttattatggattgctactatacaagtatttctttcggatgtgttgtataacctttcgggatgtaacattttatgattgcactgttgcttc

SEQ ID NO: 528 - protein, 2012 aa, Zea mays
  misc_feature: PFam Name: eIF-5_eIF-2B; PFam Description: Domain found in
  misc_feature: PFam Name: W2; PFam Description: eIF4-gamma/eIF5/eIF2-epsilon
  misc_feature: GI Number: 42733476; NR Description: BRI1-KD interacting
  misc_feature: GI Number: 1806575; NR Description: Eukaryotic initiation factor-5 [Zea mays] >gi|2494320|sp|P55876|IF5_MAIZE Eukaryotic translation initiation factor 5 (eIF-5) >gi|7489730|pir||JC5595
  misc_feature: GI Number: 4160402; NR Description: eukaryotic translation
  misc_feature: GI Number: 15810339; NR Description: putative eukaryotic
  misc_feature: GI Number: 53792080; NR Description: putative eukaryotic translation initiation factor 5 [Oryza sativa (japonica
GCACCGCATCGCCTCGCCGCTGTTCCCCGCAACCTATCGACCCAATCTCGTCCGACCCGGCGCGTCGTCCCCTCCAGATCTCCGTCGCCCTCTCCAGGTAGCAGAAACTGTTCTGCTGCAGTCTGACAAAGTGGAGGGCTTAGGAGCTTCTGCTTCTTTTATGTCTGAACAATCTTTGCTTTATTTGGGATTGTTGGGAGAGTACTCTCGTGCAACGAGGAAAAGGCACAAGGTTCCGTCCCACTGCATGCGTCAAGAGCCTGTCTGGTTTTCTTGTTCTGATTTGTCATTTGCTGGTGCTCAGAGCCGGCTTGGTTTCCTCGAAGGATCAGCAACTACTCTTGATTGTGGACTTTGTCACATCTGATATCAACTTCATAGATTTTTATCCAAGATGGCGCTGCAAAACATTGGTGCTTCAAACAGGGATGATGCCTTCTACAGGTACAAGATGCCCAGAATGATTACTAAGATAGAAGGCCGTGGTAATGGTATCAAGACAAATGTTGTGAACATGGTTGACATAGCAAAAGCACTTGCCAGGCCAGCTTCGTACACCACCAAGTACTTTGGATGTGAGCTTGGTGCACAGTCCAAATTCGATGAGAAGACAGGGATTTCCTTGGTTAATGGGGCTCATGATACTGCAAAGCTGGCTGGTCTCCTTGAGGTATTCATCAAGAAGTATGTCCAATGCTATGGGTGTGGGAATCCCGAGACTGAGATTCTCATCTCAAAGACCCAGATGATATCACTGAAATGTGCAGCCTGTGGGTTTGTCTCAGATGTTGATATGAGGGACAAGCTCACAACCTTCATCCTGAAAAACCCACCAGAACAGAAGAAGGGCGGAAAAGACAAGAAGGCCATGAGGAGAGCTGAGAAGGAACGCCTGAAGGAAGGTGAGGCTGCTGATGAGGAGCAGAAGAAACTGAAGAAGGATGCAAAGAAGAAGGGTTCCAAGGATTCCACTGCTAAGGGTTTGAAGAAGAAGGCTACTACTGCTACTGGCTCTGATGAGGACCACTCATCCTCTCCAACTCGCAGCCATGATGGTGACAAAGCAGCTGCAGATGATGATGACGATGATGTCCAGTGGCAGACTGACACTTCAATTGAGGCTGCGAAGCAGCGCATGCAAGAGCAGCTGAGTGCAGCAACTGCTGAAATGGTGATGCTGTCGACTGAGGAGACTGAGAAGAAGATGAAACAGCCAACCCACAAAGATGGAAGCACTAATGGTTCAGCAAAAGAAATCCCTAATGACAAGCCTGCCGTCACTAAGCCTAGTCCCTATGAAGAACTGATTGGAGACATCAAGGCTAGCCTAGGAAGTGCTCCGACCCCTTCCCAGCTCAAGGCTGTGCTGGCCTCATCAACCCTTCCCCCCCAGGACGTGATGAATGCTCCCCTGGAGGCTCTCTTTGGTGGTGTGGGTAAGGGATTCACCAAAGAGGTTGTGAAGAACAAGAAGTACCTTGCAGTTGCTGTGCCAGATGAGGGTGCCCAGACCCTTCTGGTTCAGGCCATTGAGGCTTTTGGTGGGAAGTGCAACCCTGAGGCGCTGAAGGAGGTTCCCGTTGTCCTCAAAGCCCTCTACGATGGAGATATCCTGGACGAGGAAACCATTGTGGACTGGTACAATGATGCTGTCGCAGCTGGGAAGGACTCCCAGGTTGTCAAGAATGCCAAGCCGTTCGTCGAGTGGCTCCAGAGTGCCGAGTCTGATGAAGAGGGTGACGACGAGTGAAGAGGCCACGCTGCTCTACTGCTAATGGCCGAACTTGATAATATTATTTCAATAAGTTTGTTTTGCTTGCCTGGTGTCGGTGTTTAAAACTGTTAATTGTCGTGTGGCGCAGCATACTCTTCTGTTGCTGCATGTGTCGTCGTCAGTTTGGTTGTCTGTTGGATGTCACAGTTTATTATGGATTGCTACTATACAAGTATTTCTTTCGGATGTGTTGTATAACCTTTCGGGATGTAACATTTTATGATTGCACTGTTGCTTC

SEQ ID NO: 529 - DNA, 2180 bp, Zea mays
  misc_feature (1)..(2180): Ceres cDNA ID no. 12342411
  misc_feature (1)..(2180): Ceres CLONE  ID no. 236605
  misc_feature (1)..(2180): Also known as  Ceres CDNA ID no. 23784137
agtcagttcctcctactcccgatccattcgcagagggcagcagccacctcctctccccgcggccgagctcgcgcctcgcccgccgcctgaactcgtcttgcctgcggccgatctcccccctccgttcttcgccgcaacccggagaggagaccgcgctcggtcgagcaccccctggggcagcgtcctcgcgaccagctccggcgcggcgtccgccctcagcagcccgggtgtccccgggaacgtctccggctcggccggcacacagctcgacaggcttttcagttcagtgcagtgtaccaagattctctgttaatttgtgtatgagatcagttaactgataaagacatgtgaagaaccagtgatcagtaatctgtacgcttcagattgtagtatccttgagatggatggaagagaatcaggcttatggtaaatcctggtgaatattcatgggaggtcagcaagttctggcctgactaagactagtaaaaatacggtgcttcatctcagatcatcaatggtgagaatgaggttcccgaaacgttatataatagtattgttgacattcatctgcacaaatgtttgctacattgagcgtgtgggtttctcaattacctatactgttgcagctgatgccatcggtgtgaatcaagccaacaagggcatgatactctctatgttctattatggttatgttttatcacagattcctggtggatgggcagcacagagaataggaggtagacgtgtcctgctactgtcatttgtattgtggtcaatgatatgtggtttaattccacttgatcccaacagagtaaccattctggtcctttctcgcctattcgttggtgtagcacaaggtttcatatttcctgccattcacactgtcctggcacaatgggtgccgccgcaggagcgctctcgctcagtatctcttactacctcagggatgtatcttggtgcagcctgtggcatgcttttcttccctagtctggtgaagcacatgggaccccagtcagttttttttgttgaagcagtgttgggagcagcatggtctgtaatatggctgaaattttccagtgacccaccccgtactgatcttccaaaggtatcaatgccaaaagtgccatctcgagacatgattaaggcacaagcaggaggggttgtggcacctcgcacggtaaagatcccgtggcgaaggataatattcagcctacctgtttgggcaatagttgtgaacaacttcacgttccactatgccctgtatgttcttatgaactggctccctacctattttgagctaggccttaagcttagcctccaggatatgggttcctcaaagatgcttccctatttcaacatgttcattttctccaatatcggcggtgtggttgctgatcacttgattacaaggaggattctatctgttaccaagacaaggaagcttctgaacaccatcgggttcatcgtctcagcgtttgcactcatggcccttcctttgttcagcacaccgtcaggcactgtaatgtgttcagcgatatccctcggttttcttgctctaggaagagcagggtttgccgtgaaccatatggatgttgctccgaagtttgcagggatagtgatgggagtctcaaacacggcggggacactggccggaatcgtcggtgtcggcctcacgggcaatattctggaggcggcaaaggcttctaacaaggatctaacggactcggaaacctggaaaacagtcttcttcgttccagcatatctttgtattttcagttccgtcatttttttgatcttttcgacaggcgaaaagatctttgaataaagggtggttattactttttttgccaattcttttcttacgatgaggcaggattgtgaaatggaaatcttacatgtatctgtagcatttgttacaaaattttcagatttcagactgcatcacatacacacgatcagaggctatgtcaggagatcttgcattttcgttatgatgaagactcggttcattggcagtcacactcacactccaatgcagctaacagaatttgcttgtctcccaggttaactccttggttttggtacatagtctcaccacaaagtttgtcaagttcccttacctttgccctgcaatgtaaacatatatggtgccaatgagaataaacggcattgtcatttgc

SEQ ID NO: 530 - protein, 2180 aa, Zea mays
  misc_feature: PFam Name: MFS_1; PFam Description: Major Facilitator Superfamily
  misc_feature: PFam Name: Sugar_tr; PFam Description: Sugar (and other)
  misc_feature: GI Number: 62734236; NR Description: Na+-dependent inorganic phosphate cotransporter, putative [Oryza sativa (japonica
  misc_feature: GI Number: 21387197; NR Description: putative Na+-dependent inorganic phosphate cotransporter [Arabidopsis thaliana] >gi|17064976|gb|AAL32642.1| putative Na+-dependent inorganic
  misc_feature: GI Number: 52077187; NR Description: putative sialin [Oryza
  misc_feature: GI Number: 42570975; NR Description: inorganic phosphate
  misc_feature: GI Number: 42569720; NR Description: transporter-related
AGTCAGTTCCTCCTACTCCCGATCCATTCGCAGAGGGCAGCAGCCACCTCCTCTCCCCGCGGCCGAGCTCGCGCCTCGCCCGCCGCCTGAACTCGTCTTGCCTGCGGCCGATCTCCCCCCTCCGTTCTTCGCCGCAACCCGGAGAGGAGACCGCGCTCGGTCGAGCACCCCCTGGGGCAGCGTCCTCGCGACCAGCTCCGGCGCGGCGTCCGCCCTCAGCAGCCCGGGTGTCCCCGGGAACGTCTCCGGCTCGGCCGGCACACAGCTCGACAGGCTTTTCAGTTCAGTGCAGTGTACCAAGATTCTCTGTTAATTTGTGTATGAGATCAGTTAACTGATAAAGACATGTGAAGAACCAGTGATCAGTAATCTGTACGCTTCAGATTGTAGTATCCTTGAGATGGATGGAAGAGAATCAGGCTTATGGTAAATCCTGGTGAATATTCATGGGAGGTCAGCAAGTTCTGGCCTGACTAAGACTAGTAAAAATACGGTGCTTCATCTCAGATCATCAATGGTGAGAATGAGGTTCCCGAAACGTTATATAATAGTATTGTTGACATTCATCTGCACAAATGTTTGCTACATTGAGCGTGTGGGTTTCTCAATTACCTATACTGTTGCAGCTGATGCCATCGGTGTGAATCAAGCCAACAAGGGCATGATACTCTCTATGTTCTATTATGGTTATGTTTTATCACAGATTCCTGGTGGATGGGCAGCACAGAGAATAGGAGGTAGACGTGTCCTGCTACTGTCATTTGTATTGTGGTCAATGATATGTGGTTTAATTCCACTTGATCCCAACAGAGTAACCATTCTGGTCCTTTCTCGCCTATTCGTTGGTGTAGCACAAGGTTTCATATTTCCTGCCATTCACACTGTCCTGGCACAATGGGTGCCGCCGCAGGAGCGCTCTCGCTCAGTATCTCTTACTACCTCAGGGATGTATCTTGGTGCAGCCTGTGGCATGCTTTTCTTCCCTAGTCTGGTGAAGCACATGGGACCCCAGTCAGTTTTTTTTGTTGAAGCAGTGTTGGGAGCAGCATGGTCTGTAATATGGCTGAAATTTTCCAGTGACCCACCCCGTACTGATCTTCCAAAGGTATCAATGCCAAAAGTGCCATCTCGAGACATGATTAAGGCACAAGCAGGAGGGGTTGTGGCACCTCGCACGGTAAAGATCCCGTGGCGAAGGATAATATTCAGCCTACCTGTTTGGGCAATAGTTGTGAACAACTTCACGTTCCACTATGCCCTGTATGTTCTTATGAACTGGCTCCCTACCTATTTTGAGCTAGGCCTTAAGCTTAGCCTCCAGGATATGGGTTCCTCAAAGATGCTTCCCTATTTCAACATGTTCATTTTCTCCAATATCGGCGGTGTGGTTGCTGATCACTTGATTACAAGGAGGATTCTATCTGTTACCAAGACAAGGAAGCTTCTGAACACCATCGGGTTCATCGTCTCAGCGTTTGCACTCATGGCCCTTCCTTTGTTCAGCACACCGTCAGGCACTGTAATGTGTTCAGCGATATCCCTCGGTTTTCTTGCTCTAGGAAGAGCAGGGTTTGCCGTGAACCATATGGATGTTGCTCCGAAGTTTGCAGGGATAGTGATGGGAGTCTCAAACACGGCGGGGACACTGGCCGGAATCGTCGGTGTCGGCCTCACGGGCAATATTCTGGAGGCGGCAAAGGCTTCTAACAAGGATCTAACGGACTCGGAAACCTGGAAAACAGTCTTCTTCGTTCCAGCATATCTTTGTATTTTCAGTTCCGTCATTTTTTTGATCTTTTCGACAGGCGAAAAGATCTTTGAATAAAGGGTGGTTATTACTTTTTTTGCCAATTCTTTTCTTACGATGAGGCAGGATTGTGAAATGGAAATCTTACATGTATCTGTAGCATTTGTTACAAAATTTTCAGATTTCAGACTGCATCACATACACACGATCAGAGGCTATGTCAGGAGATCTTGCATTTTCGTTATGATGAAGACTCGGTTCATTGGCAGTCACACTCACACTCCAATGCAGCTAACAGAATTTGCTTGTCTCCCAGGTTAACTCCTTGGTTTTGGTACATAGTCTCACCACAAAGTTTGTCAAGTTCCCTTACCTTTGCCCTGCAATGTAAACATATATGGTGCCAATGAGAATAAACGGCATTGTCATTTGC

SEQ ID NO: 531 - DNA, 1336 bp, Zea mays
  misc_feature (1)..(1336): Ceres cDNA ID no. 12342777
  misc_feature (1)..(1336): Ceres CLONE  ID no. 265427
  misc_feature (1)..(1336): Also known as  Ceres CDNA ID no. 23760066
  misc_feature (781)..(781): n is a, c, t, g, unknown, or other
  misc_feature (782)..(782): n is a, c, t, g, unknown, or other
  misc_feature (784)..(784): n is a, c, t, g, unknown, or other
  misc_feature (794)..(794): n is a, c, t, g, unknown, or other
  misc_feature (795)..(795): n is a, c, t, g, unknown, or other
  misc_feature (934)..(934): n is a, c, t, g, unknown, or other
agatagatagagtagtagtaggttgttagctgaggggaggcatcgatggctggagccaagagaggaatcctgctcgtcctgtgcctggccgtcgtcttggtggcgctcgggagtggcggcgtggaggcgaggaagcgagggaagcagtccctggggttctacgagctgcgtcggggcgagttctccatggtcgtcaccaactggggcgccaccatcctctccgtcaggctccccgataagaacgggcacatcgacgacgtcgttcttggctacaagaacatcggatcgtacgtcaacgacacgacctacttcggcgcgctggtggggcgcgtggcgaaccgcatcgccggcgggcggttcaccatcagggaccacgcctaccacacgtatcggaacgacggcaacaacacgctccacggcgggccaccgcgggttcaaccaggtgttctggtccgtccgggagcgcgtcacgggggagttcccgcacatcaccttcgcctaccgcagctacgacggcgagcaagggttcccgggcaacctggacgtgctggtcacctacaagatcgacggcgactgctcgtacagcgtcaccatgtacgcgcggccgctggacaagcccacccccgtgaacctggcgcagcacacgtactggaacctccgcggccacggcaacggcaccgtcctgcgccacgccgtccagatcttcgcgtccgcggtcacgcccgtgggccgcggcctcatcccgacgggcgcggtcacccccgtcgccggcactccgttnnanttccgcgccnngtcggcgcccggcgcgcacatcgccgaggtcgagggtgggtacgacatcaactacgtgctggacggcgagacggacgggcaaggcgtgcgcaaggtggccgtggtcagcgaggcggactccgggcgcgtcatggagctntgggccgaccagccgggcctgcagttctacactggcaacatgcttaagggcgacgagggcaagggcggcgccgtctaccccaaatacgctgggatgtgcctggagacgcaagactacccggacgccgtgcacgagccggccttcccggccgaggtgtaccgccctggccaactctacaagcactacatgctctacaagttctcaatcagcaagtaggaacttctagtacctctcgtgcctgatgcctcatagtttcggtaggtttgcaacctgttgcgactagtaataagggttctgagtctttttttttagaaaaaattgcaacagaaatgtatggttcgagttcgtccaaactttgtctagtcaacattttctgccatttgaatgccatcttaatagtct

SEQ ID NO: 532 - protein, 1336 aa, Zea mays
  misc_feature: PFam Name: Aldose_epim; PFam Description: Aldose 1-epimerase
  misc_feature: PFam Name: Peptidase_S8; PFam Description: Subtilase family
  misc_feature: PFam Name: Mucin; PFam Description: Mucin-like glycoprotein
  misc_feature: PFam Name: MAGE; PFam Description: MAGE family
  misc_feature: GI Number: 50920801; NR Description: putative aldose 1-epimerase [Oryza sativa (japonica cultivar-group)] >gi|40882679|gb|AAR96220.1| putative aldose 1-epimerase [Oryza
  misc_feature: GI Number: 50909807; NR Description: putative non-cell-autonomous protein pathway2; plasmodesmal receptor [Oryza sativa (japonica cultivar-group)] >gi|50725243|dbj|BAD34245.1| putative non-cell-autonomous protein pathway2; plasmodesmal
  misc_feature: GI Number: 21537069; NR Description: aldose 1-epimerase-like
  misc_feature: GI Number: 7671483; NR Description: putative aldose 1-epimerase-like protein [Arabidopsis thaliana] >gi|11358633|pir||T49949 probable aldose 1-epimerase-like protein - Arabidopsis thaliana >gi|15242223|ref|NP_197018.1| aldose
  misc_feature: GI Number: 15824567; NR Description: non-cell-autonomous
AGATAGATAGAGTAGTAGTAGGTTGTTAGCTGAGGGGAGGCATCGATGGCTGGAGCCAAGAGAGGAATCCTGCTCGTCCTGTGCCTGGCCGTCGTCTTGGTGGCGCTCGGGAGTGGCGGCGTGGAGGCGAGGAAGCGAGGGAAGCAGTCCCTGGGGTTCTACGAGCTGCGTCGGGGCGAGTTCTCCATGGTCGTCACCAACTGGGGCGCCACCATCCTCTCCGTCAGGCTCCCCGATAAGAACGGGCACATCGACGACGTCGTTCTTGGCTACAAGAACATCGGATCGTACGTCAACGACACGACCTACTTCGGCGCGCTGGTGGGGCGCGTGGCGAACCGCATCGCCGGCGGGCGGTTCACCATCAGGGACCACGCCTACCACACGTATCGGAACGACGGCAACAACACGCTCCACGGCGGGCCACCGCGGGTTCAACCAGGTGTTCTGGTCCGTCCGGGAGCGCGTCACGGGGGAGTTCCCGCACATCACCTTCGCCTACCGCAGCTACGACGGCGAGCAAGGGTTCCCGGGCAACCTGGACGTGCTGGTCACCTACAAGATCGACGGCGACTGCTCGTACAGCGTCACCATGTACGCGCGGCCGCTGGACAAGCCCACCCCCGTGAACCTGGCGCAGCACACGTACTGGAACCTCCGCGGCCACGGCAACGGCACCGTCCTGCGCCACGCCGTCCAGATCTTCGCGTCCGCGGTCACGCCCGTGGGCCGCGGCCTCATCCCGACGGGCGCGGTCACCCCCGTCGCCGGCACTCCGTTNNANTTCCGCGCCNNGTCGGCGCCCGGCGCGCACATCGCCGAGGTCGAGGGTGGGTACGACATCAACTACGTGCTGGACGGCGAGACGGACGGGCAAGGCGTGCGCAAGGTGGCCGTGGTCAGCGAGGCGGACTCCGGGCGCGTCATGGAGCTNTGGGCCGACCAGCCGGGCCTGCAGTTCTACACTGGCAACATGCTTAAGGGCGACGAGGGCAAGGGCGGCGCCGTCTACCCCAAATACGCTGGGATGTGCCTGGAGACGCAAGACTACCCGGACGCCGTGCACGAGCCGGCCTTCCCGGCCGAGGTGTACCGCCCTGGCCAACTCTACAAGCACTACATGCTCTACAAGTTCTCAATCAGCAAGTAGGAACTTCTAGTACCTCTCGTGCCTGATGCCTCATAGTTTCGGTAGGTTTGCAACCTGTTGCGACTAGTAATAAGGGTTCTGAGTCTTTTTTTTTAGAAAAAATTGCAACAGAAATGTATGGTTCGAGTTCGTCCAAACTTTGTCTAGTCAACATTTTCTGCCATTTGAATGCCATCTTAATAGTCT

SEQ ID NO: 533 - DNA, 850 bp, Zea mays
  misc_feature (1)..(850): Ceres cDNA ID no. 12342801
  misc_feature (1)..(850): Ceres CLONE  ID no. 265415
  misc_feature (1)..(850): Also known as  Ceres CDNA ID no. 23765463
atctcagcttcacttccactccacacctcttcagaatggcttctagcaagctctttgcggttggcctcaccgtcttactaagcattattggactgtgcaatgctattagggtggtaaaccacgccaccgcagatggacaaggcggtggaggtggtggaggcggcgggagcggaaccagctatggctccggatccggctccggctacggcgatgccgaggcctatgacggcagtgcccagtccccaacctctggccacgcatatggcagtggatccggggacggtggtggcgtttggcaaggtgacgacgagtgcgcgtccggttacggggcgggcggcgcatccggtgaaggccatggcgactcaggtaactccaacaccgatggcgctgcgaatgcgagcggagctggcggcgggggcggttctggtgggagcaatgggaatggcagcggatctggtggcggcagtggagttggagaaggcgaaggcgataactatggtccctatggttcgagctacgcaaatagcggtggcgccggaaggggaagcggaggcggtcgtaatggtggattcggcggcggttccggtggtggagcggggagcagtggtggtgccgcgtcaggttatgatgatggcagctacaacggatcaacaccttaattatgttcatttgtttgtaccacactgtcaagcaaccgacacgtactgatagggtttttctgtgcttgtgaaataatttggcctttctgagcgatgcagaagtttgttctactcatgtaataagccactgccatttctctgtatacgccatgtttgggctatagatgtcggttagtagacgttcttttgct

SEQ ID NO: 534 - protein, 850 aa, Zea mays
  misc_feature: PFam Name: GRP; PFam Description: Glycine rich protein family
  misc_feature: PFam Name: Dehydrin; PFam Description: Dehydrin
  misc_feature: PFam Name: Secretin_N; PFam Description: Bacterial type
  misc_feature: PFam Name: Peptidase_C1; PFam Description: Papain family
  misc_feature: PFam Name: COesterase; PFam Description: Carboxylesterase
  misc_feature: GI Number: 51090508; NR Description: putative glycine rich
  misc_feature: GI Number: 15887008; NR Description: glycine rich protein
  misc_feature: GI Number: 51091828; NR Description: putative glycine rich
  misc_feature: GI Number: 10954048; NR Description: ovarian fibroin-like
  misc_feature: GI Number: 8572061; NR Description: fibroin heavy chain Fib-H [Bombyx mori] >gi|9087216|sp|P05790|FBOH_BOMMO Fibroin heavy chain
ATCTCAGCTTCACTTCCACTCCACACCTCTTCAGAATGGCTTCTAGCAAGCTCTTTGCGGTTGGCCTCACCGTCTTACTAAGCATTATTGGACTGTGCAATGCTATTAGGGTGGTAAACCACGCCACCGCAGATGGACAAGGCGGTGGAGGTGGTGGAGGCGGCGGGAGCGGAACCAGCTATGGCTCCGGATCCGGCTCCGGCTACGGCGATGCCGAGGCCTATGACGGCAGTGCCCAGTCCCCAACCTCTGGCCACGCATATGGCAGTGGATCCGGGGACGGTGGTGGCGTTTGGCAAGGTGACGACGAGTGCGCGTCCGGTTACGGGGCGGGCGGCGCATCCGGTGAAGGCCATGGCGACTCAGGTAACTCCAACACCGATGGCGCTGCGAATGCGAGCGGAGCTGGCGGCGGGGGCGGTTCTGGTGGGAGCAATGGGAATGGCAGCGGATCTGGTGGCGGCAGTGGAGTTGGAGAAGGCGAAGGCGATAACTATGGTCCCTATGGTTCGAGCTACGCAAATAGCGGTGGCGCCGGAAGGGGAAGCGGAGGCGGTCGTAATGGTGGATTCGGCGGCGGTTCCGGTGGTGGAGCGGGGAGCAGTGGTGGTGCCGCGTCAGGTTATGATGATGGCAGCTACAACGGATCAACACCTTAATTATGTTCATTTGTTTGTACCACACTGTCAAGCAACCGACACGTACTGATAGGGTTTTTCTGTGCTTGTGAAATAATTTGGCCTTTCTGAGCGATGCAGAAGTTTGTTCTACTCATGTAATAAGCCACTGCCATTTCTCTGTATACGCCATGTTTGGGCTATAGATGTCGGTTAGTAGACGTTCTTTTGCT

SEQ ID NO: 535 - DNA, 1252 bp, Zea mays
  misc_feature (1)..(1252): Ceres cDNA ID no. 12343013
  misc_feature (1)..(1252): Ceres CLONE  ID no. 299334
  misc_feature (1)..(1252): Also known as  Ceres CDNA ID no. 23766843
ttaccattacggcattacctacaccgtcgcctaatttgccaacgcccgccgccgttccgatggaaaccgccgagccggcgcgcgtccaagccctcgctgaggccggcgtgttccgcctcccggcgcagtacatccagccgcctgagcacagaccgaccccctcgccttctcctattgccgcggcgctctccgtgccggtcgtcgacctctcaacctccaccgccaccgacgccgtccgcgccgcgtgcgcggactggggcgcctttcacgtggtcggccacggcgtgccgggggagctcctcgacgcggtgcgcgcggcagggctcgcgttcttccgcgcgcccatggaggacaagctccggttcgcctgcgacccggccaggggcgccgcctcggaagggtacggcagccgcatgctcgccaacgacgactccgtgctcgactggcgcgactactttgaccaccacacgctcccggagtcccgctgtgatcccgcccgctggcccgacttcgtccccggttacagagatactattgcaaaatacagccacagcatgaaggatcttgctaaaaaattgttgtgcatcatctcagaaaatctgagcctgccaccatcttatatacaagaggcggttggagaagttttccagaacattactattagctactattctccgtgtccacaacctgatcttgctcttgggttacaatctcattctgatatgggcgcaataacacttctgatacaagatgatgttggtgggcttgaagtattaaaggatggaatgtggatacctgtgcctgctttgcgtgatggcatccttgtgattctcgctgatcagacagagatcatcaccaatggaagatacaagagttcagttcatcgagctgttgtcaatgctgagcgtgcccgcttatcagtagcaacattttatgatccatcaaaatcaaggaaaatatgcactgccccgcagcttgtgagtgagaatgaaccacaaaagtatcgggatgtaatttatggtgactatgtctcatcttggtatagcaaaggtccagagggcaagcgaaacatcgatgccctcctgattcagcactagagccataggtatgccttaaaacagggttgggccactcatctgtttcctaaacttctaatgcatgtacaatatatcagtttccaactttaaacaatcaggataaggaaaccaacttgtatactggatgcagtgcaataaagtaccttttcattgtc

SEQ ID NO: 536 - protein, 1252 aa, Zea mays
  misc_feature: PFam Name: 2OG-FeII_Oxy; PFam Description: 2OG-Fe(II)
  misc_feature: GI Number: 34898354; NR Description: Similar to leucoanthocyanidin dioxygenase.(AI440611) [Oryza sativa (japonica cultivar-group)] >gi|5295961|dbj|BAA81862.1| Similar to leucoanthocyanidin dioxygenase.(AI440611) [Oryza sativa (japonica
  misc_feature: GI Number: 21387115; NR Description: strong similarity to naringenin 3-dioxygenase [Arabidopsis thaliana] >gi|20260150|gb|AAM12973.1| strong similarity to naringenin
  misc_feature: GI Number: 11045078; NR Description: naringenin 3-dioxygenase
  misc_feature: GI Number: 18414636; NR Description: oxidoreductase,
  misc_feature: GI Number: 21593639; NR Description: naringenin 3-dioxygenase
TTACCATTACGGCATTACCTACACCGTCGCCTAATTTGCCAACGCCCGCCGCCGTTCCGATGGAAACCGCCGAGCCGGCGCGCGTCCAAGCCCTCGCTGAGGCCGGCGTGTTCCGCCTCCCGGCGCAGTACATCCAGCCGCCTGAGCACAGACCGACCCCCTCGCCTTCTCCTATTGCCGCGGCGCTCTCCGTGCCGGTCGTCGACCTCTCAACCTCCACCGCCACCGACGCCGTCCGCGCCGCGTGCGCGGACTGGGGCGCCTTTCACGTGGTCGGCCACGGCGTGCCGGGGGAGCTCCTCGACGCGGTGCGCGCGGCAGGGCTCGCGTTCTTCCGCGCGCCCATGGAGGACAAGCTCCGGTTCGCCTGCGACCCGGCCAGGGGCGCCGCCTCGGAAGGGTACGGCAGCCGCATGCTCGCCAACGACGACTCCGTGCTCGACTGGCGCGACTACTTTGACCACCACACGCTCCCGGAGTCCCGCTGTGATCCCGCCCGCTGGCCCGACTTCGTCCCCGGTTACAGAGATACTATTGCAAAATACAGCCACAGCATGAAGGATCTTGCTAAAAAATTGTTGTGCATCATCTCAGAAAATCTGAGCCTGCCACCATCTTATATACAAGAGGCGGTTGGAGAAGTTTTCCAGAACATTACTATTAGCTACTATTCTCCGTGTCCACAACCTGATCTTGCTCTTGGGTTACAATCTCATTCTGATATGGGCGCAATAACACTTCTGATACAAGATGATGTTGGTGGGCTTGAAGTATTAAAGGATGGAATGTGGATACCTGTGCCTGCTTTGCGTGATGGCATCCTTGTGATTCTCGCTGATCAGACAGAGATCATCACCAATGGAAGATACAAGAGTTCAGTTCATCGAGCTGTTGTCAATGCTGAGCGTGCCCGCTTATCAGTAGCAACATTTTATGATCCATCAAAATCAAGGAAAATATGCACTGCCCCGCAGCTTGTGAGTGAGAATGAACCACAAAAGTATCGGGATGTAATTTATGGTGACTATGTCTCATCTTGGTATAGCAAAGGTCCAGAGGGCAAGCGAAACATCGATGCCCTCCTGATTCAGCACTAGAGCCATAGGTATGCCTTAAAACAGGGTTGGGCCACTCATCTGTTTCCTAAACTTCTAATGCATGTACAATATATCAGTTTCCAACTTTAAACAATCAGGATAAGGAAACCAACTTGTATACTGGATGCAGTGCAATAAAGTACCTTTTCATTGTC

SEQ ID NO: 537 - DNA, 1420 bp, Zea mays
  misc_feature (1)..(1420): Ceres cDNA ID no. 12344013
  misc_feature (1)..(1420): Ceres CLONE  ID no. 264967
  misc_feature (1)..(1420): Also known as  Ceres CDNA ID no. 23774928
attcaacgtagggtacattatataataataagctaatagcagcgccacgcaccgacaccaatacgccatgggttccatcatggagcaacgctgcaacaacgatcagcaggcgctgctcgacgctcagctcgagctctggcacagcacgttcgcgttcatcaagtccatggcgttcaagtcggcgctggagctcggcatcgccgacgccatccactgccacggcggcaccgccacgctcacccagatagccaccaaggccgcgctccacccgtccaagacaccgtgcctgcgcaggctcatgcgcgcgctcacagtcgccggcatcttcagcgtcgccaagaactcgtccgacgatgacggcgatcagcacgtctacggcctcactccggcctcccgacttcttgtcggctcgtcacagaacttggctccaacactgagcctcatccttaacaacgtcttcgtggccccgttccttgacctcggcacgtggttcgagagcgcgctgccggccacagacctgccgctcttcgagctgtcccaccggaagaacgtgtgggacgtcgtcggccacgacccgtccgtgagccagctcttcaacgccgggatggtcgcggatacccgcttcctcatggacatcgccgtcagggagtgcggcgacgtgtttcaggggatacgctccctggtcgacgttggcggcggccatggcgcggcggcgcaggccatctctgcggcgttccctgccatacagtgcaccgtgctggaccttgcacacgtggtcgcaaccgctcccgcttgcgctgggctcagcttcgttgctggcgacatgtttgaggccattccgccagcgaatgctgtcttcctcaagtggatcatgcacgactggggtgacactgagtgtgtcacgatactaaagaactgcaagaaagctatacctccacgagatgcaggcggcaaggtgataatagtagataccgtggttggtgcagggcctccaaaccttaagaacaaagagacacaggtcatgtctgatctcttctttatgatcgtcaacggccttgagagagatgagcaggaatggaggaacgtcatctttgaagctggtttcagtgactacataatcataccagttttaggtgttcgatcaatcatcgagctatacccctgaaatataatccagcttcctcagccggcggccagctcatcacctacatgttgaatgctttggcgtgtggatctgtgtgtgtgttttttcctttaagaacagtgtgcatgtgtgtttaataaattggtatatatagttatatactcactaaaaggatggtttatgtatgcatgtatgcaagtgttccaaccattattatgtctccaaagtgaagaagttgcgtttttcaattttaaggaatgaactccaggattttct

SEQ ID NO: 538 - protein, 1420 aa, Zea mays
  misc_feature: PFam Name: Methyltransf_2; PFam Description: O-methyltransferase
  misc_feature: PFam Name: Dimerisation; PFam Description: Dimerisation domain
  misc_feature: GI Number: 51451359; NR Description: putative o-methyltransferase ZRP4 [Oryza sativa (japonica cultivar-group)] >gi|46575944|gb|AAT01305.1| putative o-methyltransferase ZRP4
  misc_feature: GI Number: 51451358; NR Description: putative o-methyltransferase ZRP4 [Oryza sativa (japonica cultivar-group)] >gi|46575943|gb|AAT01304.1| putative o-methyltransferase ZRP4
  misc_feature: GI Number: 55297348; NR Description: putative o-methyltransferase [Oryza sativa (japonica cultivar-group)] gi|55297295|dbj|BAD69125.1| putative o-methyltransferase [Oryza
  misc_feature: GI Number: 50253195; NR Description: flavonoid 7-O-methyltransferase-like [Oryza sativa (japonica cultivar-group)] >gi|50252861|dbj|BAD29092.1| flavonoid 7-O-methyltransferase-like
  misc_feature: GI Number: 51535782; NR Description: putative O-methyltransferase [Oryza sativa (japonica cultivar-group)] >gi|51535174|dbj|BAD37886.1| putative O-methyltransferase [Oryza
ATTCAACGTAGGGTACATTATATAATAATAAGCTAATAGCAGCGCCACGCACCGACACCAATACGCCATGGGTTCCATCATGGAGCAACGCTGCAACAACGATCAGCAGGCGCTGCTCGACGCTCAGCTCGAGCTCTGGCACAGCACGTTCGCGTTCATCAAGTCCATGGCGTTCAAGTCGGCGCTGGAGCTCGGCATCGCCGACGCCATCCACTGCCACGGCGGCACCGCCACGCTCACCCAGATAGCCACCAAGGCCGCGCTCCACCCGTCCAAGACACCGTGCCTGCGCAGGCTCATGCGCGCGCTCACAGTCGCCGGCATCTTCAGCGTCGCCAAGAACTCGTCCGACGATGACGGCGATCAGCACGTCTACGGCCTCACTCCGGCCTCCCGACTTCTTGTCGGCTCGTCACAGAACTTGGCTCCAACACTGAGCCTCATCCTTAACAACGTCTTCGTGGCCCCGTTCCTTGACCTCGGCACGTGGTTCGAGAGCGCGCTGCCGGCCACAGACCTGCCGCTCTTCGAGCTGTCCCACCGGAAGAACGTGTGGGACGTCGTCGGCCACGACCCGTCCGTGAGCCAGCTCTTCAACGCCGGGATGGTCGCGGATACCCGCTTCCTCATGGACATCGCCGTCAGGGAGTGCGGCGACGTGTTTCAGGGGATACGCTCCCTGGTCGACGTTGGCGGCGGCCATGGCGCGGCGGCGCAGGCCATCTCTGCGGCGTTCCCTGCCATACAGTGCACCGTGCTGGACCTTGCACACGTGGTCGCAACCGCTCCCGCTTGCGCTGGGCTCAGCTTCGTTGCTGGCGACATGTTTGAGGCCATTCCGCCAGCGAATGCTGTCTTCCTCAAGTGGATCATGCACGACTGGGGTGACACTGAGTGTGTCACGATACTAAAGAACTGCAAGAAAGCTATACCTCCACGAGATGCAGGCGGCAAGGTGATAATAGTAGATACCGTGGTTGGTGCAGGGCCTCCAAACCTTAAGAACAAAGAGACACAGGTCATGTCTGATCTCTTCTTTATGATCGTCAACGGCCTTGAGAGAGATGAGCAGGAATGGAGGAACGTCATCTTTGAAGCTGGTTTCAGTGACTACATAATCATACCAGTTTTAGGTGTTCGATCAATCATCGAGCTATACCCCTGAAATATAATCCAGCTTCCTCAGCCGGCGGCCAGCTCATCACCTACATGTTGAATGCTTTGGCGTGTGGATCTGTGTGTGTGTTTTTTCCTTTAAGAACAGTGTGCATGTGTGTTTAATAAATTGGTATATATAGTTATATACTCACTAAAAGGATGGTTTATGTATGCATGTATGCAAGTGTTCCAACCATTATTATGTCTCCAAAGTGAAGAAGTTGCGTTTTTCAATTTTAAGGAATGAACTCCAGGATTTTCT

SEQ ID NO: 539 - DNA, 1729 bp, Zea mays
  misc_feature (1)..(1729): Ceres cDNA ID no. 12344108
  misc_feature (1)..(1729): Ceres CLONE  ID no. 283235
  misc_feature (1)..(1729): Also known as  Ceres CDNA ID no. 23765359
gctccgttttcttttcgcccacattcgccgttttgcctcgccatcgcatcgtccgcgcctccctctcatcgttcttccccggtacgactcgacggcgggcgtgggcgctggagttgcggctcggaggccgaggcgccgggtggtgcgttgggtgcgctcggttcgggagatcccggactttgctgctcgcgcggtcagacagggagcgccggaggaggaggaggctgtgcaagtgcaagctgtgctgaactaagggttctggcttcggactctgtgtacgcgccgcggcaggagggagctggagatgtacgggccgccgtcccgaggcggcgcgggagccggcgctgccggagagcagccgagggtttaccaagtttggcgaggaagcaacgagtttttcttgcaaggccggttcatatttggacctgatgtgagatccttgtttctcaccatattccttattcttgcaccagtggtggtcttctgcatatttgtggccagacatcttatcaatgactttcctgatcattggggagtttcagtcatggtcatagtgattgtcttcacaatatacgatttgacactgctccttcttacctctggtagagatcctggtatagtgcctcgtaacacccatcctcctgaacctgaagctattgatatgaacaatgatgctggaaatggtcagacaccacaacagttgcggttgccacggacaaaggatgttatcgtaaatgggaccattgtgaaagtcaagtactgtgacacctgcatgctgtacagaccacctcgatgctcacactgttctatctgtaataactgtgtggagcgctttgatcaccactgcccttgggttgggcagtgcataggattgcgcaattatcggttcttctatatgtttgtattctctacaacattactgtgtctctatgtatttggcttctgctttgtgtacattgtcaagattaaagacgcagagcagtcgacgttctggaaagcaatgttaaagaccccagcatcaatcgttctgatcatatactgcttcatctgtgtgtggtttgtgggtggtctgtctgtcttccatttctatctcatgagcactaaccagacaacctatgagaacttcagataccgctatgatcggcgggacaatccgtacaacagagggactgtgaacaacttcatggagatattctgcacctcagtcgctccttccaaaaacaatttccgagctagggtcccagcagagcaaggtttacagcaagcacgtgcgccagcaaggggtttcatgagcccaaacatgggtaaacctattggggaacttgaattgggcaggaagccaatatcatgggatgaacctcggtcagcagctgatatcagagacttggaggttggtctaggcagcctactggacgagaaggaaggcagggtagcccatgcatccccggacctgagcagagaagcccttcctgagcttgtggaagggagggctggtacgcattcgaggcgatcaagctggggtcacagaagtgggacctcggcctccatggatagccttgctgcgcaaatggggaccgcagaatctcactggggctccattagcagtgtccatggtacaaccagtggagctcactagcaagccgctccacgtcttgatgcgtctctttgtgtaaacctgcctgataccaccaactaagaagcaacctttgcgtgctctgtgcgcctgtgc

SEQ ID NO: 540 - protein, 1729 aa, Zea mays
  misc_feature: PFam Name: zf-DHHC; PFam Description: DHHC zinc finger domain
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 57900122; NR Description: putative zisp [Oryza sativa (japonica cultivar-group)] gi|57899394|dbj|BAD88041.1|
  misc_feature: GI Number: 30688566; NR Description: zinc finger (DHHC type)
  misc_feature: GI Number: 30693084; NR Description: zinc finger (DHHC type)
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
GCTCCGTTTTCTTTTCGCCCACATTCGCCGTTTTGCCTCGCCATCGCATCGTCCGCGCCTCCCTCTCATCGTTCTTCCCCGGTACGACTCGACGGCGGGCGTGGGCGCTGGAGTTGCGGCTCGGAGGCCGAGGCGCCGGGTGGTGCGTTGGGTGCGCTCGGTTCGGGAGATCCCGGACTTTGCTGCTCGCGCGGTCAGACAGGGAGCGCCGGAGGAGGAGGAGGCTGTGCAAGTGCAAGCTGTGCTGAACTAAGGGTTCTGGCTTCGGACTCTGTGTACGCGCCGCGGCAGGAGGGAGCTGGAGATGTACGGGCCGCCGTCCCGAGGCGGCGCGGGAGCCGGCGCTGCCGGAGAGCAGCCGAGGGTTTACCAAGTTTGGCGAGGAAGCAACGAGTTTTTCTTGCAAGGCCGGTTCATATTTGGACCTGATGTGAGATCCTTGTTTCTCACCATATTCCTTATTCTTGCACCAGTGGTGGTCTTCTGCATATTTGTGGCCAGACATCTTATCAATGACTTTCCTGATCATTGGGGAGTTTCAGTCATGGTCATAGTGATTGTCTTCACAATATACGATTTGACACTGCTCCTTCTTACCTCTGGTAGAGATCCTGGTATAGTGCCTCGTAACACCCATCCTCCTGAACCTGAAGCTATTGATATGAACAATGATGCTGGAAATGGTCAGACACCACAACAGTTGCGGTTGCCACGGACAAAGGATGTTATCGTAAATGGGACCATTGTGAAAGTCAAGTACTGTGACACCTGCATGCTGTACAGACCACCTCGATGCTCACACTGTTCTATCTGTAATAACTGTGTGGAGCGCTTTGATCACCACTGCCCTTGGGTTGGGCAGTGCATAGGATTGCGCAATTATCGGTTCTTCTATATGTTTGTATTCTCTACAACATTACTGTGTCTCTATGTATTTGGCTTCTGCTTTGTGTACATTGTCAAGATTAAAGACGCAGAGCAGTCGACGTTCTGGAAAGCAATGTTAAAGACCCCAGCATCAATCGTTCTGATCATATACTGCTTCATCTGTGTGTGGTTTGTGGGTGGTCTGTCTGTCTTCCATTTCTATCTCATGAGCACTAACCAGACAACCTATGAGAACTTCAGATACCGCTATGATCGGCGGGACAATCCGTACAACAGAGGGACTGTGAACAACTTCATGGAGATATTCTGCACCTCAGTCGCTCCTTCCAAAAACAATTTCCGAGCTAGGGTCCCAGCAGAGCAAGGTTTACAGCAAGCACGTGCGCCAGCAAGGGGTTTCATGAGCCCAAACATGGGTAAACCTATTGGGGAACTTGAATTGGGCAGGAAGCCAATATCATGGGATGAACCTCGGTCAGCAGCTGATATCAGAGACTTGGAGGTTGGTCTAGGCAGCCTACTGGACGAGAAGGAAGGCAGGGTAGCCCATGCATCCCCGGACCTGAGCAGAGAAGCCCTTCCTGAGCTTGTGGAAGGGAGGGCTGGTACGCATTCGAGGCGATCAAGCTGGGGTCACAGAAGTGGGACCTCGGCCTCCATGGATAGCCTTGCTGCGCAAATGGGGACCGCAGAATCTCACTGGGGCTCCATTAGCAGTGTCCATGGTACAACCAGTGGAGCTCACTAGCAAGCCGCTCCACGTCTTGATGCGTCTCTTTGTGTAAACCTGCCTGATACCACCAACTAAGAAGCAACCTTTGCGTGCTCTGTGCGCCTGTGC

SEQ ID NO: 541 - DNA, 1462 bp, Zea mays
  misc_feature (1)..(1462): Ceres cDNA ID no. 12344135
  misc_feature (1)..(1462): Ceres CLONE  ID no. 286263
  misc_feature (1)..(1462): Also known as  Ceres CDNA ID no. 23850887
tttttctcagccctctcagtctcacacaccacaccagagcagcgcagccgagcatgcactcatcacatcagctcctcgtctcctagctttcctattcctgccttgataattggccaattgttcgatctccttctttactaccccctttgctttcgttgctgctactactactgttccatctcctaggtttcgttgttgtccctgcaggccgccactgagtgatttgttagcagataagatttagatctcccagataaaaaaaagaggttgagaggagagctagcactaggcactagcaagcctgctgtgaggtgaatatggatccagtcgcagcatccatacacggtcatcatcttcctccaccgttcaacacccgggacttccatcaccatctccagcaacagcagcagcagctcaagaccgaggacgaccacggcagcggcgcgccaggactgttcggcagccgcggcaccaagggcgaccacgagaataatgaccagaacagtggaaacagcaacggaagtggcggaggaggaggcgacgagctggcgctggttccaccatccggcgccgggccagagggtggagagcccaccctacgccgcccgaaaggccggccggcggggtccaagaacaagccgaagccgcccatcatcatcacgagggacagcgccaacacgctccggacgcacgtcatggaggtggccagcggctgcgacatctccgagagcatcacggccttcgcgcgccgcaggcagcgcggggtctgcgtcctcagcggcgccggcaccgtgaccaacgtcaccctgcggcagccggcctcccagggcgcggtcgtcgccctccacggccttcgagatcctgtccctctccggctcctttctcccgccgcccgcgccgcccgaagccacggggctcaccgtctaccttgccggcggccaggggcaggtggtgggcggcagcgtcgtcggcgcgctgacagcagccggggccggtggtgataatggcggcatctttcgccaacgcggtgtacgagcggttgccgttggaggaggatgacatgctcgctgcgcaagcacaggccgacagtgcaggaattctcgcgggtgcgcagctcgccggcgctgtggatccaagcctcttccagggactgccaccgaacctgatgtgcaacgtgcagatgccgccagaagcagcctacggatggagcccgggcgccgccggtggccgtccggcgccgttctaataactgataagagcgcgcacgcggcttagatatggttaagtgatttagctttcttcttcgatcttttgcttgaatttttatcgtggagaatttccgtgggaattgcatatgatttcgcatgttaattagtaagctatcttaatactgtttcagaatatgtagctcgatttctgccatttcgtttcgctattccttgtgtcgtcgtaactcttgttc

SEQ ID NO: 542 - protein, 1462 aa, Zea mays
  misc_feature: GI Number: 50252749; NR Description: putative DNA-binding
  misc_feature: GI Number: 7269128; NR Description: putative DNA binding protein [Arabidopsis thaliana] >gi|2827558|emb|CAA16566.1| putative DNA binding protein [Arabidopsis thaliana] >gi|15235815|ref|NP_194012.1| DNA-binding protein-related
  misc_feature: GI Number: 56121926; NR Description: At2g45430 [Arabidopsis thaliana] gi|50198795|gb|AAT70431.1| At2g45430 [Arabidopsis thaliana] gi|2583112|gb|AAB82621.1| putative AT-hook DNA-binding protein [Arabidopsis thaliana] gi|25348246|pir||D84890 probable
  misc_feature: GI Number: 32815961; NR Description: At4g12050 [Arabidopsis thaliana] >gi|4586110|emb|CAB40946.1| putative DNA-binding protein [Arabidopsis thaliana] >gi|7267906|emb|CAB78248.1| putative DNA-binding protein [Arabidopsis thaliana]
  misc_feature: GI Number: 55296989; NR Description: putative AT-hook protein
TTTTTCTCAGCCCTCTCAGTCTCACACACCACACCAGAGCAGCGCAGCCGAGCATGCACTCATCACATCAGCTCCTCGTCTCCTAGCTTTCCTATTCCTGCCTTGATAATTGGCCAATTGTTCGATCTCCTTCTTTACTACCCCCTTTGCTTTCGTTGCTGCTACTACTACTGTTCCATCTCCTAGGTTTCGTTGTTGTCCCTGCAGGCCGCCACTGAGTGATTTGTTAGCAGATAAGATTTAGATCTCCCAGATAAAAAAAAGAGGTTGAGAGGAGAGCTAGCACTAGGCACTAGCAAGCCTGCTGTGAGGTGAATATGGATCCAGTCGCAGCATCCATACACGGTCATCATCTTCCTCCACCGTTCAACACCCGGGACTTCCATCACCATCTCCAGCAACAGCAGCAGCAGCTCAAGACCGAGGACGACCACGGCAGCGGCGCGCCAGGACTGTTCGGCAGCCGCGGCACCAAGGGCGACCACGAGAATAATGACCAGAACAGTGGAAACAGCAACGGAAGTGGCGGAGGAGGAGGCGACGAGCTGGCGCTGGTTCCACCATCCGGCGCCGGGCCAGAGGGTGGAGAGCCCACCCTACGCCGCCCGAAAGGCCGGCCGGCGGGGTCCAAGAACAAGCCGAAGCCGCCCATCATCATCACGAGGGACAGCGCCAACACGCTCCGGACGCACGTCATGGAGGTGGCCAGCGGCTGCGACATCTCCGAGAGCATCACGGCCTTCGCGCGCCGCAGGCAGCGCGGGGTCTGCGTCCTCAGCGGCGCCGGCACCGTGACCAACGTCACCCTGCGGCAGCCGGCCTCCCAGGGCGCGGTCGTCGCCCTCCACGGCCTTCGAGATCCTGTCCCTCTCCGGCTCCTTTCTCCCGCCGCCCGCGCCGCCCGAAGCCACGGGGCTCACCGTCTACCTTGCCGGCGGCCAGGGGCAGGTGGTGGGCGGCAGCGTCGTCGGCGCGCTGACAGCAGCCGGGGCCGGTGGTGATAATGGCGGCATCTTTCGCCAACGCGGTGTACGAGCGGTTGCCGTTGGAGGAGGATGACATGCTCGCTGCGCAAGCACAGGCCGACAGTGCAGGAATTCTCGCGGGTGCGCAGCTCGCCGGCGCTGTGGATCCAAGCCTCTTCCAGGGACTGCCACCGAACCTGATGTGCAACGTGCAGATGCCGCCAGAAGCAGCCTACGGATGGAGCCCGGGCGCCGCCGGTGGCCGTCCGGCGCCGTTCTAATAACTGATAAGAGCGCGCACGCGGCTTAGATATGGTTAAGTGATTTAGCTTTCTTCTTCGATCTTTTGCTTGAATTTTTATCGTGGAGAATTTCCGTGGGAATTGCATATGATTTCGCATGTTAATTAGTAAGCTATCTTAATACTGTTTCAGAATATGTAGCTCGATTTCTGCCATTTCGTTTCGCTATTCCTTGTGTCGTCGTAACTCTTGTTC

SEQ ID NO: 543 - DNA, 1600 bp, Zea mays
  misc_feature (1)..(1600): Ceres cDNA ID no. 12344156
  misc_feature (1)..(1600): Ceres CLONE  ID no. 287701
  misc_feature (1)..(1600): Also known as  Ceres CDNA ID no. 23780076
acacgacccacctaccccgccgccgccgccgccgcatccccctcgattccgtctggcgatcgagggctcccagacacatcacagatacaccacgccaagccaaatcgagcaacgtctatcatcatattataatttcccctcattcatctcacagtccctcccaggcctcccctccctcctcccccgtcgccaaccaacctccaacccccagccgatcgcgtcggagatgctgggcgtcgcgcggaggcggctcggatctggatgcgtgctcgcccagctggcgcaggccctccgccccgccgccgctcccgccaggacctactccgccgcggccaaggagataactgtacgggaagcattgaataccgcattagatgaagaaatgtcggcagacccttctgttttcttgatgggagaagaggttggcgagtaccaaggtccatacaagatatccaagggtttgcttgacaagtatggccccgatagggttctcgatactccgatcactgaggcgggcttcactggcattggtgttggtgccgcttaccatggtcttcgacctattgtagagttcatgacatttaacttttcgatgcaggcaattgatcacataattaattcagctgccaagtcgaactacatgtctgctgggcagatatctgttcctattgtctttaggggtccaaatggtgctgctgctggagttggtgcccaacactcacagtgctatgcagcttggtatgcacatgttcccggattgaaagttctagctccatattctgcagaagatgctcgaggtttgctgaaagcagcaatcagggatccagatcctgttgtgttccttgaaaatgaacttctttatggtgaatcatttcctgtatctgctgaggtacttgattctagcttctgccttccgattggaaaggctaagatagagcgacaagggaaagatgtcactatcactgcattctccaaaatggtgggatatgcccttcaggccgctgatatactggccaaggaaggtatcagtgccgaggtaatcaatcttcgctcaattagaccgctggatagagctactattaatgcatctgtgaggaaaaccaatagattggtaaccgtagaagaaggcttccctcaacatgggattggtgcggaaatatgcatgtctgttgtagaggacagctttgagtatcttgatgcaccagtcgagaggattgctggagctgatgtgcccatgccgtacgctgccaaccttgagaggatggctgttccacaggtcgatgacatcgtccgggcagccaagcgtgcttgctacagggcagcagtaccgatggcagcaaccgcctagtccagcagaaccctgcatgttgcatttctttgtctaattttaatgtccgtgctgcagaaagacgtgtcacataatggtgtgacgagtacccactgccgctgcaactcaactatagcatgagctgagtttttgtagagccaccgagaggtgttcagtactccagttccagttccgcttatcttcgccgccgcagccgaaggctgcgcatgactctgcgtctgttttatggttcacgaatgattgcagatttgc

SEQ ID NO: 544 - protein, 1600 aa, Zea mays
  misc_feature: PFam Name: Transket_pyr; PFam Description: Transketolase,
  misc_feature: PFam Name: Transketolase_C; PFam Description: Transketolase,
  misc_feature: GI Number: 23507745; NR Description: At5g50850/K16E14_1 [Arabidopsis thaliana] >gi|8953766|dbj|BAA98121.1| pyruvate dehydrogenase E1 component beta subunit, mitochondrial precursor (PDHE1-B) [Arabidopsis thaliana] >gi|17979466|gb|AAL50070.1|
  misc_feature: GI Number: 520478; NR Description: pyruvate dehydrogenase E1
  misc_feature: GI Number: 3850999; NR Description: pyruvate dehydrogenase E1
  misc_feature: GI Number: 3851001; NR Description: pyruvate dehydrogenase E1
  misc_feature: GI Number: 3851003; NR Description: pyruvate dehydrogenase E1
ACACGACCCACCTACCCCGCCGCCGCCGCCGCCGCATCCCCCTCGATTCCGTCTGGCGATCGAGGGCTCCCAGACACATCACAGATACACCACGCCAAGCCAAATCGAGCAACGTCTATCATCATATTATAATTTCCCCTCATTCATCTCACAGTCCCTCCCAGGCCTCCCCTCCCTCCTCCCCCGTCGCCAACCAACCTCCAACCCCCAGCCGATCGCGTCGGAGATGCTGGGCGTCGCGCGGAGGCGGCTCGGATCTGGATGCGTGCTCGCCCAGCTGGCGCAGGCCCTCCGCCCCGCCGCCGCTCCCGCCAGGACCTACTCCGCCGCGGCCAAGGAGATAACTGTACGGGAAGCATTGAATACCGCATTAGATGAAGAAATGTCGGCAGACCCTTCTGTTTTCTTGATGGGAGAAGAGGTTGGCGAGTACCAAGGTCCATACAAGATATCCAAGGGTTTGCTTGACAAGTATGGCCCCGATAGGGTTCTCGATACTCCGATCACTGAGGCGGGCTTCACTGGCATTGGTGTTGGTGCCGCTTACCATGGTCTTCGACCTATTGTAGAGTTCATGACATTTAACTTTTCGATGCAGGCAATTGATCACATAATTAATTCAGCTGCCAAGTCGAACTACATGTCTGCTGGGCAGATATCTGTTCCTATTGTCTTTAGGGGTCCAAATGGTGCTGCTGCTGGAGTTGGTGCCCAACACTCACAGTGCTATGCAGCTTGGTATGCACATGTTCCCGGATTGAAAGTTCTAGCTCCATATTCTGCAGAAGATGCTCGAGGTTTGCTGAAAGCAGCAATCAGGGATCCAGATCCTGTTGTGTTCCTTGAAAATGAACTTCTTTATGGTGAATCATTTCCTGTATCTGCTGAGGTACTTGATTCTAGCTTCTGCCTTCCGATTGGAAAGGCTAAGATAGAGCGACAAGGGAAAGATGTCACTATCACTGCATTCTCCAAAATGGTGGGATATGCCCTTCAGGCCGCTGATATACTGGCCAAGGAAGGTATCAGTGCCGAGGTAATCAATCTTCGCTCAATTAGACCGCTGGATAGAGCTACTATTAATGCATCTGTGAGGAAAACCAATAGATTGGTAACCGTAGAAGAAGGCTTCCCTCAACATGGGATTGGTGCGGAAATATGCATGTCTGTTGTAGAGGACAGCTTTGAGTATCTTGATGCACCAGTCGAGAGGATTGCTGGAGCTGATGTGCCCATGCCGTACGCTGCCAACCTTGAGAGGATGGCTGTTCCACAGGTCGATGACATCGTCCGGGCAGCCAAGCGTGCTTGCTACAGGGCAGCAGTACCGATGGCAGCAACCGCCTAGTCCAGCAGAACCCTGCATGTTGCATTTCTTTGTCTAATTTTAATGTCCGTGCTGCAGAAAGACGTGTCACATAATGGTGTGACGAGTACCCACTGCCGCTGCAACTCAACTATAGCATGAGCTGAGTTTTTGTAGAGCCACCGAGAGGTGTTCAGTACTCCAGTTCCAGTTCCGCTTATCTTCGCCGCCGCAGCCGAAGGCTGCGCATGACTCTGCGTCTGTTTTATGGTTCACGAATGATTGCAGATTTGC

SEQ ID NO: 545 - DNA, 1676 bp, Zea mays
  misc_feature (1)..(1676): Ceres cDNA ID no. 12344231
  misc_feature (1)..(1676): Ceres CLONE  ID no. 294971
  misc_feature (1)..(1676): Also known as  Ceres CDNA ID no. 23771206
aggcgatgagcgcctctcgcgacgccagggcggagagctagccggccggagcccacacgcagctggaagcaccagatcaccgatcgtgccggccgagcggcggcgcaggcgcacaggcgcttacatgggagtagaggcgggcgggtgcgggcggagggcggtcgtcaccgggttctacgtctggggctgggagttcctcaccgccctccttctcttctcggccgccgtcgccgccgcagactcctactagcaagctacctaccttctttctttcattcccttaggtagctcagccgtacacacaacagcacacaagtcatcagttactagctagttagtagcctatacaacacatacatatatacatacaaaggtgagtgaggttcgcgtgcaagcagagccaatcgtgccgatcgagctatatacatagccggcggcgagagatgggagaagcggcctcggccgtggcggcgtcgaagaggggcggcggcgggccggcgccgttcctgaccaagacgcaccagatggtggaggagcggggcacggacgaggtgatctcgtgggcggagcagggccgctccttcgtggtgtggaagcccgttgagctggcgcgcgacctcctcccgctccacttcaagcactgcaacttctcctccttcgtccgccagctcaacacctacggtttccggaaggtggtgccggaccggtgggagttcgcgaacgacaacttccgtcgaggcgagcagggtctcctgtccggcatccgccgccgcaagtcaacggcgctgcagatgtccaagtccggatccggcggcagcggcggcgtgaacgccacgttccccccgcctctgccccctccacctcccgcgtcggccaccacgtccggcgtccacgagcgcagctcgtcgtcggcgtcgtcgccaccgcgggcgcccgacctggccagcgagaacgagcagctcaagaaggacaaccacacgctgtccgtcgagctggcgcaggcgcgccggcactgcgaggagctcctgggcttcctctcgcgcttcctcgacgtccggcagctcgacctccggctgctcatgcaggaggacgtgcgagcgggggcaagcgacgacggcgcacagcgccgcgcgcacgcagtggccagccagctggagcgcggcggcggcgaggaggggaagagcgtgaagctgttcggcgtactcttaaaggacgccgcgaggaagaggggccggtgcgaggaagcggcggccagcgagcggcccatcaagatgatcagggtcggcgagccgtgggtcggcgtcccgtcgtcgggcccgggccggtgcggcggcgagaattaactgtcatccaatgtgaggttgatgacaaggacagtttcatccatcatatcgagcaagtaacaaagccagtgctgtggtaaaactgcaaagacagaacacaggacacaggagaaatataggcgtaaggcatgttaattaagaattaattatatatgggatgcttttgaagtagcaagattggaagtagagataagtaaaacgggctagaagcagcgcccatgtgttcagaatggaaaattagcgtttccgtgtgtgtgttaagaaaaacttatatgcgctttctgcgagcacggttgattcttaagagcgacagcaaatgaaaggtgtattatt

SEQ ID NO: 546 - protein, 1676 aa, Zea mays
  misc_feature: PFam Name: HSF_DNA-bind; PFam Description: HSF-type DNA-binding
  misc_feature: GI Number: 51536304; NR Description: putative heat shock
  misc_feature: GI Number: 5821136; NR Description: heat shock factor
  misc_feature: GI Number: 19488; NR Description: heat stress transcription factor [Lycopersicon peruvianum] >gi|100267|pir||S12361 heat shock transcription factor HSF24 - Peruvian tomato >gi|123684|sp|P22335|HSF2_LYCPE HEAT SHOCK FACTOR STRESS
  misc_feature: GI Number: 662930; NR Description: heat shock transcription factor 34 [Glycine max] >gi|2129831|pir||S59538 heat shock
  misc_feature: GI Number: 21539531; NR Description: heat shock transcription factor HSF4 [Arabidopsis thaliana] >gi|2464881|emb|CAB16764.1| heat shock transcription factor HSF4 [Arabidopsis thaliana] >gi|7270648|emb|CAB80365.1| heat shock transcription factor HSF4
AGGCGATGAGCGCCTCTCGCGACGCCAGGGCGGAGAGCTAGCCGGCCGGAGCCCACACGCAGCTGGAAGCACCAGATCACCGATCGTGCCGGCCGAGCGGCGGCGCAGGCGCACAGGCGCTTACATGGGAGTAGAGGCGGGCGGGTGCGGGCGGAGGGCGGTCGTCACCGGGTTCTACGTCTGGGGCTGGGAGTTCCTCACCGCCCTCCTTCTCTTCTCGGCCGCCGTCGCCGCCGCAGACTCCTACTAGCAAGCTACCTACCTTCTTTCTTTCATTCCCTTAGGTAGCTCAGCCGTACACACAACAGCACACAAGTCATCAGTTACTAGCTAGTTAGTAGCCTATACAACACATACATATATACATACAAAGGTGAGTGAGGTTCGCGTGCAAGCAGAGCCAATCGTGCCGATCGAGCTATATACATAGCCGGCGGCGAGAGATGGGAGAAGCGGCCTCGGCCGTGGCGGCGTCGAAGAGGGGCGGCGGCGGGCCGGCGCCGTTCCTGACCAAGACGCACCAGATGGTGGAGGAGCGGGGCACGGACGAGGTGATCTCGTGGGCGGAGCAGGGCCGCTCCTTCGTGGTGTGGAAGCCCGTTGAGCTGGCGCGCGACCTCCTCCCGCTCCACTTCAAGCACTGCAACTTCTCCTCCTTCGTCCGCCAGCTCAACACCTACGGTTTCCGGAAGGTGGTGCCGGACCGGTGGGAGTTCGCGAACGACAACTTCCGTCGAGGCGAGCAGGGTCTCCTGTCCGGCATCCGCCGCCGCAAGTCAACGGCGCTGCAGATGTCCAAGTCCGGATCCGGCGGCAGCGGCGGCGTGAACGCCACGTTCCCCCCGCCTCTGCCCCCTCCACCTCCCGCGTCGGCCACCACGTCCGGCGTCCACGAGCGCAGCTCGTCGTCGGCGTCGTCGCCACCGCGGGCGCCCGACCTGGCCAGCGAGAACGAGCAGCTCAAGAAGGACAACCACACGCTGTCCGTCGAGCTGGCGCAGGCGCGCCGGCACTGCGAGGAGCTCCTGGGCTTCCTCTCGCGCTTCCTCGACGTCCGGCAGCTCGACCTCCGGCTGCTCATGCAGGAGGACGTGCGAGCGGGGGCAAGCGACGACGGCGCACAGCGCCGCGCGCACGCAGTGGCCAGCCAGCTGGAGCGCGGCGGCGGCGAGGAGGGGAAGAGCGTGAAGCTGTTCGGCGTACTCTTAAAGGACGCCGCGAGGAAGAGGGGCCGGTGCGAGGAAGCGGCGGCCAGCGAGCGGCCCATCAAGATGATCAGGGTCGGCGAGCCGTGGGTCGGCGTCCCGTCGTCGGGCCCGGGCCGGTGCGGCGGCGAGAATTAACTGTCATCCAATGTGAGGTTGATGACAAGGACAGTTTCATCCATCATATCGAGCAAGTAACAAAGCCAGTGCTGTGGTAAAACTGCAAAGACAGAACACAGGACACAGGAGAAATATAGGCGTAAGGCATGTTAATTAAGAATTAATTATATATGGGATGCTTTTGAAGTAGCAAGATTGGAAGTAGAGATAAGTAAAACGGGCTAGAAGCAGCGCCCATGTGTTCAGAATGGAAAATTAGCGTTTCCGTGTGTGTGTTAAGAAAAACTTATATGCGCTTTCTGCGAGCACGGTTGATTCTTAAGAGCGACAGCAAATGAAAGGTGTATTATT

SEQ ID NO: 547 - DNA, 1496 bp, Zea mays
  misc_feature (1)..(1496): Ceres cDNA ID no. 12345300
  misc_feature (1)..(1496): Ceres CLONE  ID no. 258531
  misc_feature (1)..(1496): Also known as  Ceres CDNA ID no. 24282602
ccgattctctctcgcgtagtcgcgtaaatttcccagcccgaaaatggccatagccttgaggcactagtaggcacagtagaacccaaccgcggcccgctccagcagccccaccccatcgacgccgtcggcgaggggcacccaggtccgcgtcgcaccacgtcagccacacacccaccaggccaccaccgccctcagctccggtgtgcagagacgctggatggcctcgcaccagtagaatccgtccggcactttctgccctaccccaccccactccacccatccggccgcgggtggatttgaccgatatcggcaggcggccgccggcgtctgcctcgattgatccgcctcgtctcagtcctaggtatggcggcggtggcggagggatcggcgtctgctgcggcgaaggaggtggagtaccaggcgggcgtgcagaagcttgtggacctgctctccaatctcaacccggccgccaaggagttcgtcccttcctcggctccggccgcggctgcgtcgccgcccaagaaagcgttgtcggcggatgcgccggtgttcgattaccgctccaccgcaggcggcaacggggccaccgacgatcccttttacgttgggtttgggaaccagcagcgcaagagagggaatggatacatcaaccaaggaaggaggaggacaaatgataggttgaggcgtgcagacagagaggacagcgttaggcgaactgtttatgtctctgaacttgatcatactgtgacagaggagagacttgctgatatctttgctacctgtgggcatgttgttgattgccgaatttgtggtgatccccactcagttcttaggtttgcatttattgagttctctgatgaagagggtgcaagaactgcacttaaccttggaggcacaatttttggtttctaccctgttagagttttgccttcaaagacagctatcttacctgttaatccaaagtttcttcccaggacggacgatgagaaggaaatggtcatgcgaactgtctattgtacaaatatagataagatggttactcaattagatgtaaagaaattctttgaagaactttgcggtgaggtctctcggttgagacttctaggagacaatgtacattccacaaggattgcttttgttgagtttgttcatgctgagggtgccatcatggctctgaattgcagcgggatgattttgggaactctgcctgtcagggtgagtccttctaagactccggtgaagccacgtgtaaatcgaatgggatctaactgactctgcctaagctcaaccggaaggcatggccataagctgaaggcttccgcggtcctgtgcatcatgatgcatctgcttacattcttacaaacactctgtttgtacccttttgcaaacctgttggaagggaactggttaggtcaggcccttttgccttgcatttcagacatgatggaaccattgagaatgactattcggcaatcaaccatcaagtaacttctgtc

SEQ ID NO: 548 - protein, 1496 aa, Zea mays
  misc_feature: PFam Name: RRM_1; PFam Description: RNA recognition motif.
  misc_feature: GI Number: 50252270; NR Description: putative RNA-binding
  misc_feature: GI Number: 50940511; NR Description: putative RNA-binding protein RBP37 [Oryza sativa (japonica cultivar-group)] >gi|50725622|dbj|BAD33089.1| putative RNA-binding protein RBP37
  misc_feature: GI Number: 6714278; NR Description: F6N18.17 [Arabidopsis thaliana] gi|25403416|pir||F86452 protein F6N18.17 [imported] - Arabidopsis thaliana gi|15223304|ref|NP_174556.1| RNA-binding
  misc_feature: GI Number: 51970080; NR Description: putative RNA-binding protein [Arabidopsis thaliana] >gi|51969708|dbj|BAD43546.1|
  misc_feature: GI Number: 21592407; NR Description: RNA-binding protein [Arabidopsis thaliana] >gi|4539439|emb|CAB40027.1| RNA-binding protein [Arabidopsis thaliana] >gi|7267758|emb|CAB78184.1| RNA-binding protein [Arabidopsis thaliana]
CCGATTCTCTCTCGCGTAGTCGCGTAAATTTCCCAGCCCGAAAATGGCCATAGCCTTGAGGCACTAGTAGGCACAGTAGAACCCAACCGCGGCCCGCTCCAGCAGCCCCACCCCATCGACGCCGTCGGCGAGGGGCACCCAGGTCCGCGTCGCACCACGTCAGCCACACACCCACCAGGCCACCACCGCCCTCAGCTCCGGTGTGCAGAGACGCTGGATGGCCTCGCACCAGTAGAATCCGTCCGGCACTTTCTGCCCTACCCCACCCCACTCCACCCATCCGGCCGCGGGTGGATTTGACCGATATCGGCAGGCGGCCGCCGGCGTCTGCCTCGATTGATCCGCCTCGTCTCAGTCCTAGGTATGGCGGCGGTGGCGGAGGGATCGGCGTCTGCTGCGGCGAAGGAGGTGGAGTACCAGGCGGGCGTGCAGAAGCTTGTGGACCTGCTCTCCAATCTCAACCCGGCCGCCAAGGAGTTCGTCCCTTCCTCGGCTCCGGCCGCGGCTGCGTCGCCGCCCAAGAAAGCGTTGTCGGCGGATGCGCCGGTGTTCGATTACCGCTCCACCGCAGGCGGCAACGGGGCCACCGACGATCCCTTTTACGTTGGGTTTGGGAACCAGCAGCGCAAGAGAGGGAATGGATACATCAACCAAGGAAGGAGGAGGACAAATGATAGGTTGAGGCGTGCAGACAGAGAGGACAGCGTTAGGCGAACTGTTTATGTCTCTGAACTTGATCATACTGTGACAGAGGAGAGACTTGCTGATATCTTTGCTACCTGTGGGCATGTTGTTGATTGCCGAATTTGTGGTGATCCCCACTCAGTTCTTAGGTTTGCATTTATTGAGTTCTCTGATGAAGAGGGTGCAAGAACTGCACTTAACCTTGGAGGCACAATTTTTGGTTTCTACCCTGTTAGAGTTTTGCCTTCAAAGACAGCTATCTTACCTGTTAATCCAAAGTTTCTTCCCAGGACGGACGATGAGAAGGAAATGGTCATGCGAACTGTCTATTGTACAAATATAGATAAGATGGTTACTCAATTAGATGTAAAGAAATTCTTTGAAGAACTTTGCGGTGAGGTCTCTCGGTTGAGACTTCTAGGAGACAATGTACATTCCACAAGGATTGCTTTTGTTGAGTTTGTTCATGCTGAGGGTGCCATCATGGCTCTGAATTGCAGCGGGATGATTTTGGGAACTCTGCCTGTCAGGGTGAGTCCTTCTAAGACTCCGGTGAAGCCACGTGTAAATCGAATGGGATCTAACTGACTCTGCCTAAGCTCAACCGGAAGGCATGGCCATAAGCTGAAGGCTTCCGCGGTCCTGTGCATCATGATGCATCTGCTTACATTCTTACAAACACTCTGTTTGTACCCTTTTGCAAACCTGTTGGAAGGGAACTGGTTAGGTCAGGCCCTTTTGCCTTGCATTTCAGACATGATGGAACCATTGAGAATGACTATTCGGCAATCAACCATCAAGTAACTTCTGTC

SEQ ID NO: 549 - DNA, 1512 bp, Zea mays
  misc_feature (1)..(1512): Ceres cDNA ID no. 12345589
  misc_feature (1)..(1512): Ceres CLONE  ID no. 219906
  misc_feature (1)..(1512): Also known as  Ceres CDNA ID no. 23770196
caggtacctgtcctatcaccgttctctctctcgtctcttgccggcgagcggccgccgtatcgctcgctctccacggagggacgcgattgccgctacgtcccgtggggccgcgaatcggggcgttccttcgttcgttcctggctttgccgcgctgcgtggcggggatcgtctgcccgtcggtgtttgttttctagaagcgattctattgttcagatgaacctccgtgcacgccccgcatgcagtttgacgcggggacctgagatatgcctcgctatgatgaccgctatggaggcacgcgcttgtatgttagcagattggccactcgtactcgttcccgcgatttagaacatctgtttggcagatatggaagaatacgagaagtggagttgaagcgtgactatgcatttattgagttcagtgatcatcgcgatgctgatgaggctcgataccagctagatggcagggatgttgatgggagtcgtattgttgttgagtttgctaaaggggtcccacgtggttcaggtggctcacgtgaatatatggggagaggccctccaccaggtacaggtcgttgtttcaactgtggagttgatggtcactgggcaagagactgtaaagctggtgactggaaaaacaaatgctaccgttgtggagaaaggggccatatagaaagaaattgccagaacagtcctaggagtctcaggcgagagagaagttactcacggtccccatctccccgccgtggacggggccgcagtcgaagctatagcaggagcaggagccggagtcggagctatagtcgatcaagatccctgtctagatctcctaggggaggtcgtcgtgaccgtgacgataggagatcaaggagtcctagctatagcaggagccccatgcgatctgcctcgccaccagtaaaggaaaaggagcgcagccccgcacctgatggaagcaggagcccaaggagtcgcagcccccaggatcaggtgatgagcccaccaccaaaggataatggcgaaggcaatggctcagaccgtggcggcagccccagagggagggagaacagcaggagctgcagccgcagccgcagtccatctggtagtaaccgcagccctgcggccaatggacgtagccggagtcctggaggtgagcggagcccgagtcctggaggtgagcggagcccgagtcctagaggtgagcggagcccgagtcctagggctgaccgtagcccaagccccaatggcaatggtaacaatgatgctgctgctgatgtcgatgctgatgctgctgcccgcagtggctcccccactggaagcaagtcaccctgagcgctggcggtcccagattgtggtggtgcttctcaatgcaatgggcaatcgtattgctattttttgctaccatatcgaagacacaatagctacatcattttcttctctgaaacaaggactttattttgcttgctttgagatatgactcttaccctctcatggataatatatatatgatatgatgccg

SEQ ID NO: 550 - protein, 1512 aa, Zea mays
  misc_feature: PFam Name: RRM_1; PFam Description: RNA recognition motif.
  misc_feature: PFam Name: zf-CCHC; PFam Description: Zinc knuckle
  misc_feature: PFam Name: Transformer; PFam Description: Fruit fly
  misc_feature: PFam Name: S-antigen; PFam Description: S-antigen protein
  misc_feature: GI Number: 9843663; NR Description: splicing factor RSZ33
  misc_feature: GI Number: 9795142; NR Description: splicing factor-like protein [Arabidopsis thaliana] >gi|30693839|ref|NP_190918.3| zinc
  misc_feature: GI Number: 34895952; NR Description: putative splicing factor-like protein [Oryza sativa (japonica cultivar-group)] >gi|15528625|dbj|BAB64646.1| putative splicing factor-like protein
  misc_feature: GI Number: 11346381; NR Description: splicing factor-like
  misc_feature: GI Number: 42571091; NR Description: splicing factor RSZ33
CAGGTACCTGTCCTATCACCGTTCTCTCTCTCGTCTCTTGCCGGCGAGCGGCCGCCGTATCGCTCGCTCTCCACGGAGGGACGCGATTGCCGCTACGTCCCGTGGGGCCGCGAATCGGGGCGTTCCTTCGTTCGTTCCTGGCTTTGCCGCGCTGCGTGGCGGGGATCGTCTGCCCGTCGGTGTTTGTTTTCTAGAAGCGATTCTATTGTTCAGATGAACCTCCGTGCACGCCCCGCATGCAGTTTGACGCGGGGACCTGAGATATGCCTCGCTATGATGACCGCTATGGAGGCACGCGCTTGTATGTTAGCAGATTGGCCACTCGTACTCGTTCCCGCGATTTAGAACATCTGTTTGGCAGATATGGAAGAATACGAGAAGTGGAGTTGAAGCGTGACTATGCATTTATTGAGTTCAGTGATCATCGCGATGCTGATGAGGCTCGATACCAGCTAGATGGCAGGGATGTTGATGGGAGTCGTATTGTTGTTGAGTTTGCTAAAGGGGTCCCACGTGGTTCAGGTGGCTCACGTGAATATATGGGGAGAGGCCCTCCACCAGGTACAGGTCGTTGTTTCAACTGTGGAGTTGATGGTCACTGGGCAAGAGACTGTAAAGCTGGTGACTGGAAAAACAAATGCTACCGTTGTGGAGAAAGGGGCCATATAGAAAGAAATTGCCAGAACAGTCCTAGGAGTCTCAGGCGAGAGAGAAGTTACTCACGGTCCCCATCTCCCCGCCGTGGACGGGGCCGCAGTCGAAGCTATAGCAGGAGCAGGAGCCGGAGTCGGAGCTATAGTCGATCAAGATCCCTGTCTAGATCTCCTAGGGGAGGTCGTCGTGACCGTGACGATAGGAGATCAAGGAGTCCTAGCTATAGCAGGAGCCCCATGCGATCTGCCTCGCCACCAGTAAAGGAAAAGGAGCGCAGCCCCGCACCTGATGGAAGCAGGAGCCCAAGGAGTCGCAGCCCCCAGGATCAGGTGATGAGCCCACCACCAAAGGATAATGGCGAAGGCAATGGCTCAGACCGTGGCGGCAGCCCCAGAGGGAGGGAGAACAGCAGGAGCTGCAGCCGCAGCCGCAGTCCATCTGGTAGTAACCGCAGCCCTGCGGCCAATGGACGTAGCCGGAGTCCTGGAGGTGAGCGGAGCCCGAGTCCTGGAGGTGAGCGGAGCCCGAGTCCTAGAGGTGAGCGGAGCCCGAGTCCTAGGGCTGACCGTAGCCCAAGCCCCAATGGCAATGGTAACAATGATGCTGCTGCTGATGTCGATGCTGATGCTGCTGCCCGCAGTGGCTCCCCCACTGGAAGCAAGTCACCCTGAGCGCTGGCGGTCCCAGATTGTGGTGGTGCTTCTCAATGCAATGGGCAATCGTATTGCTATTTTTTGCTACCATATCGAAGACACAATAGCTACATCATTTTCTTCTCTGAAACAAGGACTTTATTTTGCTTGCTTTGAGATATGACTCTTACCCTCTCATGGATAATATATATATGATATGATGCCG

SEQ ID NO: 551 - DNA, 1549 bp, Zea mays
  misc_feature (1)..(1549): Ceres cDNA ID no. 12345645
  misc_feature (1)..(1549): Ceres CLONE  ID no. 222030
  misc_feature (1)..(1549): Also known as  Ceres CDNA ID no. 23854531
agtccgcccctcccgcctcgttctctccgccatcgtcgccgccgcctccattcctccaccagtccaccatcgccacctacgcccaaccaaacccaactccatctcttccgactataaacgcaacccaccaccgctgccgcgaacctctgcgctccgaataccccagacccccgatcctcccaatggccaccgcattttcgctgcgcgctgcggccccggccaccactccccgcgccgtctcccgatccacctccgcggcgagggtcgtgcccgtggcctcggcactggcgggacgcggaaggctggtggcgcgtgcagcagttacagcaaaggcggatgtgccatcgagcacgtccgacggccatgaggtcttgctgtttgaagctcttcgtgaggccttgatggaagagatggaattagatccaacagtgtgtgtatttggtgaagatgttggccattacggtggttcttacaaggtgacaaaaggtttggctgatacgtttggagaccttcgagttctggacacccctattgcggagaactcgtttactggcatgggagttggagcgggaatgaaagggttgagacccgtcgttgaaggcatgaacatgggattcctgctccttgcttacaaccagatctcaaataactgtggcatgcttcattacacttccggcggccagttcaaaatcccacttgtgatccgtggccccggtggtgtgggtcgtcagcttggagcagagcactcgcagcgcctggaatcgtatttccagtccatcccaggcctgcagatggtcgcctgctcgactccttacaacgctaagggcctgatgaaagctgccatcaggagcgagaaccctgtggtgctgtttgagcacgtccttctgtacaacctgaaggagaaaatcccggacgaggagtacgtgctctgcttggaggaggccgagatggtgcggcctggggagcacgtgactatactcacatactcgcgcatgaggtaccacgtgatgcaggcagcgaagacgctggtgaacaaagggtacgatcccgaggtcatcgacatcaggtcgttgaagccgtttgatctgcacactattggcaactccatcaagaagacccaccgcgtgctgatcgtggaggagtgcatgcgcacgggtgggatcggcgccagccttaggtcggccatcgtcgacaatttctgggactaccttgacgcccccatcatgtgcctgtcatctcaggatgtgcctacgccatatgctgcgactctggaggatgcaaccgttgtgcagcctgcccagatcgtggctgcggtggaacaactatgtgcatagattgtggcctgggacgtttgggagactgttgttgccatgaaaaagccttccgtttgttagttttgtgctgtaacaagcattctttggagacttaaggtgtaggcttatagtcgttttgttcttgttttaagaagtataatccagcttcgtagctgcacggactcgatcttcttgttcctaaatctgcgctatgcaatgccgaatttgatggttcg

SEQ ID NO: 552 - protein, 1549 aa, Zea mays
  misc_feature: PFam Name: Transket_pyr; PFam Description: Transketolase,
  misc_feature: PFam Name: Transketolase_C; PFam Description: Transketolase,
  misc_feature: GI Number: 20334776; NR Description: At1g30120/T2H7_8 [Arabidopsis thaliana] >gi|13605515|gb|AAK32751.1| At1g30120/T2H7_8 [Arabidopsis thaliana] >gi|12321636|gb|AAG50862.1| pyruvate dehydrogenase E1 beta
  misc_feature: GI Number: 22416925; NR Description: beta subunit of pyruvate dehydrogenase E1 component [Chaetosphaeridium globosum] >gi|22711921|ref|NP_683783.1| pyruvate dehydrogenase E1 component
  misc_feature: GI Number: 21593379; NR Description: putative pyruvate
  misc_feature: GI Number: 3128205; NR Description: putative pyruvate dehydrogenase E1 beta subunit [Arabidopsis thaliana] >gi|5702375|gb|AAD47282.1| putative pyruvate dehydrogenase beta subunit [Arabidopsis thaliana] >gi|15226781|ref|NP_181006.1|
  misc_feature: GI Number: 2454184; NR Description: pyruvate dehydrogenase E1 beta subunit [Arabidopsis thaliana] >gi|21593321|gb|AAM65270.1| pyruvate dehydrogenase E1 beta subunit, putative [Arabidopsis
AGTCCGCCCCTCCCGCCTCGTTCTCTCCGCCATCGTCGCCGCCGCCTCCATTCCTCCACCAGTCCACCATCGCCACCTACGCCCAACCAAACCCAACTCCATCTCTTCCGACTATAAACGCAACCCACCACCGCTGCCGCGAACCTCTGCGCTCCGAATACCCCAGACCCCCGATCCTCCCAATGGCCACCGCATTTTCGCTGCGCGCTGCGGCCCCGGCCACCACTCCCCGCGCCGTCTCCCGATCCACCTCCGCGGCGAGGGTCGTGCCCGTGGCCTCGGCACTGGCGGGACGCGGAAGGCTGGTGGCGCGTGCAGCAGTTACAGCAAAGGCGGATGTGCCATCGAGCACGTCCGACGGCCATGAGGTCTTGCTGTTTGAAGCTCTTCGTGAGGCCTTGATGGAAGAGATGGAATTAGATCCAACAGTGTGTGTATTTGGTGAAGATGTTGGCCATTACGGTGGTTCTTACAAGGTGACAAAAGGTTTGGCTGATACGTTTGGAGACCTTCGAGTTCTGGACACCCCTATTGCGGAGAACTCGTTTACTGGCATGGGAGTTGGAGCGGGAATGAAAGGGTTGAGACCCGTCGTTGAAGGCATGAACATGGGATTCCTGCTCCTTGCTTACAACCAGATCTCAAATAACTGTGGCATGCTTCATTACACTTCCGGCGGCCAGTTCAAAATCCCACTTGTGATCCGTGGCCCCGGTGGTGTGGGTCGTCAGCTTGGAGCAGAGCACTCGCAGCGCCTGGAATCGTATTTCCAGTCCATCCCAGGCCTGCAGATGGTCGCCTGCTCGACTCCTTACAACGCTAAGGGCCTGATGAAAGCTGCCATCAGGAGCGAGAACCCTGTGGTGCTGTTTGAGCACGTCCTTCTGTACAACCTGAAGGAGAAAATCCCGGACGAGGAGTACGTGCTCTGCTTGGAGGAGGCCGAGATGGTGCGGCCTGGGGAGCACGTGACTATACTCACATACTCGCGCATGAGGTACCACGTGATGCAGGCAGCGAAGACGCTGGTGAACAAAGGGTACGATCCCGAGGTCATCGACATCAGGTCGTTGAAGCCGTTTGATCTGCACACTATTGGCAACTCCATCAAGAAGACCCACCGCGTGCTGATCGTGGAGGAGTGCATGCGCACGGGTGGGATCGGCGCCAGCCTTAGGTCGGCCATCGTCGACAATTTCTGGGACTACCTTGACGCCCCCATCATGTGCCTGTCATCTCAGGATGTGCCTACGCCATATGCTGCGACTCTGGAGGATGCAACCGTTGTGCAGCCTGCCCAGATCGTGGCTGCGGTGGAACAACTATGTGCATAGATTGTGGCCTGGGACGTTTGGGAGACTGTTGTTGCCATGAAAAAGCCTTCCGTTTGTTAGTTTTGTGCTGTAACAAGCATTCTTTGGAGACTTAAGGTGTAGGCTTATAGTCGTTTTGTTCTTGTTTTAAGAAGTATAATCCAGCTTCGTAGCTGCACGGACTCGATCTTCTTGTTCCTAAATCTGCGCTATGCAATGCCGAATTTGATGGTTCG

SEQ ID NO: 553 - DNA, 1757 bp, Zea mays
  misc_feature (1)..(1757): Ceres cDNA ID no. 12345695
  misc_feature (1)..(1757): Ceres CLONE  ID no. 229480
  misc_feature (1)..(1757): Also known as  Ceres CDNA ID no. 23752845
gctgataacaacatcctatcgttcctgtagcccctttccgtgaccttgccaaagaatttgctcttctctgtgcgtgtgcaatttcttccgctacagctcaaggatccgctactgctgctgttttgggagattcgccatgggcggcggggccgttaacgaccacttcccgggggccagcgacccgctgctccccacgaagcgggatggggacggggacgaggacgacgcaggtgcctccgcgttccacgagttcgacggcgcctccttcgccggcgcggtgttcaacctctccaccaccatcgtcggcgcgggcatcatggccgctaccggccaccatgaaggtgctcggtctcgtccctgggctcgtcatgatagtgctcgccgcgctcctcaccgacgcctccatcgagctgctcgtgcggttcagccgggccgcgggcgcgcgctcctacagcgcggccatggccgacgccttcggatggtggggtaggaggctgctccaggtctgcgtcgtcatcaacaacgtcggcgtcatgattgtgtacatgatcattataggcgatgtgctttctggatccacttctggtggtgagcatcactatggtgtgttagaaggatggtttggaatacactggtggaatgggcgtttatttgttctccttgtcacaaccctttgtgtgttcactccactagcatgcttgaagcgtattgattcactaagctatacatccacaatatctgttgctttggcggttgtattcgttattattactgcaggaattgctgtcatcaagttgataggtggacaaattccaatgcccaagttgtttcccactgtttctgatttggcatctgtttgggaactttttacagcagtgccggttcttgtcactgcttacgtttgccattacaatgttcacccaattcataatgagctaaaggactctacccagattaagccaatagtacacacatcattgacactatgctcgaccatctacatcacaacaagtttctttggatatctcctctttggtgaatctacactctctgatgtgctctccaactttgattcaaatcttgggatcccatacagttcagtcctcaatgatgctgtcagagtgagctatgctgttcacctgatgcttgtgttccccatgatattccatgcattgaggcttaatttggatgggctcctcttcgcctctgcaaggcctctgtcttctgacaacagaagattcggcataattacagcatcgctcctcctagtgatttttgggtctgcaatcttcattcctagtatttgggatgcctttcagtttactggggcaactgctgctgtctgtatcgcctttattttcccagctgcgatcactttaagggattcacaaggtattgccaagaagtgggacaaaattctggcgatcttcatgattgttcttgctgttgtatcaaatgtagtagcggtctacagcgatgcctacaaaatattcaacaaggaaagtgctccttctaatgcctggatcggggagtcaactgaaaatagatcttcgtggtggcttgtacgttagttggccaataaaatattcatagttcatttaggctttgtttttggtgatttgttccacgggccatggtctgctcaaatctcattgagttttgtgtgtatatctacgataggtatgaaaatttgcacaaaccgaagtgctccggtaccataaaaataattgtgtcaaatctgaaattacagagttacg

SEQ ID NO: 554 - protein, 1757 aa, Zea mays
  misc_feature: PFam Name: Aa_trans; PFam Description: Transmembrane amino
  misc_feature: GI Number: 15241555; NR Description: amino acid transporter
  misc_feature: GI Number: 9758059; NR Description: amino acid
  misc_feature: GI Number: 50905855; NR Description: putative amino acid transporter A1 [Oryza sativa (japonica cultivar-group)] >gi|46390972|dbj|BAD16485.1| putative amino acid transporter A1 [Oryza sativa (japonica cultivar-group)] [Oryza sativa (japonica
  misc_feature: GI Number: 50912345; NR Description: putative amino acid transporter [Oryza sativa (japonica cultivar-group)] >gi|46390604|dbj|BAD16088.1| putative amino acid transporter [Oryza
  misc_feature: GI Number: 51535770; NR Description: putative system A
GCTGATAACAACATCCTATCGTTCCTGTAGCCCCTTTCCGTGACCTTGCCAAAGAATTTGCTCTTCTCTGTGCGTGTGCAATTTCTTCCGCTACAGCTCAAGGATCCGCTACTGCTGCTGTTTTGGGAGATTCGCCATGGGCGGCGGGGCCGTTAACGACCACTTCCCGGGGGCCAGCGACCCGCTGCTCCCCACGAAGCGGGATGGGGACGGGGACGAGGACGACGCAGGTGCCTCCGCGTTCCACGAGTTCGACGGCGCCTCCTTCGCCGGCGCGGTGTTCAACCTCTCCACCACCATCGTCGGCGCGGGCATCATGGCCGCTACCGGCCACCATGAAGGTGCTCGGTCTCGTCCCTGGGCTCGTCATGATAGTGCTCGCCGCGCTCCTCACCGACGCCTCCATCGAGCTGCTCGTGCGGTTCAGCCGGGCCGCGGGCGCGCGCTCCTACAGCGCGGCCATGGCCGACGCCTTCGGATGGTGGGGTAGGAGGCTGCTCCAGGTCTGCGTCGTCATCAACAACGTCGGCGTCATGATTGTGTACATGATCATTATAGGCGATGTGCTTTCTGGATCCACTTCTGGTGGTGAGCATCACTATGGTGTGTTAGAAGGATGGTTTGGAATACACTGGTGGAATGGGCGTTTATTTGTTCTCCTTGTCACAACCCTTTGTGTGTTCACTCCACTAGCATGCTTGAAGCGTATTGATTCACTAAGCTATACATCCACAATATCTGTTGCTTTGGCGGTTGTATTCGTTATTATTACTGCAGGAATTGCTGTCATCAAGTTGATAGGTGGACAAATTCCAATGCCCAAGTTGTTTCCCACTGTTTCTGATTTGGCATCTGTTTGGGAACTTTTTACAGCAGTGCCGGTTCTTGTCACTGCTTACGTTTGCCATTACAATGTTCACCCAATTCATAATGAGCTAAAGGACTCTACCCAGATTAAGCCAATAGTACACACATCATTGACACTATGCTCGACCATCTACATCACAACAAGTTTCTTTGGATATCTCCTCTTTGGTGAATCTACACTCTCTGATGTGCTCTCCAACTTTGATTCAAATCTTGGGATCCCATACAGTTCAGTCCTCAATGATGCTGTCAGAGTGAGCTATGCTGTTCACCTGATGCTTGTGTTCCCCATGATATTCCATGCATTGAGGCTTAATTTGGATGGGCTCCTCTTCGCCTCTGCAAGGCCTCTGTCTTCTGACAACAGAAGATTCGGCATAATTACAGCATCGCTCCTCCTAGTGATTTTTGGGTCTGCAATCTTCATTCCTAGTATTTGGGATGCCTTTCAGTTTACTGGGGCAACTGCTGCTGTCTGTATCGCCTTTATTTTCCCAGCTGCGATCACTTTAAGGGATTCACAAGGTATTGCCAAGAAGTGGGACAAAATTCTGGCGATCTTCATGATTGTTCTTGCTGTTGTATCAAATGTAGTAGCGGTCTACAGCGATGCCTACAAAATATTCAACAAGGAAAGTGCTCCTTCTAATGCCTGGATCGGGGAGTCAACTGAAAATAGATCTTCGTGGTGGCTTGTACGTTAGTTGGCCAATAAAATATTCATAGTTCATTTAGGCTTTGTTTTTGGTGATTTGTTCCACGGGCCATGGTCTGCTCAAATCTCATTGAGTTTTGTGTGTATATCTACGATAGGTATGAAAATTTGCACAAACCGAAGTGCTCCGGTACCATAAAAATAATTGTGTCAAATCTGAAATTACAGAGTTACG

SEQ ID NO: 555 - DNA, 1151 bp, Zea mays
  misc_feature (1)..(1151): Ceres cDNA ID no. 12346366
  misc_feature (1)..(1151): Ceres CLONE  ID no. 326804
  misc_feature (1)..(1151): Also known as  Ceres CDNA ID no. 23786277
gaaagccggagcgtctctgccggtgcccaacgtgcaggcactagctcagacttggcatggatcaggcgagccggtgcctttccggtacgtcaggacagaagagatcgtcgccggcgaagtcgtcgccggctgcgccatcccggtcgtggatctcagcaggttgcttgacccgcggtcgtccgaagaggagctcgcaaacctcggctctgcctgtcagcactggggtttctttcagcttatcaaccatggggtgccggacgaggtgatccaggacacgaagaaagacatggtggagttcttcaagctccctgtggaagccaagaaggtgcacgcgcaggtaccgggcggcatcgagggctacggccaggccttcgtcttctccgagacccagaagctggattgggcggacatgatctacctcatgattagccccaaggagtcgcgggacctgaggttctggcccacccggcctccctccttcagggactctatcgaaaggtactcggccgagacggcgaaggtgacggcgtgcctgctgcggttcatggccaaggacttgggcgtggagccggagcgcctcctggaggagttccggggattgccgcagagcatgcggacgacctactacccgccgtgcaggctggccgccgatgtgcttggcctgtcgccgcacaccgacgccaccggcctgacgctgctgctccacgtcaacgacgtgcagggcctgcagatcaggagggacggcaagtggctcgccgttgaccctctggacggtgctttagtcgtcagcatcggcgacatactggagattctaagcaatgggaggtacagaagcattgagcacagagccattgtacacccggacaaagaacgcatctcggcggcgatgttccatcagacatgccccaacacgacggtcggccctctgcaggagctcgtggaaagagacagtggcggggcacggtacagatccatggactacatggatttcatgaagggcttcttcgcggccaagctcgatgggcgaaggagccacatggacgctttgaggatatactagtccaaatgctggatgaatcatgttcctgtcttcataatgaattggacaactagtagtaaaatatctaaggctatccccaatagttcctctc

SEQ ID NO: 556 - protein, 1151 aa, Zea mays
  misc_feature: PFam Name: 2OG-FeII_Oxy; PFam Description: 2OG-Fe(II)
  misc_feature: GI Number: 37536792; NR Description: putative dioxygenase [Oryza sativa (japonica cultivar-group)] >gi|14165314|gb|AAK55446.1| putative dioxygenase [Oryza sativa (japonica cultivar-group)] >gi|31433480|gb|AAP54985.1| putative
  misc_feature: GI Number: 37536796; NR Description: putative dioxygenase [Oryza sativa (japonica cultivar-group)] >gi|14165331|gb|AAK55463.1| putative dioxygenase [Oryza sativa (japonica cultivar-group)] >gi|31433482|gb|AAP54987.1| putative
  misc_feature: GI Number: 37536804; NR Description: putative ethylene-forming enzyme [Oryza sativa (japonica cultivar-group)] >gi|18873852|gb|AAL79798.1| putative ethylene-forming enzyme [Oryza sativa] >gi|31433486|gb|AAP54991.1| putative
  misc_feature: GI Number: 37536802; NR Description: putative ethylene-forming enzyme [Oryza sativa (japonica cultivar-group)] >gi|14165322|gb|AAK55454.1| putative dioxygenase [Oryza sativa (japonica cultivar-group)] >gi|18873855|gb|AAL79801.1| putative
  misc_feature: GI Number: 37536820; NR Description: putative ethylene-forming enzyme [Oryza sativa (japonica cultivar-group)] >gi|18873856|gb|AAL79802.1| putative ethylene-forming enzyme [Oryza sativa] >gi|31433494|gb|AAP54999.1| putative
GAAAGCCGGAGCGTCTCTGCCGGTGCCCAACGTGCAGGCACTAGCTCAGACTTGGCATGGATCAGGCGAGCCGGTGCCTTTCCGGTACGTCAGGACAGAAGAGATCGTCGCCGGCGAAGTCGTCGCCGGCTGCGCCATCCCGGTCGTGGATCTCAGCAGGTTGCTTGACCCGCGGTCGTCCGAAGAGGAGCTCGCAAACCTCGGCTCTGCCTGTCAGCACTGGGGTTTCTTTCAGCTTATCAACCATGGGGTGCCGGACGAGGTGATCCAGGACACGAAGAAAGACATGGTGGAGTTCTTCAAGCTCCCTGTGGAAGCCAAGAAGGTGCACGCGCAGGTACCGGGCGGCATCGAGGGCTACGGCCAGGCCTTCGTCTTCTCCGAGACCCAGAAGCTGGATTGGGCGGACATGATCTACCTCATGATTAGCCCCAAGGAGTCGCGGGACCTGAGGTTCTGGCCCACCCGGCCTCCCTCCTTCAGGGACTCTATCGAAAGGTACTCGGCCGAGACGGCGAAGGTGACGGCGTGCCTGCTGCGGTTCATGGCCAAGGACTTGGGCGTGGAGCCGGAGCGCCTCCTGGAGGAGTTCCGGGGATTGCCGCAGAGCATGCGGACGACCTACTACCCGCCGTGCAGGCTGGCCGCCGATGTGCTTGGCCTGTCGCCGCACACCGACGCCACCGGCCTGACGCTGCTGCTCCACGTCAACGACGTGCAGGGCCTGCAGATCAGGAGGGACGGCAAGTGGCTCGCCGTTGACCCTCTGGACGGTGCTTTAGTCGTCAGCATCGGCGACATACTGGAGATTCTAAGCAATGGGAGGTACAGAAGCATTGAGCACAGAGCCATTGTACACCCGGACAAAGAACGCATCTCGGCGGCGATGTTCCATCAGACATGCCCCAACACGACGGTCGGCCCTCTGCAGGAGCTCGTGGAAAGAGACAGTGGCGGGGCACGGTACAGATCCATGGACTACATGGATTTCATGAAGGGCTTCTTCGCGGCCAAGCTCGATGGGCGAAGGAGCCACATGGACGCTTTGAGGATATACTAGTCCAAATGCTGGATGAATCATGTTCCTGTCTTCATAATGAATTGGACAACTAGTAGTAAAATATCTAAGGCTATCCCCAATAGTTCCTCTC

SEQ ID NO: 557 - DNA, 1703 bp, Zea mays
  misc_feature (1)..(1703): Ceres cDNA ID no. 12347254
  misc_feature (1)..(1703): Ceres CLONE  ID no. 306748
  misc_feature (1)..(1703): Also known as  Ceres CDNA ID no. 23766449
aaaggttgtggggtgataaactcgtggactgatgcaaccaggacatgctattttgaatagtgattctcttttgtctgagtcggactgctgatgagcttactgaatctacctcttgtacttgtctatgtgtgcagcggctgagaaagcaagagtaaagagcaatgggctcaccaaagaggctttggtgccaaaggatgccaatggcaatgccatctcagcgcaaactttcaccttccgtgagcttgctaccgccaccaggaacttcaggcccgagtgcttcctgggagagggaggttttggacgtgtttacaagggccgccttgagagcacaggccaggttgttgctataaagcagcttaacagggatgggcttcaaggaaacagagaatttctagtagaagttctcatgctcagcttactacatcatcaaaacctggttaatttgattggttattgtgctgatggagaccagagacttcttgtttatgaatatatgccttctggatcacttgaagatcatttgcacgatctacctcttgataaagaggccttggactggaacaccaggatgaaaattgcagcaggtgctgccaaaggactggagtaccttcatgacaaagctaatccaccagttatttatagggatttcaagtcatcgaacattctgttggatgaaagtttccacccgaagctgtctgattttggacttgctaagttgggtccagttggcgacaaatcacatgtctcaacacgtgtaatgggtacatatggttattgtgcaccagaatatgctatgacagggcagctgacagtgaagtctgacgtgtatagttttggggttgtcttgctagagttgattactggccgtagggctattgacagcaccagaccacatggagaacaaaatcttgtctcatgggcacgtcctctgtttaacgacagaagaaagctccctaagatggctgacccgaggctggaagggcgataccccatgcgtgggctttaccaagcccttgcagtggcttcgatgtgcattcagtcggaggctgcttcacgcccactgattgcagatgtcgtgactgctctgtcctacttggcatcccagccatatgatcccaacgcagctcttgcttcaaggaagccaggcggcgatcagcgaagcaagcctggcgagaacggcagggcagtttccaggaatgatgaaactggaagctccggccacaaaacacctgccaaggaccgagaggactcacctagggacctcccagcgatcctgaacaaggaccttgaccgggagcgcatggtggccgaggcgaagatgtggggcgaccgggagcgcatggtggccgaggctaagatgtggggcgaccgagagcgcatggtggctgaggcgaagatgtggggtgaaaattggcgtgacaagcggcgtgcagagattgggcaggggagcctggattcggttactgggaacagctagggggcaattaagcgaacagaaacgtgacatccacccatgcatttcgtttgtttatttccaggtccattttcgttctggcggcggtcggcaggccccagggttgtacatttctaggtcagggaagagtgggaaagcggcagcgttgtactggacagtgaatgcatgtggttgtacatgtaaattctcagaaaagttttgtgagaatgaaaggacatatttgagttcc

SEQ ID NO: 558 - protein, 1703 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15238886; NR Description: protein kinase family
  misc_feature: GI Number: 30679773; NR Description: protein kinase family
  misc_feature: GI Number: 7413555; NR Description: protein kinase-like [Arabidopsis thaliana] >gi|11259782|pir||T48301 protein kinase-like
  misc_feature: GI Number: 37625033; NR Description: protein kinase-like
  misc_feature: GI Number: 34907210; NR Description: putative serine/threonine kinase PBS1 protein [Oryza sativa (japonica cultivar-group)] >gi|15408807|dbj|BAB64203.1| putative serine/threonine kinase PBS1 protein [Oryza sativa (japonica
AAAGGTTGTGGGGTGATAAACTCGTGGACTGATGCAACCAGGACATGCTATTTTGAATAGTGATTCTCTTTTGTCTGAGTCGGACTGCTGATGAGCTTACTGAATCTACCTCTTGTACTTGTCTATGTGTGCAGCGGCTGAGAAAGCAAGAGTAAAGAGCAATGGGCTCACCAAAGAGGCTTTGGTGCCAAAGGATGCCAATGGCAATGCCATCTCAGCGCAAACTTTCACCTTCCGTGAGCTTGCTACCGCCACCAGGAACTTCAGGCCCGAGTGCTTCCTGGGAGAGGGAGGTTTTGGACGTGTTTACAAGGGCCGCCTTGAGAGCACAGGCCAGGTTGTTGCTATAAAGCAGCTTAACAGGGATGGGCTTCAAGGAAACAGAGAATTTCTAGTAGAAGTTCTCATGCTCAGCTTACTACATCATCAAAACCTGGTTAATTTGATTGGTTATTGTGCTGATGGAGACCAGAGACTTCTTGTTTATGAATATATGCCTTCTGGATCACTTGAAGATCATTTGCACGATCTACCTCTTGATAAAGAGGCCTTGGACTGGAACACCAGGATGAAAATTGCAGCAGGTGCTGCCAAAGGACTGGAGTACCTTCATGACAAAGCTAATCCACCAGTTATTTATAGGGATTTCAAGTCATCGAACATTCTGTTGGATGAAAGTTTCCACCCGAAGCTGTCTGATTTTGGACTTGCTAAGTTGGGTCCAGTTGGCGACAAATCACATGTCTCAACACGTGTAATGGGTACATATGGTTATTGTGCACCAGAATATGCTATGACAGGGCAGCTGACAGTGAAGTCTGACGTGTATAGTTTTGGGGTTGTCTTGCTAGAGTTGATTACTGGCCGTAGGGCTATTGACAGCACCAGACCACATGGAGAACAAAATCTTGTCTCATGGGCACGTCCTCTGTTTAACGACAGAAGAAAGCTCCCTAAGATGGCTGACCCGAGGCTGGAAGGGCGATACCCCATGCGTGGGCTTTACCAAGCCCTTGCAGTGGCTTCGATGTGCATTCAGTCGGAGGCTGCTTCACGCCCACTGATTGCAGATGTCGTGACTGCTCTGTCCTACTTGGCATCCCAGCCATATGATCCCAACGCAGCTCTTGCTTCAAGGAAGCCAGGCGGCGATCAGCGAAGCAAGCCTGGCGAGAACGGCAGGGCAGTTTCCAGGAATGATGAAACTGGAAGCTCCGGCCACAAAACACCTGCCAAGGACCGAGAGGACTCACCTAGGGACCTCCCAGCGATCCTGAACAAGGACCTTGACCGGGAGCGCATGGTGGCCGAGGCGAAGATGTGGGGCGACCGGGAGCGCATGGTGGCCGAGGCTAAGATGTGGGGCGACCGAGAGCGCATGGTGGCTGAGGCGAAGATGTGGGGTGAAAATTGGCGTGACAAGCGGCGTGCAGAGATTGGGCAGGGGAGCCTGGATTCGGTTACTGGGAACAGCTAGGGGGCAATTAAGCGAACAGAAACGTGACATCCACCCATGCATTTCGTTTGTTTATTTCCAGGTCCATTTTCGTTCTGGCGGCGGTCGGCAGGCCCCAGGGTTGTACATTTCTAGGTCAGGGAAGAGTGGGAAAGCGGCAGCGTTGTACTGGACAGTGAATGCATGTGGTTGTACATGTAAATTCTCAGAAAAGTTTTGTGAGAATGAAAGGACATATTTGAGTTCC

SEQ ID NO: 559 - DNA, 1298 bp, Zea mays
  misc_feature (1)..(1298): Ceres cDNA ID no. 12347470
  misc_feature (1)..(1298): Ceres CLONE  ID no. 236658
  misc_feature (1)..(1298): Also known as  Ceres CDNA ID no. 23784427
aattaaccatattggccagtgtacgtgggaacgatggccctcatgcaggagagtagtagccaggatttgctccaagctcacgacgagctcttgcaccattccctgtgcttcgccaaatcgctcgcgctcgccgtggcgctagacctccgcatccccgacgcgatccaccaccacggggccggcggcgccacccttctccagatcctcgccgagactgcgctccacccaagcaagcttcgcgcccttcgccgcctcatgcgcgtgctcaccgtcacgggcatcttcagcgtcgtcgagcaaccaccagcaggtggtggtgatgattcaaccgtccacacgtcggacgacgaagctgtcgtcgtctacaggttgacggcagcctcccgcttcctcgtcagcgacgacgtgagcacggcgaccttggctccctttgtgagtctggcgctccagcctatcgctgcctgtccgcacgccctgggtatctccgcgtggttccggcaggagcagcacgagccgtccccgtatggcctggcgttccgccagaccccaacgatctgggaacatgctgacgacgtaaacgccttgctgaacaaaggcatggccgcggacagccgcttcctcatgccaattgtgctgagggagtgcggcgagacgtttcgtgggatcgactcgttggttgacgtcggtggtggccatggtggcgccgccgccaccatcgccgccgccttcccccacctcaagtgcagcgtgcttgacctcccgcacgttgtcgccggtgctccgtctgatggcaacgtgcagttcgtcgcaggcaatatgtttgagagtattccacctgcaaccgctgttttcctcaagaaaactctacatgactggggtgacgatgagtctgtcaagatattgaagaattgcaagcaagccatatctccacgggatgcaggtgggaaggtaataatcttggatgtggtagttggatataaacagtcaaacataaagcatcaagagacacaagttatgtttgatttgtatatgatggcggttaacggagttgagcgtgacgagcaagagtggaagaagatcttcactgaagctggattcaaagactacaaaattctacccgtcattggtgatgtatcggtcatcatcgaggtctatccttgaatgctttgtgaacaaaggcctccataataaactgaagaccaagaaggtgttgatagtatattatgaattgttatttgtcctgtacacttgattctttgcgtatttgtaatgacaagttgagtaattgtgtttttgtc

SEQ ID NO: 560 - protein, 1298 aa, Zea mays
  misc_feature: PFam Name: Methyltransf_2; PFam Description: O-methyltransferase
  misc_feature: PFam Name: Dimerisation; PFam Description: Dimerisation domain
  misc_feature: GI Number: 51451358; NR Description: putative o-methyltransferase ZRP4 [Oryza sativa (japonica cultivar-group)] >gi|46575943|gb|AAT01304.1| putative o-methyltransferase ZRP4
  misc_feature: GI Number: 51451359; NR Description: putative o-methyltransferase ZRP4 [Oryza sativa (japonica cultivar-group)] >gi|46575944|gb|AAT01305.1| putative o-methyltransferase ZRP4
  misc_feature: GI Number: 55297348; NR Description: putative o-methyltransferase [Oryza sativa (japonica cultivar-group)] gi|55297295|dbj|BAD69125.1| putative o-methyltransferase [Oryza
  misc_feature: GI Number: 50253195; NR Description: flavonoid 7-O-methyltransferase-like [Oryza sativa (japonica cultivar-group)] >gi|50252861|dbj|BAD29092.1| flavonoid 7-O-methyltransferase-like
  misc_feature: GI Number: 51535782; NR Description: putative O-methyltransferase [Oryza sativa (japonica cultivar-group)] >gi|51535174|dbj|BAD37886.1| putative O-methyltransferase [Oryza
AATTAACCATATTGGCCAGTGTACGTGGGAACGATGGCCCTCATGCAGGAGAGTAGTAGCCAGGATTTGCTCCAAGCTCACGACGAGCTCTTGCACCATTCCCTGTGCTTCGCCAAATCGCTCGCGCTCGCCGTGGCGCTAGACCTCCGCATCCCCGACGCGATCCACCACCACGGGGCCGGCGGCGCCACCCTTCTCCAGATCCTCGCCGAGACTGCGCTCCACCCAAGCAAGCTTCGCGCCCTTCGCCGCCTCATGCGCGTGCTCACCGTCACGGGCATCTTCAGCGTCGTCGAGCAACCACCAGCAGGTGGTGGTGATGATTCAACCGTCCACACGTCGGACGACGAAGCTGTCGTCGTCTACAGGTTGACGGCAGCCTCCCGCTTCCTCGTCAGCGACGACGTGAGCACGGCGACCTTGGCTCCCTTTGTGAGTCTGGCGCTCCAGCCTATCGCTGCCTGTCCGCACGCCCTGGGTATCTCCGCGTGGTTCCGGCAGGAGCAGCACGAGCCGTCCCCGTATGGCCTGGCGTTCCGCCAGACCCCAACGATCTGGGAACATGCTGACGACGTAAACGCCTTGCTGAACAAAGGCATGGCCGCGGACAGCCGCTTCCTCATGCCAATTGTGCTGAGGGAGTGCGGCGAGACGTTTCGTGGGATCGACTCGTTGGTTGACGTCGGTGGTGGCCATGGTGGCGCCGCCGCCACCATCGCCGCCGCCTTCCCCCACCTCAAGTGCAGCGTGCTTGACCTCCCGCACGTTGTCGCCGGTGCTCCGTCTGATGGCAACGTGCAGTTCGTCGCAGGCAATATGTTTGAGAGTATTCCACCTGCAACCGCTGTTTTCCTCAAGAAAACTCTACATGACTGGGGTGACGATGAGTCTGTCAAGATATTGAAGAATTGCAAGCAAGCCATATCTCCACGGGATGCAGGTGGGAAGGTAATAATCTTGGATGTGGTAGTTGGATATAAACAGTCAAACATAAAGCATCAAGAGACACAAGTTATGTTTGATTTGTATATGATGGCGGTTAACGGAGTTGAGCGTGACGAGCAAGAGTGGAAGAAGATCTTCACTGAAGCTGGATTCAAAGACTACAAAATTCTACCCGTCATTGGTGATGTATCGGTCATCATCGAGGTCTATCCTTGAATGCTTTGTGAACAAAGGCCTCCATAATAAACTGAAGACCAAGAAGGTGTTGATAGTATATTATGAATTGTTATTTGTCCTGTACACTTGATTCTTTGCGTATTTGTAATGACAAGTTGAGTAATTGTGTTTTTGTC

SEQ ID NO: 561 - DNA, 1505 bp, Zea mays
  misc_feature (1)..(1505): Ceres cDNA ID no. 12347490
  misc_feature (1)..(1505): Ceres CLONE  ID no. 261099
  misc_feature (1)..(1505): Also known as  Ceres CDNA ID no. 24355874
gatatcttttttccatatgcttcactggacatctgcttattactcaggatgggtggttagcacatccctagctggtgcaacactaggttcctttaccgggggatctttggcagataaatttgggcggacaagaacattcatcctggatgcagccccactggctgtaggtgcattcttgagcgcaacagctcaagatatccgcaccatgattattggtcggttgcttgctggaattggtattgggatctcatctgcacttgtacccctttacatatctgagatatcaccaactgaaattcgtggaacacttggttctgttaatcaactttttatctgcattggaattcttgcagctttgttagctggattgcctttggcaggaaatcctgcctggtggaggacaatgtttggaattgctgtagttccatccattttgctggctgtaggaatggccttttcgcctgaaagccctcgatggctattccagcaaggaaaggttattcaagcagaatcagctgtaaaaagactatatggaaaagaaatggttaccgaaattatgtatgatctgagagctagtggccaaagttcttctgagaccgaagctggctggttggatcttttcagcaagcgttactggaaagttgtgagtgtgggggcagcactgtttttgttccagcagcttgctggtataaacgctgttgtatattactctacatcggtgttccgtaatgcaggcattacatctgatgttgctgctagtgctcttgttggagcagccaatgtttttggcaccatggttgcatcttctctaatggacaagaaaggaaggaaaagccttctgatgacaagcttttctggaatgggtgcttcaatgctactcctagcattgtccttcacctggaaagctctggcaccttattctggtactcttgctgttgttggcactgttctgtatgtgctgtcttttgctctaggagctggtcctgttcctgccctgcttcttcctgaaatatttgcctccagaataagggccaaggctgttgcattatctctaggcatgcactgggtatccaacttttttattggcctgtacttcttgagtgtcgtcaacaagttcgggatcagcaatgtatatttgggatttgcatcagtgtgcgtccttgcagttctctacatagctgggaatgtggtcgagaccaaggggcgatcacttgaagagattgaacgggaactaagtgtagcagaatgatgtgcttttgctagtcatgctgcggcgccgttttggtgattttgagaatgcaaccaagcacacaaccgagcatccttggacctggagactttctagtttcatgtagcagttaccgatcagattcagaaacaatgaactcgtcgatgtttctggagataagttttcgttttttgttctaaaatttcttgtttctcttgtataggagactttgagatagtttcagctctaaagacgtgaatatggagcagctccgctg

SEQ ID NO: 562 - protein, 1505 aa, Zea mays
  misc_feature: PFam Name: Sugar_tr; PFam Description: Sugar (and other)
  misc_feature: GI Number: 8347250; NR Description: hexose transporter
  misc_feature: GI Number: 8347244; NR Description: hexose transporter
  misc_feature: GI Number: 8347246; NR Description: hexose transporter
  misc_feature: GI Number: 8347242; NR Description: hexose transporter
  misc_feature: GI Number: 8347248; NR Description: hexose transporter [Zea mays]
GATATCTTTTTTCCATATGCTTCACTGGACATCTGCTTATTACTCAGGATGGGTGGTTAGCACATCCCTAGCTGGTGCAACACTAGGTTCCTTTACCGGGGGATCTTTGGCAGATAAATTTGGGCGGACAAGAACATTCATCCTGGATGCAGCCCCACTGGCTGTAGGTGCATTCTTGAGCGCAACAGCTCAAGATATCCGCACCATGATTATTGGTCGGTTGCTTGCTGGAATTGGTATTGGGATCTCATCTGCACTTGTACCCCTTTACATATCTGAGATATCACCAACTGAAATTCGTGGAACACTTGGTTCTGTTAATCAACTTTTTATCTGCATTGGAATTCTTGCAGCTTTGTTAGCTGGATTGCCTTTGGCAGGAAATCCTGCCTGGTGGAGGACAATGTTTGGAATTGCTGTAGTTCCATCCATTTTGCTGGCTGTAGGAATGGCCTTTTCGCCTGAAAGCCCTCGATGGCTATTCCAGCAAGGAAAGGTTATTCAAGCAGAATCAGCTGTAAAAAGACTATATGGAAAAGAAATGGTTACCGAAATTATGTATGATCTGAGAGCTAGTGGCCAAAGTTCTTCTGAGACCGAAGCTGGCTGGTTGGATCTTTTCAGCAAGCGTTACTGGAAAGTTGTGAGTGTGGGGGCAGCACTGTTTTTGTTCCAGCAGCTTGCTGGTATAAACGCTGTTGTATATTACTCTACATCGGTGTTCCGTAATGCAGGCATTACATCTGATGTTGCTGCTAGTGCTCTTGTTGGAGCAGCCAATGTTTTTGGCACCATGGTTGCATCTTCTCTAATGGACAAGAAAGGAAGGAAAAGCCTTCTGATGACAAGCTTTTCTGGAATGGGTGCTTCAATGCTACTCCTAGCATTGTCCTTCACCTGGAAAGCTCTGGCACCTTATTCTGGTACTCTTGCTGTTGTTGGCACTGTTCTGTATGTGCTGTCTTTTGCTCTAGGAGCTGGTCCTGTTCCTGCCCTGCTTCTTCCTGAAATATTTGCCTCCAGAATAAGGGCCAAGGCTGTTGCATTATCTCTAGGCATGCACTGGGTATCCAACTTTTTTATTGGCCTGTACTTCTTGAGTGTCGTCAACAAGTTCGGGATCAGCAATGTATATTTGGGATTTGCATCAGTGTGCGTCCTTGCAGTTCTCTACATAGCTGGGAATGTGGTCGAGACCAAGGGGCGATCACTTGAAGAGATTGAACGGGAACTAAGTGTAGCAGAATGATGTGCTTTTGCTAGTCATGCTGCGGCGCCGTTTTGGTGATTTTGAGAATGCAACCAAGCACACAACCGAGCATCCTTGGACCTGGAGACTTTCTAGTTTCATGTAGCAGTTACCGATCAGATTCAGAAACAATGAACTCGTCGATGTTTCTGGAGATAAGTTTTCGTTTTTTGTTCTAAAATTTCTTGTTTCTCTTGTATAGGAGACTTTGAGATAGTTTCAGCTCTAAAGACGTGAATATGGAGCAGCTCCGCTG

SEQ ID NO: 563 - DNA, 1292 bp, Arabidopsis thaliana
  misc_feature (1)..(1292): Ceres cDNA ID no. 12348332
  misc_feature (1)..(1292): Ceres CLONE  ID no. 12638
  misc_feature (1)..(1292): Also known as  Ceres CDNA ID no. 23373978
ataaaaatcattatccaaaaaagtgcaacctctttcgccgtagaaaacattccggtaaccatgctccgaagaatcacttgttcttcttcacttgcttcaccctctctcttcctccgcttctttcgccaactccctcgctcttactcctcaccgaccaccatcgccgtctcaggccgcaacattcgccgactatcaactccaaccactcttcgttgcatttgttcacactcttcatctgaaatcatctccgagcatcctccgttcgtcagggtttacaaagacggtcgtatcgaacgtctttccggcaccgaaacagtcccggcttctctaaacccacgaaacgacgtcgtttcaaaagacgttgtctactcaccggggcataacctctccgttcgtctctttctccctcacaaatcaacacaactcgccgccggtaacaaactccctctacttatctacttccacggcggagcttggataaacgaatcccctttctccccaatctaccacaatttcctcacggaggtagttaaatccgctaactgcctcgccgtctcggttcaataccgccgtgcaccggaagatccggttccggctgcgtatgaagatacatggtctgctattcaatggattttctcacattccgatggatctggtgaagaagattggattaacaaatacgctgatttcgaaaaagtttttctcgccggagatagtgccggtggtaatatatctcatcacatggctatgagagctggtaaagagaagcttaagcctagaatcaaagggactgtgattgtgcatccagcgatttgggggaaagatccggtcgatgagcacgatgtgcaagatagagagatcagagacggagttgcagaaatttgggagaaaattgtgagtccgaatagtgttgatggagcggatgatccgtggtttaatgtggttggatccgggtcggatttttccgggatgggatgtgagaaggttttggttgaggtggctgggaaagatgtgttttggcggcaaggattagcttacgcggagaagctaaagaagagtgggtggaaaggagaggtggaggtgattgaggaagaagatgaagaacattgcttccatctcttaaatccaagttctgaaaatgctcccagcttcatgaagagacttgtggagtttatcactggttaacattgttctttgtgtgacacgaataaattttgatgtaacctttgaatttgatttggttagataattatggttaaggaattaaatacaggaataactctgttctgact

SEQ ID NO: 564 - protein, 1292 aa, Arabidopsis thaliana
  misc_feature: PFam Name: Abhydrolase_3; PFam Description: alpha/beta
  misc_feature: PFam Name: COesterase; PFam Description: Carboxylesterase
  misc_feature: GI Number: 21537287; NR Description: putative esterase
  misc_feature: GI Number: 28393060; NR Description: putative esterase
  misc_feature: GI Number: 50198965; NR Description: At2g03550 [Arabidopsis
  misc_feature: GI Number: 18086341; NR Description: AT3g48690/T8P19_200
  misc_feature: GI Number: 50937897; NR Description: putative PrMC3 [Oryza sativa (japonica cultivar-group)] >gi|34393975|dbj|BAC83823.1|
ATAAAAATCATTATCCAAAAAAGTGCAACCTCTTTCGCCGTAGAAAACATTCCGGTAACCATGCTCCGAAGAATCACTTGTTCTTCTTCACTTGCTTCACCCTCTCTCTTCCTCCGCTTCTTTCGCCAACTCCCTCGCTCTTACTCCTCACCGACCACCATCGCCGTCTCAGGCCGCAACATTCGCCGACTATCAACTCCAACCACTCTTCGTTGCATTTGTTCACACTCTTCATCTGAAATCATCTCCGAGCATCCTCCGTTCGTCAGGGTTTACAAAGACGGTCGTATCGAACGTCTTTCCGGCACCGAAACAGTCCCGGCTTCTCTAAACCCACGAAACGACGTCGTTTCAAAAGACGTTGTCTACTCACCGGGGCATAACCTCTCCGTTCGTCTCTTTCTCCCTCACAAATCAACACAACTCGCCGCCGGTAACAAACTCCCTCTACTTATCTACTTCCACGGCGGAGCTTGGATAAACGAATCCCCTTTCTCCCCAATCTACCACAATTTCCTCACGGAGGTAGTTAAATCCGCTAACTGCCTCGCCGTCTCGGTTCAATACCGCCGTGCACCGGAAGATCCGGTTCCGGCTGCGTATGAAGATACATGGTCTGCTATTCAATGGATTTTCTCACATTCCGATGGATCTGGTGAAGAAGATTGGATTAACAAATACGCTGATTTCGAAAAAGTTTTTCTCGCCGGAGATAGTGCCGGTGGTAATATATCTCATCACATGGCTATGAGAGCTGGTAAAGAGAAGCTTAAGCCTAGAATCAAAGGGACTGTGATTGTGCATCCAGCGATTTGGGGGAAAGATCCGGTCGATGAGCACGATGTGCAAGATAGAGAGATCAGAGACGGAGTTGCAGAAATTTGGGAGAAAATTGTGAGTCCGAATAGTGTTGATGGAGCGGATGATCCGTGGTTTAATGTGGTTGGATCCGGGTCGGATTTTTCCGGGATGGGATGTGAGAAGGTTTTGGTTGAGGTGGCTGGGAAAGATGTGTTTTGGCGGCAAGGATTAGCTTACGCGGAGAAGCTAAAGAAGAGTGGGTGGAAAGGAGAGGTGGAGGTGATTGAGGAAGAAGATGAAGAACATTGCTTCCATCTCTTAAATCCAAGTTCTGAAAATGCTCCCAGCTTCATGAAGAGACTTGTGGAGTTTATCACTGGTTAACATTGTTCTTTGTGTGACACGAATAAATTTTGATGTAACCTTTGAATTTGATTTGGTTAGATAATTATGGTTAAGGAATTAAATACAGGAATAACTCTGTTCTGACT

SEQ ID NO: 565 - DNA, 1391 bp, Arabidopsis thaliana
  misc_feature (1)..(1391): Ceres cDNA ID no. 12348403
  misc_feature (1)..(1391): Ceres CLONE  ID no. 108168
  misc_feature (1)..(1391): Also known as  Ceres CDNA ID no. 23374041
aaaaacagcctggtaagcttcttcgttttcccttctagagaccattgattatcataattgttctacaaactttagctttttcattagtctctcgatctacttgatcgttgtcacttagcaaccctaatttctgggagaatcatccctgcagtattacccatcccgatgagtgttaaggttggatgatagaagacattttttgaccttctcttacaatgactacacgaagaaatggcgtttccaggcatcagcggtttgagagttttcgcggtgaaggaccaaattggatcttaattgctgggggtgctttgttgagtacattgtccattcgttttggctacaaattaaagcagtctattgactccaaacctcctcattccaatgccactggtggattaaaacctaatggaacaaccgacagaggaagatttaagggctgctgcttgcattctaatgcatcaccctgtgaaaggaataatgattgttgctttcactgcactcccggaactgagaatggggaaggaaatcatgctacaaatgagcaaatggcagagtccagtacttctctgcctcttgtgacagttcctgcttcatcatatagcaaagagagtgcagtcgtatggggatcttctcctgaccacctggaagtgccgatgaaagcataccatcaacattcgacctgctcagatactccttgcgtatctgaatccggctcagacatcttcagcaagcgagaagtaatacagaaactgaggcaacagctgaagagacgtgacgacatgatagttgaaatgcaggaacagattctagagctgcaaaactcgctaaacgcccagatgggacactctagccatatccaaacacagctagacgcaacaaacagggacctgtttgaatcagaaagagaagtccagagactgagaaaggcaatcgctgatcactgcgtgggacacacaggtagcaatggttggagtggcgatgtgaacagcgaaaacaactacgagtcaccagaaaatggaataagggatggagaaagaatagagatgttgagaaaagaagtgggtgagcttaaagaagtgatagatgggaaagagtatctacttaggagctataaggagcagaaaacagagcttttgcagaaggtaaaagagttgcagcagagactggactcgcagctcccaaacattttgtaggtgaagaaggttaggcattgtgcattcttaccactctcttttgtttccccgagtaaaaaatatgaatctttgttcaaaaatatctcaatttctccggggaaacttatcaactgactacattgttttgggtgtcaattatgattttatccaaattgtttttttctcttggtgaagtggatattcgaaagttgcaaaccc

SEQ ID NO: 566 - protein, 1391 aa, Arabidopsis thaliana
  misc_feature: GI Number: 21536672; NR Description: unknown [Arabidopsis thaliana]
AAAAACAGCCTGGTAAGCTTCTTCGTTTTCCCTTCTAGAGACCATTGATTATCATAATTGTTCTACAAACTTTAGCTTTTTCATTAGTCTCTCGATCTACTTGATCGTTGTCACTTAGCAACCCTAATTTCTGGGAGAATCATCCCTGCAGTATTACCCATCCCGATGAGTGTTAAGGTTGGATGATAGAAGACATTTTTTGACCTTCTCTTACAATGACTACACGAAGAAATGGCGTTTCCAGGCATCAGCGGTTTGAGAGTTTTCGCGGTGAAGGACCAAATTGGATCTTAATTGCTGGGGGTGCTTTGTTGAGTACATTGTCCATTCGTTTTGGCTACAAATTAAAGCAGTCTATTGACTCCAAACCTCCTCATTCCAATGCCACTGGTGGATTAAAACCTAATGGAACAACCGACAGAGGAAGATTTAAGGGCTGCTGCTTGCATTCTAATGCATCACCCTGTGAAAGGAATAATGATTGTTGCTTTCACTGCACTCCCGGAACTGAGAATGGGGAAGGAAATCATGCTACAAATGAGCAAATGGCAGAGTCCAGTACTTCTCTGCCTCTTGTGACAGTTCCTGCTTCATCATATAGCAAAGAGAGTGCAGTCGTATGGGGATCTTCTCCTGACCACCTGGAAGTGCCGATGAAAGCATACCATCAACATTCGACCTGCTCAGATACTCCTTGCGTATCTGAATCCGGCTCAGACATCTTCAGCAAGCGAGAAGTAATACAGAAACTGAGGCAACAGCTGAAGAGACGTGACGACATGATAGTTGAAATGCAGGAACAGATTCTAGAGCTGCAAAACTCGCTAAACGCCCAGATGGGACACTCTAGCCATATCCAAACACAGCTAGACGCAACAAACAGGGACCTGTTTGAATCAGAAAGAGAAGTCCAGAGACTGAGAAAGGCAATCGCTGATCACTGCGTGGGACACACAGGTAGCAATGGTTGGAGTGGCGATGTGAACAGCGAAAACAACTACGAGTCACCAGAAAATGGAATAAGGGATGGAGAAAGAATAGAGATGTTGAGAAAAGAAGTGGGTGAGCTTAAAGAAGTGATAGATGGGAAAGAGTATCTACTTAGGAGCTATAAGGAGCAGAAAACAGAGCTTTTGCAGAAGGTAAAAGAGTTGCAGCAGAGACTGGACTCGCAGCTCCCAAACATTTTGTAGGTGAAGAAGGTTAGGCATTGTGCATTCTTACCACTCTCTTTTGTTTCCCCGAGTAAAAAATATGAATCTTTGTTCAAAAATATCTCAATTTCTCCGGGGAAACTTATCAACTGACTACATTGTTTTGGGTGTCAATTATGATTTTATCCAAATTGTTTTTTTCTCTTGGTGAAGTGGATATTCGAAAGTTGCAAACCC

SEQ ID NO: 567 - DNA, 1126 bp, Arabidopsis thaliana
  misc_feature (1)..(1126): Ceres cDNA ID no. 12348411
  misc_feature (1)..(1126): Ceres CLONE  ID no. 111056
  misc_feature (1)..(1126): Also known as  Ceres CDNA ID no. 23374049
ctgccaaacatatacatcaaagcttgactctctttttctctcccatggaatcgacaaagaagcaagtctcgctggagctacttccatggttagttgtccacaccgatggaacggtagagagactagcgggaaccgaggtttgtcctcccggtttggatccaataaccggggttttctctaaagatatcattatcgaaccgaaaaccggtttatctgcccgaatctatcgacccttctcgattcaacccggtcagaagattcctctcatgctctattttcatggcggtgcatttctcatctcctccacttccttcccctcttaccacaccagtcttaacaaaattgtcaatcaggctaacgtcatagccgtctctgtcaattacagactagcaccagaacatccacttcctacagcgtacgaagactcatggactgcgctaaatactatccaagccataaacgagccgtggatcaacgactacgccgacttggacagtatattcctagtgggagatagcgccggagctaatatctcgcaccacctcgcatttcgagccaaacaatctgaccaaaccgtgaaaataaaaggcattggaatgatccacccatatttttggggaacacaacctatcggagcagagatcaaagacgaagcgatgaaacaaatggtggacggatggtgggaatttgtgtgcccctccaagaaaggatctgatgacccgtggattaatccgtttgcggacgggtcaccggatcttggagggttagggtgtgagagagtgatgattactgtggcggagaaagatatattgaatgagagagggaagatgtattttgaaagattggtgaagagtgagtggaaaggaaaggttgagattatggagacgaaagagaaagatcatgtttttcatatttttgagcccgattgtgatgaagctatggagatggtacgatgcttggctctctttataaaccaagttgaagcttgatattatttgttttgcctaaatttgatggcttttttaatgtttgtataatttttacatgtttgttaatgttgttgttattgtcttttcttttaaatttgtgtattacatttatatgtggttaaatttgtgttttttcc

SEQ ID NO: 568 - protein, 1126 aa, Arabidopsis thaliana
  misc_feature: PFam Name: Abhydrolase_3; PFam Description: alpha/beta
  misc_feature: PFam Name: COesterase; PFam Description: Carboxylesterase
  misc_feature: GI Number: 5668813; NR Description: Similar to gb|X77136 HSR203J protein from Nicotiana tabacum and is a member of the PF|00135 Carboxylesterase family. ESTs gb|Z25688 and gb|F14025 come from this gene. [Arabidopsis thaliana] protein [Arabidopsis
  misc_feature: GI Number: 21536771; NR Description: unknown [Arabidopsis thaliana]
  misc_feature: GI Number: 28393060; NR Description: putative esterase
  misc_feature: GI Number: 18086341; NR Description: AT3g48690/T8P19_200
  misc_feature: GI Number: 50198965; NR Description: At2g03550 [Arabidopsis
CTGCCAAACATATACATCAAAGCTTGACTCTCTTTTTCTCTCCCATGGAATCGACAAAGAAGCAAGTCTCGCTGGAGCTACTTCCATGGTTAGTTGTCCACACCGATGGAACGGTAGAGAGACTAGCGGGAACCGAGGTTTGTCCTCCCGGTTTGGATCCAATAACCGGGGTTTTCTCTAAAGATATCATTATCGAACCGAAAACCGGTTTATCTGCCCGAATCTATCGACCCTTCTCGATTCAACCCGGTCAGAAGATTCCTCTCATGCTCTATTTTCATGGCGGTGCATTTCTCATCTCCTCCACTTCCTTCCCCTCTTACCACACCAGTCTTAACAAAATTGTCAATCAGGCTAACGTCATAGCCGTCTCTGTCAATTACAGACTAGCACCAGAACATCCACTTCCTACAGCGTACGAAGACTCATGGACTGCGCTAAATACTATCCAAGCCATAAACGAGCCGTGGATCAACGACTACGCCGACTTGGACAGTATATTCCTAGTGGGAGATAGCGCCGGAGCTAATATCTCGCACCACCTCGCATTTCGAGCCAAACAATCTGACCAAACCGTGAAAATAAAAGGCATTGGAATGATCCACCCATATTTTTGGGGAACACAACCTATCGGAGCAGAGATCAAAGACGAAGCGATGAAACAAATGGTGGACGGATGGTGGGAATTTGTGTGCCCCTCCAAGAAAGGATCTGATGACCCGTGGATTAATCCGTTTGCGGACGGGTCACCGGATCTTGGAGGGTTAGGGTGTGAGAGAGTGATGATTACTGTGGCGGAGAAAGATATATTGAATGAGAGAGGGAAGATGTATTTTGAAAGATTGGTGAAGAGTGAGTGGAAAGGAAAGGTTGAGATTATGGAGACGAAAGAGAAAGATCATGTTTTTCATATTTTTGAGCCCGATTGTGATGAAGCTATGGAGATGGTACGATGCTTGGCTCTCTTTATAAACCAAGTTGAAGCTTGATATTATTTGTTTTGCCTAAATTTGATGGCTTTTTTAATGTTTGTATAATTTTTACATGTTTGTTAATGTTGTTGTTATTGTCTTTTCTTTTAAATTTGTGTATTACATTTATATGTGGTTAAATTTGTGTTTTTTCC

SEQ ID NO: 569 - DNA, 1750 bp, Arabidopsis thaliana
  misc_feature (1)..(1750): Ceres cDNA ID no. 12348561
  misc_feature (1)..(1750): Ceres CLONE  ID no. 39566
  misc_feature (1)..(1750): Also known as  Ceres CDNA ID no. 23374189
attcagcttgctcgcaacgaaacatattttttggaaaaaaaaaacaaaggaaatcgccatggaagacgttaaccagttgttcgatgctgctttcgagttcgcacactatcccggcgctcaaaacgaaacttccgttaaggaattcctcgatcgcttccctcttcctgttatcttcaatgctttgcaaaccgatccggatataccaggatttgaaaacacgttggtgacttgcttggagaggttgtttaagactaagtatggcgcttcacttattcctcagtatatgcctgttctgcaagttggtctcaaggcagattctgcagttgtgaaatctctggcttgcaaaactgttctgtgtctcttggaggattgcgatacaaacgacgtttcttctgttcagctagttgttaacaatggcatataccctcttctacttgactatatcattaacagcgatgatgaagttgcaaatgctgcaagtgagacaattaagagcctagctcgctttccagatgcaatgtccgtaattttcccttctgaaaccaacgatcctacacatcttcgtaaccttgctgcaaggtgttcatcactggcacgagtccgggttttgtcgttgatagtgaagcttttttcgatttctcgacttgtagcttcagaagttaagaaatcggggattcttgatttactggaggcagaaatgaagggtacaaaagacactcttgtgatcttaaatgttctggaactctactatgagttaatggaagtggagcacagttcagagttcgtgccacaaacatcacttattcagctgttgtgttctatcatcagtggtacatcgacgggaccctatgaaaagttaagagcaatgatgataagtggcagactactctcaaaggaaaatatctacaaagtcgtggaagaagctagtgtgaaggcgttaatttcagctattgatgggagtctggagtcagttgagatgaatgatactgatgcacaggaagctgccattgatgcacttggtcagatgggatcaacaacgaagggagcggatcttgtcctttcaacttcacctccagctgcaagacatgttgtagcttctgcctttgatcgtaatgcacatggaaaacagttggctgcactgcatgcactggcaaacatcgcaggtgaaacacgacctaagagcaacagaatagttgatggaaaagctgaagaaagccttagatgtttgatatacgacgctgcagcacagagcacaaaactaaccccatccggtttattcctctcagttcttcaacaaagctcagagattcgtcttgcgggttatcgaacgttaacagcattagtggctcggccatggtgcctggtggaaatcttggccaaagaagagataataaacatagttacggatgcaaccactgaaactgcaaaaatagcaatggaagcaaggtataactgctgcaaagcaattcacgaagcgttcttgtgtggtaactttgttgatgaccctcgtcgtctaaaaaccggtgacaagttgcaagaagctgttcgaagtggaccatatatgtcgaagaagcacagaggcgcacgaccagaagtaatgacaggcgaaggattttaaagacaactaaagaaaaaaagttaaaacttctttgttaaccaaagttttttatatcttctctggctgttcgataagtaaactttagttctttctataaacaacgaaggctaggagtaaacgttttggcggttg

SEQ ID NO: 570 - protein, 1750 aa, Arabidopsis thaliana
  misc_feature: PFam Name: HEAT; PFam Description: HEAT repeat
  misc_feature: GI Number: 30102760; NR Description: At3g15180 [Arabidopsis thaliana] >gi|18400660|ref|NP_566503.1| proteasome-related
  misc_feature: GI Number: 21593496; NR Description: unknown [Arabidopsis thaliana]
  misc_feature: GI Number: 505106; NR Description: KIAA0072 [Homo sapiens]
  misc_feature: GI Number: 4826952; NR Description: proteasome 26S non-ATPase subunit 5; 26S protease subunit S5 basic; 26S proteasome subunit S5B; 26S proteasome non-ATPase regulatory subunit 5 [Homo sapiens]
  misc_feature: GI Number: 57639314; NR Description: PSMD5 [Macaca fascicularis]
ATTCAGCTTGCTCGCAACGAAACATATTTTTTGGAAAAAAAAAACAAAGGAAATCGCCATGGAAGACGTTAACCAGTTGTTCGATGCTGCTTTCGAGTTCGCACACTATCCCGGCGCTCAAAACGAAACTTCCGTTAAGGAATTCCTCGATCGCTTCCCTCTTCCTGTTATCTTCAATGCTTTGCAAACCGATCCGGATATACCAGGATTTGAAAACACGTTGGTGACTTGCTTGGAGAGGTTGTTTAAGACTAAGTATGGCGCTTCACTTATTCCTCAGTATATGCCTGTTCTGCAAGTTGGTCTCAAGGCAGATTCTGCAGTTGTGAAATCTCTGGCTTGCAAAACTGTTCTGTGTCTCTTGGAGGATTGCGATACAAACGACGTTTCTTCTGTTCAGCTAGTTGTTAACAATGGCATATACCCTCTTCTACTTGACTATATCATTAACAGCGATGATGAAGTTGCAAATGCTGCAAGTGAGACAATTAAGAGCCTAGCTCGCTTTCCAGATGCAATGTCCGTAATTTTCCCTTCTGAAACCAACGATCCTACACATCTTCGTAACCTTGCTGCAAGGTGTTCATCACTGGCACGAGTCCGGGTTTTGTCGTTGATAGTGAAGCTTTTTTCGATTTCTCGACTTGTAGCTTCAGAAGTTAAGAAATCGGGGATTCTTGATTTACTGGAGGCAGAAATGAAGGGTACAAAAGACACTCTTGTGATCTTAAATGTTCTGGAACTCTACTATGAGTTAATGGAAGTGGAGCACAGTTCAGAGTTCGTGCCACAAACATCACTTATTCAGCTGTTGTGTTCTATCATCAGTGGTACATCGACGGGACCCTATGAAAAGTTAAGAGCAATGATGATAAGTGGCAGACTACTCTCAAAGGAAAATATCTACAAAGTCGTGGAAGAAGCTAGTGTGAAGGCGTTAATTTCAGCTATTGATGGGAGTCTGGAGTCAGTTGAGATGAATGATACTGATGCACAGGAAGCTGCCATTGATGCACTTGGTCAGATGGGATCAACAACGAAGGGAGCGGATCTTGTCCTTTCAACTTCACCTCCAGCTGCAAGACATGTTGTAGCTTCTGCCTTTGATCGTAATGCACATGGAAAACAGTTGGCTGCACTGCATGCACTGGCAAACATCGCAGGTGAAACACGACCTAAGAGCAACAGAATAGTTGATGGAAAAGCTGAAGAAAGCCTTAGATGTTTGATATACGACGCTGCAGCACAGAGCACAAAACTAACCCCATCCGGTTTATTCCTCTCAGTTCTTCAACAAAGCTCAGAGATTCGTCTTGCGGGTTATCGAACGTTAACAGCATTAGTGGCTCGGCCATGGTGCCTGGTGGAAATCTTGGCCAAAGAAGAGATAATAAACATAGTTACGGATGCAACCACTGAAACTGCAAAAATAGCAATGGAAGCAAGGTATAACTGCTGCAAAGCAATTCACGAAGCGTTCTTGTGTGGTAACTTTGTTGATGACCCTCGTCGTCTAAAAACCGGTGACAAGTTGCAAGAAGCTGTTCGAAGTGGACCATATATGTCGAAGAAGCACAGAGGCGCACGACCAGAAGTAATGACAGGCGAAGGATTTTAAAGACAACTAAAGAAAAAAAGTTAAAACTTCTTTGTTAACCAAAGTTTTTTATATCTTCTCTGGCTGTTCGATAAGTAAACTTTAGTTCTTTCTATAAACAACGAAGGCTAGGAGTAAACGTTTTGGCGGTTG

SEQ ID NO: 571 - DNA, 1535 bp, Arabidopsis thaliana
  misc_feature (1)..(1535): Ceres cDNA ID no. 12348672
  misc_feature (1)..(1535): Ceres CLONE  ID no. 113884
  misc_feature (1)..(1535): Also known as  Ceres CDNA ID no. 23374293
acaaacaatcacattcatcatttcatttaccaaaaaaaattataacctgaatataatagagatgggtagtagcctcacgcgcctactagtcttcctttccattttcgcagccatagctctgaaatcaaactctcaataccttcttccgatcaccaagcacgaacccaccaatctattctacaccactttcaacgtcggatccgccgcaaaatctcccgtaaacctcctcctcgacctcggaacaaacctcacgtggctcgactgccgcaaacttaaatctttatcatctctccgcctagtcacttgccagagctccacatgcaagtctatccccggtaatggatgcgctggcaaatcttgtctttacaagcaaccaaacccactcggacaaaaccccgttgtaaccggccgtgtcgtccaagacagagcttccatctacaccacagacggcggcaagttcctctctcaagtctccgtccgccacttcacattctcatgcgccggtgagaaagccctccaaggccttcctcctccagtcgacggagttctggctctttctcccggatcttcgtcgttcacgaaacaagtgacgtcagcgtttaacgtcatccctaaattctctctctgcttgccttcttccggtaccggtcatttctatatcgccggcattcactactttatcccaccattcaatagtagcgataatccgattccaaggactttaactcccattaaaggcactgactcaggagattatctaatcactgtaaaatctatctacgttggtggaactgctttgaagttgaaccctgatttgctaaccggcggagccaaactcagtacggtggttcactacaccgtacttcaaaccgatatctacaatgctcttgctcagtcttttacactcaaggctaaggctatgggaatagctaaggttccatcggtggcgccgtttaaacattgttttgattcacgcaccgctggaaagaatttgacggcggggcctaacgtgcccgtgatagagattggtctgccggggaggataggggaggtaaagtgggggttctacggtgcgaatacggtggtgaaagtgaaggaaacggtgatgtgtttggcgtttatcgacggtggaaagacaccgaaggatttgatggtgattgggacacatcagcttcaagatcatatgctcgagttcgatttcagcgggacggttctcgcttttagtgagtcactcttgctccataacacaagctgctccacttggccttcccaaaaatagaatcatcagtcactcatgatagtatcacagtttttggtcttgtatgacacgttttcagcgacacatgtgttctaatcgaaattttaagaaattatcacccgtttctcataaatatcgtctatgttattttattcaaatttgatattcgcttgttttgataaaaaatattgtctgaggattttgcacattaataattatctaaagtattctgtatttcttattagaaattgcaatttagatttgaaattcaaaagtt

SEQ ID NO: 572 - protein, 1535 aa, Arabidopsis thaliana
  misc_feature: PFam Name: Asp; PFam Description: Eukaryotic aspartyl protease
  misc_feature: GI Number: 15239655; NR Description: extracellular dermal
  misc_feature: GI Number: 32482806; NR Description: putative xyloglucanase
  misc_feature: GI Number: 27372527; NR Description: xyloglucan-specific fungal endoglucanase inhibitor protein precursor [Lycopersicon
  misc_feature: GI Number: 7488910; NR Description: dermal glycoprotein precursor, extracellular - carrot (fragment)
  misc_feature: GI Number: 21537233; NR Description: EDGP precursor
ACAAACAATCACATTCATCATTTCATTTACCAAAAAAAATTATAACCTGAATATAATAGAGATGGGTAGTAGCCTCACGCGCCTACTAGTCTTCCTTTCCATTTTCGCAGCCATAGCTCTGAAATCAAACTCTCAATACCTTCTTCCGATCACCAAGCACGAACCCACCAATCTATTCTACACCACTTTCAACGTCGGATCCGCCGCAAAATCTCCCGTAAACCTCCTCCTCGACCTCGGAACAAACCTCACGTGGCTCGACTGCCGCAAACTTAAATCTTTATCATCTCTCCGCCTAGTCACTTGCCAGAGCTCCACATGCAAGTCTATCCCCGGTAATGGATGCGCTGGCAAATCTTGTCTTTACAAGCAACCAAACCCACTCGGACAAAACCCCGTTGTAACCGGCCGTGTCGTCCAAGACAGAGCTTCCATCTACACCACAGACGGCGGCAAGTTCCTCTCTCAAGTCTCCGTCCGCCACTTCACATTCTCATGCGCCGGTGAGAAAGCCCTCCAAGGCCTTCCTCCTCCAGTCGACGGAGTTCTGGCTCTTTCTCCCGGATCTTCGTCGTTCACGAAACAAGTGACGTCAGCGTTTAACGTCATCCCTAAATTCTCTCTCTGCTTGCCTTCTTCCGGTACCGGTCATTTCTATATCGCCGGCATTCACTACTTTATCCCACCATTCAATAGTAGCGATAATCCGATTCCAAGGACTTTAACTCCCATTAAAGGCACTGACTCAGGAGATTATCTAATCACTGTAAAATCTATCTACGTTGGTGGAACTGCTTTGAAGTTGAACCCTGATTTGCTAACCGGCGGAGCCAAACTCAGTACGGTGGTTCACTACACCGTACTTCAAACCGATATCTACAATGCTCTTGCTCAGTCTTTTACACTCAAGGCTAAGGCTATGGGAATAGCTAAGGTTCCATCGGTGGCGCCGTTTAAACATTGTTTTGATTCACGCACCGCTGGAAAGAATTTGACGGCGGGGCCTAACGTGCCCGTGATAGAGATTGGTCTGCCGGGGAGGATAGGGGAGGTAAAGTGGGGGTTCTACGGTGCGAATACGGTGGTGAAAGTGAAGGAAACGGTGATGTGTTTGGCGTTTATCGACGGTGGAAAGACACCGAAGGATTTGATGGTGATTGGGACACATCAGCTTCAAGATCATATGCTCGAGTTCGATTTCAGCGGGACGGTTCTCGCTTTTAGTGAGTCACTCTTGCTCCATAACACAAGCTGCTCCACTTGGCCTTCCCAAAAATAGAATCATCAGTCACTCATGATAGTATCACAGTTTTTGGTCTTGTATGACACGTTTTCAGCGACACATGTGTTCTAATCGAAATTTTAAGAAATTATCACCCGTTTCTCATAAATATCGTCTATGTTATTTTATTCAAATTTGATATTCGCTTGTTTTGATAAAAAATATTGTCTGAGGATTTTGCACATTAATAATTATCTAAAGTATTCTGTATTTCTTATTAGAAATTGCAATTTAGATTTGAAATTCAAAAGTT

SEQ ID NO: 573 - DNA, 903 bp, Arabidopsis thaliana
  misc_feature (1)..(903): Ceres cDNA ID no. 12348734
  misc_feature (1)..(903): Ceres CLONE  ID no. 13796
  misc_feature (1)..(903): Also known as  Ceres CDNA ID no. 23374352
aacacacatacataaaagtagtagaactaaaaaatggcaaacctcttggtctctactttcatattttccgcacttttgctcatctccaccgcaacagccgccacattcgaaatcctaaaccaatgtagttacaccgtgtgggctgccgcaagccctggaggtggccgacgtctagatgctggccaatcatggaggctagatgtcgcggcgggcactaaaatggcacggatttggggtaggaccaattgtaactttgactcctcaggtcgtggccgatgccaaactggtgactgcagtggtggactccaatgtactggctggggacagccaccaaacacgttggctgagtacgctttgaaccaattcaacaacttagacttctacgatatctcacttgtcgatggatttaacatacctatggagtttagcccaactagttcgaactgccatcggatactatgtaccgcagacataaacggacaatgtccaaacgtgttgagagccccaggtggatgcaacaacccgtgtactgtatttcagacgaaccaatactgttgtacgaacggtcagggatcatgtagcgatactgtgtactcaagattctttaagcagagatgccctgacgcttacagctatccacaagatgacccgactagcactttcacttgcaccaacactaactacagggtcgtgttttgtccaaggtctaggctcggtgctactggatcccaccagctcccgatcaagatggtcaccgaggagaattaatagactcgtatctactgtatgtgtgtgtgtgtgagggtgtacgtagatatgcgtacgtgtgacgtgattatatatacgttaccataaacacttaatggattataataaggcatgcaataataattacgttagtcg

SEQ ID NO: 574 - protein, 903 aa, Arabidopsis thaliana
  misc_feature: PFam Name: Thaumatin; PFam Description: Thaumatin family
  misc_feature: GI Number: 33589680; NR Description: At4g11650 [Arabidopsis
  misc_feature: GI Number: 887390; NR Description: osmotin [Arabidopsis thaliana]
  misc_feature: GI Number: 21537409; NR Description: osmotin precursor
  misc_feature: GI Number: 4539456; NR Description: osmotin precursor [Arabidopsis thaliana] >gi|7267865|emb|CAB78208.1| osmotin precursor [Arabidopsis thaliana] >gi|21542444|sp|P50700|OSL3_ARATH Osmotin-like protein OSM34
  misc_feature: GI Number: 3549691; NR Description: thaumatin-like protein
AACACACATACATAAAAGTAGTAGAACTAAAAAATGGCAAACCTCTTGGTCTCTACTTTCATATTTTCCGCACTTTTGCTCATCTCCACCGCAACAGCCGCCACATTCGAAATCCTAAACCAATGTAGTTACACCGTGTGGGCTGCCGCAAGCCCTGGAGGTGGCCGACGTCTAGATGCTGGCCAATCATGGAGGCTAGATGTCGCGGCGGGCACTAAAATGGCACGGATTTGGGGTAGGACCAATTGTAACTTTGACTCCTCAGGTCGTGGCCGATGCCAAACTGGTGACTGCAGTGGTGGACTCCAATGTACTGGCTGGGGACAGCCACCAAACACGTTGGCTGAGTACGCTTTGAACCAATTCAACAACTTAGACTTCTACGATATCTCACTTGTCGATGGATTTAACATACCTATGGAGTTTAGCCCAACTAGTTCGAACTGCCATCGGATACTATGTACCGCAGACATAAACGGACAATGTCCAAACGTGTTGAGAGCCCCAGGTGGATGCAACAACCCGTGTACTGTATTTCAGACGAACCAATACTGTTGTACGAACGGTCAGGGATCATGTAGCGATACTGTGTACTCAAGATTCTTTAAGCAGAGATGCCCTGACGCTTACAGCTATCCACAAGATGACCCGACTAGCACTTTCACTTGCACCAACACTAACTACAGGGTCGTGTTTTGTCCAAGGTCTAGGCTCGGTGCTACTGGATCCCACCAGCTCCCGATCAAGATGGTCACCGAGGAGAATTAATAGACTCGTATCTACTGTATGTGTGTGTGTGTGAGGGTGTACGTAGATATGCGTACGTGTGACGTGATTATATATACGTTACCATAAACACTTAATGGATTATAATAAGGCATGCAATAATAATTACGTTAGTCG

SEQ ID NO: 575 - DNA, 1591 bp, Arabidopsis thaliana
  misc_feature (1)..(1591): Ceres cDNA ID no. 12348737
  misc_feature (1)..(1591): Ceres CLONE  ID no. 34407
  misc_feature (1)..(1591): Also known as  Ceres CDNA ID no. 23374355
attttggttaaagcaaaagattttaagagagaaagggggagaagtgagagagatggagcataagagaggacatgtattagcagtgccgtacccaacgcaaggacacatcacaccattccgccaattctgcaaacgacttcacttcaaaggtctcaaaaccactctcgctctcaccactttcgtcttcaactccatcaatcctgacctatccggtccaatctccatagccaccatctccgatggctatgaccatgggggtttcgagacagctgactccatcgacgactacctcaaagactttaaaacttccggctcgaaaaccattgcagacatcatccaaaaacaccagactagtgataaccccatcacttgtatcgtctatgatgctttcctgccttgggcacttgacgttgctagagagtttggtttagttgcgactcctttctttacgcagccttgtgctgttaactatgtttattatctttcttacataaacaatggaagcttgcaacttcccattgaggaattgccttttcttgagctccaagatttgccttctttcttctctgtttctggctcttatcctgcttactttgagatggtgcttcaacagttcataaatttcgaaaaagctgatttcgttctcgttaatagcttccaagagttggaactgcatgagaatgaattgtggtcgaaagcttgtcctgtgttgacaattggtccaactattccatcaatttacttagaccaacgtatcaaatcagacaccggctatgatcttaatctctttgaatcgaaagatgattccttctgcattaactggctcgacacaaggccacaagggtcggtggtgtacgtagcattcggaagcatggctcagctgactaatgtgcagatggaggagcttgcttcagcagtaagcaacttcagcttcctgtgggtggtcagatcttcagaggaggaaaaactcccatcagggtttcttgagacagtgaataaagaaaagagcttggtcttgaaatggagtcctcagcttcaagttctgtcaaacaaagccatcggttgtttcttgactcactgtggctggaactcaaccatggaggctttgaccttcggggttcccatggtggcaatgccccaatggactgatcaaccgatgaacgcaaagtacatacaagatgtgtggaaggctggagttcgtgtgaagacagagaaggagagtgggattgccaagagagaggagattgagtttagcattaaggaagtgatggaaggagagaggagcaaagagatgaagaagaacgtgaagaaatggagagacttggctgtcaagtcactcaatgaaggaggttctacggatactaacattgatacatttgtatcaagggttcagagcaaataggtaactcacatacagtagcaaaggtccttctataatatcttgttttgtacgtctttcattcagcataatcttttgttgacttttcttatgttgtatgttcaaatccccatattgcttcttgttgtatgttcaaatccccatattgcttcttgttgacaataataataataaaaacaatgcaactttacc

SEQ ID NO: 576 - protein, 1591 aa, Arabidopsis thaliana
  misc_feature: PFam Name: UDPGT; PFam Description: UDP-glucoronosyl and
  misc_feature: GI Number: 33942051; NR Description: At2g43820 [Arabidopsis thaliana] >gi|21592940|gb|AAM64890.1| putative glucosyltransferase [Arabidopsis thaliana] >gi|2281088|gb|AAB64024.1| putative glucosyltransferase
  misc_feature: GI Number: 42571217; NR Description: UDP-glucoronosyl/UDP-glucosyl transferase family protein
  misc_feature: GI Number: 45535373; NR Description: glycosyltransferase
  misc_feature: GI Number: 45535323; NR Description: glycosyltransferase
  misc_feature: GI Number: 45535325; NR Description: glycosyltransferase
ATTTTGGTTAAAGCAAAAGATTTTAAGAGAGAAAGGGGGAGAAGTGAGAGAGATGGAGCATAAGAGAGGACATGTATTAGCAGTGCCGTACCCAACGCAAGGACACATCACACCATTCCGCCAATTCTGCAAACGACTTCACTTCAAAGGTCTCAAAACCACTCTCGCTCTCACCACTTTCGTCTTCAACTCCATCAATCCTGACCTATCCGGTCCAATCTCCATAGCCACCATCTCCGATGGCTATGACCATGGGGGTTTCGAGACAGCTGACTCCATCGACGACTACCTCAAAGACTTTAAAACTTCCGGCTCGAAAACCATTGCAGACATCATCCAAAAACACCAGACTAGTGATAACCCCATCACTTGTATCGTCTATGATGCTTTCCTGCCTTGGGCACTTGACGTTGCTAGAGAGTTTGGTTTAGTTGCGACTCCTTTCTTTACGCAGCCTTGTGCTGTTAACTATGTTTATTATCTTTCTTACATAAACAATGGAAGCTTGCAACTTCCCATTGAGGAATTGCCTTTTCTTGAGCTCCAAGATTTGCCTTCTTTCTTCTCTGTTTCTGGCTCTTATCCTGCTTACTTTGAGATGGTGCTTCAACAGTTCATAAATTTCGAAAAAGCTGATTTCGTTCTCGTTAATAGCTTCCAAGAGTTGGAACTGCATGAGAATGAATTGTGGTCGAAAGCTTGTCCTGTGTTGACAATTGGTCCAACTATTCCATCAATTTACTTAGACCAACGTATCAAATCAGACACCGGCTATGATCTTAATCTCTTTGAATCGAAAGATGATTCCTTCTGCATTAACTGGCTCGACACAAGGCCACAAGGGTCGGTGGTGTACGTAGCATTCGGAAGCATGGCTCAGCTGACTAATGTGCAGATGGAGGAGCTTGCTTCAGCAGTAAGCAACTTCAGCTTCCTGTGGGTGGTCAGATCTTCAGAGGAGGAAAAACTCCCATCAGGGTTTCTTGAGACAGTGAATAAAGAAAAGAGCTTGGTCTTGAAATGGAGTCCTCAGCTTCAAGTTCTGTCAAACAAAGCCATCGGTTGTTTCTTGACTCACTGTGGCTGGAACTCAACCATGGAGGCTTTGACCTTCGGGGTTCCCATGGTGGCAATGCCCCAATGGACTGATCAACCGATGAACGCAAAGTACATACAAGATGTGTGGAAGGCTGGAGTTCGTGTGAAGACAGAGAAGGAGAGTGGGATTGCCAAGAGAGAGGAGATTGAGTTTAGCATTAAGGAAGTGATGGAAGGAGAGAGGAGCAAAGAGATGAAGAAGAACGTGAAGAAATGGAGAGACTTGGCTGTCAAGTCACTCAATGAAGGAGGTTCTACGGATACTAACATTGATACATTTGTATCAAGGGTTCAGAGCAAATAGGTAACTCACATACAGTAGCAAAGGTCCTTCTATAATATCTTGTTTTGTACGTCTTTCATTCAGCATAATCTTTTGTTGACTTTTCTTATGTTGTATGTTCAAATCCCCATATTGCTTCTTGTTGTATGTTCAAATCCCCATATTGCTTCTTGTTGACAATAATAATAATAAAAACAATGCAACTTTACC

SEQ ID NO: 577 - DNA, 1283 bp, Zea mays
  misc_feature (1)..(1283): Ceres cDNA ID no. 12348789
  misc_feature (1)..(1283): Ceres CLONE  ID no. 229313
  misc_feature (1)..(1283): Also known as  Ceres CDNA ID no. 23752805
atcgtacgtcgtgtcctgcagtggctcacattcgacgacacacagtagagggtagctagcagtggtgctcctggcctgtgacgatggtttcctcgtcgtcgtctccttccgccaccgccgccgccgccgccgccgtggtcctggcggtggccctgatgacgacgacgtgcttccatggcgcgacggcgcagctgtgcgaggactactatgacagcacctgcccggacgcctacgacatcgtgaaccaggtgctcgtcgacgcagtgcagtcggacacccgcatcttcgccagcctcatccgcctgcacttccacgactgcttcgtccagggctgcgacgcctcgcttctgctggacagcgtcccagggatgccgtcggagaagacgtcggcgcccaacaacggctcagcgcgcgggttcggggtggtggacgccgccaaggctgcgctggagagcgcctgccctggtgttgtctcctgcgctgacatcctcgccatcgccgcagagatctcagtcgagctgtcgggaggccccagctggggtgtgcttctgggcaggctggacagcaagacctccgacttcaacggatccctggacctcccagagcccaccgacaacctcaccatacttcagcagaagttcagcaacctcagcctcaacgatgtcgacctggtcgccctttcaggggggcacacgttcggccgggtccaatgcaagttcatcacggaccggctctacaacttcagcgggacgaacatgcccgacccgacgctggacgcctcctaccgggccttcctgacgcagaggtgccccaggaacggcgaccccacagccctgaacgacctggacccgacgaccccggacaccttcgacaacaactactacaccaacatcgaggtgaaccgaggcatcctcaactccgaccaggagctcaagtcgtcgcccctagcgcagggcaccacggcgcccatcgtcgaccagttcgcggccagccaagacgacttcttcgcgagcttcgcgcagtccatgatcaacatggggaacatcaagccgctcacggacccgtccagaggagaagtccgcaccaactgcagaagggtcaactgatccaattaagtcgatcggtcgtaattaatgtgtgcagagaaaacgacatgttcatcattggctggtcgatgtcatttggctagctgctcatcagggtgtgaagtttctgtatacacatgcagcatgcatgtatgtttcatgttttccaatccaactcaataaaatttgccaaagatt

SEQ ID NO: 578 - protein, 1283 aa, Zea mays
  misc_feature: PFam Name: peroxidase; PFam Description: Peroxidase
  misc_feature: PFam Name: Mucin; PFam Description: Mucin-like glycoprotein
  misc_feature: GI Number: 55700945; NR Description: TPA: class III
  misc_feature: GI Number: 50920551; NR Description: Putative peroxidase [Oryza sativa (japonica cultivar-group)] >gi|20330758|gb|AAM19121.1| Putative peroxidase [Oryza sativa
  misc_feature: GI Number: 8546851; NR Description: peroxidase [Ipomoea batatas]
  misc_feature: GI Number: 21593262; NR Description: peroxidase [Arabidopsis thaliana] >gi|42494611|gb|AAS17636.1| peroxidase ATPA2 [Arabidopsis
  misc_feature: GI Number: 5002348; NR Description: peroxidase 5 precursor
ATCGTACGTCGTGTCCTGCAGTGGCTCACATTCGACGACACACAGTAGAGGGTAGCTAGCAGTGGTGCTCCTGGCCTGTGACGATGGTTTCCTCGTCGTCGTCTCCTTCCGCCACCGCCGCCGCCGCCGCCGCCGTGGTCCTGGCGGTGGCCCTGATGACGACGACGTGCTTCCATGGCGCGACGGCGCAGCTGTGCGAGGACTACTATGACAGCACCTGCCCGGACGCCTACGACATCGTGAACCAGGTGCTCGTCGACGCAGTGCAGTCGGACACCCGCATCTTCGCCAGCCTCATCCGCCTGCACTTCCACGACTGCTTCGTCCAGGGCTGCGACGCCTCGCTTCTGCTGGACAGCGTCCCAGGGATGCCGTCGGAGAAGACGTCGGCGCCCAACAACGGCTCAGCGCGCGGGTTCGGGGTGGTGGACGCCGCCAAGGCTGCGCTGGAGAGCGCCTGCCCTGGTGTTGTCTCCTGCGCTGACATCCTCGCCATCGCCGCAGAGATCTCAGTCGAGCTGTCGGGAGGCCCCAGCTGGGGTGTGCTTCTGGGCAGGCTGGACAGCAAGACCTCCGACTTCAACGGATCCCTGGACCTCCCAGAGCCCACCGACAACCTCACCATACTTCAGCAGAAGTTCAGCAACCTCAGCCTCAACGATGTCGACCTGGTCGCCCTTTCAGGGGGGCACACGTTCGGCCGGGTCCAATGCAAGTTCATCACGGACCGGCTCTACAACTTCAGCGGGACGAACATGCCCGACCCGACGCTGGACGCCTCCTACCGGGCCTTCCTGACGCAGAGGTGCCCCAGGAACGGCGACCCCACAGCCCTGAACGACCTGGACCCGACGACCCCGGACACCTTCGACAACAACTACTACACCAACATCGAGGTGAACCGAGGCATCCTCAACTCCGACCAGGAGCTCAAGTCGTCGCCCCTAGCGCAGGGCACCACGGCGCCCATCGTCGACCAGTTCGCGGCCAGCCAAGACGACTTCTTCGCGAGCTTCGCGCAGTCCATGATCAACATGGGGAACATCAAGCCGCTCACGGACCCGTCCAGAGGAGAAGTCCGCACCAACTGCAGAAGGGTCAACTGATCCAATTAAGTCGATCGGTCGTAATTAATGTGTGCAGAGAAAACGACATGTTCATCATTGGCTGGTCGATGTCATTTGGCTAGCTGCTCATCAGGGTGTGAAGTTTCTGTATACACATGCAGCATGCATGTATGTTTCATGTTTTCCAATCCAACTCAATAAAATTTGCCAAAGATT

SEQ ID NO: 579 - DNA, 1744 bp, Zea mays
  misc_feature (1)..(1744): Ceres cDNA ID no. 12348828
  misc_feature (1)..(1744): Ceres CLONE  ID no. 229484
  misc_feature (1)..(1744): Also known as  Ceres CDNA ID no. 23770731
ctccggcctttgccgcttccacagggagtccggggccatgcagagctccgtaaagctcgcggtgcttgctctactgctagcggcagcagctcaccacggtctgctgccgctgccgacggcgcgatgctactggctcaacccggagatctacgacgccggcgggctgagccgccgcgcgttcccggacggcttcgtcttcgggacggccgcgtcggcgtaccaggtcgaggggatggccaagcacggcgggcggggccccagcatctgggacgccttcatagaggttcctgggaccatccctaacaatgccaccgctgacgtgacggtcgacgagtatcatcggtacaaggaagatgtgaacataatgaagaacatgggctttgatgcgtaccggttttcgatctcttggtcgaggattttcccagatggaactggcaaggtgaaccaggaaggagtggattactacaacaggctcatagattacatgctccagcaaggtatcgcgccgtatgcaaatctctaccattatgacctcccattggcactccatgaacagtacctgggctggcttagcccaaagattgtggaggcgtttgcagactacgccgagttctgcttccacgcgttcggagacagggtgaagaactggtttaccttcaacgagccgaggtgcgtcgctgctctgggctacgacaatggcttgcacgcaccgggaaggtgttccgggtgccccgccggaggcaactccaccacggagccgtaccttgtcgcacaccatctcatcctttctcatgcagctgcggtcaggcgataccgcgacaagtatcagcttcaccagaaggggaagattggaattctcctggatttcgtgtggtacgaacctttcagcgacagcaatgcggaccaggctgcagcacagcgagccagggacttccacctaggctggttccttgaccccattgtacatggacggtacccgtactcgatgcaagagattgccaaagacaggctaccgttgttcagcgatgaagaagccaggatggtgaaaggctctatagactatgttggcatcaaccactacacttctttctacatgaaggaccctgggacatggaacctgacgccagtcagctaccaggatgattggcatgttggttttgtctacgaacgaaatggagttcctattggcgctcacgcaaactcctactggctgtacattgtgccgtggggcatcaacaaggctgtcagctatgtcaaggaaacttacaaaaatcttacaatgatccttgctgaaaacggaatggaccaacctggtgatgtcagtattactcagggtgtgcatgacacagtaagaatccgttattacagagactacataactgagctcaagaaagcaatagatgatggtgccagagtcattgggtactttgcgtggtcgctgcttgacaacttcgagtggaggcttgggtacacttcgcggtttggcttggtgtacgtggactacaagactctgaagaggtaccccaaggactcagctttctggttcaagcatatgctgtccaagaaaaggagctagagaattgcagacaagaggaccactggcttcaggtgtcatacaaaagttcactctgcaaatcctcttagtatgtcagatttagcttaagaaaccgtgcagacaattgagtctcaaggctcgacatctctagcttcgttaattgttgcaaggcaataaattggtatcttc

SEQ ID NO: 580 - protein, 1744 aa, Zea mays
  misc_feature: PFam Name: Glyco_hydro_1; PFam Description: Glycosyl
  misc_feature: GI Number: 62733403; NR Description: Putative Glycosyl
  misc_feature: GI Number: 50918079; NR Description: beta-glucosidase (with alternative splicing) [Oryza sativa (japonica cultivar-group)] >gi|41469453|gb|AAS07254.1| beta-glucosidase (with alternative
  misc_feature: GI Number: 9294062; NR Description: beta-glucosidase
  misc_feature: GI Number: 18875458; NR Description: beta-glucosidase [Oryza
  misc_feature: GI Number: 50881478; NR Description: beta-glucosidase,
CTCCGGCCTTTGCCGCTTCCACAGGGAGTCCGGGGCCATGCAGAGCTCCGTAAAGCTCGCGGTGCTTGCTCTACTGCTAGCGGCAGCAGCTCACCACGGTCTGCTGCCGCTGCCGACGGCGCGATGCTACTGGCTCAACCCGGAGATCTACGACGCCGGCGGGCTGAGCCGCCGCGCGTTCCCGGACGGCTTCGTCTTCGGGACGGCCGCGTCGGCGTACCAGGTCGAGGGGATGGCCAAGCACGGCGGGCGGGGCCCCAGCATCTGGGACGCCTTCATAGAGGTTCCTGGGACCATCCCTAACAATGCCACCGCTGACGTGACGGTCGACGAGTATCATCGGTACAAGGAAGATGTGAACATAATGAAGAACATGGGCTTTGATGCGTACCGGTTTTCGATCTCTTGGTCGAGGATTTTCCCAGATGGAACTGGCAAGGTGAACCAGGAAGGAGTGGATTACTACAACAGGCTCATAGATTACATGCTCCAGCAAGGTATCGCGCCGTATGCAAATCTCTACCATTATGACCTCCCATTGGCACTCCATGAACAGTACCTGGGCTGGCTTAGCCCAAAGATTGTGGAGGCGTTTGCAGACTACGCCGAGTTCTGCTTCCACGCGTTCGGAGACAGGGTGAAGAACTGGTTTACCTTCAACGAGCCGAGGTGCGTCGCTGCTCTGGGCTACGACAATGGCTTGCACGCACCGGGAAGGTGTTCCGGGTGCCCCGCCGGAGGCAACTCCACCACGGAGCCGTACCTTGTCGCACACCATCTCATCCTTTCTCATGCAGCTGCGGTCAGGCGATACCGCGACAAGTATCAGCTTCACCAGAAGGGGAAGATTGGAATTCTCCTGGATTTCGTGTGGTACGAACCTTTCAGCGACAGCAATGCGGACCAGGCTGCAGCACAGCGAGCCAGGGACTTCCACCTAGGCTGGTTCCTTGACCCCATTGTACATGGACGGTACCCGTACTCGATGCAAGAGATTGCCAAAGACAGGCTACCGTTGTTCAGCGATGAAGAAGCCAGGATGGTGAAAGGCTCTATAGACTATGTTGGCATCAACCACTACACTTCTTTCTACATGAAGGACCCTGGGACATGGAACCTGACGCCAGTCAGCTACCAGGATGATTGGCATGTTGGTTTTGTCTACGAACGAAATGGAGTTCCTATTGGCGCTCACGCAAACTCCTACTGGCTGTACATTGTGCCGTGGGGCATCAACAAGGCTGTCAGCTATGTCAAGGAAACTTACAAAAATCTTACAATGATCCTTGCTGAAAACGGAATGGACCAACCTGGTGATGTCAGTATTACTCAGGGTGTGCATGACACAGTAAGAATCCGTTATTACAGAGACTACATAACTGAGCTCAAGAAAGCAATAGATGATGGTGCCAGAGTCATTGGGTACTTTGCGTGGTCGCTGCTTGACAACTTCGAGTGGAGGCTTGGGTACACTTCGCGGTTTGGCTTGGTGTACGTGGACTACAAGACTCTGAAGAGGTACCCCAAGGACTCAGCTTTCTGGTTCAAGCATATGCTGTCCAAGAAAAGGAGCTAGAGAATTGCAGACAAGAGGACCACTGGCTTCAGGTGTCATACAAAAGTTCACTCTGCAAATCCTCTTAGTATGTCAGATTTAGCTTAAGAAACCGTGCAGACAATTGAGTCTCAAGGCTCGACATCTCTAGCTTCGTTAATTGTTGCAAGGCAATAAATTGGTATCTTC

SEQ ID NO: 581 - DNA, 1471 bp, Zea mays
  misc_feature (1)..(1471): Ceres cDNA ID no. 12349040
  misc_feature (1)..(1471): Ceres CLONE  ID no. 282558
  misc_feature (1)..(1471): Also known as  Ceres CDNA ID no. 23779587
acgcctcctcccctaccattcgcagttttggacacttggttgtcgtttcgtcccgcagatccgcaagcaccggggccagtagagagagagagagagaggagggagggtcgcggcctcgcggggggtggaggagatgtctgtggcgaaggaggcggggccgagcagcagggcggtgcttgtgacgggcggggcgggatacatcggcagccacgccgtgctgcagctgctcaccgcgggcttccgggtcgtcgtcgtcgacagcctcgccaactcctccgagctcgtgatccgccgcctgcgctcgctcgcggtggaacacgccaaaaacctcgcgttccacaaggttgatatccgtgacaaagatggattggaaaaggtttttgcttcaacaagatttgatgctgttattcattttgctggactgaaagctgttggagaaagtgtacaaaagcctttgctttattatgaccataatgttgttggcacaataaatcttctggaagtaatggcagctcatggatgtaagaagttagtgttctcatcatcagctgcagtttatgggtcacctaagaactcaccctgcactgaagattttcctctcactccacataacccatatggcagaaccaaacttatggcagaggagatatgccgtgatatctaccattcagatcctgaatggaatatcattttgcttaggtactttaatccagttggggctcaccccagtggataccttggtgaagacccatgtggaactcctaacaaccttatgcccttcgttcagcaaattgcagttggcaggaggccatcgctaacaatatttggaaataactacgcaacaaaggatgggacaggggttcgtgattatattcatgtggttgaccttgctgaaggacatcttttcgcattaaagaagctttttgaaagctcatctaacataggatgtgaagcatacaaccttggaaccggaaaaggaacatcagtgttggagatagtcaatgcatttgagaaggcttctggaaagaaaatccctttgatcatgggccaacggcgtcctggtgatgctgagattctcttttcatcgccggcaaaagcagagagagagctccactggaaagcgaaatatggcatcacagaaatgtgcggagacctgtggaactgggctagcaagagcccttatggatacgcggcatctgagtctccgaagctgaatggtagttcacgctgagcaacgccgattggcccgtgtggactcacttgtacatgagactgtagtgccagccaaccaggataaatgtagatctagtcggtcggtcatacagagagaagttctataggcctaggaaagaaatgttatcctgttcctcagcataagctcccatagtggttcttccatatgcgtatagtctatgaaatttgttctaggaccattgctatagtcaaccagctaattcaattctatttcttg

SEQ ID NO: 582 - protein, 1471 aa, Zea mays
  misc_feature: PFam Name: Epimerase; PFam Description: NAD dependent
  misc_feature: GI Number: 12643850; NR Description: Probable UDP-glucose 4-epimerase At4g10960 (Galactowaldenase) (UDP-galactose 4-epimerase) >gi|7437224|pir||T01881 UDPglucose 4-epimerase (EC 5.1.3.2) F8M12.10 - Arabidopsis thaliana epimerase; F8M12.10
  misc_feature: GI Number: 3021357; NR Description: UDP-galactose 4-epimerase [Cyamopsis tetragonoloba] >gi|7437270|pir||T10498 UDPglucose 4-epimerase (EC 5.1.3.2) (clone GEPI48) - guar
  misc_feature: GI Number: 21553659; NR Description: UDP-galactose
  misc_feature: GI Number: 37781556; NR Description: UDP-glucose 4-epimerase
  misc_feature: GI Number: 32130594; NR Description: UDP-glucose-4-epimerase
ACGCCTCCTCCCCTACCATTCGCAGTTTTGGACACTTGGTTGTCGTTTCGTCCCGCAGATCCGCAAGCACCGGGGCCAGTAGAGAGAGAGAGAGAGAGGAGGGAGGGTCGCGGCCTCGCGGGGGGTGGAGGAGATGTCTGTGGCGAAGGAGGCGGGGCCGAGCAGCAGGGCGGTGCTTGTGACGGGCGGGGCGGGATACATCGGCAGCCACGCCGTGCTGCAGCTGCTCACCGCGGGCTTCCGGGTCGTCGTCGTCGACAGCCTCGCCAACTCCTCCGAGCTCGTGATCCGCCGCCTGCGCTCGCTCGCGGTGGAACACGCCAAAAACCTCGCGTTCCACAAGGTTGATATCCGTGACAAAGATGGATTGGAAAAGGTTTTTGCTTCAACAAGATTTGATGCTGTTATTCATTTTGCTGGACTGAAAGCTGTTGGAGAAAGTGTACAAAAGCCTTTGCTTTATTATGACCATAATGTTGTTGGCACAATAAATCTTCTGGAAGTAATGGCAGCTCATGGATGTAAGAAGTTAGTGTTCTCATCATCAGCTGCAGTTTATGGGTCACCTAAGAACTCACCCTGCACTGAAGATTTTCCTCTCACTCCACATAACCCATATGGCAGAACCAAACTTATGGCAGAGGAGATATGCCGTGATATCTACCATTCAGATCCTGAATGGAATATCATTTTGCTTAGGTACTTTAATCCAGTTGGGGCTCACCCCAGTGGATACCTTGGTGAAGACCCATGTGGAACTCCTAACAACCTTATGCCCTTCGTTCAGCAAATTGCAGTTGGCAGGAGGCCATCGCTAACAATATTTGGAAATAACTACGCAACAAAGGATGGGACAGGGGTTCGTGATTATATTCATGTGGTTGACCTTGCTGAAGGACATCTTTTCGCATTAAAGAAGCTTTTTGAAAGCTCATCTAACATAGGATGTGAAGCATACAACCTTGGAACCGGAAAAGGAACATCAGTGTTGGAGATAGTCAATGCATTTGAGAAGGCTTCTGGAAAGAAAATCCCTTTGATCATGGGCCAACGGCGTCCTGGTGATGCTGAGATTCTCTTTTCATCGCCGGCAAAAGCAGAGAGAGAGCTCCACTGGAAAGCGAAATATGGCATCACAGAAATGTGCGGAGACCTGTGGAACTGGGCTAGCAAGAGCCCTTATGGATACGCGGCATCTGAGTCTCCGAAGCTGAATGGTAGTTCACGCTGAGCAACGCCGATTGGCCCGTGTGGACTCACTTGTACATGAGACTGTAGTGCCAGCCAACCAGGATAAATGTAGATCTAGTCGGTCGGTCATACAGAGAGAAGTTCTATAGGCCTAGGAAAGAAATGTTATCCTGTTCCTCAGCATAAGCTCCCATAGTGGTTCTTCCATATGCGTATAGTCTATGAAATTTGTTCTAGGACCATTGCTATAGTCAACCAGCTAATTCAATTCTATTTCTTG

SEQ ID NO: 583 - DNA, 1510 bp, Zea mays
  misc_feature (1)..(1510): Ceres cDNA ID no. 12349160
  misc_feature (1)..(1510): Ceres CLONE  ID no. 286516
  misc_feature (1)..(1510): Also known as  Ceres CDNA ID no. 23776027
aacacaacacatctgagagacatacagcaagctctctccccattggccatatctagctcgtagtctacactgcctctaaaccttgacatttcctttgtattcccctttccaatttgcagtagtttgtaggtagaccgcaaggtggttttttcttgcagcaatggcggccaaggtttgacaaggcatgacgtcctgattaagccccctcgcggcagccacaagatttgttgcagcgtgagacaggagctgcggctgcggaggaagtgagcaaaagcatggatctttccggcacgcagggcgagctgccgatggcaacaatgcacgccggcgggtcgccgtacctggggctgcaccacgggcacccacagcagcacaaccatggcgcgaacggccggcacatgtcgccgccggatgtggtggcggaggaggccaagaaccggcagctggcggtggtgcccgtgggcacaggaggcggaggcggggcaggggtgaggtaccgcgagtgcctgaagaaccacgcggctgccatcggcgggagcgcgacggacgggtgcggcgagttcatgcccgcgggcgaggaggggtcgctggacgcgctccggtgctcggcgtgcgggtgccaccgcaacttccaccgcaaggagccgccgggcggcgacgggcggcagctgtacgggcaccaccaccaccacccgctgagcccgctggccgcggtgcacccccaccatcaccgggggctgctggtggcggcgcttcccccggcgccgacgcgcatggtgatgccgctgagcgccgccatgcaccatcaccagcagccgccgcagcagcaccacagctcggcgtcagcggactccgacgacgcacacgtgccaggggtgcgcgggggggaggtgcagcagcagcagcaggcaccggcacggaagcggttccggaccaagttcaccgcggagcagaaggcccggatgctggggttcgccggaggacgccgggtggcggctgcagaagctggacgaggcggcggtgcagcgcttctgccaggaggtcggcgtgaagcggcgcgtgctcaaggtgtggatgcacaacaacaagcacaccctggcgcggcgcggccacgccgggctccccggcgacccggagctgctggggccgcacgacggccagctcggcatgccgctcccggagccggcggcggagcccgcagttgctgctgcggctgcggctggacttggagtgaccgaccaagccatgtctttcgggactggacgacattgatcaagagagtctaatgctgactgaatcagccttgcggcatagggaagctgttttctttgttaatctgctgctgatctcatcaatctagccgtagctttagctgcatttgcattccactgttccatccatcctagctatccatcaaccacaaactgatgatgcggagtctccatggatttctattccttgttgatttctgtagctgctctccccgctcttgactttaattttttagtgc

SEQ ID NO: 584 - protein, 1510 aa, Zea mays
  misc_feature: PFam Name: ZF-HD_dimer; PFam Description: ZF-HD protein
  misc_feature: PFam Name: Homeobox; PFam Description: Homeobox domain
  misc_feature: PFam Name: MARCKS; PFam Description: MARCKS family
  misc_feature: PFam Name: Pkinase; PFam Description: Protein kinase domain
  misc_feature: PFam Name: Drf_FH1; PFam Description: Formin Homology Region 1
  misc_feature: GI Number: 13374061; NR Description: ZF-HD homeobox protein
  misc_feature: GI Number: 5091602; NR Description: 10A19I.6 [Oryza sativa
  misc_feature: GI Number: 50251525; NR Description: putative ZF-HD homeobox
  misc_feature: GI Number: 13277218; NR Description: ZF-HD homeobox protein
  misc_feature: GI Number: 53689757; NR Description: ZF-HD homeobox
AACACAACACATCTGAGAGACATACAGCAAGCTCTCTCCCCATTGGCCATATCTAGCTCGTAGTCTACACTGCCTCTAAACCTTGACATTTCCTTTGTATTCCCCTTTCCAATTTGCAGTAGTTTGTAGGTAGACCGCAAGGTGGTTTTTTCTTGCAGCAATGGCGGCCAAGGTTTGACAAGGCATGACGTCCTGATTAAGCCCCCTCGCGGCAGCCACAAGATTTGTTGCAGCGTGAGACAGGAGCTGCGGCTGCGGAGGAAGTGAGCAAAAGCATGGATCTTTCCGGCACGCAGGGCGAGCTGCCGATGGCAACAATGCACGCCGGCGGGTCGCCGTACCTGGGGCTGCACCACGGGCACCCACAGCAGCACAACCATGGCGCGAACGGCCGGCACATGTCGCCGCCGGATGTGGTGGCGGAGGAGGCCAAGAACCGGCAGCTGGCGGTGGTGCCCGTGGGCACAGGAGGCGGAGGCGGGGCAGGGGTGAGGTACCGCGAGTGCCTGAAGAACCACGCGGCTGCCATCGGCGGGAGCGCGACGGACGGGTGCGGCGAGTTCATGCCCGCGGGCGAGGAGGGGTCGCTGGACGCGCTCCGGTGCTCGGCGTGCGGGTGCCACCGCAACTTCCACCGCAAGGAGCCGCCGGGCGGCGACGGGCGGCAGCTGTACGGGCACCACCACCACCACCCGCTGAGCCCGCTGGCCGCGGTGCACCCCCACCATCACCGGGGGCTGCTGGTGGCGGCGCTTCCCCCGGCGCCGACGCGCATGGTGATGCCGCTGAGCGCCGCCATGCACCATCACCAGCAGCCGCCGCAGCAGCACCACAGCTCGGCGTCAGCGGACTCCGACGACGCACACGTGCCAGGGGTGCGCGGGGGGGAGGTGCAGCAGCAGCAGCAGGCACCGGCACGGAAGCGGTTCCGGACCAAGTTCACCGCGGAGCAGAAGGCCCGGATGCTGGGGTTCGCCGGAGGACGCCGGGTGGCGGCTGCAGAAGCTGGACGAGGCGGCGGTGCAGCGCTTCTGCCAGGAGGTCGGCGTGAAGCGGCGCGTGCTCAAGGTGTGGATGCACAACAACAAGCACACCCTGGCGCGGCGCGGCCACGCCGGGCTCCCCGGCGACCCGGAGCTGCTGGGGCCGCACGACGGCCAGCTCGGCATGCCGCTCCCGGAGCCGGCGGCGGAGCCCGCAGTTGCTGCTGCGGCTGCGGCTGGACTTGGAGTGACCGACCAAGCCATGTCTTTCGGGACTGGACGACATTGATCAAGAGAGTCTAATGCTGACTGAATCAGCCTTGCGGCATAGGGAAGCTGTTTTCTTTGTTAATCTGCTGCTGATCTCATCAATCTAGCCGTAGCTTTAGCTGCATTTGCATTCCACTGTTCCATCCATCCTAGCTATCCATCAACCACAAACTGATGATGCGGAGTCTCCATGGATTTCTATTCCTTGTTGATTTCTGTAGCTGCTCTCCCCGCTCTTGACTTTAATTTTTTAGTGC

SEQ ID NO: 585 - DNA, 1818 bp, Zea mays
  misc_feature (1)..(1818): Ceres cDNA ID no. 12349389
  misc_feature (1)..(1818): Ceres CLONE  ID no. 325552
  misc_feature (1)..(1818): Also known as  Ceres CDNA ID no. 23793983
actcaaatcctcctcctccttctcctcctaccgcagcccgcagggaggtggagttgtcaacgtgccgaggactggagcgacccgcgtcctctataaacgagacgcccggccatttcctctgctcctctctgttcccccctgcctgcctgcttccagctgcatctctctcctcggtcctcgctcgctcggcttccctctctccgccgagaccgagaggaggcatccctgacgtacggacggcggccatggggacgcaggcgccggagaactaccccgccgagaaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagctcggctggggccctggcatcgcggtgctggtggtgtcgtgggtgatcacgctgtacacgctgtggcagatggtggagatgcacgagatggtccccgggaagcggttcgaccgttaccacgagctggggcagcacgcgttcggggaccggctgggcctgtggatcgtggtgccgcagcagctggtcgtcgaggtgggcgtgaacatcgtgtacatggtgaccggcggcaagtccctgaagaagttccacgacgtgctggtgtgcggcgacacgggggtgtgcgaggggaaggacaacatcaagaccacctacttcatcatgatcttcgcgtccgtccacttcgtcctctcgcagctccccaacttcaactccatctccggcgtctccctcgccgccgccgtcatgtcgctcagctactccaccatcgcgtggggcgcgtcggtgcacaaggggaggatgtcgggcgtggactaccacctgcgcgcgacgactacgccggggaaggtgttcggcttcttcggcgcgctgggggacgtggcgttcgcctacgccgggcacaacgtggtgctggagatccaggccaccatcccgtccacccccgacaagccgtccaagaagcccatgtggaagggcgtggtggtcgcctacgtcgtggtggcgctctgctacttccccgtcgcgctcatcggctactgggcgttcggaagcacggtcgaggacaacatcctcatcacgctcagcaagcccaagtggctcatcgcgctcgccaacatgatggtcgtcgtccatgtcatcggcagctaccagatctatgccatgccggtgtttgacatgatagagaccgtgctggtgaagaagctgcgcttccctcccggcctcacgctgcgtctgatcgctcggactctctatgttgcgttcacaatgttcatagccatcaccttccccttcttcggtgggctgctcggtttcttcggcgggttcgccttcgcgccgaccacctatttccttccctgcgtcatgtggctcgcgatctacaagcccaaaaggttcagcctctcctggttgaccaactggatgtgcatcattcttggggtgctcctgatgattctgtcgcccatcggagggctccggcaaataataatggaagcgaaaacctaccagttctactcgtgagctctaccaccagccatgacttgtgactgcacgattggagaaatctgtcaaagcctcaaccacgagtttttttttgtcatgccaaacacatacatatacgtactgtttcttaatattcaaaggtgttcttcgtggcttgcgtgtgtacagtattatgtgtatgagggagacttttaagtttaatgatgctggctgtcaaagataatggcggttc

SEQ ID NO: 586 - protein, 1818 aa, Zea mays
  misc_feature: PFam Name: Aa_trans; PFam Description: Transmembrane amino
  misc_feature: GI Number: 22137070; NR Description: At5g40780/K1B16_3 [Arabidopsis thaliana] >gi|14194151|gb|AAK56270.1| AT5g40780/K1B16_3 [Arabidopsis thaliana] >gi|30693663|ref|NP_851109.1| lysine and histidine specific
  misc_feature: GI Number: 1906549; NR Description: amino acid permease [Nicotiana sylvestris] >gi|976402|gb|AAB48944.1| amino acid permease 1 >gi|7489096|pir||T15052 amino acid permease 1 - wood
  misc_feature: GI Number: 9293860; NR Description: amino acid transporter-like protein 2 [Arabidopsis thaliana] >gi|18395471|ref|NP_564217.1| lysine and histidine specific transporter, putative [Arabidopsis thaliana]
  misc_feature: GI Number: 30409136; NR Description: histidine amino acid
  misc_feature: GI Number: 2576361; NR Description: lysine and histidine
ACTCAAATCCTCCTCCTCCTTCTCCTCCTACCGCAGCCCGCAGGGAGGTGGAGTTGTCAACGTGCCGAGGACTGGAGCGACCCGCGTCCTCTATAAACGAGACGCCCGGCCATTTCCTCTGCTCCTCTCTGTTCCCCCCTGCCTGCCTGCTTCCAGCTGCATCTCTCTCCTCGGTCCTCGCTCGCTCGGCTTCCCTCTCTCCGCCGAGACCGAGAGGAGGCATCCCTGACGTACGGACGGCGGCCATGGGGACGCAGGCGCCGGAGAACTACCCCGCCGAGAAGGACGCGAGGAGCGCGCGGGAGAAGGCCATCGACGACTGGCTCCCGATCACCTCGTCGCGGAACGCCAAGTGGTGGTACTCCGCCTTCCACAATGTCACCGCCATGGTCGGCGCCGGCGTGCTCAGCCTGCCCTACGCCATGTCCGAGCTCGGCTGGGGCCCTGGCATCGCGGTGCTGGTGGTGTCGTGGGTGATCACGCTGTACACGCTGTGGCAGATGGTGGAGATGCACGAGATGGTCCCCGGGAAGCGGTTCGACCGTTACCACGAGCTGGGGCAGCACGCGTTCGGGGACCGGCTGGGCCTGTGGATCGTGGTGCCGCAGCAGCTGGTCGTCGAGGTGGGCGTGAACATCGTGTACATGGTGACCGGCGGCAAGTCCCTGAAGAAGTTCCACGACGTGCTGGTGTGCGGCGACACGGGGGTGTGCGAGGGGAAGGACAACATCAAGACCACCTACTTCATCATGATCTTCGCGTCCGTCCACTTCGTCCTCTCGCAGCTCCCCAACTTCAACTCCATCTCCGGCGTCTCCCTCGCCGCCGCCGTCATGTCGCTCAGCTACTCCACCATCGCGTGGGGCGCGTCGGTGCACAAGGGGAGGATGTCGGGCGTGGACTACCACCTGCGCGCGACGACTACGCCGGGGAAGGTGTTCGGCTTCTTCGGCGCGCTGGGGGACGTGGCGTTCGCCTACGCCGGGCACAACGTGGTGCTGGAGATCCAGGCCACCATCCCGTCCACCCCCGACAAGCCGTCCAAGAAGCCCATGTGGAAGGGCGTGGTGGTCGCCTACGTCGTGGTGGCGCTCTGCTACTTCCCCGTCGCGCTCATCGGCTACTGGGCGTTCGGAAGCACGGTCGAGGACAACATCCTCATCACGCTCAGCAAGCCCAAGTGGCTCATCGCGCTCGCCAACATGATGGTCGTCGTCCATGTCATCGGCAGCTACCAGATCTATGCCATGCCGGTGTTTGACATGATAGAGACCGTGCTGGTGAAGAAGCTGCGCTTCCCTCCCGGCCTCACGCTGCGTCTGATCGCTCGGACTCTCTATGTTGCGTTCACAATGTTCATAGCCATCACCTTCCCCTTCTTCGGTGGGCTGCTCGGTTTCTTCGGCGGGTTCGCCTTCGCGCCGACCACCTATTTCCTTCCCTGCGTCATGTGGCTCGCGATCTACAAGCCCAAAAGGTTCAGCCTCTCCTGGTTGACCAACTGGATGTGCATCATTCTTGGGGTGCTCCTGATGATTCTGTCGCCCATCGGAGGGCTCCGGCAAATAATAATGGAAGCGAAAACCTACCAGTTCTACTCGTGAGCTCTACCACCAGCCATGACTTGTGACTGCACGATTGGAGAAATCTGTCAAAGCCTCAACCACGAGTTTTTTTTTGTCATGCCAAACACATACATATACGTACTGTTTCTTAATATTCAAAGGTGTTCTTCGTGGCTTGCGTGTGTACAGTATTATGTGTATGAGGGAGACTTTTAAGTTTAATGATGCTGGCTGTCAAAGATAATGGCGGTTC

SEQ ID NO: 587 - DNA, 1316 bp, Zea mays
  misc_feature (1)..(1316): Ceres cDNA ID no. 12349557
  misc_feature (1)..(1316): Ceres CLONE  ID no. 336720
  misc_feature (1)..(1316): Also known as  Ceres CDNA ID no. 24371774
gtctagatcgctcgtccggtgtggtctctggacttgcttgccgttcacttctcttcagcggcagcgtggcaaggcaacgagagcaacgaagagtattcaaaccgaaaacaatggatccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacgacagcattgcatcagcagttgccggctgtgagggtgtcttccatgtagctagccctgtcctttcccatcgaccctccaaccctgaggtggaggtcatagctcccgctgtaataggtacaaccaatgtgttaaaggcttgctatgaggcaaaagttaggcgagttgtggtggtgtcttcatgtggagctgtgtatgctaatcctatttatccgaagggtaaggtgtttgatgaagactgctggtcagatgaggattactgcaggaagaaggaggattggtatttagtttccaaaacactgtcggaacgagaggctcttgcttttgcagcaaaaacagggctggacgttgtaactgtttgtccgtcattagtatttggacccttgatgcagcctacagtaaatttgagcagcgaaatgatccttaaatatttcaaagatctcgagactgttgaaaatgtactcagtaatatggtggatattcgtgatgttgctgatgctcttcttctgacttacgaaaagccagaagcgtctggacgatacatctgcagttcacatgcaataaaaatttctgatatgataaacatactgaagaccatgtatccgtcttacccttatcccaaaaattttgtggaagatgatgtcaactctgtatacagctctgagaaactgcagaagctggggtggagcttcaagcctatagaggaatccctccgtgacactgttgaatcctacaaggcatttggcatcctgaattgaacatcgaactaggattgtttccatctgctgttgcctccgaactcctcctgaataatgtaggcgcagtgacaacagcactgccgttctctttatttttcaacactattatgtagtggttcaggccaaataagtaggcccggtgctgactgttgtatggtttgtggcctattgtcgttgctaaaaactagaaatatgcgtactaatgttgcattgctgcacttgatttgcttgtcgtcattctgatgc

SEQ ID NO: 588 - protein, 1316 aa, Zea mays
  misc_feature: PFam Name: Epimerase; PFam Description: NAD dependent
  misc_feature: PFam Name: 3Beta_HSD; PFam Description: 3-beta
  misc_feature: PFam Name: Polysacc_synt_2; PFam Description: Polysaccharide
  misc_feature: GI Number: 51091030; NR Description: putative cinnamoyl-CoA
  misc_feature: GI Number: 51091033; NR Description: putative cinnamoyl-CoA
  misc_feature: GI Number: 23197694; NR Description: putative cinnamoyl-CoA reductase [Arabidopsis thaliana] >gi|21536817|gb|AAM61149.1| putative cinnamoyl-CoA reductase [Arabidopsis thaliana] >gi|21539439|gb|AAM53272.1| putative cinnamoyl-CoA reductase
  misc_feature: GI Number: 30984536; NR Description: At2g33600 [Arabidopsis thaliana] >gi|20260488|gb|AAM13142.1| putative cinnamoyl-CoA reductase [Arabidopsis thaliana] >gi|2459448|gb|AAB80683.1| putative cinnamoyl-CoA reductase [Arabidopsis thaliana]
  misc_feature: GI Number: 12323980; NR Description: putative cinnamoyl-CoA reductase; 27707-26257 [Arabidopsis thaliana] >gi|15223068|ref|NP_177773.1| cinnamoyl-CoA reductase family
GTCTAGATCGCTCGTCCGGTGTGGTCTCTGGACTTGCTTGCCGTTCACTTCTCTTCAGCGGCAGCGTGGCAAGGCAACGAGAGCAACGAAGAGTATTCAAACCGAAAACAATGGATCCGGTGCGGAAGAGCGTGTGCGTGACCGGCGCTGGCGGCTTCGTCGCGTCGGAGCTGGTGAAGCTCCTCCTCTCCCGGGGCCAATACGCGGTCCGCGGCACCGTGCGCGACCCTGGTGCTAGCAAGAATGCCCATCTCAAGGTGCTGGAAGGAGCTGAGGAAAGGTTGCAGCTTCTCAAGGCTGATCTGATGGACTACGACAGCATTGCATCAGCAGTTGCCGGCTGTGAGGGTGTCTTCCATGTAGCTAGCCCTGTCCTTTCCCATCGACCCTCCAACCCTGAGGTGGAGGTCATAGCTCCCGCTGTAATAGGTACAACCAATGTGTTAAAGGCTTGCTATGAGGCAAAAGTTAGGCGAGTTGTGGTGGTGTCTTCATGTGGAGCTGTGTATGCTAATCCTATTTATCCGAAGGGTAAGGTGTTTGATGAAGACTGCTGGTCAGATGAGGATTACTGCAGGAAGAAGGAGGATTGGTATTTAGTTTCCAAAACACTGTCGGAACGAGAGGCTCTTGCTTTTGCAGCAAAAACAGGGCTGGACGTTGTAACTGTTTGTCCGTCATTAGTATTTGGACCCTTGATGCAGCCTACAGTAAATTTGAGCAGCGAAATGATCCTTAAATATTTCAAAGATCTCGAGACTGTTGAAAATGTACTCAGTAATATGGTGGATATTCGTGATGTTGCTGATGCTCTTCTTCTGACTTACGAAAAGCCAGAAGCGTCTGGACGATACATCTGCAGTTCACATGCAATAAAAATTTCTGATATGATAAACATACTGAAGACCATGTATCCGTCTTACCCTTATCCCAAAAATTTTGTGGAAGATGATGTCAACTCTGTATACAGCTCTGAGAAACTGCAGAAGCTGGGGTGGAGCTTCAAGCCTATAGAGGAATCCCTCCGTGACACTGTTGAATCCTACAAGGCATTTGGCATCCTGAATTGAACATCGAACTAGGATTGTTTCCATCTGCTGTTGCCTCCGAACTCCTCCTGAATAATGTAGGCGCAGTGACAACAGCACTGCCGTTCTCTTTATTTTTCAACACTATTATGTAGTGGTTCAGGCCAAATAAGTAGGCCCGGTGCTGACTGTTGTATGGTTTGTGGCCTATTGTCGTTGCTAAAAACTAGAAATATGCGTACTAATGTTGCATTGCTGCACTTGATTTGCTTGTCGTCATTCTGATGC

SEQ ID NO: 589 - DNA, 1816 bp, Zea mays
  misc_feature (1)..(1816): Ceres cDNA ID no. 12350131
  misc_feature (1)..(1816): Ceres CLONE  ID no. 328878
  misc_feature (1)..(1816): Also known as  Ceres CDNA ID no. 23763366
gacgacagagagacagacagagagaatggcggcgccagatgcccggccctcgtcagctggtccaccgccggcccgctccctcctcctgcctctcctgctcgtgctcctcctcgcggcctactcgctcccagccgactcagcagcgcgcccgtcctccaactccaacccacggcctgccttcacgccgccgctgctgaagcgccaccagctgcggcgcccgagcagcagcagcgccgagctcgtcgccgggcccgccaacgcgtcgaccaagcccttcacggcgcactacttcccgcagctgctcgaccacttcgccttcacgcccaacgcgtccacggtcttccgccacaagtacctcctcaacgacaccttctggcgccggcccggcgccggcgccggcgacgacggccccggcccgctgttcgtgtacacgggcaacgagggcgacatcgagtggttcgccaccaacaccgggttcatgttcgacatcgcgcccacgttcggcgccctcctcgtcttcatcgagcaccagttctacggggagtcgaagccgttcgggaacgactcgtacaggtcggccgagacgctgggctacctcacgtccacgcaggcgctggccgacttcgccgtcgtcatcaggggcctgaagcgggacctcggcgccgaggccgctcccgtcgtcgtcttcggcggctcctacggcggaatgctggcttcctggttcaggctcaagtacccccacgtcgccattggtgccctagcttcctccgcgccgatcctgcagttcgaccacataacgccgtggagcagcttctacgacgccgtctcgcaggacttcaagtccgagagctccaactgcttcggtgtcatcagggcagcctgggacgtcctggatgagaggggggccacagacaaagggctcctggacctcagcaaactcttcagagcctgcaagactgtgaagtacgcttattcaatccggaactggctgtggacagcattcacctacactgccatggtggactacccgaccccagccaacttcctggagaacctgcctgcctacccagtcaaggagatgtgcaagaccatcgatgcgttccccgcgggcgcagacgtcctggagaaggcgttcgcggcggcgagcctgtactacaactacacgggagaccaggcctgcaacaagatagaggacggagacgacccgcacggcctcgatggctggcaatggcaggcctgcacagagatgatcatgcccatgacgatctccaacgagagcatgttcccgccgtccgccttcagctacgacgacaggtccgacgagtgtttccagagctggggggttcggccgaggccgcactggatcaccactgagtacggtggatataaaatcgataaggtgctcaagaggttcggcagcaacatcatcttctccaacggaatgcgagacccatggagccgtggcggggtgctcaagaacatctcgtccagcatcatcgcccttgttacagagaaaggtgcccatcatttagacttgaggtcttcaacgaagggtgatccagactggctcatagaacagaggaggcaagaggttgagatcattcagggatggattgatcagtatcatcaggacatggcggaaacatcttcctgaagacagggcaagtcagtattcttcttcttacacatggtggaaacagggcgtgtatcatcaggacatggcggaaacatcttcatgaaaacaggacaccttcctgttacggtcatgtttggatccatggaaaaaaataaaggacaaaaaatcaataatttacac

SEQ ID NO: 590 - protein, 1816 aa, Zea mays
  misc_feature: PFam Name: Peptidase_S28; PFam Description: Serine
  misc_feature: PFam Name: Peptidase_S8; PFam Description: Subtilase family
  misc_feature: PFam Name: Pyr_redox_2; PFam Description: Pyridine
  misc_feature: PFam Name: Mucin; PFam Description: Mucin-like glycoprotein
  misc_feature: PFam Name: Pkinase; PFam Description: Protein kinase domain
  misc_feature: GI Number: 22655366; NR Description: At2g24280/F27D4.19 [Arabidopsis thaliana] >gi|16648801|gb|AAL25591.1| At2g24280/F27D4.19 [Arabidopsis thaliana] >gi|30682358|ref|NP_850050.1| serine carboxypeptidase S28 family
  misc_feature: GI Number: 10177334; NR Description: lysosomal Pro-X
  misc_feature: GI Number: 20197495; NR Description: putative prolylcarboxypeptidase [Arabidopsis thaliana] >gi|25350513|pir||G84634 probable prolylcarboxypeptidase [imported]
  misc_feature: GI Number: 51535425; NR Description: putative prolylcarboxypeptidase isoform 1 [Oryza sativa (japonica
  misc_feature: GI Number: 53793554; NR Description: putative prolylcarboxypeptidase, isoform 1 [Oryza sativa (japonica cultivar-group)] >gi|53792444|dbj|BAD53352.1| putative prolylcarboxypeptidase, isoform 1 [Oryza sativa (japonica
GACGACAGAGAGACAGACAGAGAGAATGGCGGCGCCAGATGCCCGGCCCTCGTCAGCTGGTCCACCGCCGGCCCGCTCCCTCCTCCTGCCTCTCCTGCTCGTGCTCCTCCTCGCGGCCTACTCGCTCCCAGCCGACTCAGCAGCGCGCCCGTCCTCCAACTCCAACCCACGGCCTGCCTTCACGCCGCCGCTGCTGAAGCGCCACCAGCTGCGGCGCCCGAGCAGCAGCAGCGCCGAGCTCGTCGCCGGGCCCGCCAACGCGTCGACCAAGCCCTTCACGGCGCACTACTTCCCGCAGCTGCTCGACCACTTCGCCTTCACGCCCAACGCGTCCACGGTCTTCCGCCACAAGTACCTCCTCAACGACACCTTCTGGCGCCGGCCCGGCGCCGGCGCCGGCGACGACGGCCCCGGCCCGCTGTTCGTGTACACGGGCAACGAGGGCGACATCGAGTGGTTCGCCACCAACACCGGGTTCATGTTCGACATCGCGCCCACGTTCGGCGCCCTCCTCGTCTTCATCGAGCACCAGTTCTACGGGGAGTCGAAGCCGTTCGGGAACGACTCGTACAGGTCGGCCGAGACGCTGGGCTACCTCACGTCCACGCAGGCGCTGGCCGACTTCGCCGTCGTCATCAGGGGCCTGAAGCGGGACCTCGGCGCCGAGGCCGCTCCCGTCGTCGTCTTCGGCGGCTCCTACGGCGGAATGCTGGCTTCCTGGTTCAGGCTCAAGTACCCCCACGTCGCCATTGGTGCCCTAGCTTCCTCCGCGCCGATCCTGCAGTTCGACCACATAACGCCGTGGAGCAGCTTCTACGACGCCGTCTCGCAGGACTTCAAGTCCGAGAGCTCCAACTGCTTCGGTGTCATCAGGGCAGCCTGGGACGTCCTGGATGAGAGGGGGGCCACAGACAAAGGGCTCCTGGACCTCAGCAAACTCTTCAGAGCCTGCAAGACTGTGAAGTACGCTTATTCAATCCGGAACTGGCTGTGGACAGCATTCACCTACACTGCCATGGTGGACTACCCGACCCCAGCCAACTTCCTGGAGAACCTGCCTGCCTACCCAGTCAAGGAGATGTGCAAGACCATCGATGCGTTCCCCGCGGGCGCAGACGTCCTGGAGAAGGCGTTCGCGGCGGCGAGCCTGTACTACAACTACACGGGAGACCAGGCCTGCAACAAGATAGAGGACGGAGACGACCCGCACGGCCTCGATGGCTGGCAATGGCAGGCCTGCACAGAGATGATCATGCCCATGACGATCTCCAACGAGAGCATGTTCCCGCCGTCCGCCTTCAGCTACGACGACAGGTCCGACGAGTGTTTCCAGAGCTGGGGGGTTCGGCCGAGGCCGCACTGGATCACCACTGAGTACGGTGGATATAAAATCGATAAGGTGCTCAAGAGGTTCGGCAGCAACATCATCTTCTCCAACGGAATGCGAGACCCATGGAGCCGTGGCGGGGTGCTCAAGAACATCTCGTCCAGCATCATCGCCCTTGTTACAGAGAAAGGTGCCCATCATTTAGACTTGAGGTCTTCAACGAAGGGTGATCCAGACTGGCTCATAGAACAGAGGAGGCAAGAGGTTGAGATCATTCAGGGATGGATTGATCAGTATCATCAGGACATGGCGGAAACATCTTCCTGAAGACAGGGCAAGTCAGTATTCTTCTTCTTACACATGGTGGAAACAGGGCGTGTATCATCAGGACATGGCGGAAACATCTTCATGAAAACAGGACACCTTCCTGTTACGGTCATGTTTGGATCCATGGAAAAAAATAAAGGACAAAAAATCAATAATTTACAC

SEQ ID NO: 591 - DNA, 1322 bp, Zea mays
  misc_feature (1)..(1322): Ceres cDNA ID no. 12350141
  misc_feature (1)..(1322): Ceres CLONE  ID no. 325478
  misc_feature (1)..(1322): Also known as  Ceres CDNA ID no. 23793971
aaaaaatttgcgacaattcacctgcatacaggggcagcatatctagcagctactccgcccccaaatgctcgccggcatatcccgtttcctcactcgccgccgccgcccgccctttccgcttgccgctaccgccgctgcagcagccatgtcgtcgtcgtcgtccacggcagcgaacatctccgagcgtccgatctctccggacaccacccgcgtggcctgggtggggacgggcgtcatgggccagtcaatggccggccacctcctcgccgccggctacgctctcaccgtattcaaccggacggcatccaagacccagggcctcgtctcccgcggcgccagcctcgcggacagcccgcgcgcggccgccgcggctgccgatgtcatcttcctcatggtcggcttcccctccgacgtccgctccaccgccctcgatccatccacaggcgccctctctggcctcaccccaggcggtatcctagtcgacatgaccacctccgaccccaccctcgccgccgagatagccgcggccgcggccgccgccggctgctcggccgtcgacgcccccgtctccggcggtgaccgaggggcccgcaacgccaccctctccatcttcgctggcggcgacgccgccgtcgttgctcgcctggcgccgctcttcaagctcatgggaaacgcgctgtacatgggcgggcccggcgcggggcagcgcgcgaagctgggcaaccagatcgccatcgcatccaccatggtagggctcgtggagggcatggtgtacgcgcacaaggccgggctggacgtggccaagtggctggaggccatctccaccggcgcagccgggtccaagtcgctggaactgtatgggaagcggatcctggagagggatatggcggctggcttctatgtccggcacttcgtcaaggacctcggtatctgcctgttggaatgccaggccatggggctgtcgctgccggggctcgccctcgcgcaacagctgtacgtgtcgctgatcgcgcacggcgagggcgggctcggtacacaggcgcttatactggccgtcgagcggctgaacaacaccagcctcgagaagaaggacgaatgaaaggccccaggctctagctttgatgaacttgtgggaagctttgcttggtgccttggtgcaagtatgcaagatcgaggtgactgttaagttgtctttcagagttctacagttgttcacttttgtagtagtatatatgttatgcacttgtgcaaaaaattgtgctggcttggatgattgcttagctctacctgtttacatccgccaccggttcaaataagatttt

SEQ ID NO: 592 - protein, 1322 aa, Zea mays
  misc_feature: PFam Name: NAD_binding_2; PFam Description: NAD binding
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: PFam Name: GATase_2; PFam Description: Glutamine
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
AAAAAATTTGCGACAATTCACCTGCATACAGGGGCAGCATATCTAGCAGCTACTCCGCCCCCAAATGCTCGCCGGCATATCCCGTTTCCTCACTCGCCGCCGCCGCCCGCCCTTTCCGCTTGCCGCTACCGCCGCTGCAGCAGCCATGTCGTCGTCGTCGTCCACGGCAGCGAACATCTCCGAGCGTCCGATCTCTCCGGACACCACCCGCGTGGCCTGGGTGGGGACGGGCGTCATGGGCCAGTCAATGGCCGGCCACCTCCTCGCCGCCGGCTACGCTCTCACCGTATTCAACCGGACGGCATCCAAGACCCAGGGCCTCGTCTCCCGCGGCGCCAGCCTCGCGGACAGCCCGCGCGCGGCCGCCGCGGCTGCCGATGTCATCTTCCTCATGGTCGGCTTCCCCTCCGACGTCCGCTCCACCGCCCTCGATCCATCCACAGGCGCCCTCTCTGGCCTCACCCCAGGCGGTATCCTAGTCGACATGACCACCTCCGACCCCACCCTCGCCGCCGAGATAGCCGCGGCCGCGGCCGCCGCCGGCTGCTCGGCCGTCGACGCCCCCGTCTCCGGCGGTGACCGAGGGGCCCGCAACGCCACCCTCTCCATCTTCGCTGGCGGCGACGCCGCCGTCGTTGCTCGCCTGGCGCCGCTCTTCAAGCTCATGGGAAACGCGCTGTACATGGGCGGGCCCGGCGCGGGGCAGCGCGCGAAGCTGGGCAACCAGATCGCCATCGCATCCACCATGGTAGGGCTCGTGGAGGGCATGGTGTACGCGCACAAGGCCGGGCTGGACGTGGCCAAGTGGCTGGAGGCCATCTCCACCGGCGCAGCCGGGTCCAAGTCGCTGGAACTGTATGGGAAGCGGATCCTGGAGAGGGATATGGCGGCTGGCTTCTATGTCCGGCACTTCGTCAAGGACCTCGGTATCTGCCTGTTGGAATGCCAGGCCATGGGGCTGTCGCTGCCGGGGCTCGCCCTCGCGCAACAGCTGTACGTGTCGCTGATCGCGCACGGCGAGGGCGGGCTCGGTACACAGGCGCTTATACTGGCCGTCGAGCGGCTGAACAACACCAGCCTCGAGAAGAAGGACGAATGAAAGGCCCCAGGCTCTAGCTTTGATGAACTTGTGGGAAGCTTTGCTTGGTGCCTTGGTGCAAGTATGCAAGATCGAGGTGACTGTTAAGTTGTCTTTCAGAGTTCTACAGTTGTTCACTTTTGTAGTAGTATATATGTTATGCACTTGTGCAAAAAATTGTGCTGGCTTGGATGATTGCTTAGCTCTACCTGTTTACATCCGCCACCGGTTCAAATAAGATTTT

SEQ ID NO: 593 - DNA, 1576 bp, Zea mays
  misc_feature (1)..(1576): Ceres cDNA ID no. 12350195
  misc_feature (1)..(1576): Ceres CLONE  ID no. 331372
  misc_feature (1)..(1576): Also known as  Ceres CDNA ID no. 23767396
aaaactcccccaactgacggccacctcgaacggaaggggatcccccttaattatgagacaattattgctgaaattatttttttcggaatccaatcaggtagtagtatttgtgtgattgtgtccaggccctatacataagccgccatttgcagtccggacgcagccccgttcagtcgcagcccaggccgacgacggcagagagcgagccgacgccgccgcaccctcgtgccaggttacacggtgtgaaaatgtcaggaagggctttgaaagatctcaatgtttctcagtcagcagacctggagaacggaaaagacaattctgtgaaatcctgcatcaccaagcctgtgttgaatggcaacaaatgtgccaacaaggaagaaaaggctccgtctgcttgccacgacgctgtgactaatggaaatgcggctgccattgcagatgtggagtacattgattctgaaaatctagtagatctcccagatgtcgatgcagctctaagtaccttagctaaaagattggattcaaaggactgggttatgacatgtgaagctctcaacaatgttcgtcagttggcaatgtatcacaaggaacgattgcaggagcttctggagcctgtagttcctcttatcgtgaaatctgtgaagaacccaagaagtgctgtatgcaaaactgcactaatgacttgtgctgacatctttaaggcctatggtgacttaatggttcactcaatcgatccactgctagtacaactgtttctgaaggcttcacaagataagcgttttgtctgtgaagctgcagaggcagctcttatatcgatgacaagttggatctcccctttactactcttgccaagaatgctgccttacctcaagaacaagaatccacggatccgagcaaaagcatcagtgtgtttcagcaagagtgtaccacgccttgatgtggtgggaatcaaagaatatggtatggataagctcatccagattgcggcaacccaacttagcgaccagcttcctgaatcaagggaggctgctcgcaacctggcactggaactgcaagcattctatgagaagtctcaggcctcaacttctgacgaacacgaggtcgaggcctctgcctcgccagatgctgaatcatgggaggctttctgccagtccaagctctccgcattaagtgcccaagccattcttcgtgtgacctctactactacaaaagagtgcgtcacctctgccccaaaagaagggttggctgtgggttgctagcacaagccacaggggagatattgcgatttttcaccctgttcgctgttttgctgtacatgcttttggtttgtcctgcggtgcacccagtcgtgaaaaggttaatcattggttcaggagttcaggtgtgaccacggtgttaatattggtgtgggatatatatccattatagttggttgtacaatcatttggttccactacttggtattggagtgtagatttttttccccatggttcagcgttatacacaacagtccttattttttgtttttgatgctggttctgttattttgaaggaaatgacatattttgtgtttcgg

SEQ ID NO: 594 - protein, 1576 aa, Zea mays
  misc_feature: PFam Name: HEAT; PFam Description: HEAT repeat
  misc_feature: GI Number: 51979208; NR Description: PREDICTED P0543C11.17-3 gene product [Oryza sativa (japonica cultivar-group)] >gi|51979206|ref|XP_507469.1| PREDICTED P0543C11.17-3 gene product [Oryza sativa (japonica cultivar-group)] [Oryza sativa
  misc_feature: GI Number: 51979707; NR Description: PREDICTED P0702C09.23 gene product [Oryza sativa (japonica cultivar-group)] >gi|51979705|ref|XP_507599.1| PREDICTED P0702C09.23 gene product [Oryza sativa (japonica cultivar-group)] [Oryza sativa (japonica
  misc_feature: GI Number: 21537265; NR Description: unknown [Arabidopsis thaliana]
  misc_feature: GI Number: 21593517; NR Description: unknown [Arabidopsis thaliana]
AAAACTCCCCCAACTGACGGCCACCTCGAACGGAAGGGGATCCCCCTTAATTATGAGACAATTATTGCTGAAATTATTTTTTTCGGAATCCAATCAGGTAGTAGTATTTGTGTGATTGTGTCCAGGCCCTATACATAAGCCGCCATTTGCAGTCCGGACGCAGCCCCGTTCAGTCGCAGCCCAGGCCGACGACGGCAGAGAGCGAGCCGACGCCGCCGCACCCTCGTGCCAGGTTACACGGTGTGAAAATGTCAGGAAGGGCTTTGAAAGATCTCAATGTTTCTCAGTCAGCAGACCTGGAGAACGGAAAAGACAATTCTGTGAAATCCTGCATCACCAAGCCTGTGTTGAATGGCAACAAATGTGCCAACAAGGAAGAAAAGGCTCCGTCTGCTTGCCACGACGCTGTGACTAATGGAAATGCGGCTGCCATTGCAGATGTGGAGTACATTGATTCTGAAAATCTAGTAGATCTCCCAGATGTCGATGCAGCTCTAAGTACCTTAGCTAAAAGATTGGATTCAAAGGACTGGGTTATGACATGTGAAGCTCTCAACAATGTTCGTCAGTTGGCAATGTATCACAAGGAACGATTGCAGGAGCTTCTGGAGCCTGTAGTTCCTCTTATCGTGAAATCTGTGAAGAACCCAAGAAGTGCTGTATGCAAAACTGCACTAATGACTTGTGCTGACATCTTTAAGGCCTATGGTGACTTAATGGTTCACTCAATCGATCCACTGCTAGTACAACTGTTTCTGAAGGCTTCACAAGATAAGCGTTTTGTCTGTGAAGCTGCAGAGGCAGCTCTTATATCGATGACAAGTTGGATCTCCCCTTTACTACTCTTGCCAAGAATGCTGCCTTACCTCAAGAACAAGAATCCACGGATCCGAGCAAAAGCATCAGTGTGTTTCAGCAAGAGTGTACCACGCCTTGATGTGGTGGGAATCAAAGAATATGGTATGGATAAGCTCATCCAGATTGCGGCAACCCAACTTAGCGACCAGCTTCCTGAATCAAGGGAGGCTGCTCGCAACCTGGCACTGGAACTGCAAGCATTCTATGAGAAGTCTCAGGCCTCAACTTCTGACGAACACGAGGTCGAGGCCTCTGCCTCGCCAGATGCTGAATCATGGGAGGCTTTCTGCCAGTCCAAGCTCTCCGCATTAAGTGCCCAAGCCATTCTTCGTGTGACCTCTACTACTACAAAAGAGTGCGTCACCTCTGCCCCAAAAGAAGGGTTGGCTGTGGGTTGCTAGCACAAGCCACAGGGGAGATATTGCGATTTTTCACCCTGTTCGCTGTTTTGCTGTACATGCTTTTGGTTTGTCCTGCGGTGCACCCAGTCGTGAAAAGGTTAATCATTGGTTCAGGAGTTCAGGTGTGACCACGGTGTTAATATTGGTGTGGGATATATATCCATTATAGTTGGTTGTACAATCATTTGGTTCCACTACTTGGTATTGGAGTGTAGATTTTTTTCCCCATGGTTCAGCGTTATACACAACAGTCCTTATTTTTTGTTTTTGATGCTGGTTCTGTTATTTTGAAGGAAATGACATATTTTGTGTTTCGG

SEQ ID NO: 595 - DNA, 1053 bp, Zea mays
  misc_feature (1)..(1053): Ceres cDNA ID no. 12350538
  misc_feature (1)..(1053): Ceres CLONE  ID no. 289144
  misc_feature (1)..(1053): Also known as  Ceres CDNA ID no. 23749300
acagagcgaaacaatccgcagagactcggaagtcggaaagaatccctcctgttcttcgtcaaccctccagaacctgctctctcttcctctacgagactacgaccgtgtaaggacatggccgtcgagcgcttgaagaccgggttcgagcagttcaaggccgacgtctacgacaagaagccggagctgttcgagccactcaaggcgcaccagtcgcccaagtacatggtgttcgcctgctccgactcccgcgtgtgcccgtcggtgaccctgggcctgcaccccggcgaggcctttgccgtccgcaacatcgccagcatggtgccgccctacgacaagaccaagtacgccggcgtcggctccgccatcgagtacgccgtctgcgccctcaaggtggaggtcatcgtggtcataggccacagccgctgcggcgggatcaaggcgctcctctccctcgaggacggcgcgcccgacaagttccacttcgtggaggaatgggtcagggtcggcgccccggcgaagtccaaggtgctggccgaccacgcctcggtgcctttcgaagaccaatgctccatcctggagaaggaggccgtcaacgtgtcccttgagaacctcaagtcctacccgttcgtcaaggaagggctggagaaagggaccctcaagctggtcggcggccattacgacttcgtcaatggaaagttcgagacatgggaaccctaagtgaccatacgtacaaatacgccccaccggacttatttgccgcgtggagtgcttaattatttgccgatatatatatacacatatacaggaaatgaccggtgagaactatactgttgtaataataatagcgaggaaaaaaatatttgcatccgggatataaaaaacacttctttacaaatagaagaaaaataaattactaagagattaatttataaatttgatatgtttttgtgggcctgcctctaggtagtagatgtgaggggctttaaaagagtgtttgtatcccgaatgcaaagaattttttccagaaaggaatacatgtgttctttgacttcg

SEQ ID NO: 596 - protein, 1053 aa, Zea mays
  misc_feature: PFam Name: Pro_CA; PFam Description: Carbonic anhydrase
  misc_feature: GI Number: 729003; NR Description: CARBONIC ANHYDRASE, CHLOROPLAST PRECURSOR (CARBONATE DEHYDRATASE) >gi|7436817|pir||T04478 probable carbonate dehydratase (EC 4.2.1.1)
  misc_feature: GI Number: 5917783; NR Description: carbonic anhydrase 3 [Oryza sativa] >gi|7436816|pir||T03254 probable carbonate dehydratase (EC 4.2.1.1), chloroplast - rice
  misc_feature: GI Number: 34911604; NR Description: carbonic anhydrase [Oryza sativa (japonica cultivar-group)] >gi|3345477|dbj|BAA31953.1| carbonic anhydrase [Oryza sativa] >gi|15290096|dbj|BAB63789.1| carbonic anhydrase [Oryza sativa
  misc_feature: GI Number: 882248; NR Description: carbonic anhydrase 1
  misc_feature: GI Number: 882246; NR Description: carbonic anhydrase 2
ACAGAGCGAAACAATCCGCAGAGACTCGGAAGTCGGAAAGAATCCCTCCTGTTCTTCGTCAACCCTCCAGAACCTGCTCTCTCTTCCTCTACGAGACTACGACCGTGTAAGGACATGGCCGTCGAGCGCTTGAAGACCGGGTTCGAGCAGTTCAAGGCCGACGTCTACGACAAGAAGCCGGAGCTGTTCGAGCCACTCAAGGCGCACCAGTCGCCCAAGTACATGGTGTTCGCCTGCTCCGACTCCCGCGTGTGCCCGTCGGTGACCCTGGGCCTGCACCCCGGCGAGGCCTTTGCCGTCCGCAACATCGCCAGCATGGTGCCGCCCTACGACAAGACCAAGTACGCCGGCGTCGGCTCCGCCATCGAGTACGCCGTCTGCGCCCTCAAGGTGGAGGTCATCGTGGTCATAGGCCACAGCCGCTGCGGCGGGATCAAGGCGCTCCTCTCCCTCGAGGACGGCGCGCCCGACAAGTTCCACTTCGTGGAGGAATGGGTCAGGGTCGGCGCCCCGGCGAAGTCCAAGGTGCTGGCCGACCACGCCTCGGTGCCTTTCGAAGACCAATGCTCCATCCTGGAGAAGGAGGCCGTCAACGTGTCCCTTGAGAACCTCAAGTCCTACCCGTTCGTCAAGGAAGGGCTGGAGAAAGGGACCCTCAAGCTGGTCGGCGGCCATTACGACTTCGTCAATGGAAAGTTCGAGACATGGGAACCCTAAGTGACCATACGTACAAATACGCCCCACCGGACTTATTTGCCGCGTGGAGTGCTTAATTATTTGCCGATATATATATACACATATACAGGAAATGACCGGTGAGAACTATACTGTTGTAATAATAATAGCGAGGAAAAAAATATTTGCATCCGGGATATAAAAAACACTTCTTTACAAATAGAAGAAAAATAAATTACTAAGAGATTAATTTATAAATTTGATATGTTTTTGTGGGCCTGCCTCTAGGTAGTAGATGTGAGGGGCTTTAAAAGAGTGTTTGTATCCCGAATGCAAAGAATTTTTTCCAGAAAGGAATACATGTGTTCTTTGACTTCG

SEQ ID NO: 597 - DNA, 1685 bp, Zea mays
  misc_feature (1)..(1685): Ceres cDNA ID no. 12350656
  misc_feature (1)..(1685): Ceres CLONE  ID no. 338600
  misc_feature (1)..(1685): Also known as  Ceres CDNA ID no. 23779047
atagtcattttagcttgtgcacgctttgctgctctaaggtttaccgggcaaacactggacgacaggtgaacggggatgcacagttaggagattgagggagcgagaagggagggaggcaaaggagacagcatatgggatgtatttacagatgacaaagaacatgtcttagacagaagcaatggagaaattgcagttgatcactaccatcgatacaaggaagacattgagctcatggcaagtctaggttttagcgcatacagattttctatatcttgggcgcgtatatttcctgatggcttggggggaaaggtcaatgatcaaggagtcgccttctataatgacctcatcaactttatgatttcgaaaggtattgagccttacgcaactctatatcattgggatcttccaaacaatcttcagaagactctggggggctggatttctgacaagattgtggagtactttgcattgtatgcagaagcttgctttgcaaattttggagacagagtaaagcattggataacaatcaatgaacctctccaaactgcaatcaatggttatgggattggaatttttgcacctggaggatgccaaggtgaaactgctagatgttacttggctgcccatcaccaaatcttggctcatgctgctgctgttgatgtttatagaagaaaattcaaggctgcacaaggtggtgaagtagggttggttgttgattgtgaatgggcagagccattttctgaaaatgtggaagaccaaattgctgcacagcggaggcttgactttcaacttggatggtacttagatccaatatattttggtgattacccagaaagcatgcgtcaacgactgggcagtgatcttccaaccttctcagagaaagataaagagttcatgaggaacaaaattgattttgttggagtaaatcattatacttcaagactcattgctcatctccaaaatccaaacgatgtttatttctaccaagtgcaacaaatggagcgaatagaaaaatggaatagtggtgaaaaaattggtgaaagggctgcatctgaatggcttttcatagttccttggggccttcataagtcacttaattatatagcgaagaagtacaataatccagcaatttatgttactgagaatggcatggatgaagaggacgatcaatccgcaacgcttgaccaggtcctaaacgacacgacgagggtcggttacttcaaagggtacctcaattcagttgcgcaagcgatcaaggacggagctgatgtccgcgggtactttgcgtggtcgttcctggacaacttcgagtgggcaatgggctacaccaagaggttcggcatagtctacgtggactacaagaaggggctgtccaggcacccgaaagcatcggcgctgtggttctcgcgcttgctcaagggcgaggctggcactggcacaagctgagcgaactgcacgcagcatgcaagcacagaacgtcgtcgttattacaatataaatattccacacaactagacgttttctcctgttgttgtatcgtactactgtacagtaagcgccaataagctagcctcagatgtgtgctgcctgcctatacctctagtggctgccattgatccagcactagctgaaatgtacccggcctccaagaatcagcaccagaatatatgctttgaattgaactc

SEQ ID NO: 598 - protein, 1685 aa, Zea mays
  misc_feature: PFam Name: Glyco_hydro_1; PFam Description: Glycosyl
  misc_feature: GI Number: 37202036; NR Description: At5g36890 [Arabidopsis thaliana] >gi|10178206|dbj|BAB11630.1| beta-glucosidase [Arabidopsis thaliana] >gi|51969662|dbj|BAD43523.1| beta-glucosidase -like protein [Arabidopsis thaliana]
  misc_feature: GI Number: 31580730; NR Description: latex cyanogenic beta
  misc_feature: GI Number: 34907636; NR Description: putative beta-glucosidase [Oryza sativa (japonica cultivar-group)] >gi|19386689|dbj|BAB86071.1| putative beta-glucosidase [Oryza sativa (japonica cultivar-group)] >gi|22093598|dbj|BAC06894.1|
  misc_feature: GI Number: 56785274; NR Description: putative latex cyanogenic beta glucosidase [Oryza sativa (japonica cultivar-group)] gi|56784325|dbj|BAD82346.1| putative latex cyanogenic beta glucosidase [Oryza sativa (japonica
  misc_feature: GI Number: 22658440; NR Description: beta-glucosidase [Oryza
ATAGTCATTTTAGCTTGTGCACGCTTTGCTGCTCTAAGGTTTACCGGGCAAACACTGGACGACAGGTGAACGGGGATGCACAGTTAGGAGATTGAGGGAGCGAGAAGGGAGGGAGGCAAAGGAGACAGCATATGGGATGTATTTACAGATGACAAAGAACATGTCTTAGACAGAAGCAATGGAGAAATTGCAGTTGATCACTACCATCGATACAAGGAAGACATTGAGCTCATGGCAAGTCTAGGTTTTAGCGCATACAGATTTTCTATATCTTGGGCGCGTATATTTCCTGATGGCTTGGGGGGAAAGGTCAATGATCAAGGAGTCGCCTTCTATAATGACCTCATCAACTTTATGATTTCGAAAGGTATTGAGCCTTACGCAACTCTATATCATTGGGATCTTCCAAACAATCTTCAGAAGACTCTGGGGGGCTGGATTTCTGACAAGATTGTGGAGTACTTTGCATTGTATGCAGAAGCTTGCTTTGCAAATTTTGGAGACAGAGTAAAGCATTGGATAACAATCAATGAACCTCTCCAAACTGCAATCAATGGTTATGGGATTGGAATTTTTGCACCTGGAGGATGCCAAGGTGAAACTGCTAGATGTTACTTGGCTGCCCATCACCAAATCTTGGCTCATGCTGCTGCTGTTGATGTTTATAGAAGAAAATTCAAGGCTGCACAAGGTGGTGAAGTAGGGTTGGTTGTTGATTGTGAATGGGCAGAGCCATTTTCTGAAAATGTGGAAGACCAAATTGCTGCACAGCGGAGGCTTGACTTTCAACTTGGATGGTACTTAGATCCAATATATTTTGGTGATTACCCAGAAAGCATGCGTCAACGACTGGGCAGTGATCTTCCAACCTTCTCAGAGAAAGATAAAGAGTTCATGAGGAACAAAATTGATTTTGTTGGAGTAAATCATTATACTTCAAGACTCATTGCTCATCTCCAAAATCCAAACGATGTTTATTTCTACCAAGTGCAACAAATGGAGCGAATAGAAAAATGGAATAGTGGTGAAAAAATTGGTGAAAGGGCTGCATCTGAATGGCTTTTCATAGTTCCTTGGGGCCTTCATAAGTCACTTAATTATATAGCGAAGAAGTACAATAATCCAGCAATTTATGTTACTGAGAATGGCATGGATGAAGAGGACGATCAATCCGCAACGCTTGACCAGGTCCTAAACGACACGACGAGGGTCGGTTACTTCAAAGGGTACCTCAATTCAGTTGCGCAAGCGATCAAGGACGGAGCTGATGTCCGCGGGTACTTTGCGTGGTCGTTCCTGGACAACTTCGAGTGGGCAATGGGCTACACCAAGAGGTTCGGCATAGTCTACGTGGACTACAAGAAGGGGCTGTCCAGGCACCCGAAAGCATCGGCGCTGTGGTTCTCGCGCTTGCTCAAGGGCGAGGCTGGCACTGGCACAAGCTGAGCGAACTGCACGCAGCATGCAAGCACAGAACGTCGTCGTTATTACAATATAAATATTCCACACAACTAGACGTTTTCTCCTGTTGTTGTATCGTACTACTGTACAGTAAGCGCCAATAAGCTAGCCTCAGATGTGTGCTGCCTGCCTATACCTCTAGTGGCTGCCATTGATCCAGCACTAGCTGAAATGTACCCGGCCTCCAAGAATCAGCACCAGAATATATGCTTTGAATTGAACTC

SEQ ID NO: 599 - DNA, 1086 bp, Zea mays
  misc_feature (1)..(1086): Ceres cDNA ID no. 12350847
  misc_feature (1)..(1086): Ceres CLONE  ID no. 332661
  misc_feature (1)..(1086): Also known as  Ceres CDNA ID no. 23764270
  misc_feature (968)..(968): n is a, c, t, g, unknown, or other
  misc_feature (976)..(976): n is a, c, t, g, unknown, or other
  misc_feature (977)..(977): n is a, c, t, g, unknown, or other
  misc_feature (978)..(978): n is a, c, t, g, unknown, or other
  misc_feature (979)..(979): n is a, c, t, g, unknown, or other
atcacctcagtcctcacactgacatttcactctcggctgctggagtgtcggccgctgccatctgcctgccgctcactcccacgcgccgcaatgtgccactccccactcggcgccgccaccaccaccgcgggggcgctagcgctcctcttcctcctgccgctagcctcggccgccgccgccggcggcggcaccgcggcgaaggcgacgcccaacatcacggcgctcatgtccaagggcgggtgcaaggcgttcgcgtcgctgctggacaagtcccccgacgctctgtcggcgttcgagtcggcggtgagcggcggcgtgacggcgttctgcccgacggacgaggccgtgcgcgggttcatgcccagctaccggaacctgagcgcggacggcaaggcgtcgctgctgctgtttccacgcggtgcccgtgtactacacgctgcggggcctgaaatccagcaacgggcccatgaacacgctggccaccgacggcgccgccagcaactacaacctgacggtgcagaacgcgggcgaccaggtgacgctgcggacgccggcggccgacgcgccggcccgcgtgcgctccaccgtctacgacagggaccccgtcgccatctacgccgtggacgcggtgctggagcccgtggagctgttcgaccccgtggcggacgcgccgacccctgcgcccgcgccggcgccggcgctggcgcctaggtccgccaagcggacgcggcaccagcggcggcgcggagcggacgcgcctggcccggccgccgccgacgcctcgccggccgaccagaggaaggactacaagaagaacgcggcggccccgtgccgcacgcggtggctcgcgaccgccgccgccgctatcgccgtggccgccgccttggctgcttagggcggggtggtttaaagattgctcggccacccagctgttgtctttggatggagacgccatgcctttttggttnttggtcannnncggttgcttattacttcatcgattactgccgttgttagtatgaagtatgaacaaggtcgatatgtgacctggtggtgtacatcaaaactcaaatcttgttgattcgt

SEQ ID NO: 600 - protein, 1086 aa, Zea mays
  misc_feature: PFam Name: Fasciclin; PFam Description: Fasciclin domain
  misc_feature: PFam Name: FH2; PFam Description: Formin Homology 2 Domain
  misc_feature: GI Number: 50947129; NR Description: putative arabinogalactan protein [Oryza sativa (japonica cultivar-group)] >gi|42408491|dbj|BAD09671.1| putative arabinogalactan protein
  misc_feature: GI Number: 52077341; NR Description: fasciclin-like arabinogalactan-protein 2-like [Oryza sativa (japonica
  misc_feature: GI Number: 29836529; NR Description: putative pollen surface
  misc_feature: GI Number: 29836525; NR Description: putative pollen surface
  misc_feature: GI Number: 29836527; NR Description: putative pollen surface
ATCACCTCAGTCCTCACACTGACATTTCACTCTCGGCTGCTGGAGTGTCGGCCGCTGCCATCTGCCTGCCGCTCACTCCCACGCGCCGCAATGTGCCACTCCCCACTCGGCGCCGCCACCACCACCGCGGGGGCGCTAGCGCTCCTCTTCCTCCTGCCGCTAGCCTCGGCCGCCGCCGCCGGCGGCGGCACCGCGGCGAAGGCGACGCCCAACATCACGGCGCTCATGTCCAAGGGCGGGTGCAAGGCGTTCGCGTCGCTGCTGGACAAGTCCCCCGACGCTCTGTCGGCGTTCGAGTCGGCGGTGAGCGGCGGCGTGACGGCGTTCTGCCCGACGGACGAGGCCGTGCGCGGGTTCATGCCCAGCTACCGGAACCTGAGCGCGGACGGCAAGGCGTCGCTGCTGCTGTTTCCACGCGGTGCCCGTGTACTACACGCTGCGGGGCCTGAAATCCAGCAACGGGCCCATGAACACGCTGGCCACCGACGGCGCCGCCAGCAACTACAACCTGACGGTGCAGAACGCGGGCGACCAGGTGACGCTGCGGACGCCGGCGGCCGACGCGCCGGCCCGCGTGCGCTCCACCGTCTACGACAGGGACCCCGTCGCCATCTACGCCGTGGACGCGGTGCTGGAGCCCGTGGAGCTGTTCGACCCCGTGGCGGACGCGCCGACCCCTGCGCCCGCGCCGGCGCCGGCGCTGGCGCCTAGGTCCGCCAAGCGGACGCGGCACCAGCGGCGGCGCGGAGCGGACGCGCCTGGCCCGGCCGCCGCCGACGCCTCGCCGGCCGACCAGAGGAAGGACTACAAGAAGAACGCGGCGGCCCCGTGCCGCACGCGGTGGCTCGCGACCGCCGCCGCCGCTATCGCCGTGGCCGCCGCCTTGGCTGCTTAGGGCGGGGTGGTTTAAAGATTGCTCGGCCACCCAGCTGTTGTCTTTGGATGGAGACGCCATGCCTTTTTGGTTNTTGGTCANNNNCGGTTGCTTATTACTTCATCGATTACTGCCGTTGTTAGTATGAAGTATGAACAAGGTCGATATGTGACCTGGTGGTGTACATCAAAACTCAAATCTTGTTGATTCGT

SEQ ID NO: 601 - DNA, 1786 bp, Zea mays
  misc_feature (1)..(1786): Ceres cDNA ID no. 12351650
  misc_feature (1)..(1786): Ceres CLONE  ID no. 209794
  misc_feature (1)..(1786): Also known as  Ceres CDNA ID no. 23741011
aacgggtcaggcgctcccctgaccaaggccatgagccactacaccatgcatgcagccatcaactacgccgcgctgccacccacgtcgccgctgcaactccccctcccgtacctccctccgcctcctcctccgccgttaccgctaccgccgctgttgtcgccgccgccaccggcggcggcgtcctctgacgcgggattccagagcaggatcagccccagcgtccttctcatcatcctgatcttggccgtcatcttcttcgtctccggcctgctgcaccttctcgtccggttcctgctccgcccggcgccgcgggatcccggcgacgcgtacgggggtgacgcgaacgctaccgccttccagggtcagctccagcagctgttccacctccacgacgccggcgtcgaccagtccttcatcgacgcgctggccggtgttcctctacggcgccgtggtcggcgccggcgggaaggatcctttcgactgcgcggtctgcctctgcgagttcgcggacgacgaccgcctccgcctcctccccaagtgcagccacgcgttccacgtcgactgcatcgacacgtggctgctgtcgcactccacctgcccgctctgccgccgcagcctcctcgccgacttccccacctgcggcggcgcctgcagcccgctggtgttcgtcctcgagtccggctccgagggctcggtctccgatcgccacgacgcggcgtcctccgcgcgcctcagctttggcatggagcaggagcaggcagggcaggatcggaaacacgtcgccgctgcagaggtagcggacaagaaggacgaggtggtcgttccggtgaagctcggcaagttcagaagccaggccaccgaaggagccggcggcagcgccagccatggaagccatgacgtgaggcggtgcttctccatggggacctacgagtacgtcatggacgagagctccctgctccgcgtcgccgtgaagctgccggagaaaaagcgccccgcgacccgctctcgcatgcccgggcaccgtgttgccatgtcggagtgcgactgccactccaagcgggaaggcttccgcggattcgatgcgccgcccaagcagcagcagcagctgtcgaaagcggcggtggacaagagggagagcttctccgtctccaagatatggatgcgcagcgggccgaggaggaaggacgtgccctctggcgcaacgacctcgcgccgtgcgtcgtcgttccggctctcctcggcgctccagcgcacggcgagcgacgtcggggcgacgacggcgaagcgccgggcggacgtggtgagccccgtgacggagtccgagtacaacgtgtcggcttgggataagagcgcgagcggcagcgtcgtggattgggacgtcgagtccgcgggcggcgggcacggcctcagctccagagccgacgaggcgccgtcgttcgcccggcggacgctgctctggatcagaggccacctgtgaattgaaccgaagcgaagcagagatcttggcttctaccaccttgttcttcccctctgctctccccgtgtaagttgtagtaactgtgtgtgcatggatgcctgcgatcttctgctgcagcaacagatcgcaggaaatttgcattgcttggcgagtggatgaaatggtggatatgcgttcgaggtaaaaaaagattacgtctcgagatttctagattgtttcgcatagcatttcgcagttgtgtgtagtagattagctgtatttgctttgcattttgctgtacatttgaaattgcttcgtagggttttatcc

SEQ ID NO: 602 - protein, 1786 aa, Zea mays
  misc_feature: PFam Name: zf-C3HC4; PFam Description: Zinc finger, C3HC4
  misc_feature: PFam Name: SerH; PFam Description: Cell surface
  misc_feature: GI Number: 50946255; NR Description: putative RING finger 1 [Oryza sativa (japonica cultivar-group)] >gi|42407444|dbj|BAD10051.1| putative RING finger 1 [Oryza sativa
  misc_feature: GI Number: 18417587; NR Description: zinc finger (C3HC4-type
  misc_feature: GI Number: 21655299; NR Description: AT4g30400/F17I23_260 [Arabidopsis thaliana] >gi|15809840|gb|AAL06848.1|
  misc_feature: GI Number: 51091716; NR Description: RING finger 1-like
  misc_feature: GI Number: 4185131; NR Description: putative RING zinc finger protein [Arabidopsis thaliana] >gi|25411889|pir||H84566 probable RING zinc finger protein [imported] - Arabidopsis thaliana
AACGGGTCAGGCGCTCCCCTGACCAAGGCCATGAGCCACTACACCATGCATGCAGCCATCAACTACGCCGCGCTGCCACCCACGTCGCCGCTGCAACTCCCCCTCCCGTACCTCCCTCCGCCTCCTCCTCCGCCGTTACCGCTACCGCCGCTGTTGTCGCCGCCGCCACCGGCGGCGGCGTCCTCTGACGCGGGATTCCAGAGCAGGATCAGCCCCAGCGTCCTTCTCATCATCCTGATCTTGGCCGTCATCTTCTTCGTCTCCGGCCTGCTGCACCTTCTCGTCCGGTTCCTGCTCCGCCCGGCGCCGCGGGATCCCGGCGACGCGTACGGGGGTGACGCGAACGCTACCGCCTTCCAGGGTCAGCTCCAGCAGCTGTTCCACCTCCACGACGCCGGCGTCGACCAGTCCTTCATCGACGCGCTGGCCGGTGTTCCTCTACGGCGCCGTGGTCGGCGCCGGCGGGAAGGATCCTTTCGACTGCGCGGTCTGCCTCTGCGAGTTCGCGGACGACGACCGCCTCCGCCTCCTCCCCAAGTGCAGCCACGCGTTCCACGTCGACTGCATCGACACGTGGCTGCTGTCGCACTCCACCTGCCCGCTCTGCCGCCGCAGCCTCCTCGCCGACTTCCCCACCTGCGGCGGCGCCTGCAGCCCGCTGGTGTTCGTCCTCGAGTCCGGCTCCGAGGGCTCGGTCTCCGATCGCCACGACGCGGCGTCCTCCGCGCGCCTCAGCTTTGGCATGGAGCAGGAGCAGGCAGGGCAGGATCGGAAACACGTCGCCGCTGCAGAGGTAGCGGACAAGAAGGACGAGGTGGTCGTTCCGGTGAAGCTCGGCAAGTTCAGAAGCCAGGCCACCGAAGGAGCCGGCGGCAGCGCCAGCCATGGAAGCCATGACGTGAGGCGGTGCTTCTCCATGGGGACCTACGAGTACGTCATGGACGAGAGCTCCCTGCTCCGCGTCGCCGTGAAGCTGCCGGAGAAAAAGCGCCCCGCGACCCGCTCTCGCATGCCCGGGCACCGTGTTGCCATGTCGGAGTGCGACTGCCACTCCAAGCGGGAAGGCTTCCGCGGATTCGATGCGCCGCCCAAGCAGCAGCAGCAGCTGTCGAAAGCGGCGGTGGACAAGAGGGAGAGCTTCTCCGTCTCCAAGATATGGATGCGCAGCGGGCCGAGGAGGAAGGACGTGCCCTCTGGCGCAACGACCTCGCGCCGTGCGTCGTCGTTCCGGCTCTCCTCGGCGCTCCAGCGCACGGCGAGCGACGTCGGGGCGACGACGGCGAAGCGCCGGGCGGACGTGGTGAGCCCCGTGACGGAGTCCGAGTACAACGTGTCGGCTTGGGATAAGAGCGCGAGCGGCAGCGTCGTGGATTGGGACGTCGAGTCCGCGGGCGGCGGGCACGGCCTCAGCTCCAGAGCCGACGAGGCGCCGTCGTTCGCCCGGCGGACGCTGCTCTGGATCAGAGGCCACCTGTGAATTGAACCGAAGCGAAGCAGAGATCTTGGCTTCTACCACCTTGTTCTTCCCCTCTGCTCTCCCCGTGTAAGTTGTAGTAACTGTGTGTGCATGGATGCCTGCGATCTTCTGCTGCAGCAACAGATCGCAGGAAATTTGCATTGCTTGGCGAGTGGATGAAATGGTGGATATGCGTTCGAGGTAAAAAAAGATTACGTCTCGAGATTTCTAGATTGTTTCGCATAGCATTTCGCAGTTGTGTGTAGTAGATTAGCTGTATTTGCTTTGCATTTTGCTGTACATTTGAAATTGCTTCGTAGGGTTTTATCC

SEQ ID NO: 603 - DNA, 1439 bp, Zea mays
  misc_feature (1)..(1439): Ceres cDNA ID no. 12351772
  misc_feature (1)..(1439): Ceres CLONE  ID no. 230762
  misc_feature (1)..(1439): Also known as  Ceres CDNA ID no. 23777756
ctatgggctttgtggccgccctgtcggaaaacccgcgcaagaaaagagaaacccgcaagccgcccgcgcagaccatcgccccgttgccacggtcaaattcgtcggcgtttggtgccgcggcgtgactgtccgccggtcgcggcgcgcgtcctgcctggttggatcccttcggacttccgcagattcccgcgcgggggtgtttgatttggatgagaggagcgcggcggcgggatggggaccccttcgcagggctcggcggccgtgacggcggcccgggtcgacctctgcgcgctcgacctcatgcctgtctttgccaaggagatgatcgccggcggcgtcgccggcgccttctccaaaaccgccatcgcgccgctcgagcgcgtcaagatattgctgcagaccagaacaaatgagtttgggtctcttggagttctcaaatcattgaagaaactgagacaacttgatggagtcatggggttttacaaaggaaatggtgccagtgtgatgagaattgttccttatgctgcattacatttcatggcatatgagcggtaccggtgttggattttgaataactgtccctcactgggaacagggcctttagtagatcttttagccggttcagcatcagggggaactgctgtattgtgtacttatcccttggatttggcccggactaagcttgcctttcaggtcaatagttcagatgaactcagcagagctttgaaaaggggaagtccccagccagcatatggaggaatcattgatgtctttagatgtgtttactcagaaggtggagtgcgggctctttaccgaggtgtaggtccaacactcatggggatacttccttatgctggtcttaagttctacatatatgaagggctgaaggtacatgtaccagaagattacagaagttctgtaacattgaagctgtcatgtggtgctgctgctggtttatttggacagactctgacatatccattagatgttgtcaggaggcagatgcaggttcaaaatcagcaacaacatgaacaatttggtgccccacgaataacgggcacattccagggtcttgtgtccattaaacaaacacagggttggaaacaattatttgctggcttgagcctcaattacatcaaggtggtgccttcagtggccattggtttcaccgcatatgacaccatgaagcatttgctgaagatacctccaagagagaagaataaggtctgagcatggtcctgcttgaaattttggccgctcaattctgcagctagcagaaaagcactgcttctttctaaggcatgggagtgccgtatgaagcttacaatagaatgaagcagcctcgcccgcaattctgttacctagtactaattgcgttgtgtcacgtgatagcttatgtacctgacatattctttcattctaattttcctcattcatct

SEQ ID NO: 604 - protein, 1439 aa, Zea mays
  misc_feature: PFam Name: Mito_carr; PFam Description: Mitochondrial
  misc_feature: GI Number: 56784132; NR Description: Graves disease mitochondrial solute carrier protein-like [Oryza sativa (japonica
  misc_feature: GI Number: 50901792; NR Description: putative mitochondrial carrier [Oryza sativa (japonica cultivar-group)] >gi|20161078|dbj|BAB90009.1| mitochondrial carrier protein-like
  misc_feature: GI Number: 52077498; NR Description: mitochondrial carrier
  misc_feature: GI Number: 15223820; NR Description: mitochondrial substrate
  misc_feature: GI Number: 7527717; NR Description: T5E21.6 [Arabidopsis thaliana]
CTATGGGCTTTGTGGCCGCCCTGTCGGAAAACCCGCGCAAGAAAAGAGAAACCCGCAAGCCGCCCGCGCAGACCATCGCCCCGTTGCCACGGTCAAATTCGTCGGCGTTTGGTGCCGCGGCGTGACTGTCCGCCGGTCGCGGCGCGCGTCCTGCCTGGTTGGATCCCTTCGGACTTCCGCAGATTCCCGCGCGGGGGTGTTTGATTTGGATGAGAGGAGCGCGGCGGCGGGATGGGGACCCCTTCGCAGGGCTCGGCGGCCGTGACGGCGGCCCGGGTCGACCTCTGCGCGCTCGACCTCATGCCTGTCTTTGCCAAGGAGATGATCGCCGGCGGCGTCGCCGGCGCCTTCTCCAAAACCGCCATCGCGCCGCTCGAGCGCGTCAAGATATTGCTGCAGACCAGAACAAATGAGTTTGGGTCTCTTGGAGTTCTCAAATCATTGAAGAAACTGAGACAACTTGATGGAGTCATGGGGTTTTACAAAGGAAATGGTGCCAGTGTGATGAGAATTGTTCCTTATGCTGCATTACATTTCATGGCATATGAGCGGTACCGGTGTTGGATTTTGAATAACTGTCCCTCACTGGGAACAGGGCCTTTAGTAGATCTTTTAGCCGGTTCAGCATCAGGGGGAACTGCTGTATTGTGTACTTATCCCTTGGATTTGGCCCGGACTAAGCTTGCCTTTCAGGTCAATAGTTCAGATGAACTCAGCAGAGCTTTGAAAAGGGGAAGTCCCCAGCCAGCATATGGAGGAATCATTGATGTCTTTAGATGTGTTTACTCAGAAGGTGGAGTGCGGGCTCTTTACCGAGGTGTAGGTCCAACACTCATGGGGATACTTCCTTATGCTGGTCTTAAGTTCTACATATATGAAGGGCTGAAGGTACATGTACCAGAAGATTACAGAAGTTCTGTAACATTGAAGCTGTCATGTGGTGCTGCTGCTGGTTTATTTGGACAGACTCTGACATATCCATTAGATGTTGTCAGGAGGCAGATGCAGGTTCAAAATCAGCAACAACATGAACAATTTGGTGCCCCACGAATAACGGGCACATTCCAGGGTCTTGTGTCCATTAAACAAACACAGGGTTGGAAACAATTATTTGCTGGCTTGAGCCTCAATTACATCAAGGTGGTGCCTTCAGTGGCCATTGGTTTCACCGCATATGACACCATGAAGCATTTGCTGAAGATACCTCCAAGAGAGAAGAATAAGGTCTGAGCATGGTCCTGCTTGAAATTTTGGCCGCTCAATTCTGCAGCTAGCAGAAAAGCACTGCTTCTTTCTAAGGCATGGGAGTGCCGTATGAAGCTTACAATAGAATGAAGCAGCCTCGCCCGCAATTCTGTTACCTAGTACTAATTGCGTTGTGTCACGTGATAGCTTATGTACCTGACATATTCTTTCATTCTAATTTTCCTCATTCATCT

SEQ ID NO: 605 - DNA, 1393 bp, Zea mays
  misc_feature (1)..(1393): Ceres cDNA ID no. 12351858
  misc_feature (1)..(1393): Ceres CLONE  ID no. 238124
  misc_feature (1)..(1393): Also known as  Ceres CDNA ID no. 23772801
aagggtggccagctagccgaagaaacacccagacgaagcggccgtttttggcatctcgtatgtgcaacttcgctggaaccctcctcgactgattttaccgcacagcagaaaaggagataaaacacgacaaaaattgaaggaaaacgcattcacatcttctcttcgtccgccgccgccgcctctcttcattggtagcaccttaatccgaccccagtccagcccgccgccatggaggcgctgacggccacggacaaatgcttctccccggccagggcgatgttcccgatgccgattgtgaggccacctgcatcaccagaccatgccagtcagtatctggaggacttgttgcaggagcaacagaagctcgggccattcgtgcaggtgctcccaatctgcggcaggctgttgaatcaagagataatgagaacatcaaacctgctttctaactttggagttagaggaaatgagaggttgccaccaattgcaagtccgaaccacatgcatccattgccccggggacctgatttctgtggaaacggtttcggtccatggaatgagatgcatcctgagagaagtggttttcctaggggagccatgggttggcaaggtgctgtacagaaccattcctcctacattgtcaagaagatcgtgcgattggaagttccaacagatgcttaccccaattttaacttcattggccgtttgcttgggccgaggggacactcactaaagagaatcgaagctactacaggttgccgtgttttcatcagagggaaaggctccataaaagatcctgtgaaagaggaacagctcaagggaagacctggctatgaacacttggatgatccaacacatatcttgattgaggccgaattacctgctgatgttattgatgctagactggcacaagcacaggagatactagaggagtcgctgaaaccagtggatgagtcacaagacaacatcaagagacaacaacttcgagaacttgccatgttgaactctgtatatcgagagggtagcctgcatcagaacggcagcgcctctccgttcagcaatggggcacaaaacagtgacagggaggagattcagctctgatccttcccggaaactctcgcgttagtcctgctctcatgacagacatagcttctctgatgctcaagctcccgtgatggtattggaattcatgccattgctaactggtgaattttgatatcccttgtgacattgacctgcggatgagaagactagcgagaaaaaactcccccatggctgtgtacttaggatatttcgtttattgcttgcgcccactattagtgcagagatgtctaagttctagtattttgagctctttgattatctataaagttatgactccgcaaaatatttgatt

SEQ ID NO: 606 - protein, 1393 aa, Zea mays
  misc_feature: PFam Name: KH_1; PFam Description: KH domain
  misc_feature: GI Number: 34909270; NR Description: P0454H12.18 [Oryza sativa (japonica cultivar-group)] >gi|15128399|dbj|BAB62585.1|
  misc_feature: GI Number: 34900448; NR Description: KH domain-like protein [Oryza sativa (japonica cultivar-group)] >gi|24060154|dbj|BAC21599.1| KH domain-like protein [Oryza sativa
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 50912257; NR Description: putative KH domain protein [Oryza sativa (japonica cultivar-group)] >gi|45735990|dbj|BAD13019.1| putative KH domain protein [Oryza sativa (japonica cultivar-group)] >gi|45735994|dbj|BAD13022.1|
AAGGGTGGCCAGCTAGCCGAAGAAACACCCAGACGAAGCGGCCGTTTTTGGCATCTCGTATGTGCAACTTCGCTGGAACCCTCCTCGACTGATTTTACCGCACAGCAGAAAAGGAGATAAAACACGACAAAAATTGAAGGAAAACGCATTCACATCTTCTCTTCGTCCGCCGCCGCCGCCTCTCTTCATTGGTAGCACCTTAATCCGACCCCAGTCCAGCCCGCCGCCATGGAGGCGCTGACGGCCACGGACAAATGCTTCTCCCCGGCCAGGGCGATGTTCCCGATGCCGATTGTGAGGCCACCTGCATCACCAGACCATGCCAGTCAGTATCTGGAGGACTTGTTGCAGGAGCAACAGAAGCTCGGGCCATTCGTGCAGGTGCTCCCAATCTGCGGCAGGCTGTTGAATCAAGAGATAATGAGAACATCAAACCTGCTTTCTAACTTTGGAGTTAGAGGAAATGAGAGGTTGCCACCAATTGCAAGTCCGAACCACATGCATCCATTGCCCCGGGGACCTGATTTCTGTGGAAACGGTTTCGGTCCATGGAATGAGATGCATCCTGAGAGAAGTGGTTTTCCTAGGGGAGCCATGGGTTGGCAAGGTGCTGTACAGAACCATTCCTCCTACATTGTCAAGAAGATCGTGCGATTGGAAGTTCCAACAGATGCTTACCCCAATTTTAACTTCATTGGCCGTTTGCTTGGGCCGAGGGGACACTCACTAAAGAGAATCGAAGCTACTACAGGTTGCCGTGTTTTCATCAGAGGGAAAGGCTCCATAAAAGATCCTGTGAAAGAGGAACAGCTCAAGGGAAGACCTGGCTATGAACACTTGGATGATCCAACACATATCTTGATTGAGGCCGAATTACCTGCTGATGTTATTGATGCTAGACTGGCACAAGCACAGGAGATACTAGAGGAGTCGCTGAAACCAGTGGATGAGTCACAAGACAACATCAAGAGACAACAACTTCGAGAACTTGCCATGTTGAACTCTGTATATCGAGAGGGTAGCCTGCATCAGAACGGCAGCGCCTCTCCGTTCAGCAATGGGGCACAAAACAGTGACAGGGAGGAGATTCAGCTCTGATCCTTCCCGGAAACTCTCGCGTTAGTCCTGCTCTCATGACAGACATAGCTTCTCTGATGCTCAAGCTCCCGTGATGGTATTGGAATTCATGCCATTGCTAACTGGTGAATTTTGATATCCCTTGTGACATTGACCTGCGGATGAGAAGACTAGCGAGAAAAAACTCCCCCATGGCTGTGTACTTAGGATATTTCGTTTATTGCTTGCGCCCACTATTAGTGCAGAGATGTCTAAGTTCTAGTATTTTGAGCTCTTTGATTATCTATAAAGTTATGACTCCGCAAAATATTTGATT

SEQ ID NO: 607 - DNA, 1549 bp, Zea mays
  misc_feature (1)..(1549): Ceres cDNA ID no. 12351900
  misc_feature (1)..(1549): Ceres CLONE  ID no. 241429
  misc_feature (1)..(1549): Also known as  Ceres CDNA ID no. 23755960
actcgacaccgcacggcctcaagcagaggaagctttccgcccgggaacgccatggggtcgcttcctctccttgctgcctgctgctccctcctgctcacggtcgcagctcctgcccgggacagcactaccagcgtctgcgcttcgcaaatcggcgatttcccgcaccggaacagttcgggcctccacctgacgctgcaccacccgcagagcccctgctcgccggcgccgctcccgtccgacctccccttctccacagtcctcacccacgacgatgcgcgcgtcgcccacctcgcgtcgcgactcgccgccagtgatccgccgtcccgccgtccgacatcactccgcaagcagaagaaggccgccggtggtgcttccggcggccaccacctcgacgacgactccctggcctccgtgcctctctcgcccggaacgtcagtgggcgtggggaactacgttacccagctcggcctcggcacgccgtccacctcctacgcaatggtagtcgacacgggctcctcgctcacctggctgcagtgctcgccttgcgtcgtgtcgtgccaccgccaggtggggccgctcttcgaccccagggcctccagcacctacgcctccgtgcgctgctcggcgtcgcagtgcgacgagctccaggccgccacgctcaacccgtccgcctgctccgcctcaaacgtctgcatctaccaggccagctacggcgacagctccttctccgtcggctccctcagcacggacaccgtctccttcggctccacccgctacccgagcttctactacggctgcggccaggacaatgaggggctcttcggccgctcggcggggctcatcggcctcgcgcgcaacaagctctcgctgctctaccagctcgcgcccagcctcggctactccttctcctattgcctcccgacggctgcgtcaacggggtatctctccatcgggccctacaacacggggcactactactcgtacacgcccatggcctcgagctctctcgacgcctcgctctacttcatcaccctgtccgggatgtcggtcggcgggagcccactcgcggtctcgccgtcggagtacagcagcctgcccacgatcatagactcgggcacggtgatcacgcgcctgccgacggctgtgcacacggcgctcagcaaggcggtggcccaggccatggcaggggcgcagcgcgcaccggccttctccatcctggacacgtgcttcgagggccaggcgtcgcagctgcgcgtgcccaccgtggccatggcgttcgcgggcggcgcctccatgaagctgacgacgcggaacgtgctcatagacgtcgacgactccacgacgtgcctggcgtttgcgcccaccgacagcacggccatcatcggcaacacgcagcagcagacgttcagcgtcatctacgacgtcgcgcaatccaggatcggcttctcggcaggcggatgcagctgaatagctgatgggtgaaaagtgaaaactgattattgagctctatggagtgggcagctcaagcttggtaatagaaaatgcgtac

SEQ ID NO: 608 - protein, 1549 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Podocalyxin; PFam Description: Podocalyxin
  misc_feature: GI Number: 45735971; NR Description: putative chloroplast nucleoid DNA-binding protein cnd41 [Oryza sativa (japonica cultivar-group)] gi|45735845|dbj|BAD12880.1| putative chloroplast nucleoid DNA-binding protein cnd41 [Oryza sativa (japonica
  misc_feature: GI Number: 55417864; NR Description: putative chloroplast nucleoid DNA-binding protein cnd41 [Oryza sativa (japonica cultivar-group)] gi|50912217|ref|XP_467516.1| putative chloroplast nucleoid DNA-binding protein cnd41 [Oryza sativa
  misc_feature: GI Number: 24430421; NR Description: 41 kD chloroplast
  misc_feature: GI Number: 51091964; NR Description: putative nucleoid DNA-binding protein cnd41, chloroplast [Oryza sativa (japonica
  misc_feature: GI Number: 7489168; NR Description: nucleoid DNA-binding protein cnd41, chloroplast - common tobacco >gi|2541876|dbj|BAA22813.1| CND41, chloroplast nucleoid DNA binding
ACTCGACACCGCACGGCCTCAAGCAGAGGAAGCTTTCCGCCCGGGAACGCCATGGGGTCGCTTCCTCTCCTTGCTGCCTGCTGCTCCCTCCTGCTCACGGTCGCAGCTCCTGCCCGGGACAGCACTACCAGCGTCTGCGCTTCGCAAATCGGCGATTTCCCGCACCGGAACAGTTCGGGCCTCCACCTGACGCTGCACCACCCGCAGAGCCCCTGCTCGCCGGCGCCGCTCCCGTCCGACCTCCCCTTCTCCACAGTCCTCACCCACGACGATGCGCGCGTCGCCCACCTCGCGTCGCGACTCGCCGCCAGTGATCCGCCGTCCCGCCGTCCGACATCACTCCGCAAGCAGAAGAAGGCCGCCGGTGGTGCTTCCGGCGGCCACCACCTCGACGACGACTCCCTGGCCTCCGTGCCTCTCTCGCCCGGAACGTCAGTGGGCGTGGGGAACTACGTTACCCAGCTCGGCCTCGGCACGCCGTCCACCTCCTACGCAATGGTAGTCGACACGGGCTCCTCGCTCACCTGGCTGCAGTGCTCGCCTTGCGTCGTGTCGTGCCACCGCCAGGTGGGGCCGCTCTTCGACCCCAGGGCCTCCAGCACCTACGCCTCCGTGCGCTGCTCGGCGTCGCAGTGCGACGAGCTCCAGGCCGCCACGCTCAACCCGTCCGCCTGCTCCGCCTCAAACGTCTGCATCTACCAGGCCAGCTACGGCGACAGCTCCTTCTCCGTCGGCTCCCTCAGCACGGACACCGTCTCCTTCGGCTCCACCCGCTACCCGAGCTTCTACTACGGCTGCGGCCAGGACAATGAGGGGCTCTTCGGCCGCTCGGCGGGGCTCATCGGCCTCGCGCGCAACAAGCTCTCGCTGCTCTACCAGCTCGCGCCCAGCCTCGGCTACTCCTTCTCCTATTGCCTCCCGACGGCTGCGTCAACGGGGTATCTCTCCATCGGGCCCTACAACACGGGGCACTACTACTCGTACACGCCCATGGCCTCGAGCTCTCTCGACGCCTCGCTCTACTTCATCACCCTGTCCGGGATGTCGGTCGGCGGGAGCCCACTCGCGGTCTCGCCGTCGGAGTACAGCAGCCTGCCCACGATCATAGACTCGGGCACGGTGATCACGCGCCTGCCGACGGCTGTGCACACGGCGCTCAGCAAGGCGGTGGCCCAGGCCATGGCAGGGGCGCAGCGCGCACCGGCCTTCTCCATCCTGGACACGTGCTTCGAGGGCCAGGCGTCGCAGCTGCGCGTGCCCACCGTGGCCATGGCGTTCGCGGGCGGCGCCTCCATGAAGCTGACGACGCGGAACGTGCTCATAGACGTCGACGACTCCACGACGTGCCTGGCGTTTGCGCCCACCGACAGCACGGCCATCATCGGCAACACGCAGCAGCAGACGTTCAGCGTCATCTACGACGTCGCGCAATCCAGGATCGGCTTCTCGGCAGGCGGATGCAGCTGAATAGCTGATGGGTGAAAAGTGAAAACTGATTATTGAGCTCTATGGAGTGGGCAGCTCAAGCTTGGTAATAGAAAATGCGTAC

SEQ ID NO: 609 - DNA, 1315 bp, Zea mays
  misc_feature (1)..(1315): Ceres cDNA ID no. 12351926
  misc_feature (1)..(1315): Ceres CLONE  ID no. 242216
  misc_feature (1)..(1315): Also known as  Ceres CDNA ID no. 23754742
aggacagaaccctgagccggaacaaaatggcggcgctcataaaccctatataccgccgactcgccgccttcgcctgccgccggatctctgcaccggcggtagagaagcccgtgctgcccctcgtgtatcaccggaacttgcagcaaagacacaattccagtttggtggatgcgagtggaggattcagcgagatgcttgcctctacacggaggtgctatgtatttggaggcaaaggtggtgtggggaaaacaagcatggcgggcgtcgcttgctgtgaagtttgccaaccatggtgaaccaacagctattgtttcgacggaaccatctccgtcactcggtgatttatttgaacaagacatgggtgttggcggcaaaactgtacgcatcactggatttgactctctttttgcagttgaggctggtcagttcaagataaagggagaacctgaagatcttggatcttttatcaacaatttacttggaaagatggggcttggaacacattctgatattatgtctatgattagagagatgctggatggaatgccccctggacttgaagaagcgcttgtactatcaaaggtgataaaatctattgacgtgcaagaggccgatatacttcggcgtttagtgctggatgctccatccactggacatacacttaagcttctgtcagcttctgattggattgaaatgttccttactttgagcattaagggcataaaagtggcttcgtccatgccatcgtttaatatgtatcttgaggacgtgcaattcatctctgccaggctagaggaactaaggcagcaggttcgcagagtgcgtgagattttgtttgatccacaatcaacagaattcatcgtcgtgacaattccaacgatgatggcagttactgagtcatcaaggtttcacgagtcattaaagaaggatggtgcacacacaagaaggctcgtcataaatcaggtgttgccaccgtctgcgtcggactgcagattctgtgctgcaaaacggagggaagaagcacgtgccttccgtgcgatactggaggaccgagaactcggcggcctgaagctgatccaggctccgctccttgatatggaggtgaaaggcgtccctgcactccgattcctcagcgattcagtgtggaagtagcgagaaacactaggtcaaataaaagattaatctctgtcggtctgttcggattctttcatttggttggagctagaatctagttcatgaatttggcctagaatctggcattcgaccacgttctatcactcttctcaagtatagatctgtgtcaaattcagagggc

SEQ ID NO: 610 - protein, 1315 aa, Zea mays
  misc_feature: PFam Name: ArsA_ATPase; PFam Description: Anion-transporting
  misc_feature: GI Number: 30681260; NR Description: anion-transporting
  misc_feature: GI Number: 9759337; NR Description: arsenite translocating
  misc_feature: GI Number: 6056208; NR Description: putative ATPase
  misc_feature: GI Number: 5824321; NR Description: ATPase [Solanum tuberosum]
  misc_feature: GI Number: 50912707; NR Description: putative ATPase [Oryza sativa (japonica cultivar-group)] >gi|46390107|dbj|BAD15543.1| putative ATPase [Oryza sativa (japonica cultivar-group)] >gi|46390644|dbj|BAD16127.1| putative ATPase [Oryza sativa
AGGACAGAACCCTGAGCCGGAACAAAATGGCGGCGCTCATAAACCCTATATACCGCCGACTCGCCGCCTTCGCCTGCCGCCGGATCTCTGCACCGGCGGTAGAGAAGCCCGTGCTGCCCCTCGTGTATCACCGGAACTTGCAGCAAAGACACAATTCCAGTTTGGTGGATGCGAGTGGAGGATTCAGCGAGATGCTTGCCTCTACACGGAGGTGCTATGTATTTGGAGGCAAAGGTGGTGTGGGGAAAACAAGCATGGCGGGCGTCGCTTGCTGTGAAGTTTGCCAACCATGGTGAACCAACAGCTATTGTTTCGACGGAACCATCTCCGTCACTCGGTGATTTATTTGAACAAGACATGGGTGTTGGCGGCAAAACTGTACGCATCACTGGATTTGACTCTCTTTTTGCAGTTGAGGCTGGTCAGTTCAAGATAAAGGGAGAACCTGAAGATCTTGGATCTTTTATCAACAATTTACTTGGAAAGATGGGGCTTGGAACACATTCTGATATTATGTCTATGATTAGAGAGATGCTGGATGGAATGCCCCCTGGACTTGAAGAAGCGCTTGTACTATCAAAGGTGATAAAATCTATTGACGTGCAAGAGGCCGATATACTTCGGCGTTTAGTGCTGGATGCTCCATCCACTGGACATACACTTAAGCTTCTGTCAGCTTCTGATTGGATTGAAATGTTCCTTACTTTGAGCATTAAGGGCATAAAAGTGGCTTCGTCCATGCCATCGTTTAATATGTATCTTGAGGACGTGCAATTCATCTCTGCCAGGCTAGAGGAACTAAGGCAGCAGGTTCGCAGAGTGCGTGAGATTTTGTTTGATCCACAATCAACAGAATTCATCGTCGTGACAATTCCAACGATGATGGCAGTTACTGAGTCATCAAGGTTTCACGAGTCATTAAAGAAGGATGGTGCACACACAAGAAGGCTCGTCATAAATCAGGTGTTGCCACCGTCTGCGTCGGACTGCAGATTCTGTGCTGCAAAACGGAGGGAAGAAGCACGTGCCTTCCGTGCGATACTGGAGGACCGAGAACTCGGCGGCCTGAAGCTGATCCAGGCTCCGCTCCTTGATATGGAGGTGAAAGGCGTCCCTGCACTCCGATTCCTCAGCGATTCAGTGTGGAAGTAGCGAGAAACACTAGGTCAAATAAAAGATTAATCTCTGTCGGTCTGTTCGGATTCTTTCATTTGGTTGGAGCTAGAATCTAGTTCATGAATTTGGCCTAGAATCTGGCATTCGACCACGTTCTATCACTCTTCTCAAGTATAGATCTGTGTCAAATTCAGAGGGC

SEQ ID NO: 611 - DNA, 1860 bp, Zea mays
  misc_feature (1)..(1860): Ceres cDNA ID no. 12351934
  misc_feature (1)..(1860): Ceres CLONE  ID no. 242317
  misc_feature (1)..(1860): Also known as  Ceres CDNA ID no. 23754761
acgaagcaagcaagactactgctacagaaagcagcagcaaaggtctagccggctgcgtggcctaggcgcctaactatatagttaaggtctatctttgagcagttaacgtgcaggaggaataacacgatagccatggacgtgtacatctaccaggcgctcctcctctcggtccttgctgtggcactgctgcagctggtgaagatggccctcaagccgaggccacggctgccgccagggccttggaagctgcccgtcatcggcagcatgcaccacctcgtgaacgtgcttccacaccgggcgctgcgggatctggcggacgtccacggcccgctcatgatgctgcagctcggccagacgccgctcgtcgtcgcctcttccaaggagacggcgcgcgccgtgctcaagacgcacgacaccaacttcgccacacgccccaagctcctcggccggcgagatcgtcggctatgagtgggtcgacatcctctttgccccctccggcgactactggcgcaagctccgccagctctgcgccgccgagatcctgagccccaagcgcgtgctctcgtttcgtcacatccgggaggaggaggtgatgctgcgggtggaggagatccgcgcggcgggcccgtcgacgccggtgaacctgagcgtgatgttccacagcatcacaaacagcgtcgtgtcgcgggccgcattcgggaagaagcggaagaacgcggcggagttcctggcggctaccaaggccgtcgtcggcctgtcgagcggcttcaacatcccggacttgttcccggcgtggaccacagtcctggccaagctcaccggcatgacgcgcagcctcaaggagatccacaagacggtggacaccatcctcgaggaaattatcgaggagcgcaagcgcatccgcgacgaaaagatcatgggcggcgccgccgccgaggacgtcgacgagaacctcgtcgacgtactcatcggcctgcaggagaaaggcggcttcggcttccaacttaccaacagcatcatcaaggccatcatactggacatgttcgcgggcgggacggggacgtcggggtcggccatggagtgggggatgtcggagctgatgcggaacccaccagtgatgaagaagatgcaggcgctgatcagggaggcgttccgtgggaagacggtggtgacagagggcgacctacaggcgagcaacctccagtacatgaagctggtgatcaaagaggccctgcggctgcatccgccggcaccgctgctggtgccccgggagagcatcgaggagtgcgagctggacgggtacacgattccagccaagtcacgggtcatcatcaacgcgtgggccatcggccgtgaccccaagtactggaatgacgccgacgagttcaagccggagcggttcgaggacggctcccgagacttcacgggcagcagctacgagttcttgcccttcggctccggccgaaggatgtgccccgacttcaactacggcctcgccagcatggagctcgcctttgtcggcctgctctaccacttcgactcgtcgctgcccgatggcgtcaaggaggtcaacatgggggaggtgcctggactcggcgtctgccgccgcacgccactaatgctttgcgcaaccccgttcgtcccggtccccgcctagctagccaacgtacatcgtcatgccagccgcgagctgagggacctattgtatctctgtctcagtatctctatgtgcttgctggctaaataaacacgtcatctgtacgtctcgttatgggtgctgcccattgtagtgtgctgtgcgtacgtgtagtagtacagtgaagagtgtactataatcatgtacctaaagtttcaacttcc

SEQ ID NO: 612 - protein, 1860 aa, Zea mays
  misc_feature: PFam Name: p450; PFam Description: Cytochrome P450
  misc_feature: GI Number: 13661752; NR Description: putative cytochrome P450
  misc_feature: GI Number: 13661754; NR Description: putative cytochrome P450
  misc_feature: GI Number: 13661760; NR Description: putative cytochrome P450
  misc_feature: GI Number: 50906339; NR Description: putative cytochrome P450 [Oryza sativa (japonica cultivar-group)] >gi|46805218|dbj|BAD17698.1| putative cytochrome P450 [Oryza sativa
  misc_feature: GI Number: 50906341; NR Description: putative cytochrome P450 [Oryza sativa (japonica cultivar-group)] >gi|46805219|dbj|BAD17699.1| putative cytochrome P450 [Oryza sativa
ACGAAGCAAGCAAGACTACTGCTACAGAAAGCAGCAGCAAAGGTCTAGCCGGCTGCGTGGCCTAGGCGCCTAACTATATAGTTAAGGTCTATCTTTGAGCAGTTAACGTGCAGGAGGAATAACACGATAGCCATGGACGTGTACATCTACCAGGCGCTCCTCCTCTCGGTCCTTGCTGTGGCACTGCTGCAGCTGGTGAAGATGGCCCTCAAGCCGAGGCCACGGCTGCCGCCAGGGCCTTGGAAGCTGCCCGTCATCGGCAGCATGCACCACCTCGTGAACGTGCTTCCACACCGGGCGCTGCGGGATCTGGCGGACGTCCACGGCCCGCTCATGATGCTGCAGCTCGGCCAGACGCCGCTCGTCGTCGCCTCTTCCAAGGAGACGGCGCGCGCCGTGCTCAAGACGCACGACACCAACTTCGCCACACGCCCCAAGCTCCTCGGCCGGCGAGATCGTCGGCTATGAGTGGGTCGACATCCTCTTTGCCCCCTCCGGCGACTACTGGCGCAAGCTCCGCCAGCTCTGCGCCGCCGAGATCCTGAGCCCCAAGCGCGTGCTCTCGTTTCGTCACATCCGGGAGGAGGAGGTGATGCTGCGGGTGGAGGAGATCCGCGCGGCGGGCCCGTCGACGCCGGTGAACCTGAGCGTGATGTTCCACAGCATCACAAACAGCGTCGTGTCGCGGGCCGCATTCGGGAAGAAGCGGAAGAACGCGGCGGAGTTCCTGGCGGCTACCAAGGCCGTCGTCGGCCTGTCGAGCGGCTTCAACATCCCGGACTTGTTCCCGGCGTGGACCACAGTCCTGGCCAAGCTCACCGGCATGACGCGCAGCCTCAAGGAGATCCACAAGACGGTGGACACCATCCTCGAGGAAATTATCGAGGAGCGCAAGCGCATCCGCGACGAAAAGATCATGGGCGGCGCCGCCGCCGAGGACGTCGACGAGAACCTCGTCGACGTACTCATCGGCCTGCAGGAGAAAGGCGGCTTCGGCTTCCAACTTACCAACAGCATCATCAAGGCCATCATACTGGACATGTTCGCGGGCGGGACGGGGACGTCGGGGTCGGCCATGGAGTGGGGGATGTCGGAGCTGATGCGGAACCCACCAGTGATGAAGAAGATGCAGGCGCTGATCAGGGAGGCGTTCCGTGGGAAGACGGTGGTGACAGAGGGCGACCTACAGGCGAGCAACCTCCAGTACATGAAGCTGGTGATCAAAGAGGCCCTGCGGCTGCATCCGCCGGCACCGCTGCTGGTGCCCCGGGAGAGCATCGAGGAGTGCGAGCTGGACGGGTACACGATTCCAGCCAAGTCACGGGTCATCATCAACGCGTGGGCCATCGGCCGTGACCCCAAGTACTGGAATGACGCCGACGAGTTCAAGCCGGAGCGGTTCGAGGACGGCTCCCGAGACTTCACGGGCAGCAGCTACGAGTTCTTGCCCTTCGGCTCCGGCCGAAGGATGTGCCCCGACTTCAACTACGGCCTCGCCAGCATGGAGCTCGCCTTTGTCGGCCTGCTCTACCACTTCGACTCGTCGCTGCCCGATGGCGTCAAGGAGGTCAACATGGGGGAGGTGCCTGGACTCGGCGTCTGCCGCCGCACGCCACTAATGCTTTGCGCAACCCCGTTCGTCCCGGTCCCCGCCTAGCTAGCCAACGTACATCGTCATGCCAGCCGCGAGCTGAGGGACCTATTGTATCTCTGTCTCAGTATCTCTATGTGCTTGCTGGCTAAATAAACACGTCATCTGTACGTCTCGTTATGGGTGCTGCCCATTGTAGTGTGCTGTGCGTACGTGTAGTAGTACAGTGAAGAGTGTACTATAATCATGTACCTAAAGTTTCAACTTCC

SEQ ID NO: 613 - DNA, 659 bp, Zea mays
  misc_feature (1)..(659): Ceres cDNA ID no. 12352020
  misc_feature (1)..(659): Ceres CLONE  ID no. 244744
  misc_feature (1)..(659): Also known as  Ceres CDNA ID no. 12352020
agaacattcgattctaaaatttacaatttacaatttacagctgtgcggaggcgggagcagggggcagcgagcacctagcagcgcgcggccggcgactccaccgagacacctcagccggccgcgcggtcgcggttgcctccggctggctcctcgcctcgatggtggggatgtaccagcaccaactccgcgacgaccccttcgacaccctaagcggcggccactgcgaggtacatggcggcggacagccgcggcagcgggtcgaggcgcttgccgacggaagaagcatgttgcgcggcgggggaagcggtatagttggcgccgcgggtggagatctaggggtgctagtgcggtggatgcgggaactcgcagcggatccccgtgggtccacttccggcgccatcagagcacagggtgaggaagcggcacgtgctggcctggcggcgcgctcgctacctcagattggaggacgtggcggacgcagaagagcttcccagcttctccaagaaaaggaagctctactgggatcaaaaaaagaaaggctgcttgaacatgccaacaaggaaatctgagaggcttgctaagagaatgaaactcatggcatcattgctcctcacgcaacggaaaaagattggagtaggtgagcactttcaggcagaggt

SEQ ID NO: 614 - protein, 659 aa, Zea mays
AGAACATTCGATTCTAAAATTTACAATTTACAATTTACAGCTGTGCGGAGGCGGGAGCAGGGGGCAGCGAGCACCTAGCAGCGCGCGGCCGGCGACTCCACCGAGACACCTCAGCCGGCCGCGCGGTCGCGGTTGCCTCCGGCTGGCTCCTCGCCTCGATGGTGGGGATGTACCAGCACCAACTCCGCGACGACCCCTTCGACACCCTAAGCGGCGGCCACTGCGAGGTACATGGCGGCGGACAGCCGCGGCAGCGGGTCGAGGCGCTTGCCGACGGAAGAAGCATGTTGCGCGGCGGGGGAAGCGGTATAGTTGGCGCCGCGGGTGGAGATCTAGGGGTGCTAGTGCGGTGGATGCGGGAACTCGCAGCGGATCCCCGTGGGTCCACTTCCGGCGCCATCAGAGCACAGGGTGAGGAAGCGGCACGTGCTGGCCTGGCGGCGCGCTCGCTACCTCAGATTGGAGGACGTGGCGGACGCAGAAGAGCTTCCCAGCTTCTCCAAGAAAAGGAAGCTCTACTGGGATCAAAAAAAGAAAGGCTGCTTGAACATGCCAACAAGGAAATCTGAGAGGCTTGCTAAGAGAATGAAACTCATGGCATCATTGCTCCTCACGCAACGGAAAAAGATTGGAGTAGGTGAGCACTTTCAGGCAGAGGT

SEQ ID NO: 615 - DNA, 1517 bp, Zea mays
  misc_feature (1)..(1517): Ceres cDNA ID no. 12352068
  misc_feature (1)..(1517): Ceres CLONE  ID no. 246734
  misc_feature (1)..(1517): Also known as  Ceres CDNA ID no. 23783445
atatagccgcaggagagggcgggggatcggagcaggtgataggggggaaaatcgggaagccttcggagaaaagaaaagggcaaccgagaccgtgagagaggggaagcggggagccttgtccgatccggtgcagcccgcgcgtcaaactcccggataactgtggcatatgatcccaaatcttgatccacttgaagtgttcagtacattctgtagttggtttcaagatgacaagtaagaaaagtaacagatctacagtcacaccacacactgctctgcatatggaatgggacaggatttcttgccctatttgtatggagcaaccccacaatgctgttttacttatatgcagttcatacaagaatggctgcagatgttacatttgtaacacaagccatcgtcactctaattgccttgatcggttcagaaaaatgaatggtgatagtaagacgttcacggagcccaagactcggaagacatgttgataatgagggatcttatcataccgatgtaaacagtggcccaaatccagatgacatatctagatctgaatttgatttcgctaaccatcaagaatttgagaactcaaccttaactgttgaaggtggtattgtatcgggggaatgccatgatgccatgcaaagttctgctgaagttaagtgtcctctctgtagaggatctgtatctggctggattcctgctggagatgtgagacagtatctagacaataagttgagaacttgctctcatgaatcctgcaaatttactggaacctatgaacaactgcgtgaacatgctaggactgcacacgttcttacagagcctgctcatgtagatctgtccaggaaaagagcttgggatcgccttgagcgtgagcaggaggtcggtgatgtcattagtgcaatcaggtcccaggtacctggggcaataatagttggtgactatgttattgagactagagatgacatgtccccagacatagactctggcgacgatgaaagtagtgaatggtggtcagaccaagttgaatcaccagatgctagacttgatcccccaagggtttggccacatgaagcccctagggtcacctagcatttggtcagatgaaaggcgtaatttggcaaggataccacagaacaacagagtaccacccaggttttcattaggcagtaggcgacccctgcattcaggttggcaggggggtcgtcggtcaagcacacggaatcgactgcaacggggcttctcaaatcaccactctggacaccgtagcaactatcgtggacatcgtcacttgcttctggataggtcctatgttggtacccgagattcaggctccggcaggagcctaaattcgtcagtggtgccaagcaggcggcagcggctgcggtacacgcacagaagccactactgatggaagcaatatcagttctacgtgtagagctttattggttaatccattcatgctatctttgtaaatatatgttaaggttatgtttttatttaatgtatttaatctgtcc

SEQ ID NO: 616 - protein, 1517 aa, Zea mays
  misc_feature: GI Number: 34912600; NR Description: P0046B10.17 [Oryza sativa (japonica cultivar-group)] >gi|11034559|dbj|BAB17083.1| P0410E01.4 [Oryza sativa (japonica cultivar-group)] >gi|21104687|dbj|BAB93277.1| P0046B10.17 [Oryza sativa (japonica
  misc_feature: GI Number: 5103842; NR Description: F9L1.39 [Arabidopsis thaliana]
ATATAGCCGCAGGAGAGGGCGGGGGATCGGAGCAGGTGATAGGGGGGAAAATCGGGAAGCCTTCGGAGAAAAGAAAAGGGCAACCGAGACCGTGAGAGAGGGGAAGCGGGGAGCCTTGTCCGATCCGGTGCAGCCCGCGCGTCAAACTCCCGGATAACTGTGGCATATGATCCCAAATCTTGATCCACTTGAAGTGTTCAGTACATTCTGTAGTTGGTTTCAAGATGACAAGTAAGAAAAGTAACAGATCTACAGTCACACCACACACTGCTCTGCATATGGAATGGGACAGGATTTCTTGCCCTATTTGTATGGAGCAACCCCACAATGCTGTTTTACTTATATGCAGTTCATACAAGAATGGCTGCAGATGTTACATTTGTAACACAAGCCATCGTCACTCTAATTGCCTTGATCGGTTCAGAAAAATGAATGGTGATAGTAAGACGTTCACGGAGCCCAAGACTCGGAAGACATGTTGATAATGAGGGATCTTATCATACCGATGTAAACAGTGGCCCAAATCCAGATGACATATCTAGATCTGAATTTGATTTCGCTAACCATCAAGAATTTGAGAACTCAACCTTAACTGTTGAAGGTGGTATTGTATCGGGGGAATGCCATGATGCCATGCAAAGTTCTGCTGAAGTTAAGTGTCCTCTCTGTAGAGGATCTGTATCTGGCTGGATTCCTGCTGGAGATGTGAGACAGTATCTAGACAATAAGTTGAGAACTTGCTCTCATGAATCCTGCAAATTTACTGGAACCTATGAACAACTGCGTGAACATGCTAGGACTGCACACGTTCTTACAGAGCCTGCTCATGTAGATCTGTCCAGGAAAAGAGCTTGGGATCGCCTTGAGCGTGAGCAGGAGGTCGGTGATGTCATTAGTGCAATCAGGTCCCAGGTACCTGGGGCAATAATAGTTGGTGACTATGTTATTGAGACTAGAGATGACATGTCCCCAGACATAGACTCTGGCGACGATGAAAGTAGTGAATGGTGGTCAGACCAAGTTGAATCACCAGATGCTAGACTTGATCCCCCAAGGGTTTGGCCACATGAAGCCCCTAGGGTCACCTAGCATTTGGTCAGATGAAAGGCGTAATTTGGCAAGGATACCACAGAACAACAGAGTACCACCCAGGTTTTCATTAGGCAGTAGGCGACCCCTGCATTCAGGTTGGCAGGGGGGTCGTCGGTCAAGCACACGGAATCGACTGCAACGGGGCTTCTCAAATCACCACTCTGGACACCGTAGCAACTATCGTGGACATCGTCACTTGCTTCTGGATAGGTCCTATGTTGGTACCCGAGATTCAGGCTCCGGCAGGAGCCTAAATTCGTCAGTGGTGCCAAGCAGGCGGCAGCGGCTGCGGTACACGCACAGAAGCCACTACTGATGGAAGCAATATCAGTTCTACGTGTAGAGCTTTATTGGTTAATCCATTCATGCTATCTTTGTAAATATATGTTAAGGTTATGTTTTTATTTAATGTATTTAATCTGTCC

SEQ ID NO: 617 - DNA, 1597 bp, Zea mays
  misc_feature (1)..(1597): Ceres cDNA ID no. 12352156
  misc_feature (1)..(1597): Ceres CLONE  ID no. 260361
  misc_feature (1)..(1597): Also known as  Ceres CDNA ID no. 23783680
tcacactctgcccagctaagctaagctccctccgtccatcggcatggcgactaccactactaccatcctcctcctcctcctcgtcgcagccacagccgtctcggcggccgacctctccgtgtaccacaacgtgcacccgccgtccccgtccccgctcgagtccatcatcgcgctcgcccgcgccgacgacgcgcggctcctcttcctctcatccaaggcggcctcgtccggcggcgtcacctccgctcccgtcgcctccggccagactccgccctcgtacgtcgtccgcgcggggctcggcaccccggtccagcagctgctcctcgcgctcgacaccagcgccgacgccacctggtcgcactgcgcgccgtgcgacacgtgccccgccggcagccgcttcatcccggccagctcctcctcgtacgcctccctcccgtgcgcctccgactggtgcccgctcttcgagggccagccgtgcccggcgaatcaggacgcctcggcgccgctgccggcgtgcgccttctccaagccgttcgcggacacctcgttccaggcgtcgctgggcagcgacacgctgcgcctgggcaaggacgccatcgccggctacgcgttcgggtgcgtgggcgcggtggccgggccgacgaccaacctgccgaagcaggggctcctcggcctcggccggggccccatgtctctgctatcccagaccgggagcacgtacaacggcgtcttctcctactgcctgcccagctacaggtcctactacttctccggctccctccggctgggagccgccgggcagcccaggaacgtccggtacacgccgctgctgaccaacccgcaccgcccgtcgctctactacgtgaacgtgacggggctcagcgtgggtcggacctgggtgaaggtccccgcggggtcgttcgcgttcgacccggccaccggcgccggcacggtgatcgactcgggcacggtgatcacgcggtggacagcacccgtgtacgcggcgctgcgcgaggagttccggcggcaggtggcggcgccgagcgggtacacgtcgctgggagcgttcgacacgtgcttcaacacggacgaggtggcggcgggcggcgcgccgcccgtgacgctgcacatggacggcggcgtggacctgacgctgccgatggagaacacgctgatccacagcagcgccacgccgctggcgtgcctggccatggccgaggcgccgcagaacgtgaacgccgtcgtgaacgtggtggccaaccttcagcagcagaacgtgcgggtcgtcgtcgacgtcgccggctcgcgcgtcgggttcgcgagggagccctgcaactgagcccctgaatccgtccgtgccctatgcacgggaggaaggaggagacgcgctgcggctgctgcatcggtcggtgtgcagttagttgtcctgttagtctatgctacgttgtctgcactctgcaataacggacgtgacccggggaaaaaaactgtttcgtcacgggtagctagagaatcacgtaaggctcttgttttcgtttgtgtcctataatgtatggctattggcctgtttcgagaggttaaaatttggaggtgctgc

SEQ ID NO: 618 - protein, 1597 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: Pkinase; PFam Description: Protein kinase domain
  misc_feature: GI Number: 49532749; NR Description: Radc1 [Oryza sativa
  misc_feature: GI Number: 50939761; NR Description: nucleoid DNA-binding-like protein [Oryza sativa (japonica cultivar-group)] >gi|22775625|dbj|BAC15479.1| nucleoid DNA-binding-like protein [Oryza sativa (japonica cultivar-group)]
  misc_feature: GI Number: 50904527; NR Description: putative nucleoid DNA-binding-like protein [Oryza sativa (japonica cultivar-group)] >gi|20161865|dbj|BAB90778.1| putative nucleoid DNA-binding-like
  misc_feature: GI Number: 21553652; NR Description: nucleoid DNA-binding-like protein [Arabidopsis thaliana] >gi|9759559|dbj|BAB11161.1| nucleoid DNA-binding-like protein [Arabidopsis thaliana] >gi|15240680|ref|NP_196320.1| aspartyl
  misc_feature: GI Number: 21617933; NR Description: nucleoid
TCACACTCTGCCCAGCTAAGCTAAGCTCCCTCCGTCCATCGGCATGGCGACTACCACTACTACCATCCTCCTCCTCCTCCTCGTCGCAGCCACAGCCGTCTCGGCGGCCGACCTCTCCGTGTACCACAACGTGCACCCGCCGTCCCCGTCCCCGCTCGAGTCCATCATCGCGCTCGCCCGCGCCGACGACGCGCGGCTCCTCTTCCTCTCATCCAAGGCGGCCTCGTCCGGCGGCGTCACCTCCGCTCCCGTCGCCTCCGGCCAGACTCCGCCCTCGTACGTCGTCCGCGCGGGGCTCGGCACCCCGGTCCAGCAGCTGCTCCTCGCGCTCGACACCAGCGCCGACGCCACCTGGTCGCACTGCGCGCCGTGCGACACGTGCCCCGCCGGCAGCCGCTTCATCCCGGCCAGCTCCTCCTCGTACGCCTCCCTCCCGTGCGCCTCCGACTGGTGCCCGCTCTTCGAGGGCCAGCCGTGCCCGGCGAATCAGGACGCCTCGGCGCCGCTGCCGGCGTGCGCCTTCTCCAAGCCGTTCGCGGACACCTCGTTCCAGGCGTCGCTGGGCAGCGACACGCTGCGCCTGGGCAAGGACGCCATCGCCGGCTACGCGTTCGGGTGCGTGGGCGCGGTGGCCGGGCCGACGACCAACCTGCCGAAGCAGGGGCTCCTCGGCCTCGGCCGGGGCCCCATGTCTCTGCTATCCCAGACCGGGAGCACGTACAACGGCGTCTTCTCCTACTGCCTGCCCAGCTACAGGTCCTACTACTTCTCCGGCTCCCTCCGGCTGGGAGCCGCCGGGCAGCCCAGGAACGTCCGGTACACGCCGCTGCTGACCAACCCGCACCGCCCGTCGCTCTACTACGTGAACGTGACGGGGCTCAGCGTGGGTCGGACCTGGGTGAAGGTCCCCGCGGGGTCGTTCGCGTTCGACCCGGCCACCGGCGCCGGCACGGTGATCGACTCGGGCACGGTGATCACGCGGTGGACAGCACCCGTGTACGCGGCGCTGCGCGAGGAGTTCCGGCGGCAGGTGGCGGCGCCGAGCGGGTACACGTCGCTGGGAGCGTTCGACACGTGCTTCAACACGGACGAGGTGGCGGCGGGCGGCGCGCCGCCCGTGACGCTGCACATGGACGGCGGCGTGGACCTGACGCTGCCGATGGAGAACACGCTGATCCACAGCAGCGCCACGCCGCTGGCGTGCCTGGCCATGGCCGAGGCGCCGCAGAACGTGAACGCCGTCGTGAACGTGGTGGCCAACCTTCAGCAGCAGAACGTGCGGGTCGTCGTCGACGTCGCCGGCTCGCGCGTCGGGTTCGCGAGGGAGCCCTGCAACTGAGCCCCTGAATCCGTCCGTGCCCTATGCACGGGAGGAAGGAGGAGACGCGCTGCGGCTGCTGCATCGGTCGGTGTGCAGTTAGTTGTCCTGTTAGTCTATGCTACGTTGTCTGCACTCTGCAATAACGGACGTGACCCGGGGAAAAAAACTGTTTCGTCACGGGTAGCTAGAGAATCACGTAAGGCTCTTGTTTTCGTTTGTGTCCTATAATGTATGGCTATTGGCCTGTTTCGAGAGGTTAAAATTTGGAGGTGCTGC

SEQ ID NO: 619 - DNA, 1620 bp, Zea mays
  misc_feature (1)..(1620): Ceres cDNA ID no. 12352160
  misc_feature (1)..(1620): Ceres CLONE  ID no. 260601
  misc_feature (1)..(1620): Also known as  Ceres CDNA ID no. 23783698
gacatgcccgatcccgacgccctggcggccgcggtcgccgtcgccgggtgcgagggggtcgcctctcctgtgtcctgtgcccgtagataaggtcctcaatcctgaggaaagttccggtccaatctcttccaattgacaccgtgttggtgttgttctgacttctgttgaataggatgaacctgcatttacggaaaaaattctccctttgatgacccaacccctgtgaaaacaaaacaaccctcagaagatgtccaaactccaaacacacgaaaaggggagcgtgcgacgactttccgccgacctgcagagctgaatgtgcatttttggtcgtttgcatccttcgccgccggctctttctgcgtgttcttcttcttgtcgatttccgtcttgtgtatatactatatactatgctgctgtgctgggttacaagacaagcaagtggcaactggcaatatacggacaagccgtggcgggtatatacggacgaagaggaggaccggaggaggaagcttcagtgaggccctggactgcagcgggatggcgtcgccgccgccaccacgcgtgtgcgtaaccggtggcggcgggtacgtcgcctcatggctcgtcaagctcctgctctcccgcggctacgccgtgcacgccactgtccgcgacccaagtgatcccaagaacgcccacctgcaacagctggacggggcccgggagaggttgcgcctgttcaaggccgacgtgctcgaccgcgacgccctggcgaccgcggtcgtcgcgtgcgagggcgtcttccacgtcgcctcccctgtgcccgcggacaaagtcctcgatcccgagtccgaggtgctgtctcctgctgtcaagggcactctgaacgtcctccaggcctgctcggcaaacaacgttcagaaagttgtcgtggtttcgtccacggctgctgtttactttaacccgagctggccccaaggtagaaccaaagacgagagttgctggtcagacagagatttatgcattaagaacgagaactggtactgtgctgccaagacgattgctgaagaaactgcagtggagtatggagagaagaacgggctggttgttgtcacggtctgcccttgtatcgttttaggcccactcctgcagccgctgatcaatgccagcagcgaattactcatctacattataaaaggaggtcctagggtgctgaaaaacctcccctggaacatagtcgacgtccgtgacgtagctgatgctttgctcctagtatacgagaaagtggaatcatccgggagatacatctgtgcgcctaatcggatcagcacaaacaacatggtgaacttgtttaaaaagtcctaccctaactacaattatgtgaactgcgacaacaaggactatgaatctgaaatctcaccagttacatcggagaaacttaagagtctaggctggaacccaaggacaatggagaaaactttgttggacaacattgagtatttcgagaaggcagggtttttgcgtgatgcagagggttatccttgtcgtctactacctcatatttttcatttcgcttctgactaatgaaatagattctgtaaaacaattacgacaactactataactgtctttggacaattc

SEQ ID NO: 620 - protein, 1620 aa, Zea mays
  misc_feature: PFam Name: Epimerase; PFam Description: NAD dependent
  misc_feature: PFam Name: 3Beta_HSD; PFam Description: 3-beta
  misc_feature: PFam Name: Polysacc_synt_2; PFam Description: Polysaccharide
  misc_feature: PFam Name: adh_short; PFam Description: short chain dehydrogenase
  misc_feature: GI Number: 23197694; NR Description: putative cinnamoyl-CoA reductase [Arabidopsis thaliana] >gi|21536817|gb|AAM61149.1| putative cinnamoyl-CoA reductase [Arabidopsis thaliana] >gi|21539439|gb|AAM53272.1| putative cinnamoyl-CoA reductase
  misc_feature: GI Number: 51091030; NR Description: putative cinnamoyl-CoA
  misc_feature: GI Number: 51091033; NR Description: putative cinnamoyl-CoA
  misc_feature: GI Number: 12323980; NR Description: putative cinnamoyl-CoA reductase; 27707-26257 [Arabidopsis thaliana] >gi|15223068|ref|NP_177773.1| cinnamoyl-CoA reductase family
  misc_feature: GI Number: 6554472; NR Description: putative cinnamoyl-CoA
GACATGCCCGATCCCGACGCCCTGGCGGCCGCGGTCGCCGTCGCCGGGTGCGAGGGGGTCGCCTCTCCTGTGTCCTGTGCCCGTAGATAAGGTCCTCAATCCTGAGGAAAGTTCCGGTCCAATCTCTTCCAATTGACACCGTGTTGGTGTTGTTCTGACTTCTGTTGAATAGGATGAACCTGCATTTACGGAAAAAATTCTCCCTTTGATGACCCAACCCCTGTGAAAACAAAACAACCCTCAGAAGATGTCCAAACTCCAAACACACGAAAAGGGGAGCGTGCGACGACTTTCCGCCGACCTGCAGAGCTGAATGTGCATTTTTGGTCGTTTGCATCCTTCGCCGCCGGCTCTTTCTGCGTGTTCTTCTTCTTGTCGATTTCCGTCTTGTGTATATACTATATACTATGCTGCTGTGCTGGGTTACAAGACAAGCAAGTGGCAACTGGCAATATACGGACAAGCCGTGGCGGGTATATACGGACGAAGAGGAGGACCGGAGGAGGAAGCTTCAGTGAGGCCCTGGACTGCAGCGGGATGGCGTCGCCGCCGCCACCACGCGTGTGCGTAACCGGTGGCGGCGGGTACGTCGCCTCATGGCTCGTCAAGCTCCTGCTCTCCCGCGGCTACGCCGTGCACGCCACTGTCCGCGACCCAAGTGATCCCAAGAACGCCCACCTGCAACAGCTGGACGGGGCCCGGGAGAGGTTGCGCCTGTTCAAGGCCGACGTGCTCGACCGCGACGCCCTGGCGACCGCGGTCGTCGCGTGCGAGGGCGTCTTCCACGTCGCCTCCCCTGTGCCCGCGGACAAAGTCCTCGATCCCGAGTCCGAGGTGCTGTCTCCTGCTGTCAAGGGCACTCTGAACGTCCTCCAGGCCTGCTCGGCAAACAACGTTCAGAAAGTTGTCGTGGTTTCGTCCACGGCTGCTGTTTACTTTAACCCGAGCTGGCCCCAAGGTAGAACCAAAGACGAGAGTTGCTGGTCAGACAGAGATTTATGCATTAAGAACGAGAACTGGTACTGTGCTGCCAAGACGATTGCTGAAGAAACTGCAGTGGAGTATGGAGAGAAGAACGGGCTGGTTGTTGTCACGGTCTGCCCTTGTATCGTTTTAGGCCCACTCCTGCAGCCGCTGATCAATGCCAGCAGCGAATTACTCATCTACATTATAAAAGGAGGTCCTAGGGTGCTGAAAAACCTCCCCTGGAACATAGTCGACGTCCGTGACGTAGCTGATGCTTTGCTCCTAGTATACGAGAAAGTGGAATCATCCGGGAGATACATCTGTGCGCCTAATCGGATCAGCACAAACAACATGGTGAACTTGTTTAAAAAGTCCTACCCTAACTACAATTATGTGAACTGCGACAACAAGGACTATGAATCTGAAATCTCACCAGTTACATCGGAGAAACTTAAGAGTCTAGGCTGGAACCCAAGGACAATGGAGAAAACTTTGTTGGACAACATTGAGTATTTCGAGAAGGCAGGGTTTTTGCGTGATGCAGAGGGTTATCCTTGTCGTCTACTACCTCATATTTTTCATTTCGCTTCTGACTAATGAAATAGATTCTGTAAAACAATTACGACAACTACTATAACTGTCTTTGGACAATTC

SEQ ID NO: 621 - DNA, 1375 bp, Zea mays
  misc_feature (1)..(1375): Ceres cDNA ID no. 12352226
  misc_feature (1)..(1375): Ceres CLONE  ID no. 272185
  misc_feature (1)..(1375): Also known as  Ceres CDNA ID no. 23757891
gatctggccacccgagcacggccaaaaaggcgctcgcccagcgcttcaccagatagagcaacacagctcagctcagctcagcctcggaccagcagccggcgtgcggagctgcggtgcggcgtcgtgcgtgcgccagaacaggatgctgcccgccgggtgcggcctcctctcgtgcctccgcctcgacaagcagggcgacgcgggccgaaccgacccccgcgtcgcggacgagcccgccgcgtcgctcggcaagggcagcgggtcgtcggccaggcggttcgcgtgggccgagatcgagtccgtcacggcgggcttctcctcccgcgtcatcggccagggcggcttcagcaccgtctacctggcctgcctctcctcctcccgcctcggcgccgtcaaggtgcagcgcagcagcgagcgcctccaccgcgccttccgccaggagctccacgtgctcctctcgctccgccacccgcacatcgtccgcctgctcggctactgcgacgaacgagaggaaggcgtgttggtctttgagtacgcaccgaacggcgacctccacgagaggctccacggcagcggcaaggcgccgctcccgtgggcgcgccgcatggcggtggcgttccaggtggccatggcgctggagcacctccacgagagccgcgacccggcggtgatccacggcgacgtgaaggcctccaacgtgctgctggacgccagcctcgacgccaagctctgcgacctgggcttcgcgcacgtgggcttctcggccgcgctccagccgccggaggccagcggggccagggccagggcgtcgtcggcgccgcgcgccgtcgtcatgggctccccgggctacgtggacccgcacttcctccgctccggcgtcgccacccaagaagggcgacgtgtacagcttcggcgtgctgctgctcgagctcctcacggggagggaggccatatgcgccgacacggggcgccggctcgccgccgcggtgggtcctacgctcggcgaaggaagagtagcggaggcagtggaccggaggctcggagacgagtacgacacgcacgaggcggccaccgtggcggcgcttgcgctgcggtgcatcggcgacggccccgggacgcggccctccatggtggaggtggttcgcgagctccaggagaagacgaccgcgctgatctcggccgctggatgcaaacctgccggcaagatgggttcctgagctgtattgtcggccgaagaagaccgtaaataccattagctttgtttagagagagtagaaggtgaaggtaatgtttttttatttattttacttatataagtttcttgatgtagtggattagtagtagttgaatcggattacatagaaaaatttccgtg

SEQ ID NO: 622 - protein, 1375 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 50911268; NR Description: putative serine/threonine-specific protein kinase [Oryza sativa (japonica cultivar-group)] >gi|49388396|dbj|BAD25532.1| putative serine/threonine-specific protein kinase [Oryza sativa (japonica
  misc_feature: GI Number: 37536060; NR Description: putative receptor protein kinase [Oryza sativa (japonica cultivar-group)] >gi|13786470|gb|AAK39595.1| putative receptor protein kinase [Oryza
  misc_feature: GI Number: 29367339; NR Description: putative receptor
  misc_feature: GI Number: 42571731; NR Description: protein kinase family
  misc_feature: GI Number: 42562481; NR Description: protein kinase family
GATCTGGCCACCCGAGCACGGCCAAAAAGGCGCTCGCCCAGCGCTTCACCAGATAGAGCAACACAGCTCAGCTCAGCTCAGCCTCGGACCAGCAGCCGGCGTGCGGAGCTGCGGTGCGGCGTCGTGCGTGCGCCAGAACAGGATGCTGCCCGCCGGGTGCGGCCTCCTCTCGTGCCTCCGCCTCGACAAGCAGGGCGACGCGGGCCGAACCGACCCCCGCGTCGCGGACGAGCCCGCCGCGTCGCTCGGCAAGGGCAGCGGGTCGTCGGCCAGGCGGTTCGCGTGGGCCGAGATCGAGTCCGTCACGGCGGGCTTCTCCTCCCGCGTCATCGGCCAGGGCGGCTTCAGCACCGTCTACCTGGCCTGCCTCTCCTCCTCCCGCCTCGGCGCCGTCAAGGTGCAGCGCAGCAGCGAGCGCCTCCACCGCGCCTTCCGCCAGGAGCTCCACGTGCTCCTCTCGCTCCGCCACCCGCACATCGTCCGCCTGCTCGGCTACTGCGACGAACGAGAGGAAGGCGTGTTGGTCTTTGAGTACGCACCGAACGGCGACCTCCACGAGAGGCTCCACGGCAGCGGCAAGGCGCCGCTCCCGTGGGCGCGCCGCATGGCGGTGGCGTTCCAGGTGGCCATGGCGCTGGAGCACCTCCACGAGAGCCGCGACCCGGCGGTGATCCACGGCGACGTGAAGGCCTCCAACGTGCTGCTGGACGCCAGCCTCGACGCCAAGCTCTGCGACCTGGGCTTCGCGCACGTGGGCTTCTCGGCCGCGCTCCAGCCGCCGGAGGCCAGCGGGGCCAGGGCCAGGGCGTCGTCGGCGCCGCGCGCCGTCGTCATGGGCTCCCCGGGCTACGTGGACCCGCACTTCCTCCGCTCCGGCGTCGCCACCCAAGAAGGGCGACGTGTACAGCTTCGGCGTGCTGCTGCTCGAGCTCCTCACGGGGAGGGAGGCCATATGCGCCGACACGGGGCGCCGGCTCGCCGCCGCGGTGGGTCCTACGCTCGGCGAAGGAAGAGTAGCGGAGGCAGTGGACCGGAGGCTCGGAGACGAGTACGACACGCACGAGGCGGCCACCGTGGCGGCGCTTGCGCTGCGGTGCATCGGCGACGGCCCCGGGACGCGGCCCTCCATGGTGGAGGTGGTTCGCGAGCTCCAGGAGAAGACGACCGCGCTGATCTCGGCCGCTGGATGCAAACCTGCCGGCAAGATGGGTTCCTGAGCTGTATTGTCGGCCGAAGAAGACCGTAAATACCATTAGCTTTGTTTAGAGAGAGTAGAAGGTGAAGGTAATGTTTTTTTATTTATTTTACTTATATAAGTTTCTTGATGTAGTGGATTAGTAGTAGTTGAATCGGATTACATAGAAAAATTTCCGTG

SEQ ID NO: 623 - DNA, 1049 bp, Zea mays
  misc_feature (1)..(1049): Ceres cDNA ID no. 12352246
  misc_feature (1)..(1049): Ceres CLONE  ID no. 275400
  misc_feature (1)..(1049): Also known as  Ceres CDNA ID no. 23778860
ctcgttcagttgttcctcaacctacctacgccgctccgcgctcgaccgcctttgcctgccttcccattccccccgtctcctcttcccttccgccatggcccagcccgctttcctctcctctctccgctcccgcctcggctccgcgccgccgcccccgccgaaccatcgcctccagcccaggcgcggctaccacgtcgagcttggggctcgcgaaaaagcgctgatccgggtgcggacggggctggaggggcggttccaggagcccgggctcaagggcccgctgtgggaggaggtgagcgcgcgcatggcggcggcgggctacggccgcagcgccaagcgctgcaaggagaagtgggagaacatcaacaagtacttccgcaaggccaaggagagcggcaagaagcggccggcgcacgccaagacgtgcccctacttcgacgagctggaccgcctctactcccgcttgggccaggcaaagcaggcgagctcggagctgctggacgcggtggtcaagtaccccgacgtgagctacggtccgccggggttcgggatggacagggagcaggcctccggcggcgggggcaataataataacactaataatgaaggtggacaggacggcggcgctgaggatttcgacggagaggaggacggcattggcaaggggagggccggcgatggtcaggacgacgaggtggaaagccatggccacgaggatgagtagctagctgcattgcatgcatggcgccatggatgcgacaaccacaggacatacgatgcgagctgggcgccatctgtttaatttgttcgttcgttcgttctttctttcttcttgctactaaatcagtactactagcttttatcactaccttttgttattagctaccacctgcatgcatctgctgctgcttctagctagctgttattatgtatactactatatatgatatgatgatactactgttaatcactggtccaaggaatcattaaataatttgtacgatcaccattgcatatttatatagctcctggagcagtgttttaatttt

SEQ ID NO: 624 - protein, 1049 aa, Zea mays
  misc_feature: PFam Name: Myb_DNA-binding; PFam Description: Myb-like
  misc_feature: GI Number: 50904639; NR Description: putative GT-2 factor [Oryza sativa (japonica cultivar-group)] >gi|40363766|dbj|BAD06276.1| putative GT-2 factor [Oryza sativa (japonica cultivar-group)] >gi|41052544|dbj|BAD07536.1| putative
  misc_feature: GI Number: 18182309; NR Description: GT-2 factor [Glycine max]
  misc_feature: GI Number: 30699205; NR Description: trihelix DNA-binding
  misc_feature: GI Number: 37536070; NR Description: putative transcription factor [Oryza sativa (japonica cultivar-group)] >gi|13786451|gb|AAK39576.1| putative transcription factor [Oryza sativa] >gi|31433064|gb|AAP54624.1| putative transcription factor
  misc_feature: GI Number: 21592726; NR Description: trihelix DNA-binding
CTCGTTCAGTTGTTCCTCAACCTACCTACGCCGCTCCGCGCTCGACCGCCTTTGCCTGCCTTCCCATTCCCCCCGTCTCCTCTTCCCTTCCGCCATGGCCCAGCCCGCTTTCCTCTCCTCTCTCCGCTCCCGCCTCGGCTCCGCGCCGCCGCCCCCGCCGAACCATCGCCTCCAGCCCAGGCGCGGCTACCACGTCGAGCTTGGGGCTCGCGAAAAAGCGCTGATCCGGGTGCGGACGGGGCTGGAGGGGCGGTTCCAGGAGCCCGGGCTCAAGGGCCCGCTGTGGGAGGAGGTGAGCGCGCGCATGGCGGCGGCGGGCTACGGCCGCAGCGCCAAGCGCTGCAAGGAGAAGTGGGAGAACATCAACAAGTACTTCCGCAAGGCCAAGGAGAGCGGCAAGAAGCGGCCGGCGCACGCCAAGACGTGCCCCTACTTCGACGAGCTGGACCGCCTCTACTCCCGCTTGGGCCAGGCAAAGCAGGCGAGCTCGGAGCTGCTGGACGCGGTGGTCAAGTACCCCGACGTGAGCTACGGTCCGCCGGGGTTCGGGATGGACAGGGAGCAGGCCTCCGGCGGCGGGGGCAATAATAATAACACTAATAATGAAGGTGGACAGGACGGCGGCGCTGAGGATTTCGACGGAGAGGAGGACGGCATTGGCAAGGGGAGGGCCGGCGATGGTCAGGACGACGAGGTGGAAAGCCATGGCCACGAGGATGAGTAGCTAGCTGCATTGCATGCATGGCGCCATGGATGCGACAACCACAGGACATACGATGCGAGCTGGGCGCCATCTGTTTAATTTGTTCGTTCGTTCGTTCTTTCTTTCTTCTTGCTACTAAATCAGTACTACTAGCTTTTATCACTACCTTTTGTTATTAGCTACCACCTGCATGCATCTGCTGCTGCTTCTAGCTAGCTGTTATTATGTATACTACTATATATGATATGATGATACTACTGTTAATCACTGGTCCAAGGAATCATTAAATAATTTGTACGATCACCATTGCATATTTATATAGCTCCTGGAGCAGTGTTTTAATTTT

SEQ ID NO: 625 - DNA, 1653 bp, Zea mays
  misc_feature (1)..(1653): Ceres cDNA ID no. 12352312
  misc_feature (1)..(1653): Ceres CLONE  ID no. 280800
  misc_feature (1)..(1653): Also known as  Ceres CDNA ID no. 23850714
aaggtaaggaaggagaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatccttttcgaggagacgctgtaccagtccgccgtcgacggccgcaagatcgtggacatcctggtggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccggggataccgccgcccctccgagagatacgtgtgtactgatcatggttaagcacgtactccgatccattcccatcccatgaagccattataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctatatatgc

SEQ ID NO: 626 - protein, 1653 aa, Zea mays
  misc_feature: PFam Name: Glycolytic; PFam Description:
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: GI Number: 16226653; NR Description: AT4g38970/F19H22_70
  misc_feature: GI Number: 53828647; NR Description: At4g38970 [Arabidopsis thaliana] >gi|18420348|ref|NP_568049.1| fructose-bisphosphate
  misc_feature: GI Number: 8272480; NR Description: fructose 1,6-bisphosphate
  misc_feature: GI Number: 1781348; NR Description: homologous to plastidic aldolases [Solanum tuberosum] >gi|7436610|pir||T07418 probable fructose-bisphosphate aldolase (EC 4.1.2.13) precursor, chloroplast
  misc_feature: GI Number: 21311559; NR Description: latex plastidic
AAGGTAAGGAAGGAGAAGAAGACGAGTGTCAAGTGAACCTGAAACTTGCGGTGTCACTGGCTGGTATAGCCTGAGTGTGAGTGAGTGATCGAGCTAGCTGAGCTCCGATCCTCGCTAGCTAGCTAGGATACCGCCATACCACAAGTCTTCTTCACAAGTTTAGGAGTGACAGCAACAAGAGATCTCGATGGCCTCTGCCACCGTGCTCAAGTCCTCCTTCCTTCCCAAGAAGTCCGAATGGGGCGCCACCAGGCAGGCCGCCGCGCCCAGGCCGCCCACCGTCTCCATGGTCGTCCGCGCCTCCGCCTACGCCGATGAGCTCGTGAAGACCGCGAAAACGATCGCGTCGCCGGGGCGGGGCATCCTGGCGATGGACGAGTCGAACGCGACGTGCGGGAAGCGGCTGGCGTCCATCGGGCTGGAGAACACGGAGGCCAACCGGCAGGCGTACCGCACGCTGCTGGTCACGGCGCCGGGCCTGGGCCAGTACATCTCCGGCGCCATCCTTTTCGAGGAGACGCTGTACCAGTCCGCCGTCGACGGCCGCAAGATCGTGGACATCCTGGTGGAGCAGGGCATCGTGCCGGGGATCAAGGTGGACAAGGGCCTTGTCCCGCTCGCCGGCTCCAACAACGAGTCGTGGTGCCAGGGCCTGGACGGCCTGGCGTCCCGCGAGGCCGCCTACTACCAGCAGGGCGCGCGGTTCGCCAAGTGGCGCACCGTCGTCAGCATCCCTAACGGCCCCTCCGAGCTCGCCGTCAAGGAGGCCGCGTGGGGGCTCGCACGCTACGCCGCCATCTCACAGGACAACGGGCTTGTGCCGATCGTGGAGCCGGAGATCCTGCTGGACGGCGAGCACGGCATCGAGCGCACGTTCGAGGTGGCGCAGAAGGTGTGGGCCGAAACCTTCTACGCCATGGCGGAGAACAACGTCATGTTCGAGGGCATCCTGCTGAAGCCGTCCATGGTGACGCCCGGCGCGGAGGCCAAGGACAGGGCCACCCCGGAGCAGGTGGCCGCGTACACCCTCAAGCTCCTCCACCGCCGGATCCCCCCCTCCGTGCCCGGGATCATGTTCCTCTCCGGCGGGCAGTCGGAGGTGGAGGCGACGCAGAACCTCAACGCCATGAACCAGGGGCCCAACCCGTGGCACGTGTCCTTCTCCTACGCGCGGGCGCTGCAGAACACCTGCCTCAAGACCTGGGGCGGCCAGCCGGACAAGGTCAAGGCGGCGCAGGACGCGCTGCTGCTGCGCGCCAAGGCCAACTCCCTGGCGCAGCTCGGCAAGTACACCTCCGACGGCGAGGCCGCCGAGGCCAAGGAGGGAATGTTCGTCAAGAACTACAGCTACTAATTAATCGCCCGGCCATCACCCGGGGATACCGCCGCCCCTCCGAGAGATACGTGTGTACTGATCATGGTTAAGCACGTACTCCGATCCATTCCCATCCCATGAAGCCATTATAATGATGATATGATCCATGGACCATGCATGGTGCTCTGGTCGATGCCGTACGTGTGTCCCTGATACAATACTATTTTAGTACTGATGCTAGTCATCATATATATCGATCGAGCTCGCCACTGCGAAGTCTGAGATAATGCATGTATGCTTGACGGCGAGATCTGAGGAAAAATAATTTCTATATATGC

SEQ ID NO: 627 - DNA, 1676 bp, Zea mays
  misc_feature (1)..(1676): Ceres cDNA ID no. 12352494
  misc_feature (1)..(1676): Ceres CLONE  ID no. 295530
  misc_feature (1)..(1676): Also known as  Ceres CDNA ID no. 23760621
aactcactgcatatctgacatctcagttgctgaacgcctgaaccgcaagtcatccatgacctcttctattccgaagctgcttctcctcctcttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgccgacgttggaggagacgctccaccgcgatcagctccgagctgcctacatccagcggaagttctcaggcggcggtggcgctggtggtgacgtccagcgatcggacgccaccgtgccgacggccctgggcacctccctgaacacgctggagtacctgatcaccgtaggcctgggctcgccggccacgtcccagaccatgctcatccgacaccggcagcgacgtgtcgtgggtgcagtgcaagccgtgctcgcagtgccactcccaggcggacccactcttcgaccccagctcgtcgagcacgtactccccgttctcctgcggctccgccgcctgcgcgcagctcggccaggaaggcaacggctgctcctccagctcccagtgccagtacattgtcacgtacggcgacggctccagcaccacggggacctacagctccgacacgctcgcgctgggctccagcgccgtcaagagcttccagttcgggtgcagcaacgtggagtcgggcttcaacgaccagaccgacgggctcatggggctcggcggcggcgcgcagtcgctggtgtcacagacggcggggacgctcggcagggccttctcgtactgcctcccgccgacgccgagctcctccgggttcctcacgctcggcgctgctggcggtagcggaacctcgggcttcgtcaagacgccgatgctcaggagcagccaggtccccacgttctacggcgtgcgcctccaggccatccgggtgggcgggaggcagctcagcatacccgcctcggtcttctccgctgggacggtcatggactcgggcacggtcatcacgcggctgccgccgaccgcctactcggcgctgtcgtcggcgttcaaggccgggatgaagcagtacccgccggcgcagccgagcggcatcctcgacacctgctttgacttcagcggccagtccagcgtcagcataccgtccgtcgcgctagtcttctccgggggcgccgttgtcagcctcgacgccagcggcatcatcctcagcaactgcctcgccttcgcggccaacagcgacgacagctccttgggcatcatcggcaacgtgcagcagcggacgttcgaggtgctgtacgacgttggccggggcgtcgtggggttcagggctggggcgtgctgatcgatcgtgatcggcgcaaggacattgacaataccggccgggagtacgtactgtgctcgtttgggttgcgagtgcaacgtaaatggaagaagtgcaaaacatatacatactacttcgattttaattatctttgcgatagcatgcaataacgtcatgcatgcaagtgtgcaaactactaaaagctaaaagataatcttaatgtcacctgattgatgactataaaagattaatgat

SEQ ID NO: 628 - protein, 1676 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: Cation_efflux; PFam Description: Cation efflux family
  misc_feature: GI Number: 34912520; NR Description: chloroplast nucleoid DNA-binding protein cnd41-like [Oryza sativa (japonica
  misc_feature: GI Number: 53792202; NR Description: nucleoid DNA-binding
  misc_feature: GI Number: 50912211; NR Description: putative 41 kD chloroplast nucleoid DNA binding protein (CND41) [Oryza sativa (japonica cultivar-group)] gi|51964318|ref|XP_506944.1| PREDICTED
  misc_feature: GI Number: 50912209; NR Description: putative chloroplast nucleoid DNA-binding protein cnd41 [Oryza sativa (japonica cultivar-group)] >gi|45735840|dbj|BAD12875.1| putative chloroplast nucleoid DNA-binding protein cnd41 [Oryza sativa
  misc_feature: GI Number: 50725881; NR Description: putative nucleoid DNA-binding protein cnd41 [Oryza sativa (japonica cultivar-group)] >gi|50725878|dbj|BAD33407.1| putative nucleoid DNA-binding protein
AACTCACTGCATATCTGACATCTCAGTTGCTGAACGCCTGAACCGCAAGTCATCCATGACCTCTTCTATTCCGAAGCTGCTTCTCCTCCTCTTCTTTCTCAGCCATCGCTCTCCCATTGCTCGCGCAGGCGATGATGGCAGCTACAAGGTTCTGTCCATGGGCTCTCCGAGAACTGACTCCGTCTGTTCCCAGTCCAAAGCGGTTCCTTCGTCGTCCGCCGGTGCCGCCACGGTGCCCTTGCATCACCGTCACGGCCCATGCTCGCCGTTGCCGACCAAGAAGATGCCGACGTTGGAGGAGACGCTCCACCGCGATCAGCTCCGAGCTGCCTACATCCAGCGGAAGTTCTCAGGCGGCGGTGGCGCTGGTGGTGACGTCCAGCGATCGGACGCCACCGTGCCGACGGCCCTGGGCACCTCCCTGAACACGCTGGAGTACCTGATCACCGTAGGCCTGGGCTCGCCGGCCACGTCCCAGACCATGCTCATCCGACACCGGCAGCGACGTGTCGTGGGTGCAGTGCAAGCCGTGCTCGCAGTGCCACTCCCAGGCGGACCCACTCTTCGACCCCAGCTCGTCGAGCACGTACTCCCCGTTCTCCTGCGGCTCCGCCGCCTGCGCGCAGCTCGGCCAGGAAGGCAACGGCTGCTCCTCCAGCTCCCAGTGCCAGTACATTGTCACGTACGGCGACGGCTCCAGCACCACGGGGACCTACAGCTCCGACACGCTCGCGCTGGGCTCCAGCGCCGTCAAGAGCTTCCAGTTCGGGTGCAGCAACGTGGAGTCGGGCTTCAACGACCAGACCGACGGGCTCATGGGGCTCGGCGGCGGCGCGCAGTCGCTGGTGTCACAGACGGCGGGGACGCTCGGCAGGGCCTTCTCGTACTGCCTCCCGCCGACGCCGAGCTCCTCCGGGTTCCTCACGCTCGGCGCTGCTGGCGGTAGCGGAACCTCGGGCTTCGTCAAGACGCCGATGCTCAGGAGCAGCCAGGTCCCCACGTTCTACGGCGTGCGCCTCCAGGCCATCCGGGTGGGCGGGAGGCAGCTCAGCATACCCGCCTCGGTCTTCTCCGCTGGGACGGTCATGGACTCGGGCACGGTCATCACGCGGCTGCCGCCGACCGCCTACTCGGCGCTGTCGTCGGCGTTCAAGGCCGGGATGAAGCAGTACCCGCCGGCGCAGCCGAGCGGCATCCTCGACACCTGCTTTGACTTCAGCGGCCAGTCCAGCGTCAGCATACCGTCCGTCGCGCTAGTCTTCTCCGGGGGCGCCGTTGTCAGCCTCGACGCCAGCGGCATCATCCTCAGCAACTGCCTCGCCTTCGCGGCCAACAGCGACGACAGCTCCTTGGGCATCATCGGCAACGTGCAGCAGCGGACGTTCGAGGTGCTGTACGACGTTGGCCGGGGCGTCGTGGGGTTCAGGGCTGGGGCGTGCTGATCGATCGTGATCGGCGCAAGGACATTGACAATACCGGCCGGGAGTACGTACTGTGCTCGTTTGGGTTGCGAGTGCAACGTAAATGGAAGAAGTGCAAAACATATACATACTACTTCGATTTTAATTATCTTTGCGATAGCATGCAATAACGTCATGCATGCAAGTGTGCAAACTACTAAAAGCTAAAAGATAATCTTAATGTCACCTGATTGATGACTATAAAAGATTAATGAT

SEQ ID NO: 629 - DNA, 1696 bp, Zea mays
  misc_feature (1)..(1696): Ceres cDNA ID no. 12352506
  misc_feature (1)..(1696): Ceres CLONE  ID no. 296671
  misc_feature (1)..(1696): Also known as  Ceres CDNA ID no. 23777060
atagagagagccactggccacaggtaggcaggcaggaggacgagtcggcaaggaagctgcctgctttcagaaagagtcatagagatagttattaagatggcgttgcttcggctgcttgccctctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgcgtcgctcgccgcgcgcctcgccaagacgccgtcctctcggcccaccttgcttgacgagagccgcgcggggtcgtcgtcgtcgtcccccgatgacgagtccctcgcgtccgtgccgctcggcccgggcacgtccgtcggcgtcggcaactacgtcacccgcatgggcctcggcacgccggccaagtcgtacgtcatggtcgtggacacggggtcctcgctcacctggctccagtgctccccctgcgtcgtgtcgtgccaccgccagtccggcccggtgttcaaccccaaggcgtccagctcctacgcctccgtgtcctgctccgcgcagcagtgcagcgacctcaccaccgccacgctcaaccccgcctcctgctccacctccaacgtctgcatctaccaggccagctacggcgacagctccttctcggtcgggtatctgagcaaggacaccgtgtcgttcggctccaccagcgtgcccaacttctactacggctgcggacaagacaacgagggcctcttcgggcagtcggcggggctcatcggcctggcgcgtaacaagctgtcgctgctgtaccagctggcgccgagcatgggctactccttctcctactgcctcccgacgtcgtcgtcgtcctcctcggggtacctgtccatcggctcctacaacccggggcagtactcgtacacgcccatggcgtcgagctcgctggacgactcgctctacttcatcaagatgaccgggatcaaggtcgcgggcaagccgctgtccgtgtcgtcgtcggcctactccagcctgccgacgatcatcgactccggcacggtgatcacgcgcctgcctacgggcgtgtactcggcgctcagcaaggcggtggcgggcgccatgaaggggacgccccgcgcgtcggcgttctccatcctggacacgtgcttccagggccaggcggcgcggctgcgcgtgcccgaggtcaccatggccttcgccggcggcgcggcgctcaagctggccgccaggaacctgctggtggacgtggacagcgccaccacgtgcctggccttcgcgcccgcccggagcgccgccatcatcgggaacacgcagcagcagacgttcagcgtcgtctacgacgtcaagaacagcaagatcgggttcgccgccgccggctgcagctgagaagcgacacctacatacacgcgcatgcacagaccgactcggcaactaaaactaaaacgagcagcgcatgcatgcatctaccgtccggtttcgtctgaaaccatcattaatttcgatcgtccactccacgcacagcaagttctttacggaccttgccgcatatgatatgtacatggtgacaagataaggtacaggagaattg

SEQ ID NO: 630 - protein, 1696 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Pkinase; PFam Description: Protein kinase domain
  misc_feature: GI Number: 45735971; NR Description: putative chloroplast nucleoid DNA-binding protein cnd41 [Oryza sativa (japonica cultivar-group)] gi|45735845|dbj|BAD12880.1| putative chloroplast nucleoid DNA-binding protein cnd41 [Oryza sativa (japonica
  misc_feature: GI Number: 55417864; NR Description: putative chloroplast nucleoid DNA-binding protein cnd41 [Oryza sativa (japonica cultivar-group)] gi|50912217|ref|XP_467516.1| putative chloroplast nucleoid DNA-binding protein cnd41 [Oryza sativa
  misc_feature: GI Number: 24430421; NR Description: 41 kD chloroplast
  misc_feature: GI Number: 51091964; NR Description: putative nucleoid DNA-binding protein cnd41, chloroplast [Oryza sativa (japonica
  misc_feature: GI Number: 7489168; NR Description: nucleoid DNA-binding protein cnd41, chloroplast - common tobacco >gi|2541876|dbj|BAA22813.1| CND41, chloroplast nucleoid DNA binding
ATAGAGAGAGCCACTGGCCACAGGTAGGCAGGCAGGAGGACGAGTCGGCAAGGAAGCTGCCTGCTTTCAGAAAGAGTCATAGAGATAGTTATTAAGATGGCGTTGCTTCGGCTGCTTGCCCTCTCCCTGCTCTTCGCAGTGGCCACTCCTGTCAGGGACATCGCCCACGATGCCTGCTCGTCAGAAGTGAAGGATTTCCAGCACCTGAACAACAGCTCGGGGCTCCACCTGACGCTGCACCACCCGCAGAGCCCCTGCTCCCCGGCGCCGCTGCCCGCCGACCTCCCCTTCTCCGCGGTGCTCGCCCACGACGGCGCGCGCATCGCGTCGCTCGCCGCGCGCCTCGCCAAGACGCCGTCCTCTCGGCCCACCTTGCTTGACGAGAGCCGCGCGGGGTCGTCGTCGTCGTCCCCCGATGACGAGTCCCTCGCGTCCGTGCCGCTCGGCCCGGGCACGTCCGTCGGCGTCGGCAACTACGTCACCCGCATGGGCCTCGGCACGCCGGCCAAGTCGTACGTCATGGTCGTGGACACGGGGTCCTCGCTCACCTGGCTCCAGTGCTCCCCCTGCGTCGTGTCGTGCCACCGCCAGTCCGGCCCGGTGTTCAACCCCAAGGCGTCCAGCTCCTACGCCTCCGTGTCCTGCTCCGCGCAGCAGTGCAGCGACCTCACCACCGCCACGCTCAACCCCGCCTCCTGCTCCACCTCCAACGTCTGCATCTACCAGGCCAGCTACGGCGACAGCTCCTTCTCGGTCGGGTATCTGAGCAAGGACACCGTGTCGTTCGGCTCCACCAGCGTGCCCAACTTCTACTACGGCTGCGGACAAGACAACGAGGGCCTCTTCGGGCAGTCGGCGGGGCTCATCGGCCTGGCGCGTAACAAGCTGTCGCTGCTGTACCAGCTGGCGCCGAGCATGGGCTACTCCTTCTCCTACTGCCTCCCGACGTCGTCGTCGTCCTCCTCGGGGTACCTGTCCATCGGCTCCTACAACCCGGGGCAGTACTCGTACACGCCCATGGCGTCGAGCTCGCTGGACGACTCGCTCTACTTCATCAAGATGACCGGGATCAAGGTCGCGGGCAAGCCGCTGTCCGTGTCGTCGTCGGCCTACTCCAGCCTGCCGACGATCATCGACTCCGGCACGGTGATCACGCGCCTGCCTACGGGCGTGTACTCGGCGCTCAGCAAGGCGGTGGCGGGCGCCATGAAGGGGACGCCCCGCGCGTCGGCGTTCTCCATCCTGGACACGTGCTTCCAGGGCCAGGCGGCGCGGCTGCGCGTGCCCGAGGTCACCATGGCCTTCGCCGGCGGCGCGGCGCTCAAGCTGGCCGCCAGGAACCTGCTGGTGGACGTGGACAGCGCCACCACGTGCCTGGCCTTCGCGCCCGCCCGGAGCGCCGCCATCATCGGGAACACGCAGCAGCAGACGTTCAGCGTCGTCTACGACGTCAAGAACAGCAAGATCGGGTTCGCCGCCGCCGGCTGCAGCTGAGAAGCGACACCTACATACACGCGCATGCACAGACCGACTCGGCAACTAAAACTAAAACGAGCAGCGCATGCATGCATCTACCGTCCGGTTTCGTCTGAAACCATCATTAATTTCGATCGTCCACTCCACGCACAGCAAGTTCTTTACGGACCTTGCCGCATATGATATGTACATGGTGACAAGATAAGGTACAGGAGAATTG

SEQ ID NO: 631 - DNA, 1502 bp, Zea mays
  misc_feature (1)..(1502): Ceres cDNA ID no. 12352518
  misc_feature (1)..(1502): Ceres CLONE  ID no. 298573
  misc_feature (1)..(1502): Also known as  Ceres CDNA ID no. 12352518
aactctgctctggcactcgcctgttgcccaactcgtcatgtggtagcctggtaggctggtagcccaaggcgcagggccctgtcactcgcgcgcaacttgctcgacggaatgccgcatcgggacgtcatctcggccacggccgccatcggcgcgctaacccgcggcggccgacaccgcgacgccctcgcactgttctcccgagttctcgccgacggcgtccgcccaacgagttcactttcggtaccgtcctgcgctcggccaccgcgctccgagtccgagccccgcgcgtcggcgtgcagctccacgcctgcgctgccaagctcggcctctgctccaacgtcttcgtcggcagcgctctcctcgaccactacgccaagatgggcgccatgacggaggcccagcgcgcgctcgatgacacccgcgagccgaatgtggtctcctacaccgccctcatcgccggtttgctgaagaatgggatgtttgatgaggcagaccgattgttccggcgcatgccagagaggaacgtggtctcgtggaacgcgatgatcggcgggtacagtcaagccggtctcggtgaggaggctgtcaatctgttcctggaaatgtgccgaggaggcgtctcaccgaacgaaagcaccttcccctgcgtgctcacctctgttgccagtgcagggacacttggcgtaggcagaagcattcatgcatcagccatcaagttcttgggcaagcttgacgtttatataggtaattctcttgtgagcttctatgccaggtgcggtagcttggaggacagtgttttggctttcaaaaaaatcaatcggaaaaacgtggtctcctggaacgcactgatctgcgggtatgcgcagaatgggaagggggaagaggctttggacgcttacagaatgatgagagcaacgggcctcaagccagataacgtcactcttctcggcttgctgtttggttgtaaccatactggtctagttgatgaaggttatgcattgttcaagaccgcagagagggagcaaccgggcatactgaaacctgagcattacgcttgtgtggttgatctactatctcgtgccaagcggttcgacgaggccagaaggtttcttgaggagctcccctttgagccaggcattgggttctggaaggctttgttagggggctgtcagattcactggaacagcaagctggctgagagcgttgcaaagcgcattcgtgcattggatccaaaggacacatcttcctacattcttctgtcaaatgtatactctgcgtcaggaagttggcagagtgtgtctatggtcaggtgggagattaaggagaaggggctgaagaggatcaccggctgcagttggattgaggtccaggagaaggtccatgtcttcttcaatggagactgtaggcatcaccagagtgatgaaatttattcgatgctcgaatcatgtttttattccatggaagatgaaggtgaacactcaattgtgtgatgataaccaatg

SEQ ID NO: 632 - protein, 1502 aa, Zea mays
AACTCTGCTCTGGCACTCGCCTGTTGCCCAACTCGTCATGTGGTAGCCTGGTAGGCTGGTAGCCCAAGGCGCAGGGCCCTGTCACTCGCGCGCAACTTGCTCGACGGAATGCCGCATCGGGACGTCATCTCGGCCACGGCCGCCATCGGCGCGCTAACCCGCGGCGGCCGACACCGCGACGCCCTCGCACTGTTCTCCCGAGTTCTCGCCGACGGCGTCCGCCCAACGAGTTCACTTTCGGTACCGTCCTGCGCTCGGCCACCGCGCTCCGAGTCCGAGCCCCGCGCGTCGGCGTGCAGCTCCACGCCTGCGCTGCCAAGCTCGGCCTCTGCTCCAACGTCTTCGTCGGCAGCGCTCTCCTCGACCACTACGCCAAGATGGGCGCCATGACGGAGGCCCAGCGCGCGCTCGATGACACCCGCGAGCCGAATGTGGTCTCCTACACCGCCCTCATCGCCGGTTTGCTGAAGAATGGGATGTTTGATGAGGCAGACCGATTGTTCCGGCGCATGCCAGAGAGGAACGTGGTCTCGTGGAACGCGATGATCGGCGGGTACAGTCAAGCCGGTCTCGGTGAGGAGGCTGTCAATCTGTTCCTGGAAATGTGCCGAGGAGGCGTCTCACCGAACGAAAGCACCTTCCCCTGCGTGCTCACCTCTGTTGCCAGTGCAGGGACACTTGGCGTAGGCAGAAGCATTCATGCATCAGCCATCAAGTTCTTGGGCAAGCTTGACGTTTATATAGGTAATTCTCTTGTGAGCTTCTATGCCAGGTGCGGTAGCTTGGAGGACAGTGTTTTGGCTTTCAAAAAAATCAATCGGAAAAACGTGGTCTCCTGGAACGCACTGATCTGCGGGTATGCGCAGAATGGGAAGGGGGAAGAGGCTTTGGACGCTTACAGAATGATGAGAGCAACGGGCCTCAAGCCAGATAACGTCACTCTTCTCGGCTTGCTGTTTGGTTGTAACCATACTGGTCTAGTTGATGAAGGTTATGCATTGTTCAAGACCGCAGAGAGGGAGCAACCGGGCATACTGAAACCTGAGCATTACGCTTGTGTGGTTGATCTACTATCTCGTGCCAAGCGGTTCGACGAGGCCAGAAGGTTTCTTGAGGAGCTCCCCTTTGAGCCAGGCATTGGGTTCTGGAAGGCTTTGTTAGGGGGCTGTCAGATTCACTGGAACAGCAAGCTGGCTGAGAGCGTTGCAAAGCGCATTCGTGCATTGGATCCAAAGGACACATCTTCCTACATTCTTCTGTCAAATGTATACTCTGCGTCAGGAAGTTGGCAGAGTGTGTCTATGGTCAGGTGGGAGATTAAGGAGAAGGGGCTGAAGAGGATCACCGGCTGCAGTTGGATTGAGGTCCAGGAGAAGGTCCATGTCTTCTTCAATGGAGACTGTAGGCATCACCAGAGTGATGAAATTTATTCGATGCTCGAATCATGTTTTTATTCCATGGAAGATGAAGGTGAACACTCAATTGTGTGATGATAACCAATG

SEQ ID NO: 633 - DNA, 1277 bp, Zea mays
  misc_feature (1)..(1277): Ceres cDNA ID no. 12352611
  misc_feature (1)..(1277): Ceres CLONE  ID no. 306068
  misc_feature (1)..(1277): Also known as  Ceres CDNA ID no. 23782052
aggcacaaggaagaacgaagagagatcagcgacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcgggtctgccacgctgccggacctcgtggccgcgctgtccctgccagcggccaagctcccgttcctcgggcgcgtgatgcggctgctggtcacgtcggggcgtcttcgcgtcgtccgacgacgtgcagtaccggctgaacccgctgtcctggctgctggtggagggcgtggagtcggaggaccacacctaccagaagtacttcgtgctgggcaccgtctcccgccactacgtggaggccggcatgtccctggccgactggttcaagaaggaggaggacgaggaccgccagctgccgtcgccgttcgaggccctgcacggggtgcccctcgtccacgagagcaccaagctgctggacgaggagctggacagggtcgtggaggaaggcgtggccgcgcacgacaacctggccatcgggaccgtcatacgggagtgcggcgccgacgtcttcagcggcctccgctcgctcacctactgctgcggcaggcaggggaacgccagcgcggccgccatcgtcaaggccttcccagacatcaagtgcaccgtgctcaaccttcccagggtcgtcgaggagacgacgaccaagaccatcaccatcccgcctgcgcaggctgtcatgctcaagctcgtcctgcacttctggagcgacgacgactgcgtcaagatcctggagctgtgcaggaaggccatcccttcccgccaagaaggagggaaggtgatcatcattgagatactcctgggcccgtacatggggccggtcatgtacgaggcccagctgctgatggacatgctcatgatggtgaacaccaagggcaggcagcgcggcgaagacgactggcgccacatctttaccaaggctggcttctccgactacaaggttgtcaagaaaatcggagctcgtggtgtcatcgaggtctacccatgatccatgatcgatgtcatgtgactgtgagaggacgatactgtacaattaaataaacggggtatctagctactactcagcttttgtacctcgagatccatgcatgttaattacttgcttccatctgttttcaaaatgcatctatgtaatgtacttcgcttcttcgtcc

SEQ ID NO: 634 - protein, 1277 aa, Zea mays
  misc_feature: PFam Name: Methyltransf_2; PFam Description: O-methyltransferase
  misc_feature: PFam Name: Dimerisation; PFam Description: Dimerisation domain
  misc_feature: GI Number: 62734415; NR Description: O-methyltransferase
  misc_feature: GI Number: 62734422; NR Description: O-methyltransferase
  misc_feature: GI Number: 27777630; NR Description: O-methyltransferase
  misc_feature: GI Number: 62732812; NR Description: O-methyltransferase
  misc_feature: GI Number: 2921304; NR Description: herbicide safener binding protein [Zea mays] >gi|7447882|pir||T01354 herbicide safener
AGGCACAAGGAAGAACGAAGAGAGATCAGCGACTTAACAACAATAATGGCCACCGCCATAGTTCCCACGGACGCCGAGCTGCTGCAGGCGCAGGCCGACCTGTGGCGCCACAGCCTCTACTACCTGACATCCATGGCGCTCAAGTGCGCGGTGGAGCTCCACATCCCGACCGCCATCCACAACCTAGGCGGGTCTGCCACGCTGCCGGACCTCGTGGCCGCGCTGTCCCTGCCAGCGGCCAAGCTCCCGTTCCTCGGGCGCGTGATGCGGCTGCTGGTCACGTCGGGGCGTCTTCGCGTCGTCCGACGACGTGCAGTACCGGCTGAACCCGCTGTCCTGGCTGCTGGTGGAGGGCGTGGAGTCGGAGGACCACACCTACCAGAAGTACTTCGTGCTGGGCACCGTCTCCCGCCACTACGTGGAGGCCGGCATGTCCCTGGCCGACTGGTTCAAGAAGGAGGAGGACGAGGACCGCCAGCTGCCGTCGCCGTTCGAGGCCCTGCACGGGGTGCCCCTCGTCCACGAGAGCACCAAGCTGCTGGACGAGGAGCTGGACAGGGTCGTGGAGGAAGGCGTGGCCGCGCACGACAACCTGGCCATCGGGACCGTCATACGGGAGTGCGGCGCCGACGTCTTCAGCGGCCTCCGCTCGCTCACCTACTGCTGCGGCAGGCAGGGGAACGCCAGCGCGGCCGCCATCGTCAAGGCCTTCCCAGACATCAAGTGCACCGTGCTCAACCTTCCCAGGGTCGTCGAGGAGACGACGACCAAGACCATCACCATCCCGCCTGCGCAGGCTGTCATGCTCAAGCTCGTCCTGCACTTCTGGAGCGACGACGACTGCGTCAAGATCCTGGAGCTGTGCAGGAAGGCCATCCCTTCCCGCCAAGAAGGAGGGAAGGTGATCATCATTGAGATACTCCTGGGCCCGTACATGGGGCCGGTCATGTACGAGGCCCAGCTGCTGATGGACATGCTCATGATGGTGAACACCAAGGGCAGGCAGCGCGGCGAAGACGACTGGCGCCACATCTTTACCAAGGCTGGCTTCTCCGACTACAAGGTTGTCAAGAAAATCGGAGCTCGTGGTGTCATCGAGGTCTACCCATGATCCATGATCGATGTCATGTGACTGTGAGAGGACGATACTGTACAATTAAATAAACGGGGTATCTAGCTACTACTCAGCTTTTGTACCTCGAGATCCATGCATGTTAATTACTTGCTTCCATCTGTTTTCAAAATGCATCTATGTAATGTACTTCGCTTCTTCGTCC

SEQ ID NO: 635 - DNA, 1600 bp, Zea mays
  misc_feature (1)..(1600): Ceres cDNA ID no. 12352722
  misc_feature (1)..(1600): Ceres CLONE  ID no. 320060
  misc_feature (1)..(1600): Also known as  Ceres CDNA ID no. 24443975
atcctcaacctcatccgcccccgcccgcaccccgcaggcaccatcaccaaaaaggtccccgccttcttcttcttcttcttcttctcctctgcccctgcttgtcgtttgctcgtgctcccccaccccctttctgattcagcaagggttccttccgcggcgcggcgcgtcgccatgggcaactgctggggcgccaagatcagctccgacagcccgtcccgcggcgcctcatccccgtcagggacggcgtccaagttggcgagcaggaacggggcggcggcagccctgagcgggtgcagcagccacgcgtcgtccgcgtccatgctgccgacgccccgcagcgaggacgagatcctggagtcggccaacgtcagggccttcagcttcaacgagctgaggaccgccaccaggaacttcaggccggacagcgtgctgggcgagggcgggttcggatccgtcttcaagggctgggtcgacgagaagacgctcgccccggctaggcccggcacggggatggtcattgccgtcaagaagctcaaccaggatggataccagggccacaaggagtggctgactgaagtgaactaccttggaacgctgtcgcacccctaccttgtgaagctcgttggctactgcctcgaggacgaacagcgcctcctcgtctacgagttcatgccacgcgggagtctggagaaccatctgttcaggaggagctcctatttccagcctctgtcctggaacctacggatgaagattgcgctcggagcagctaaaggcctcgcgtatctccacagcgacgaggctaaagtcatctaccgtgacttcaagacatctaatgtccttctagatgcgaacttcaatgcaaagctctctgatttcgggctggcgaaggatggtccgaccggcgacaagagccatgtctccactagggtgatggggactcacgggtatgcagctccagaataccttgcgacaggtcatctgaccaccaagagcgacgtgtacagctttggggtggtgctcctagagatgctgtcagggcggcgggcgctggacaagaaccgcccgaacggggagcacaacctggtggagtgggctaggccatacctgagaagcaagcggcgcatatttcgcatcctggacccacggctgggcgggcagtactcccttgccagggcgcagaaggctgcggcgctcgccctgcaatgcctctcggtggagtccaggcacaggcccagcatggacgaggtggtcacagcgttagagcagctccaggacaccaaagaaggaggtaaccatcacctacagaagaggccaggcagccggagcttggataacaatggcggcaaagcggcagggaaggggaagcctgctcctcatgtaaaaccagtttgagtgattggattttatatgccagagtatctctctttttttttcccatccatttgtaggtgtaggtaatatagtagggttcttagagggatttgtaaagaggcaggcagagttctggatgttttctgtctattatgtagttttttttacatcttcaagtctctgtaaagtacgctatgtaaatacataatgacatccagttcggagtgcg

SEQ ID NO: 636 - protein, 1600 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 8778537; NR Description: F22G5.5 [Arabidopsis thaliana]
  misc_feature: GI Number: 166809; NR Description: protein kinase
  misc_feature: GI Number: 42569425; NR Description: protein kinase (APK1b)
  misc_feature: GI Number: 34906046; NR Description: putative serine/threonine-specific protein kinase [Oryza sativa (japonica cultivar-group)] >gi|15290002|dbj|BAB63697.1| putative serine/threonine-specific protein kinase [Oryza sativa (japonica
  misc_feature: GI Number: 21555255; NR Description: serine/threonine-specific protein kinase NAK [Arabidopsis thaliana] >gi|7406425|emb|CAB85534.1| serine/threonine-specific protein kinase NAK [Arabidopsis thaliana]
ATCCTCAACCTCATCCGCCCCCGCCCGCACCCCGCAGGCACCATCACCAAAAAGGTCCCCGCCTTCTTCTTCTTCTTCTTCTTCTCCTCTGCCCCTGCTTGTCGTTTGCTCGTGCTCCCCCACCCCCTTTCTGATTCAGCAAGGGTTCCTTCCGCGGCGCGGCGCGTCGCCATGGGCAACTGCTGGGGCGCCAAGATCAGCTCCGACAGCCCGTCCCGCGGCGCCTCATCCCCGTCAGGGACGGCGTCCAAGTTGGCGAGCAGGAACGGGGCGGCGGCAGCCCTGAGCGGGTGCAGCAGCCACGCGTCGTCCGCGTCCATGCTGCCGACGCCCCGCAGCGAGGACGAGATCCTGGAGTCGGCCAACGTCAGGGCCTTCAGCTTCAACGAGCTGAGGACCGCCACCAGGAACTTCAGGCCGGACAGCGTGCTGGGCGAGGGCGGGTTCGGATCCGTCTTCAAGGGCTGGGTCGACGAGAAGACGCTCGCCCCGGCTAGGCCCGGCACGGGGATGGTCATTGCCGTCAAGAAGCTCAACCAGGATGGATACCAGGGCCACAAGGAGTGGCTGACTGAAGTGAACTACCTTGGAACGCTGTCGCACCCCTACCTTGTGAAGCTCGTTGGCTACTGCCTCGAGGACGAACAGCGCCTCCTCGTCTACGAGTTCATGCCACGCGGGAGTCTGGAGAACCATCTGTTCAGGAGGAGCTCCTATTTCCAGCCTCTGTCCTGGAACCTACGGATGAAGATTGCGCTCGGAGCAGCTAAAGGCCTCGCGTATCTCCACAGCGACGAGGCTAAAGTCATCTACCGTGACTTCAAGACATCTAATGTCCTTCTAGATGCGAACTTCAATGCAAAGCTCTCTGATTTCGGGCTGGCGAAGGATGGTCCGACCGGCGACAAGAGCCATGTCTCCACTAGGGTGATGGGGACTCACGGGTATGCAGCTCCAGAATACCTTGCGACAGGTCATCTGACCACCAAGAGCGACGTGTACAGCTTTGGGGTGGTGCTCCTAGAGATGCTGTCAGGGCGGCGGGCGCTGGACAAGAACCGCCCGAACGGGGAGCACAACCTGGTGGAGTGGGCTAGGCCATACCTGAGAAGCAAGCGGCGCATATTTCGCATCCTGGACCCACGGCTGGGCGGGCAGTACTCCCTTGCCAGGGCGCAGAAGGCTGCGGCGCTCGCCCTGCAATGCCTCTCGGTGGAGTCCAGGCACAGGCCCAGCATGGACGAGGTGGTCACAGCGTTAGAGCAGCTCCAGGACACCAAAGAAGGAGGTAACCATCACCTACAGAAGAGGCCAGGCAGCCGGAGCTTGGATAACAATGGCGGCAAAGCGGCAGGGAAGGGGAAGCCTGCTCCTCATGTAAAACCAGTTTGAGTGATTGGATTTTATATGCCAGAGTATCTCTCTTTTTTTTTCCCATCCATTTGTAGGTGTAGGTAATATAGTAGGGTTCTTAGAGGGATTTGTAAAGAGGCAGGCAGAGTTCTGGATGTTTTCTGTCTATTATGTAGTTTTTTTTACATCTTCAAGTCTCTGTAAAGTACGCTATGTAAATACATAATGACATCCAGTTCGGAGTGCG

SEQ ID NO: 637 - DNA, 1097 bp, Zea mays
  misc_feature (1)..(1097): Ceres cDNA ID no. 12353369
  misc_feature (1)..(1097): Ceres CLONE  ID no. 221668
  misc_feature (1)..(1097): Also known as  Ceres CDNA ID no. 23741753
ctatcagcccaaaaccgaacccacacctctgcccttcccatggcggccacgctattctccacctccctcttgccccagttcctctccctctccgctaagcccgccgccgccgccgccgccccgtccgccgccgccttcccatcggggatgccgcagctccacgcgctgtccgccgcggcggtgggctttaggccgctcgagcccgtgcgagcagccgcgaccgcggccgtgacggaggagctcgaggcggaggggcgttcgggcggggacgagttttcagatgatctcagggtcttcgtcggtaaccttccgttcagcgtcgacagcgcccagctcgcgggacttttcgagcaggccggctccgtcgagatggtcgaggttatctatgacaaattgacgggaagaagccgtggattcgggtttgtgaccatgtcttcggtcgaagaagttgaggtggctgttgaccaatttaatggctatgtgcttgatggaagaagtttgagggtgaactctgggccgccaccacccagagatcggtcatcaccgtcaccgcaaagacccaggggtgatgccaacagggtctacgtgggtaacctttcctggggagttgacaattcagctctcgcaaacctgttcagtgagcaaggtgaggtactggaagcaaggatcatctatgacagggagagtggaaggtcaagggggtttggttttgtcacgtacggttctgccgaagaggttgagaatgcaatatctaatctcgatggcgctgacttggacggcagacagatccgtgttacggtagcagagtcgaagccacctaggcagcaatactgaaattcctcttgagatttttgtaggtgtaccggtagcccaaactctggattatagtgacgccagtcctggatttggtctcgagattcattgaagttaaaaagccctcatgtatatggctcactatttatatacatgtaatattggattcccgtgttcagtgtccttttgtatcaatttggctgcatagtgtcttgtggcacttcaaaggacatagattgttgacgggcaaccaaacctcaagaaagtatcttgtattgtttctt

SEQ ID NO: 638 - protein, 1097 aa, Zea mays
  misc_feature: PFam Name: RRM_1; PFam Description: RNA recognition motif.
  misc_feature: GI Number: 50920707; NR Description: putative ribonucleoprotein [Oryza sativa] >gi|18921322|gb|AAL82527.1|
  misc_feature: GI Number: 34913270; NR Description: putative 29 kDa ribonucleoprotein A, chloroplast precursor [Oryza sativa (japonica cultivar-group)] >gi|22296371|dbj|BAC10140.1| putative 29 kDa ribonucleoprotein A, chloroplast precursor [Oryza sativa
  misc_feature: GI Number: 16323482; NR Description: putative RNA-binding protein [Arabidopsis thaliana] >gi|13877809|gb|AAK43982.1| putative RNA-binding protein [Arabidopsis thaliana] >gi|20197716|gb|AAM15222.1| putative RNA-binding protein
  misc_feature: GI Number: 21617920; NR Description: putative RNA-binding
CTATCAGCCCAAAACCGAACCCACACCTCTGCCCTTCCCATGGCGGCCACGCTATTCTCCACCTCCCTCTTGCCCCAGTTCCTCTCCCTCTCCGCTAAGCCCGCCGCCGCCGCCGCCGCCCCGTCCGCCGCCGCCTTCCCATCGGGGATGCCGCAGCTCCACGCGCTGTCCGCCGCGGCGGTGGGCTTTAGGCCGCTCGAGCCCGTGCGAGCAGCCGCGACCGCGGCCGTGACGGAGGAGCTCGAGGCGGAGGGGCGTTCGGGCGGGGACGAGTTTTCAGATGATCTCAGGGTCTTCGTCGGTAACCTTCCGTTCAGCGTCGACAGCGCCCAGCTCGCGGGACTTTTCGAGCAGGCCGGCTCCGTCGAGATGGTCGAGGTTATCTATGACAAATTGACGGGAAGAAGCCGTGGATTCGGGTTTGTGACCATGTCTTCGGTCGAAGAAGTTGAGGTGGCTGTTGACCAATTTAATGGCTATGTGCTTGATGGAAGAAGTTTGAGGGTGAACTCTGGGCCGCCACCACCCAGAGATCGGTCATCACCGTCACCGCAAAGACCCAGGGGTGATGCCAACAGGGTCTACGTGGGTAACCTTTCCTGGGGAGTTGACAATTCAGCTCTCGCAAACCTGTTCAGTGAGCAAGGTGAGGTACTGGAAGCAAGGATCATCTATGACAGGGAGAGTGGAAGGTCAAGGGGGTTTGGTTTTGTCACGTACGGTTCTGCCGAAGAGGTTGAGAATGCAATATCTAATCTCGATGGCGCTGACTTGGACGGCAGACAGATCCGTGTTACGGTAGCAGAGTCGAAGCCACCTAGGCAGCAATACTGAAATTCCTCTTGAGATTTTTGTAGGTGTACCGGTAGCCCAAACTCTGGATTATAGTGACGCCAGTCCTGGATTTGGTCTCGAGATTCATTGAAGTTAAAAAGCCCTCATGTATATGGCTCACTATTTATATACATGTAATATTGGATTCCCGTGTTCAGTGTCCTTTTGTATCAATTTGGCTGCATAGTGTCTTGTGGCACTTCAAAGGACATAGATTGTTGACGGGCAACCAAACCTCAAGAAAGTATCTTGTATTGTTTCTT

SEQ ID NO: 639 - DNA, 1394 bp, Zea mays
  misc_feature (1)..(1394): Ceres cDNA ID no. 12353583
  misc_feature (1)..(1394): Ceres CLONE  ID no. 240112
  misc_feature (1)..(1394): Also known as  Ceres CDNA ID no. 23754913
agatcccctcacagtcatcctccacccaccccacccaccgcctccgcctctctctctctctcgtttgttcgtctcggcttccggtcgccgattcttctctgcgcaaaagattcctggtggtggtgcccgtaccttgctccacgcctcgctcgcgtcgcgtgcatggggctggacgtcggcggcatcgggatgggcctggatctgggtctggacctcgggctgttcgccgcgcggagcgccggagggatggcggccgcggccaagggtgcgccggcggagatcgagtcctgcatcaggagcctcgaggaggagcgccggaagatcgaggtgttcaggcgcgagctcccgctctgcgtgcgtctcctcgccgatgtaatcgacgaattgaaggatgaggccgccaagagaggcggagacgcggaggccaaggccgacgacggcgataagcggaaatggatgagcaccgctcagctgtggctcgacagcgacgccaaatccgacgagtctgacaaagagcaactgagtgaaatcacttcgccggagcccaagttgctcggtggcgcacccatgcccataagggccgttgcggcggtgccacccctgccgcctccattcttcaggagagaagacagctctgccggcagtggtctgtcgctggtaccacccgcagctaagccgccgattcctcccatgtctgccagcgacaacgcgagcggcagattctgtgccactatgccaccgtctggctctggggccaacttgcactctcaggctcagcagcaagccaggaaggcgaggcggtgctggtcgccggagcttcaccggctgtttgttgccgccttgcatcaactcggcggccctcaagttgctactccgaagcagatcagggaggtgatgaaggtggacgggcttacaaacgatgaagtgaaaagccatctccagaagtaccggctgcacaacagaagatcccccggcgtcgtggctccggtgagccagtcggtcatgctggcgggcggcctctgggctcctcctcatcaggagcaaagcagctcgcagtccgggtctccccagggcccgcttcagttctctggatccggtgtagcggccaccgtcggcggcgatagcagcagcagcgacgaggacgacaagtccgaaggctacagccggaaatacgtgtaaaggccgcgttcgacggatgagagtgtagagatagcgtcgcggcttctgcttgcccgtctgtggcaataacagattcatcagtcttgagagaggttgtagtgcgtgcgcccaagagctcaactgatcatgggttggattgtttgtttgtcatgtacgtacatggaaagctgatggcttcctgacttttaatttctgggcaggtcccaaaattttcg

SEQ ID NO: 640 - protein, 1394 aa, Zea mays
  misc_feature: PFam Name: Myb_DNA-binding; PFam Description: Myb-like
  misc_feature: GI Number: 50933785; NR Description: putative cytoskeletal protein-like protein [Oryza sativa (japonica cultivar-group)] >gi|33146555|dbj|BAC79732.1| putative cytoskeletal protein-like
  misc_feature: GI Number: 18419989; NR Description: myb family transcription
  misc_feature: GI Number: 14532434; NR Description: AT4g37180/C7A10_180
  misc_feature: GI Number: 30690890; NR Description: myb family transcription
  misc_feature: GI Number: 21554992; NR Description: unknown [Arabidopsis thaliana]
AGATCCCCTCACAGTCATCCTCCACCCACCCCACCCACCGCCTCCGCCTCTCTCTCTCTCTCGTTTGTTCGTCTCGGCTTCCGGTCGCCGATTCTTCTCTGCGCAAAAGATTCCTGGTGGTGGTGCCCGTACCTTGCTCCACGCCTCGCTCGCGTCGCGTGCATGGGGCTGGACGTCGGCGGCATCGGGATGGGCCTGGATCTGGGTCTGGACCTCGGGCTGTTCGCCGCGCGGAGCGCCGGAGGGATGGCGGCCGCGGCCAAGGGTGCGCCGGCGGAGATCGAGTCCTGCATCAGGAGCCTCGAGGAGGAGCGCCGGAAGATCGAGGTGTTCAGGCGCGAGCTCCCGCTCTGCGTGCGTCTCCTCGCCGATGTAATCGACGAATTGAAGGATGAGGCCGCCAAGAGAGGCGGAGACGCGGAGGCCAAGGCCGACGACGGCGATAAGCGGAAATGGATGAGCACCGCTCAGCTGTGGCTCGACAGCGACGCCAAATCCGACGAGTCTGACAAAGAGCAACTGAGTGAAATCACTTCGCCGGAGCCCAAGTTGCTCGGTGGCGCACCCATGCCCATAAGGGCCGTTGCGGCGGTGCCACCCCTGCCGCCTCCATTCTTCAGGAGAGAAGACAGCTCTGCCGGCAGTGGTCTGTCGCTGGTACCACCCGCAGCTAAGCCGCCGATTCCTCCCATGTCTGCCAGCGACAACGCGAGCGGCAGATTCTGTGCCACTATGCCACCGTCTGGCTCTGGGGCCAACTTGCACTCTCAGGCTCAGCAGCAAGCCAGGAAGGCGAGGCGGTGCTGGTCGCCGGAGCTTCACCGGCTGTTTGTTGCCGCCTTGCATCAACTCGGCGGCCCTCAAGTTGCTACTCCGAAGCAGATCAGGGAGGTGATGAAGGTGGACGGGCTTACAAACGATGAAGTGAAAAGCCATCTCCAGAAGTACCGGCTGCACAACAGAAGATCCCCCGGCGTCGTGGCTCCGGTGAGCCAGTCGGTCATGCTGGCGGGCGGCCTCTGGGCTCCTCCTCATCAGGAGCAAAGCAGCTCGCAGTCCGGGTCTCCCCAGGGCCCGCTTCAGTTCTCTGGATCCGGTGTAGCGGCCACCGTCGGCGGCGATAGCAGCAGCAGCGACGAGGACGACAAGTCCGAAGGCTACAGCCGGAAATACGTGTAAAGGCCGCGTTCGACGGATGAGAGTGTAGAGATAGCGTCGCGGCTTCTGCTTGCCCGTCTGTGGCAATAACAGATTCATCAGTCTTGAGAGAGGTTGTAGTGCGTGCGCCCAAGAGCTCAACTGATCATGGGTTGGATTGTTTGTTTGTCATGTACGTACATGGAAAGCTGATGGCTTCCTGACTTTTAATTTCTGGGCAGGTCCCAAAATTTTCG

SEQ ID NO: 641 - DNA, 1657 bp, Zea mays
  misc_feature (1)..(1657): Ceres cDNA ID no. 12353590
  misc_feature (1)..(1657): Ceres CLONE  ID no. 240784
  misc_feature (1)..(1657): Also known as  Ceres CDNA ID no. 23755399
ctcttttaataggttgttgctatcaggtgtcaagtaaagtaatgagtttcttgttaaattcgccatcagatggtaaacaatgattgttctgaactggtggaggtgcaaaccatctgatatataggagagcctagtaagctaaggggcccttgctacccttcttatagccattttagcaggtactgggttcagtggtactattgagtcttatcaagttacttgtggttgagcctctctccaaaacattgtctttggtagtttctgttacttaaataatgtagaaagtttcccccctcagaaattgtgtgtttgacttggatgatcttgttgaaggtttttcggtttttaccggaggtctttggtggaagggtgcccttggtggacttggtgaccatttggtgaagggtgcccttggtgtaatgttattgactgttttagtggaagttccaagttggtgatgcatttgagtacttgacacatgacgtgacggcttactgtttgtggcaaccctttgcgcagaatacgagaagtggagttgaagcgtgactatgcatttattgagttcagtgatcatcgcgatgctgatgaggctcgataccagctagatggcagggatgttgatgggagtcgtattgttgttgagtttgctaaaggggtcccacgtggttcaggtggctcacgtgaatatatggggagaggccctccaccaggtacaggtcgttgtttcaactgtggagttgatggtcactgggcaagagactgtaaagctggtgactggaaaaacaaatgctaccgttgtggagaaaggggccatatagaaagaaattgccagaacagtcctaggagtctcaggcgagagagaagttactcacggtccccatctccccgccgtggacggggccgcagtcgaagctatagcaggagcaggagccggagtcggagctatagtcgatcaagatccctgtctagatctcctaggggaggtcgtcgtgaccgtgacgataggagatcaaggagtcctagctatagcaggagccccatgcgatctgcctcgccaccagtaaaggaaaaggagcgcagccccgcacctgatggaagcaggagcccaaggagtcgcagcccccaggatcaggtgatgagcccaccaccaaaggataatggcgaaggcaatggctcagaccgtggcggcagccccagagggagggagaacagcaggagctgcagccgcagccgcagtccatctggtagtaaccgcagcctgcggccaatggacgtagccggagtcctggaggtgagcggagcccgagtcctggaggtgagcggagcccgagtcctagaggtgagcggagcccgagtcctagggctgaccgtagcccaagccccaatggcaatggtaacaatgatgctgctgctgatgtcgatgctgatgctgctgcccgcagtggctcccccactggaagcaagtcaccctgagcgctggcggtcccagattgtggtggtgcttctcaatgcaatgggcaatcgtattgctattttttgctaccatatcgaagacacaatagctacatcattttcttctctgaaacaaggactttattttgcttgctttgagatatgactcttaccctctcatggataatatatatatgatatgatg

SEQ ID NO: 642 - protein, 1657 aa, Zea mays
  misc_feature: PFam Name: RRM_1; PFam Description: RNA recognition motif.
  misc_feature: PFam Name: zf-CCHC; PFam Description: Zinc knuckle
  misc_feature: PFam Name: Transformer; PFam Description: Fruit fly
  misc_feature: PFam Name: S-antigen; PFam Description: S-antigen protein
  misc_feature: GI Number: 9843663; NR Description: splicing factor RSZ33
  misc_feature: GI Number: 9795142; NR Description: splicing factor-like protein [Arabidopsis thaliana] >gi|30693839|ref|NP_190918.3| zinc
  misc_feature: GI Number: 42571091; NR Description: splicing factor RSZ33
  misc_feature: GI Number: 34895952; NR Description: putative splicing factor-like protein [Oryza sativa (japonica cultivar-group)] >gi|15528625|dbj|BAB64646.1| putative splicing factor-like protein
  misc_feature: GI Number: 24111329; NR Description: At3g53500/F4P12_200 [Arabidopsis thaliana] >gi|20465265|gb|AAM19952.1| AT3g53500/F4P12_200 [Arabidopsis thaliana] >gi|30693836|ref|NP_851015.1| zinc knuckle (CCHC-type) family
CTCTTTTAATAGGTTGTTGCTATCAGGTGTCAAGTAAAGTAATGAGTTTCTTGTTAAATTCGCCATCAGATGGTAAACAATGATTGTTCTGAACTGGTGGAGGTGCAAACCATCTGATATATAGGAGAGCCTAGTAAGCTAAGGGGCCCTTGCTACCCTTCTTATAGCCATTTTAGCAGGTACTGGGTTCAGTGGTACTATTGAGTCTTATCAAGTTACTTGTGGTTGAGCCTCTCTCCAAAACATTGTCTTTGGTAGTTTCTGTTACTTAAATAATGTAGAAAGTTTCCCCCCTCAGAAATTGTGTGTTTGACTTGGATGATCTTGTTGAAGGTTTTTCGGTTTTTACCGGAGGTCTTTGGTGGAAGGGTGCCCTTGGTGGACTTGGTGACCATTTGGTGAAGGGTGCCCTTGGTGTAATGTTATTGACTGTTTTAGTGGAAGTTCCAAGTTGGTGATGCATTTGAGTACTTGACACATGACGTGACGGCTTACTGTTTGTGGCAACCCTTTGCGCAGAATACGAGAAGTGGAGTTGAAGCGTGACTATGCATTTATTGAGTTCAGTGATCATCGCGATGCTGATGAGGCTCGATACCAGCTAGATGGCAGGGATGTTGATGGGAGTCGTATTGTTGTTGAGTTTGCTAAAGGGGTCCCACGTGGTTCAGGTGGCTCACGTGAATATATGGGGAGAGGCCCTCCACCAGGTACAGGTCGTTGTTTCAACTGTGGAGTTGATGGTCACTGGGCAAGAGACTGTAAAGCTGGTGACTGGAAAAACAAATGCTACCGTTGTGGAGAAAGGGGCCATATAGAAAGAAATTGCCAGAACAGTCCTAGGAGTCTCAGGCGAGAGAGAAGTTACTCACGGTCCCCATCTCCCCGCCGTGGACGGGGCCGCAGTCGAAGCTATAGCAGGAGCAGGAGCCGGAGTCGGAGCTATAGTCGATCAAGATCCCTGTCTAGATCTCCTAGGGGAGGTCGTCGTGACCGTGACGATAGGAGATCAAGGAGTCCTAGCTATAGCAGGAGCCCCATGCGATCTGCCTCGCCACCAGTAAAGGAAAAGGAGCGCAGCCCCGCACCTGATGGAAGCAGGAGCCCAAGGAGTCGCAGCCCCCAGGATCAGGTGATGAGCCCACCACCAAAGGATAATGGCGAAGGCAATGGCTCAGACCGTGGCGGCAGCCCCAGAGGGAGGGAGAACAGCAGGAGCTGCAGCCGCAGCCGCAGTCCATCTGGTAGTAACCGCAGCCTGCGGCCAATGGACGTAGCCGGAGTCCTGGAGGTGAGCGGAGCCCGAGTCCTGGAGGTGAGCGGAGCCCGAGTCCTAGAGGTGAGCGGAGCCCGAGTCCTAGGGCTGACCGTAGCCCAAGCCCCAATGGCAATGGTAACAATGATGCTGCTGCTGATGTCGATGCTGATGCTGCTGCCCGCAGTGGCTCCCCCACTGGAAGCAAGTCACCCTGAGCGCTGGCGGTCCCAGATTGTGGTGGTGCTTCTCAATGCAATGGGCAATCGTATTGCTATTTTTTGCTACCATATCGAAGACACAATAGCTACATCATTTTCTTCTCTGAAACAAGGACTTTATTTTGCTTGCTTTGAGATATGACTCTTACCCTCTCATGGATAATATATATATGATATGATG

SEQ ID NO: 643 - DNA, 1155 bp, Zea mays
  misc_feature (1)..(1155): Ceres cDNA ID no. 12353616
  misc_feature (1)..(1155): Ceres CLONE  ID no. 244892
  misc_feature (1)..(1155): Also known as  Ceres CDNA ID no. 23783291
cacgggcgcctgcctctacgaggtggcctacggcgacggctcctacaccgtgggcgacttcgccaccgagacgctcacgctgggggactccaccccggtcggcaacgtcgccatcgggtgcggccacgacaacgagggcctcttcgtcggcgccgcggggctgctggcgctgggcggcgggccgctctccttcccgtcccagatctccgcgtccaccttctcctactgcctcgtggaccgcgactccccggccgcgtccacgctccagttcggcgacggcgccgccgaggcgggcaccgtgacggcgcctctcgtgcgcagcccgcgcacgagcaccttctactacgtggcgctgtcgggcatctcggtgggcgggcagccgctgtccatcccggcatccgccttcgccatggacgccacgtcgggctcgggcggcgtcatcgtggactccggcaccgccgtgacgcggctccagtccgccgcctacgcggcgctccgcgacgccttcgtccagggcgcgccgtcgcttccccggacctccggggtgtcgctgttcgacacgtgctacgacctgtcggaccggacgagcgtggaggtgcccgcggtgtcgctgcggttcgagggcggcggcgcgctgcggctgccggcgaagaactacctgatccccgtggacggagccggcacctactgcctggccttcgcgccgacgaacgcggccgtgtccatcatcgggaacgtgcagcagcagggcacccgcgtcagcttcgacaccgccaggggcgccgtcggcttcacccccaacaagtgctagcctagcctagcctaagcctgccttctggccctgttagccacggttgtcagtagtaatgacaagccggtgtttaattagcgggagaatgattagatggggggtaattaagcggtgggccctgccgggtctggggaggagcgaaaggcaaaggcgaggacagatgatgccattgccatgccagcctgtgtccggccgatgggtccagctccagcagtgtttctctctttctctcgagtatgcgtgcgtggagccttgtcatgacgaattagatcgtgggggctcccaagttaagagtatttatttttattttatttgctatgtcaagaaaatggaagtttccatcc

SEQ ID NO: 644 - protein, 1155 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: GATase_2; PFam Description: Glutamine
  misc_feature: GI Number: 34895664; NR Description: nucleoid DNA-binding protein cnd41-like protein [Oryza sativa (japonica cultivar-group)] >gi|12328547|dbj|BAB21205.1| nucleoid DNA-binding protein
  misc_feature: GI Number: 19424106; NR Description: putative chloroplast
  misc_feature: GI Number: 23297732; NR Description: putative chloroplast nucleoid DNA-binding protein [Arabidopsis thaliana] >gi|11994113|dbj|BAB01116.1| CND41, chloroplast nucleoid DNA binding protein-like [Arabidopsis thaliana]
  misc_feature: GI Number: 50901910; NR Description: nucleoid DNA-binding protein cnd41-like protein [Oryza sativa (japonica cultivar-group)] >gi|15290061|dbj|BAB63755.1| nucleoid DNA-binding protein
  misc_feature: GI Number: 21594980; NR Description: chloroplast nucleoid DNA
CACGGGCGCCTGCCTCTACGAGGTGGCCTACGGCGACGGCTCCTACACCGTGGGCGACTTCGCCACCGAGACGCTCACGCTGGGGGACTCCACCCCGGTCGGCAACGTCGCCATCGGGTGCGGCCACGACAACGAGGGCCTCTTCGTCGGCGCCGCGGGGCTGCTGGCGCTGGGCGGCGGGCCGCTCTCCTTCCCGTCCCAGATCTCCGCGTCCACCTTCTCCTACTGCCTCGTGGACCGCGACTCCCCGGCCGCGTCCACGCTCCAGTTCGGCGACGGCGCCGCCGAGGCGGGCACCGTGACGGCGCCTCTCGTGCGCAGCCCGCGCACGAGCACCTTCTACTACGTGGCGCTGTCGGGCATCTCGGTGGGCGGGCAGCCGCTGTCCATCCCGGCATCCGCCTTCGCCATGGACGCCACGTCGGGCTCGGGCGGCGTCATCGTGGACTCCGGCACCGCCGTGACGCGGCTCCAGTCCGCCGCCTACGCGGCGCTCCGCGACGCCTTCGTCCAGGGCGCGCCGTCGCTTCCCCGGACCTCCGGGGTGTCGCTGTTCGACACGTGCTACGACCTGTCGGACCGGACGAGCGTGGAGGTGCCCGCGGTGTCGCTGCGGTTCGAGGGCGGCGGCGCGCTGCGGCTGCCGGCGAAGAACTACCTGATCCCCGTGGACGGAGCCGGCACCTACTGCCTGGCCTTCGCGCCGACGAACGCGGCCGTGTCCATCATCGGGAACGTGCAGCAGCAGGGCACCCGCGTCAGCTTCGACACCGCCAGGGGCGCCGTCGGCTTCACCCCCAACAAGTGCTAGCCTAGCCTAGCCTAAGCCTGCCTTCTGGCCCTGTTAGCCACGGTTGTCAGTAGTAATGACAAGCCGGTGTTTAATTAGCGGGAGAATGATTAGATGGGGGGTAATTAAGCGGTGGGCCCTGCCGGGTCTGGGGAGGAGCGAAAGGCAAAGGCGAGGACAGATGATGCCATTGCCATGCCAGCCTGTGTCCGGCCGATGGGTCCAGCTCCAGCAGTGTTTCTCTCTTTCTCTCGAGTATGCGTGCGTGGAGCCTTGTCATGACGAATTAGATCGTGGGGGCTCCCAAGTTAAGAGTATTTATTTTTATTTTATTTGCTATGTCAAGAAAATGGAAGTTTCCATCC

SEQ ID NO: 645 - DNA, 1379 bp, Zea mays
  misc_feature (1)..(1379): Ceres cDNA ID no. 12353653
  misc_feature (1)..(1379): Ceres CLONE  ID no. 243558
  misc_feature (1)..(1379): Also known as  Ceres CDNA ID no. 23783157
cccagctagacctacagaaaaaaaactctaaaatagttgttggtaaaccagcaggtgagcagtcgaacatcgtggccgcctctgctcagcccagatctccgatggccaccgcacccgccgccccgccgccggcctccgcggacgacgagatcatctacgagtccatgccctgcatccgcgtctacaaggaccgcgtggagcgctacttcggcaccgagttcgtcgccgcctcgacgaacgactccaccggcgtggcctccagggacgtcgtcatctcccccaacgtctccgcgcgcctctacctcccgcgcctggacgacgggaacgccaagctccccatcttcgtctactaccacggcggcggcttctgcatcggctccgccttcaaccccatcttccacgactacttcaactgcctcgtggccctcgccgacatcctcgtcgtctccgtcgagtaccgcctcgccccggagcaccccgtccccgccgcctacgccgactcctgggaagcgctcgcctgggtcatctctcacctcggccccgccggcgacggcgcccgggacccgtggatcgcgagccacgccgacttctcccgcctcttcctgggcggcgagagcgcgggctccaacatcgcgcaccacatggcgatgcgcgctgccgcggaggggctggcccacggcgcccggatccggggactcgtcatgatccacccctacttcctgggcacggacaaggtgccctccgacgacctcagcccggaggtgcgcgagagcctggggtccctgtggcgcttcatgtgcccgaccaccacgggggaggacgacccgctcatcaaccccttcgttgacggcgccccgccgctagcgtccctgccgtgcggccgcgtgctcgtgtgcatcggcgagggcgacgtcctccgcgaccgcggccgcgcctactacgaccggctcagggccagcgggtggcccggcaaggcagagatttggcaggcgcccggcaagggacacacgttccacctcctggatccgtgctgcgacgaggccatcgcgcaggataaagtcatcagctacttcctcagccactgactcgcctcgcgtcctcgccggtggtggtggcgttgttgggcttggatcaaaattagcttctttcatgctggcgctacactacataccttacttctagtacatatcaggttcagagttgtatccgtattctttgaaattggatctcagaatggagctttgcccattgttagtaggcaatggtgttgatgtattgcacctggtaatttggggacgatgatacagtcatagtgtcatacatatgaaattatacttgtttgtcacacagaatttgttgaaacaaatgttccatctttt

SEQ ID NO: 646 - protein, 1379 aa, Zea mays
  misc_feature: PFam Name: Abhydrolase_3; PFam Description: alpha/beta
  misc_feature: PFam Name: Pyr_redox_2; PFam Description: Pyridine
  misc_feature: PFam Name: FH2; PFam Description: Formin Homology 2 Domain
  misc_feature: PFam Name: Peptidase_S8; PFam Description: Subtilase family
  misc_feature: PFam Name: Atrophin-1; PFam Description: Atrophin-1 family
  misc_feature: GI Number: 51535285; NR Description: putative PrMC3 [Oryza
  misc_feature: GI Number: 51535286; NR Description: putative PrMC3 [Oryza
  misc_feature: GI Number: 51091937; NR Description: putative PrMC3 [Oryza sativa (japonica cultivar-group)] >gi|51090387|dbj|BAD35309.1|
  misc_feature: GI Number: 51091934; NR Description: putative PrMC3 [Oryza sativa (japonica cultivar-group)] >gi|51090384|dbj|BAD35306.1|
  misc_feature: GI Number: 51535276; NR Description: putative PrMC3 [Oryza
CCCAGCTAGACCTACAGAAAAAAAACTCTAAAATAGTTGTTGGTAAACCAGCAGGTGAGCAGTCGAACATCGTGGCCGCCTCTGCTCAGCCCAGATCTCCGATGGCCACCGCACCCGCCGCCCCGCCGCCGGCCTCCGCGGACGACGAGATCATCTACGAGTCCATGCCCTGCATCCGCGTCTACAAGGACCGCGTGGAGCGCTACTTCGGCACCGAGTTCGTCGCCGCCTCGACGAACGACTCCACCGGCGTGGCCTCCAGGGACGTCGTCATCTCCCCCAACGTCTCCGCGCGCCTCTACCTCCCGCGCCTGGACGACGGGAACGCCAAGCTCCCCATCTTCGTCTACTACCACGGCGGCGGCTTCTGCATCGGCTCCGCCTTCAACCCCATCTTCCACGACTACTTCAACTGCCTCGTGGCCCTCGCCGACATCCTCGTCGTCTCCGTCGAGTACCGCCTCGCCCCGGAGCACCCCGTCCCCGCCGCCTACGCCGACTCCTGGGAAGCGCTCGCCTGGGTCATCTCTCACCTCGGCCCCGCCGGCGACGGCGCCCGGGACCCGTGGATCGCGAGCCACGCCGACTTCTCCCGCCTCTTCCTGGGCGGCGAGAGCGCGGGCTCCAACATCGCGCACCACATGGCGATGCGCGCTGCCGCGGAGGGGCTGGCCCACGGCGCCCGGATCCGGGGACTCGTCATGATCCACCCCTACTTCCTGGGCACGGACAAGGTGCCCTCCGACGACCTCAGCCCGGAGGTGCGCGAGAGCCTGGGGTCCCTGTGGCGCTTCATGTGCCCGACCACCACGGGGGAGGACGACCCGCTCATCAACCCCTTCGTTGACGGCGCCCCGCCGCTAGCGTCCCTGCCGTGCGGCCGCGTGCTCGTGTGCATCGGCGAGGGCGACGTCCTCCGCGACCGCGGCCGCGCCTACTACGACCGGCTCAGGGCCAGCGGGTGGCCCGGCAAGGCAGAGATTTGGCAGGCGCCCGGCAAGGGACACACGTTCCACCTCCTGGATCCGTGCTGCGACGAGGCCATCGCGCAGGATAAAGTCATCAGCTACTTCCTCAGCCACTGACTCGCCTCGCGTCCTCGCCGGTGGTGGTGGCGTTGTTGGGCTTGGATCAAAATTAGCTTCTTTCATGCTGGCGCTACACTACATACCTTACTTCTAGTACATATCAGGTTCAGAGTTGTATCCGTATTCTTTGAAATTGGATCTCAGAATGGAGCTTTGCCCATTGTTAGTAGGCAATGGTGTTGATGTATTGCACCTGGTAATTTGGGGACGATGATACAGTCATAGTGTCATACATATGAAATTATACTTGTTTGTCACACAGAATTTGTTGAAACAAATGTTCCATCTTTT

SEQ ID NO: 647 - DNA, 1407 bp, Zea mays
  misc_feature (1)..(1407): Ceres cDNA ID no. 12353910
  misc_feature (1)..(1407): Ceres CLONE  ID no. 293869
  misc_feature (1)..(1407): Also known as  Ceres CDNA ID no. 23762011
aaaaaaaactgcgctccgaataccccagacccccgatcctcccaatggccaccgcattttcgctgcgcgctgcggccccggccaccgctccccgcgccgtctcccgatccacctccgcggcgagggtcgtgcccatggcatcggcactggcgggacgcggaaggctggtggcgcgtgcagcagttacagcaaaggcggatgtgccatcgagcacgtccgacggccatgaggtcttgctgtttgaagctcttcgtgaggccttgatggaagagatggaattagatccaacagtgtgtgtgtttggtgaagatgttggccattacggtggttcttacaaggtgacaaaaggtttggctgatacgtttggtgaccttcgagttctggacacccctattgcggagaactcgtttactggcatgggagttggagcgggaatgaaagggctgaggcccgtcgttgaaggcatgaacatgggattcctgctccttgcttacaaccagatctcaaataactgtggcatgcttcattacacttccggcggccagttcaaaatcccacttgtgatccgtggccccggtggtgtgggtcgtcagcttggagcagagcactcgcagcgcctggaatcgtatttccagtccatcccaggcctgcagatggtcgcctgctcgactccttacaacgctaagggcctgatgaaagctgccatcaggagcgagaaccctgtggtgctgtttgagcacgtccttctgtacaacctgaaggagaaaatcccggacgaggagtacgtgctctgcttggaggaggccgagatggtgcggcctggggagcacgtgactatactcacatactcgcgcatgaggtaccacgtgatgcaggcagcgaagacgctggtgaacaaagggtacgatcccgaggtcatcgacatcaggtcgttgaagccgtttgatctgcacactattggcaactccatcaagaagacccaccgcgtgctgatcgtggaggagtgcatgcgcacgggtgggatcggcgccagccttaggtcggccatcgtcgacaatttctgggactaccttgacgcccccatcatgtgcctgtcatctcaggatgtgcctacgccatatgctgcgactctggaggatgcaaccgttgtgcagcctgcccagatcgtggctgcggtggaacaactatgtgcatagattgtggcctgggacgtttgggagactgttgttgccatgaaaaagccttccgtttgttagttttgtgctgtaacaagcattctttggagacttaaggtgtaggcttatagtcgttttgttcttgttttaagaagtataatccagcttcgtagctgcacggactcgatcttcttgttcctaaatctgcgctatgcaatgccgaatttgatgc

SEQ ID NO: 648 - protein, 1407 aa, Zea mays
  misc_feature: PFam Name: Transket_pyr; PFam Description: Transketolase,
  misc_feature: PFam Name: Transketolase_C; PFam Description: Transketolase,
  misc_feature: GI Number: 20334776; NR Description: At1g30120/T2H7_8 [Arabidopsis thaliana] >gi|13605515|gb|AAK32751.1| At1g30120/T2H7_8 [Arabidopsis thaliana] >gi|12321636|gb|AAG50862.1| pyruvate dehydrogenase E1 beta
  misc_feature: GI Number: 22416925; NR Description: beta subunit of pyruvate dehydrogenase E1 component [Chaetosphaeridium globosum] >gi|22711921|ref|NP_683783.1| pyruvate dehydrogenase E1 component
  misc_feature: GI Number: 21593379; NR Description: putative pyruvate
  misc_feature: GI Number: 3128205; NR Description: putative pyruvate dehydrogenase E1 beta subunit [Arabidopsis thaliana] >gi|5702375|gb|AAD47282.1| putative pyruvate dehydrogenase beta subunit [Arabidopsis thaliana] >gi|15226781|ref|NP_181006.1|
  misc_feature: GI Number: 2454184; NR Description: pyruvate dehydrogenase E1 beta subunit [Arabidopsis thaliana] >gi|21593321|gb|AAM65270.1| pyruvate dehydrogenase E1 beta subunit, putative [Arabidopsis
AAAAAAAACTGCGCTCCGAATACCCCAGACCCCCGATCCTCCCAATGGCCACCGCATTTTCGCTGCGCGCTGCGGCCCCGGCCACCGCTCCCCGCGCCGTCTCCCGATCCACCTCCGCGGCGAGGGTCGTGCCCATGGCATCGGCACTGGCGGGACGCGGAAGGCTGGTGGCGCGTGCAGCAGTTACAGCAAAGGCGGATGTGCCATCGAGCACGTCCGACGGCCATGAGGTCTTGCTGTTTGAAGCTCTTCGTGAGGCCTTGATGGAAGAGATGGAATTAGATCCAACAGTGTGTGTGTTTGGTGAAGATGTTGGCCATTACGGTGGTTCTTACAAGGTGACAAAAGGTTTGGCTGATACGTTTGGTGACCTTCGAGTTCTGGACACCCCTATTGCGGAGAACTCGTTTACTGGCATGGGAGTTGGAGCGGGAATGAAAGGGCTGAGGCCCGTCGTTGAAGGCATGAACATGGGATTCCTGCTCCTTGCTTACAACCAGATCTCAAATAACTGTGGCATGCTTCATTACACTTCCGGCGGCCAGTTCAAAATCCCACTTGTGATCCGTGGCCCCGGTGGTGTGGGTCGTCAGCTTGGAGCAGAGCACTCGCAGCGCCTGGAATCGTATTTCCAGTCCATCCCAGGCCTGCAGATGGTCGCCTGCTCGACTCCTTACAACGCTAAGGGCCTGATGAAAGCTGCCATCAGGAGCGAGAACCCTGTGGTGCTGTTTGAGCACGTCCTTCTGTACAACCTGAAGGAGAAAATCCCGGACGAGGAGTACGTGCTCTGCTTGGAGGAGGCCGAGATGGTGCGGCCTGGGGAGCACGTGACTATACTCACATACTCGCGCATGAGGTACCACGTGATGCAGGCAGCGAAGACGCTGGTGAACAAAGGGTACGATCCCGAGGTCATCGACATCAGGTCGTTGAAGCCGTTTGATCTGCACACTATTGGCAACTCCATCAAGAAGACCCACCGCGTGCTGATCGTGGAGGAGTGCATGCGCACGGGTGGGATCGGCGCCAGCCTTAGGTCGGCCATCGTCGACAATTTCTGGGACTACCTTGACGCCCCCATCATGTGCCTGTCATCTCAGGATGTGCCTACGCCATATGCTGCGACTCTGGAGGATGCAACCGTTGTGCAGCCTGCCCAGATCGTGGCTGCGGTGGAACAACTATGTGCATAGATTGTGGCCTGGGACGTTTGGGAGACTGTTGTTGCCATGAAAAAGCCTTCCGTTTGTTAGTTTTGTGCTGTAACAAGCATTCTTTGGAGACTTAAGGTGTAGGCTTATAGTCGTTTTGTTCTTGTTTTAAGAAGTATAATCCAGCTTCGTAGCTGCACGGACTCGATCTTCTTGTTCCTAAATCTGCGCTATGCAATGCCGAATTTGATGC

SEQ ID NO: 649 - DNA, 1125 bp, Zea mays
  misc_feature (1)..(1125): Ceres cDNA ID no. 12353975
  misc_feature (1)..(1125): Ceres CLONE  ID no. 301835
  misc_feature (1)..(1125): Also known as  Ceres CDNA ID no. 23744805
acttgtttccagcatacgtagctagtgcaactgcaagctccggatcctcctcatatcagctataaattaaaaggtcgtgacaggtgaggccgcgccgcgaggaaccgcgtcgaccttgtcgtcgatgttggcttgcaaggcgagcccgagccggccgtgcgtcgtcccccttgtttgcctgctggtggtggcggccgcagtcgtcgtcgtcgctgcctcggcgccgccggcggaggcggcgttcgacgacaactacgtggcgcagtggggtagagatggttatcaccttgtcgtccggggcacggaggcgaatgtcaccatggaccagagctctggtgccgggttccggtccaagtccacgtacggctcagggttcttccacatgaggatgaagctgccctccgggtacacggccggcgtcgtcacgaccttctacctcatctcgcagccggaggatgggagccgcgacgaggtggacttggagttcctgggcgacaaggccggcgtgcccatcaccctccagaccaacgtcttcgtcgacggccgcggcgacagggagcagcggacgcgcctctggttcgaccccgccgccgacttccacgactacaagatcctctggaacccataccagctcgtgatgttcgtggacgacacgccggtccgggtgctgaggaacctgacgggcgccgtgccggggtacccgttcccggggaagcagacgatgctgatccgcgcgagcgtgtgggacggctccgactgggccacggacggcggccggaccaaggtggactggtccaggggccccttcaccgccggctaccggggcttcgacgtcgacggctgcgccaacaacgggagcgacgcgtgccaatcgcccgacctatggtggaacgccgccgagtaccggaacatcaccgcggagcagcgggcggcgtacgaggacgtgaagaggagttacatgaactacgactactgcgccgataaggccaggtttaacagcaccaccgtacccattgaatgcaactacgcttgagaagccagttaggagtggcggcgttgtatatcaacggtttatatatatatattatatatatatacacacacacgaaaaagatatgtcttctc

SEQ ID NO: 650 - protein, 1125 aa, Zea mays
  misc_feature: PFam Name: Glyco_hydro_16; PFam Description: Glycosyl
  misc_feature: PFam Name: XET_C; PFam Description: Xyloglucan
  misc_feature: PFam Name: Mucin; PFam Description: Mucin-like glycoprotein
  misc_feature: PFam Name: Peptidase_S8; PFam Description: Subtilase family
  misc_feature: GI Number: 9293987; NR Description: endoxyloglucan transferase-like protein [Arabidopsis thaliana] >gi|38605497|sp|Q9LJR7|XTH3_ARATH Probable xyloglucan endotransglucosylase/hydrolase protein 3 precursor (At-XTH3)
  misc_feature: GI Number: 7268010; NR Description: endoxyloglucan transferase-like protein [Arabidopsis thaliana] >gi|5123949|emb|CAB45507.1| endoxyloglucan transferase-like protein
  misc_feature: GI Number: 22328589; NR Description: xyloglucan:xyloglucosyl transferase, putative / xyloglucan endotransglycosylase, putative /
  misc_feature: GI Number: 7268011; NR Description: endoxyloglucan transferase-like protein [Arabidopsis thaliana] >gi|5123950|emb|CAB45508.1| endoxyloglucan transferase-like protein
  misc_feature: GI Number: 1885310; NR Description: Endoxyloglucan
ACTTGTTTCCAGCATACGTAGCTAGTGCAACTGCAAGCTCCGGATCCTCCTCATATCAGCTATAAATTAAAAGGTCGTGACAGGTGAGGCCGCGCCGCGAGGAACCGCGTCGACCTTGTCGTCGATGTTGGCTTGCAAGGCGAGCCCGAGCCGGCCGTGCGTCGTCCCCCTTGTTTGCCTGCTGGTGGTGGCGGCCGCAGTCGTCGTCGTCGCTGCCTCGGCGCCGCCGGCGGAGGCGGCGTTCGACGACAACTACGTGGCGCAGTGGGGTAGAGATGGTTATCACCTTGTCGTCCGGGGCACGGAGGCGAATGTCACCATGGACCAGAGCTCTGGTGCCGGGTTCCGGTCCAAGTCCACGTACGGCTCAGGGTTCTTCCACATGAGGATGAAGCTGCCCTCCGGGTACACGGCCGGCGTCGTCACGACCTTCTACCTCATCTCGCAGCCGGAGGATGGGAGCCGCGACGAGGTGGACTTGGAGTTCCTGGGCGACAAGGCCGGCGTGCCCATCACCCTCCAGACCAACGTCTTCGTCGACGGCCGCGGCGACAGGGAGCAGCGGACGCGCCTCTGGTTCGACCCCGCCGCCGACTTCCACGACTACAAGATCCTCTGGAACCCATACCAGCTCGTGATGTTCGTGGACGACACGCCGGTCCGGGTGCTGAGGAACCTGACGGGCGCCGTGCCGGGGTACCCGTTCCCGGGGAAGCAGACGATGCTGATCCGCGCGAGCGTGTGGGACGGCTCCGACTGGGCCACGGACGGCGGCCGGACCAAGGTGGACTGGTCCAGGGGCCCCTTCACCGCCGGCTACCGGGGCTTCGACGTCGACGGCTGCGCCAACAACGGGAGCGACGCGTGCCAATCGCCCGACCTATGGTGGAACGCCGCCGAGTACCGGAACATCACCGCGGAGCAGCGGGCGGCGTACGAGGACGTGAAGAGGAGTTACATGAACTACGACTACTGCGCCGATAAGGCCAGGTTTAACAGCACCACCGTACCCATTGAATGCAACTACGCTTGAGAAGCCAGTTAGGAGTGGCGGCGTTGTATATCAACGGTTTATATATATATATTATATATATATACACACACACGAAAAAGATATGTCTTCTC

SEQ ID NO: 651 - DNA, 2052 bp, Zea mays
  misc_feature (1)..(2052): Ceres cDNA ID no. 12354033
  misc_feature (1)..(2052): Ceres CLONE  ID no. 313748
  misc_feature (1)..(2052): Also known as  Ceres CDNA ID no. 23782198
agactctctctcgcgtcgggcacgcagtcgcacaagtagtgaactcaaacgggatctcctgctctgcctccctcgtcttcctctgcccgtgcgcgtttcagagcacgtacggagagggcgagcagcagcttgcggccgggcaccatcatggaggacgtcgcgccgggtgcggagccgtgggaggggtacgtggactggaggaaccggccggcgaccaggtcccggcacggcggcatggccgccgcctccttcgtgctcgtggtggaggtgctggagaacctggcgttcctggcgaacgccagcaacctggtgacctacctgatggggttcatgcactactcgccgtcgcagtcggccacggcggtcaccaacttcatgggcacggccttcctgctcgcgctcctcggcggcttcctctccgacgccttcttcaccacctacaccatctacatcgccagcgccttcatcgagctcatggggctggtgatcctgacggtccaggcgcggacgcagtcgctgatgccaccgcagtgcgccaagccagcggctccgtgcgagcccgtgtcgggcgccaagaaggcgatgctgttcgcggggctgtacctcacggcgctgggcgtgggcgggatcaagggctccctcccctcccacggcgcggagcagttcgacgagcatgcggcgcgggggcgcaagggccgctccaccttcttcaactacttcgtcttctgcctctcctgcggcgccctcgtcgccgtcaccttcgccgtctgggtcgaggacaacaagggctggcagtgggggttcggcatctccaccatcgccatcctgctctccatcccgctcttcgtcgccggctccagccgctaccggaacaaggtgcccacggggagcccgctcaccaccatcgccaaggtcctcatcgccgccgcgctcgcgcgccgcggctgcgcgccgagctccagcaacggcgccgtcatcgaccgcgcgcccagccccacggggagcaccgacatgaaagagtactgcaagcccggggacatggaggagatcacggtctccggcgccgcgatcgtggcgtcgtcgcccgccgagccgtcccgcgaactcgcgttcctcaaccgcgcggtgcagtgccagccgccgcggcacggccgcctggcgtgcacggtccaggaggtggaggacgtcaagatcgtgctcatggtgctgcccatcttcttgtccaccatcatgctcaactgctgcctggcgcagctgtccaccttctcggtcgagcaagcggccaccatggacacgcgcgtgggcagcctcaccgtgccgccggcgtcgctccccgtcttccctgtcacgttcatcatcatcctcgcgcccgtctacgatcacgtcatcgtcccgttcgcgcgccgcgtcacggggaccgagatgggcatcacacacctccagcgtatcggcaccgggctggtgctgtccatcgtcgcgatggccgtggccgccgtcgtcgaggtcaagcgcaagaacgtggcgtcccacaacgggatgctggactccaccaagccgctgcccatcaccttcttctggatcgcgttccagtacctgttcctgggttccgcggacctgttcacgttggcggggctgctcgagttcttcttcagcgaggcgccggcgcggatgagatccctggcgacgtcgctgtcgtgggcgtcgctggcgctgggttattacctcagctcggtgctggtgtccatcgtcaacagcgtgacagggcgcggcgaccaccggccgtggctgcagggtgccagcctgaaccattaccacctcgagaggttctactgggtcatgtgcgtgctcagcaccatcaactacctcttcttcctgttcttggccgtcaggtacaagtacagaaacgcgggggtcatcaaaggctaatgccatcttcatatggccagtcggcgttgccattaatccccgtggtcttgagcaatgctgggtgtaactaactgtttatataggtggaaaacagagggttgaagaaaatgtaggttaattttctgc

SEQ ID NO: 652 - protein, 2052 aa, Zea mays
  misc_feature: PFam Name: PTR2; PFam Description: POT family
  misc_feature: PFam Name: Pyr_redox_2; PFam Description: Pyridine
  misc_feature: PFam Name: APC_basic; PFam Description: APC basic domain
  misc_feature: PFam Name: FH2; PFam Description: Formin Homology 2 Domain
  misc_feature: PFam Name: Pkinase; PFam Description: Protein kinase domain
  misc_feature: GI Number: 27311911; NR Description: nitrate transporter (NTL1) [Arabidopsis thaliana] >gi|17064754|gb|AAL32531.1| nitrate
  misc_feature: GI Number: 10177451; NR Description: nitrate transporter NTL1
  misc_feature: GI Number: 25403281; NR Description: protein T7N9.10 [imported] - Arabidopsis thaliana >gi|42571657|ref|NP_973919.1| nitrate transporter, putative [Arabidopsis thaliana]
  misc_feature: GI Number: 15241938; NR Description: proton-dependent
  misc_feature: GI Number: 23397158; NR Description: putative nitrate transporter (NTL1) [Arabidopsis thaliana] >gi|18409382|ref|NP_564978.1| nitrate transporter (NTL1)
  misc_feature: Utility: Useful for making plants tolerant to low nitrogen
  misc_feature: Utility: Useful for making plants with enhanced tolerance to
AGACTCTCTCTCGCGTCGGGCACGCAGTCGCACAAGTAGTGAACTCAAACGGGATCTCCTGCTCTGCCTCCCTCGTCTTCCTCTGCCCGTGCGCGTTTCAGAGCACGTACGGAGAGGGCGAGCAGCAGCTTGCGGCCGGGCACCATCATGGAGGACGTCGCGCCGGGTGCGGAGCCGTGGGAGGGGTACGTGGACTGGAGGAACCGGCCGGCGACCAGGTCCCGGCACGGCGGCATGGCCGCCGCCTCCTTCGTGCTCGTGGTGGAGGTGCTGGAGAACCTGGCGTTCCTGGCGAACGCCAGCAACCTGGTGACCTACCTGATGGGGTTCATGCACTACTCGCCGTCGCAGTCGGCCACGGCGGTCACCAACTTCATGGGCACGGCCTTCCTGCTCGCGCTCCTCGGCGGCTTCCTCTCCGACGCCTTCTTCACCACCTACACCATCTACATCGCCAGCGCCTTCATCGAGCTCATGGGGCTGGTGATCCTGACGGTCCAGGCGCGGACGCAGTCGCTGATGCCACCGCAGTGCGCCAAGCCAGCGGCTCCGTGCGAGCCCGTGTCGGGCGCCAAGAAGGCGATGCTGTTCGCGGGGCTGTACCTCACGGCGCTGGGCGTGGGCGGGATCAAGGGCTCCCTCCCCTCCCACGGCGCGGAGCAGTTCGACGAGCATGCGGCGCGGGGGCGCAAGGGCCGCTCCACCTTCTTCAACTACTTCGTCTTCTGCCTCTCCTGCGGCGCCCTCGTCGCCGTCACCTTCGCCGTCTGGGTCGAGGACAACAAGGGCTGGCAGTGGGGGTTCGGCATCTCCACCATCGCCATCCTGCTCTCCATCCCGCTCTTCGTCGCCGGCTCCAGCCGCTACCGGAACAAGGTGCCCACGGGGAGCCCGCTCACCACCATCGCCAAGGTCCTCATCGCCGCCGCGCTCGCGCGCCGCGGCTGCGCGCCGAGCTCCAGCAACGGCGCCGTCATCGACCGCGCGCCCAGCCCCACGGGGAGCACCGACATGAAAGAGTACTGCAAGCCCGGGGACATGGAGGAGATCACGGTCTCCGGCGCCGCGATCGTGGCGTCGTCGCCCGCCGAGCCGTCCCGCGAACTCGCGTTCCTCAACCGCGCGGTGCAGTGCCAGCCGCCGCGGCACGGCCGCCTGGCGTGCACGGTCCAGGAGGTGGAGGACGTCAAGATCGTGCTCATGGTGCTGCCCATCTTCTTGTCCACCATCATGCTCAACTGCTGCCTGGCGCAGCTGTCCACCTTCTCGGTCGAGCAAGCGGCCACCATGGACACGCGCGTGGGCAGCCTCACCGTGCCGCCGGCGTCGCTCCCCGTCTTCCCTGTCACGTTCATCATCATCCTCGCGCCCGTCTACGATCACGTCATCGTCCCGTTCGCGCGCCGCGTCACGGGGACCGAGATGGGCATCACACACCTCCAGCGTATCGGCACCGGGCTGGTGCTGTCCATCGTCGCGATGGCCGTGGCCGCCGTCGTCGAGGTCAAGCGCAAGAACGTGGCGTCCCACAACGGGATGCTGGACTCCACCAAGCCGCTGCCCATCACCTTCTTCTGGATCGCGTTCCAGTACCTGTTCCTGGGTTCCGCGGACCTGTTCACGTTGGCGGGGCTGCTCGAGTTCTTCTTCAGCGAGGCGCCGGCGCGGATGAGATCCCTGGCGACGTCGCTGTCGTGGGCGTCGCTGGCGCTGGGTTATTACCTCAGCTCGGTGCTGGTGTCCATCGTCAACAGCGTGACAGGGCGCGGCGACCACCGGCCGTGGCTGCAGGGTGCCAGCCTGAACCATTACCACCTCGAGAGGTTCTACTGGGTCATGTGCGTGCTCAGCACCATCAACTACCTCTTCTTCCTGTTCTTGGCCGTCAGGTACAAGTACAGAAACGCGGGGGTCATCAAAGGCTAATGCCATCTTCATATGGCCAGTCGGCGTTGCCATTAATCCCCGTGGTCTTGAGCAATGCTGGGTGTAACTAACTGTTTATATAGGTGGAAAACAGAGGGTTGAAGAAAATGTAGGTTAATTTTCTGC

SEQ ID NO: 653 - DNA, 1413 bp, Zea mays
  misc_feature (1)..(1413): Ceres cDNA ID no. 12354086
  misc_feature (1)..(1413): Ceres CLONE  ID no. 316686
  misc_feature (1)..(1413): Also known as  Ceres CDNA ID no. 23782546
cacccaaaagcgagagccgtgggctggtggctgctgaccaaaacgaagtccctcgccgccgcttcccgaaatcccccaaatccggagccaatgccgccgtcccctcccaccccggcggcacccaaaactatcgccgacttcttcgcgcgccccgccaagcgcctgtgcgctgccccggccgcctccctctcctccaactcctctccctcctcgctgtcgccggagcagcgccgtcgcgccgacaccaacctggcgctcgcccgcgcgcggcgcaacctccgcctcgccgagtccaaagcgcaagcatcggggggcgcaccgaagctggaggagctcctggtggaggacacgtgggcggaggcgcttcgtggtgagctgcgcaagtcatacgcgctcgagctctgccgcttcgtggcccacgagaggctccacggcccgctgcccgtgtacccgccgccgcacctcgtgttccacgcgctcaacgccaccccgttcgaccgtgtcaaggcagtcatcatcggtcaggatccataccatggccctggtcaggccatggggttgtctttctcagtaccggaggggataaaaataccttctagcttaggtaacatttttaaagagctcaaaaaagacctaggctgcactgtgccatcacatggaaatttggaaagatgggctgtgcagggtgttcttatgctcaataccgtcctaactgtgagggagcatcaagccaactcacatgccaagaaaggatgggagcagtttacggatgaggtcattaagactgtatcacaaaagaaatcaggattagtattccttctttggggaaattctgctcaatctaagacaagattgattgacgaaacaaaacatcacatattgaaatctgctcatccatcaggtctgtctgcaaacaggggtttctttggatgcaggcacttctccaaaacaaaccagatcttagagaagctggggctgtctgccatcgattggcagctctagaaaaatcccaagacgacatgtgatttctctgtttgagtttgacaaccaccgttgctgtatggagtggagcagaagcacatgcctcaaggccatcctactcggtcaagattttgtggcgactaaagttattattcatacatggccgatatggatgtgagtgcttaacgcttcttttgtgtcgtgtcttatcctgctttatttacttttgccctgtaccagcttgttgcggccattgtggttgtcgtgcgtacgtcaaatactttgcttggcgctaggacacgcccattcgggctgtcttgctagatctaagcatctgacgtactagagcttaaccaaccaccctgcacgtacatgtttttaaccgccatatatatatatgcataaagggcctgcctctacggctctaccttc

SEQ ID NO: 654 - protein, 1413 aa, Zea mays
  misc_feature: PFam Name: UDG; PFam Description: Uracil DNA glycosylase
  misc_feature: PFam Name: Extensin_2; PFam Description: Extensin-like region
  misc_feature: GI Number: 21537176; NR Description: uracil-DNA glycosylase, putative [Arabidopsis thaliana] >gi|9294324|dbj|BAB02221.1| uracil-DNA glycosylase-like protein [Arabidopsis thaliana] >gi|15230152|ref|NP_188493.1| uracil DNA glycosylase family
  misc_feature: GI Number: 53611343; NR Description: COG0692: Uracil DNA
  misc_feature: GI Number: 48729760; NR Description: COG0692: Uracil DNA
  misc_feature: GI Number: 26988146; NR Description: uracil-DNA glycosylase [Pseudomonas putida KT2440] >gi|24982878|gb|AAN67035.1| uracil-DNA glycosylase [Pseudomonas putida KT2440]
  misc_feature: GI Number: 19718751; NR Description: uracil-DNA glycosylase isoform UNG2; uracil-DNA glycosylase 1 [Homo sapiens] >gi|37999897|sp|P13051|UNG_HUMAN Uracil-DNA glycosylase (UDG) >gi|1654005|emb|CAA61578.1| uracil-DNA-glycosylase, UNG2 [Homo
CACCCAAAAGCGAGAGCCGTGGGCTGGTGGCTGCTGACCAAAACGAAGTCCCTCGCCGCCGCTTCCCGAAATCCCCCAAATCCGGAGCCAATGCCGCCGTCCCCTCCCACCCCGGCGGCACCCAAAACTATCGCCGACTTCTTCGCGCGCCCCGCCAAGCGCCTGTGCGCTGCCCCGGCCGCCTCCCTCTCCTCCAACTCCTCTCCCTCCTCGCTGTCGCCGGAGCAGCGCCGTCGCGCCGACACCAACCTGGCGCTCGCCCGCGCGCGGCGCAACCTCCGCCTCGCCGAGTCCAAAGCGCAAGCATCGGGGGGCGCACCGAAGCTGGAGGAGCTCCTGGTGGAGGACACGTGGGCGGAGGCGCTTCGTGGTGAGCTGCGCAAGTCATACGCGCTCGAGCTCTGCCGCTTCGTGGCCCACGAGAGGCTCCACGGCCCGCTGCCCGTGTACCCGCCGCCGCACCTCGTGTTCCACGCGCTCAACGCCACCCCGTTCGACCGTGTCAAGGCAGTCATCATCGGTCAGGATCCATACCATGGCCCTGGTCAGGCCATGGGGTTGTCTTTCTCAGTACCGGAGGGGATAAAAATACCTTCTAGCTTAGGTAACATTTTTAAAGAGCTCAAAAAAGACCTAGGCTGCACTGTGCCATCACATGGAAATTTGGAAAGATGGGCTGTGCAGGGTGTTCTTATGCTCAATACCGTCCTAACTGTGAGGGAGCATCAAGCCAACTCACATGCCAAGAAAGGATGGGAGCAGTTTACGGATGAGGTCATTAAGACTGTATCACAAAAGAAATCAGGATTAGTATTCCTTCTTTGGGGAAATTCTGCTCAATCTAAGACAAGATTGATTGACGAAACAAAACATCACATATTGAAATCTGCTCATCCATCAGGTCTGTCTGCAAACAGGGGTTTCTTTGGATGCAGGCACTTCTCCAAAACAAACCAGATCTTAGAGAAGCTGGGGCTGTCTGCCATCGATTGGCAGCTCTAGAAAAATCCCAAGACGACATGTGATTTCTCTGTTTGAGTTTGACAACCACCGTTGCTGTATGGAGTGGAGCAGAAGCACATGCCTCAAGGCCATCCTACTCGGTCAAGATTTTGTGGCGACTAAAGTTATTATTCATACATGGCCGATATGGATGTGAGTGCTTAACGCTTCTTTTGTGTCGTGTCTTATCCTGCTTTATTTACTTTTGCCCTGTACCAGCTTGTTGCGGCCATTGTGGTTGTCGTGCGTACGTCAAATACTTTGCTTGGCGCTAGGACACGCCCATTCGGGCTGTCTTGCTAGATCTAAGCATCTGACGTACTAGAGCTTAACCAACCACCCTGCACGTACATGTTTTTAACCGCCATATATATATATGCATAAAGGGCCTGCCTCTACGGCTCTACCTTC

SEQ ID NO: 655 - DNA, 1234 bp, Zea mays
  misc_feature (1)..(1234): Ceres cDNA ID no. 12354115
  misc_feature (1)..(1234): Ceres CLONE  ID no. 321562
  misc_feature (1)..(1234): Also known as  Ceres CDNA ID no. 23765858
acccaaaaccagaattaattatctgacggtgcatgccatgcccatgacacccctcgagtgcgacatggcccctgcagcttctcgccagtcgtggcctcttcctcgctgcggcctgctggtcttggcccttgcactggcgacgaccgccgcggtgggcagcgcgcagctgtcgtcggagagctactacgacgcgtcctgccccgccgcccttctcaccatcaggaccgccgtctcgacggccgtgctgctggagccccgcatgggggcctcccttctccgcctccacttccacgactgtttcgtgcagggttgcgacgcgtcggtgctgctagacgacacggcgagcttcaccggcgagaagggggcggggccgaacgcggggtcgctccggggcttcgacgtgatcgacaacatcaagatgctgctggagctgctgtgccccgcagaccgtctcctgcgccgacatcctcgccgtcgccgcccgcgactcggttgcacaactgggaggaccatcgtgggcggttccgctgggcaggagggacgcgaccacggcgagcgcgtccctggccaacagtgacctccctgggcctaccagcagcctcaacggcctgctcaacgctttctccaacaagggtttgagcagcaccgacatggttgccctctcaggtgcccacaccgtcggccgggcgcagtgcaagaactgccgggcccggatctacaacgacaccgacatcgacgcctccttcgcggcgtcgctgcgggccagctgtcccgcgcaggccggcgccggcgacggcgcgctcgagccgctcgacggctccacgccggacgccttcgacaacgcctacttcggcaacctgctctcccagcgcggcctgctccactccgaccaggcgctcttcggcggcggcggcggcggcgcgactgacggcctggtcagcgcctacgcgtccaacgccggccagtggggggccgacttcgcggcggccatggtcaagatgggcagcatcagcccgctcaccggcacggacggcgagatcagggtcaactgccggagagtgaattaattatttattacagccacgttgattgcatttgctcttggggtagtggactagcgtgcatattttgcaaagaggcagagaagaattgaaatggagcctaagctcatatgtatacaaatgttgtttattattccatattatttcttgcatatataatatatatagcatac

SEQ ID NO: 656 - protein, 1234 aa, Zea mays
  misc_feature: PFam Name: peroxidase; PFam Description: Peroxidase
  misc_feature: PFam Name: Peptidase_S8; PFam Description: Subtilase family
  misc_feature: PFam Name: Pkinase; PFam Description: Protein kinase domain
  misc_feature: GI Number: 50939965; NR Description: putative peroxidase precursor [Oryza sativa (japonica cultivar-group)] >gi|34393249|dbj|BAC83101.1| putative peroxidase precursor [Oryza
  misc_feature: GI Number: 55701085; NR Description: TPA: class III
  misc_feature: GI Number: 732976; NR Description: peroxidase [Triticum aestivum] >gi|2117619|pir||S61408 peroxidase (EC 1.11.1.7) 4
  misc_feature: GI Number: 50939971; NR Description: peroxidase [Oryza sativa (japonica cultivar-group)] >gi|585662|sp|P37835|PER2_ORYSA Peroxidase 2 precursor >gi|7433040|pir||T03929 peroxidase (EC 1.11.1.7) - rice >gi|303851|dbj|BAA03911.1| peroxidase [Oryza
  misc_feature: GI Number: 2429292; NR Description: peroxidase [Oryza sativa]
ACCCAAAACCAGAATTAATTATCTGACGGTGCATGCCATGCCCATGACACCCCTCGAGTGCGACATGGCCCCTGCAGCTTCTCGCCAGTCGTGGCCTCTTCCTCGCTGCGGCCTGCTGGTCTTGGCCCTTGCACTGGCGACGACCGCCGCGGTGGGCAGCGCGCAGCTGTCGTCGGAGAGCTACTACGACGCGTCCTGCCCCGCCGCCCTTCTCACCATCAGGACCGCCGTCTCGACGGCCGTGCTGCTGGAGCCCCGCATGGGGGCCTCCCTTCTCCGCCTCCACTTCCACGACTGTTTCGTGCAGGGTTGCGACGCGTCGGTGCTGCTAGACGACACGGCGAGCTTCACCGGCGAGAAGGGGGCGGGGCCGAACGCGGGGTCGCTCCGGGGCTTCGACGTGATCGACAACATCAAGATGCTGCTGGAGCTGCTGTGCCCCGCAGACCGTCTCCTGCGCCGACATCCTCGCCGTCGCCGCCCGCGACTCGGTTGCACAACTGGGAGGACCATCGTGGGCGGTTCCGCTGGGCAGGAGGGACGCGACCACGGCGAGCGCGTCCCTGGCCAACAGTGACCTCCCTGGGCCTACCAGCAGCCTCAACGGCCTGCTCAACGCTTTCTCCAACAAGGGTTTGAGCAGCACCGACATGGTTGCCCTCTCAGGTGCCCACACCGTCGGCCGGGCGCAGTGCAAGAACTGCCGGGCCCGGATCTACAACGACACCGACATCGACGCCTCCTTCGCGGCGTCGCTGCGGGCCAGCTGTCCCGCGCAGGCCGGCGCCGGCGACGGCGCGCTCGAGCCGCTCGACGGCTCCACGCCGGACGCCTTCGACAACGCCTACTTCGGCAACCTGCTCTCCCAGCGCGGCCTGCTCCACTCCGACCAGGCGCTCTTCGGCGGCGGCGGCGGCGGCGCGACTGACGGCCTGGTCAGCGCCTACGCGTCCAACGCCGGCCAGTGGGGGGCCGACTTCGCGGCGGCCATGGTCAAGATGGGCAGCATCAGCCCGCTCACCGGCACGGACGGCGAGATCAGGGTCAACTGCCGGAGAGTGAATTAATTATTTATTACAGCCACGTTGATTGCATTTGCTCTTGGGGTAGTGGACTAGCGTGCATATTTTGCAAAGAGGCAGAGAAGAATTGAAATGGAGCCTAAGCTCATATGTATACAAATGTTGTTTATTATTCCATATTATTTCTTGCATATATAATATATATAGCATAC

SEQ ID NO: 657 - DNA, 1675 bp, Zea mays
  misc_feature (1)..(1675): Ceres cDNA ID no. 12354295
  misc_feature (1)..(1675): Ceres CLONE  ID no. 325356
  misc_feature (1)..(1675): Also known as  Ceres CDNA ID no. 23792821
atagaacatcctaatcgaaaaattttctggttgcagattgattctttaccatttgtatcgccattcctccctgttcgttgggcgtggggtctcaacctaaaatcagtcccattccgcgctcctagtggagagtggattcgaacggaaacacctttttgtgccccaagatgcctgtttccgcttcgtttccacgccacaccttttgaatcctttgccgtcacctcgccttttgcagcactagttgtttgtcagccttcttggagtgtggaggggcagagagcgccgtcctgttgattcaggaaaacagtccgagccgatgggcaggaagagcgacggcgcgcggttgcaatgcgctgaggccaaactggcgacggattggacctgctgcttcctggccctgccaccggcagcaccatccgctgtggatggcgatggtggattcaacctctcgtggaacctccaccagtccttccacccgccggccggcttcttcgccagcgtgggccagcaggttggggttgggttcccagggccttcgtcccagtcgccggagacgccacgggacccatacatgaagtacgtctcgccggaggttgttgtgacacctctgccgagggaaggcgtggtggggttgagggacaaggggaagaagaaagtcgtgaagctcaagattaaggttgggaatcatcacctcaagagactgatcagtggagcaatcgcaggcgcagtgtcaagaactgctgttgcacctttggagacgatcaggacgcatttgatggtgggaagtaatgggaattcgacgacggaggtgttccagtctatcatgaagcatgagggatggactgggttgttccgtggtaacgttgttaatgtcatccgggtagccccaagcaaggcaatcgagctttttgcctttgatacagctaataagttcttgacccccaaatatggggagaaaccgaagatcccagtccctccttcactagtggctggggcatttgccggtgttagctcaactctgtgtacatacccactggaattaattaagacacggctaactatacagagaggcgtgtatgacaatttccttgatgcatttgtcaaaatcatccgcgacgaagggccttctgagctctaccgaggcttaaccccaagcttgattggagtggtgccatatgctgcaacgaactacttcgcctatgacagcctgaagaaggtgtacaagaagatgttcaagacaaatgagattggcagtgttccaacactgttcatcgggtctgccgcaggagctatctcaagcacagcgacgttccctcttgaggtggcacggaagcacatgcaagttggagctgttggtggcaggaaggtttacaagaacatgcttcatgccttgttgagcattcttgaggatgaaggggttgggggcctttacagagggttggggccaagctgcatgaagttggtgcctgctgctgggatttcgttcatgtgctacgaggcttgcaagaagattctgattgaggaagaggatgagtgaagtgtatgcagatcattagaactcagttttgtgacatcctgacagcaggcagcttgaggttactgctgtagtcggcataagttcttaacccctttttgcacccagttttatctgataaactcacctcgttttttcccc

SEQ ID NO: 658 - protein, 1675 aa, Zea mays
  misc_feature: PFam Name: Mito_carr; PFam Description: Mitochondrial
  misc_feature: GI Number: 52353768; NR Description: putative adenylate translocator (Brittle-1) protein [Oryza sativa (japonica
  misc_feature: GI Number: 51090886; NR Description: putative mitochondrial
  misc_feature: GI Number: 4138581; NR Description: mitochondrial energy
  misc_feature: GI Number: 21537158; NR Description: adenylate translocator (brittle-1)-like protein [Arabidopsis thaliana] >gi|7270144|emb|CAB79957.1| adenylate translocator (brittle-1)-like protein [Arabidopsis thaliana]
  misc_feature: GI Number: 47156872; NR Description: plastidial ADP-glucose
ATAGAACATCCTAATCGAAAAATTTTCTGGTTGCAGATTGATTCTTTACCATTTGTATCGCCATTCCTCCCTGTTCGTTGGGCGTGGGGTCTCAACCTAAAATCAGTCCCATTCCGCGCTCCTAGTGGAGAGTGGATTCGAACGGAAACACCTTTTTGTGCCCCAAGATGCCTGTTTCCGCTTCGTTTCCACGCCACACCTTTTGAATCCTTTGCCGTCACCTCGCCTTTTGCAGCACTAGTTGTTTGTCAGCCTTCTTGGAGTGTGGAGGGGCAGAGAGCGCCGTCCTGTTGATTCAGGAAAACAGTCCGAGCCGATGGGCAGGAAGAGCGACGGCGCGCGGTTGCAATGCGCTGAGGCCAAACTGGCGACGGATTGGACCTGCTGCTTCCTGGCCCTGCCACCGGCAGCACCATCCGCTGTGGATGGCGATGGTGGATTCAACCTCTCGTGGAACCTCCACCAGTCCTTCCACCCGCCGGCCGGCTTCTTCGCCAGCGTGGGCCAGCAGGTTGGGGTTGGGTTCCCAGGGCCTTCGTCCCAGTCGCCGGAGACGCCACGGGACCCATACATGAAGTACGTCTCGCCGGAGGTTGTTGTGACACCTCTGCCGAGGGAAGGCGTGGTGGGGTTGAGGGACAAGGGGAAGAAGAAAGTCGTGAAGCTCAAGATTAAGGTTGGGAATCATCACCTCAAGAGACTGATCAGTGGAGCAATCGCAGGCGCAGTGTCAAGAACTGCTGTTGCACCTTTGGAGACGATCAGGACGCATTTGATGGTGGGAAGTAATGGGAATTCGACGACGGAGGTGTTCCAGTCTATCATGAAGCATGAGGGATGGACTGGGTTGTTCCGTGGTAACGTTGTTAATGTCATCCGGGTAGCCCCAAGCAAGGCAATCGAGCTTTTTGCCTTTGATACAGCTAATAAGTTCTTGACCCCCAAATATGGGGAGAAACCGAAGATCCCAGTCCCTCCTTCACTAGTGGCTGGGGCATTTGCCGGTGTTAGCTCAACTCTGTGTACATACCCACTGGAATTAATTAAGACACGGCTAACTATACAGAGAGGCGTGTATGACAATTTCCTTGATGCATTTGTCAAAATCATCCGCGACGAAGGGCCTTCTGAGCTCTACCGAGGCTTAACCCCAAGCTTGATTGGAGTGGTGCCATATGCTGCAACGAACTACTTCGCCTATGACAGCCTGAAGAAGGTGTACAAGAAGATGTTCAAGACAAATGAGATTGGCAGTGTTCCAACACTGTTCATCGGGTCTGCCGCAGGAGCTATCTCAAGCACAGCGACGTTCCCTCTTGAGGTGGCACGGAAGCACATGCAAGTTGGAGCTGTTGGTGGCAGGAAGGTTTACAAGAACATGCTTCATGCCTTGTTGAGCATTCTTGAGGATGAAGGGGTTGGGGGCCTTTACAGAGGGTTGGGGCCAAGCTGCATGAAGTTGGTGCCTGCTGCTGGGATTTCGTTCATGTGCTACGAGGCTTGCAAGAAGATTCTGATTGAGGAAGAGGATGAGTGAAGTGTATGCAGATCATTAGAACTCAGTTTTGTGACATCCTGACAGCAGGCAGCTTGAGGTTACTGCTGTAGTCGGCATAAGTTCTTAACCCCTTTTTGCACCCAGTTTTATCTGATAAACTCACCTCGTTTTTTCCCC

SEQ ID NO: 659 - DNA, 1638 bp, Zea mays
  misc_feature (1)..(1638): Ceres cDNA ID no. 12354359
  misc_feature (1)..(1638): Ceres CLONE  ID no. 324612
  misc_feature (1)..(1638): Also known as  Ceres CDNA ID no. 23793359
acgataccttctcttctccctccattcctttcctttgccccaaccatgccaattggagaggcgtcgagatcttatccctcgatccaattccaaacagaaaccgccggagctggaacaagagccgctcgcagcttgctggactctcccgctcctggccccggagccgccggccatggccaagcacaagcagcgcagggtgtaccaagtctggaaaggcaaaaacataatactatgtggtggaaggttgatctttggaccagatgccaaggccaccctgatttccttcgccctaatcgccatccctgtccttgtcttctgcgtctttgtggccagacatctcatacacatcttccctgcatataacgcaggatacgcaattcttgctgccaccataggccttaccatttatgtattgtaccacgaaattcacatccacctgtggaagagttctcttatgatgcttcggctccacatgctcttcagttccctcgagtaaaagaggtcatggtcaatggagttcatgtgaaaatgaaatactgtgaaacttgcatgatataccggcctcctcggtgctcgcactgctccaaatgtgataactgtgtcgagcgctttgatcatcactgcccttgggttgggcaatgtattggagagcgaaattaccggtacttcttctgttttgttgcttcagcggcagtgctttgtatctatgtatgtgcaatgtgtggattgtacatcaggcttctcatgaataggggtcattattcggtggggaaagccattaaagaatctccagcttcattggcagtcatggcatattgtttcatttgcttctggttcgtcggtggtctcactgggttccactcttatcttattgtgacaaacaagacaacatatgagaatatcaagtacaagtacagcaaccaaccaaatgtgtatgaccatggttgtgtgctcaactgccatgaggttttgtgcaaaaaaaggaaaccttctaagatcaacctaagagctattgtccaagaagaacaagaggtagcacggccacagaccagctcttccaatatacgagaagatgaggcaccccaccgtccacgagccaaggttgaggatgatctagaaatgggtcttgacatcctcaagaccacagggcgcaggacggataaattcagcgatgaggaattggagcctgcaactggaagcaatggtattgaatatcgcacgccagattcagagactgagattcctgttaccagaactaagacagagatctttaatgaagttagggatctggacttatcggttagtaatggtgcacaatcttcatctcctgaacaagaacagcacccagacaaactttgctgatggaacaaatggtctctctgcatttccgtagtgcagacaccaaattattcaccagggctgtgaatggttggatttgaaggcagatttcctcctttgccgtctgctttcaggatttaagcctttgcttggccaatcatagattcataggtgtgtaaggatcctccagtttgtgcggtttatggaggttctaaaagattctaggaactgtttgagattcttctggtgtgtgaaggctaattgtacataattttcatagctatatgatcactgaaatgt

SEQ ID NO: 660 - protein, 1638 aa, Zea mays
  misc_feature: PFam Name: zf-DHHC; PFam Description: DHHC zinc finger domain
  misc_feature: GI Number: 56784777; NR Description: putative NEW1 domain
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 30688566; NR Description: zinc finger (DHHC type)
  misc_feature: GI Number: 30693084; NR Description: zinc finger (DHHC type)
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
ACGATACCTTCTCTTCTCCCTCCATTCCTTTCCTTTGCCCCAACCATGCCAATTGGAGAGGCGTCGAGATCTTATCCCTCGATCCAATTCCAAACAGAAACCGCCGGAGCTGGAACAAGAGCCGCTCGCAGCTTGCTGGACTCTCCCGCTCCTGGCCCCGGAGCCGCCGGCCATGGCCAAGCACAAGCAGCGCAGGGTGTACCAAGTCTGGAAAGGCAAAAACATAATACTATGTGGTGGAAGGTTGATCTTTGGACCAGATGCCAAGGCCACCCTGATTTCCTTCGCCCTAATCGCCATCCCTGTCCTTGTCTTCTGCGTCTTTGTGGCCAGACATCTCATACACATCTTCCCTGCATATAACGCAGGATACGCAATTCTTGCTGCCACCATAGGCCTTACCATTTATGTATTGTACCACGAAATTCACATCCACCTGTGGAAGAGTTCTCTTATGATGCTTCGGCTCCACATGCTCTTCAGTTCCCTCGAGTAAAAGAGGTCATGGTCAATGGAGTTCATGTGAAAATGAAATACTGTGAAACTTGCATGATATACCGGCCTCCTCGGTGCTCGCACTGCTCCAAATGTGATAACTGTGTCGAGCGCTTTGATCATCACTGCCCTTGGGTTGGGCAATGTATTGGAGAGCGAAATTACCGGTACTTCTTCTGTTTTGTTGCTTCAGCGGCAGTGCTTTGTATCTATGTATGTGCAATGTGTGGATTGTACATCAGGCTTCTCATGAATAGGGGTCATTATTCGGTGGGGAAAGCCATTAAAGAATCTCCAGCTTCATTGGCAGTCATGGCATATTGTTTCATTTGCTTCTGGTTCGTCGGTGGTCTCACTGGGTTCCACTCTTATCTTATTGTGACAAACAAGACAACATATGAGAATATCAAGTACAAGTACAGCAACCAACCAAATGTGTATGACCATGGTTGTGTGCTCAACTGCCATGAGGTTTTGTGCAAAAAAAGGAAACCTTCTAAGATCAACCTAAGAGCTATTGTCCAAGAAGAACAAGAGGTAGCACGGCCACAGACCAGCTCTTCCAATATACGAGAAGATGAGGCACCCCACCGTCCACGAGCCAAGGTTGAGGATGATCTAGAAATGGGTCTTGACATCCTCAAGACCACAGGGCGCAGGACGGATAAATTCAGCGATGAGGAATTGGAGCCTGCAACTGGAAGCAATGGTATTGAATATCGCACGCCAGATTCAGAGACTGAGATTCCTGTTACCAGAACTAAGACAGAGATCTTTAATGAAGTTAGGGATCTGGACTTATCGGTTAGTAATGGTGCACAATCTTCATCTCCTGAACAAGAACAGCACCCAGACAAACTTTGCTGATGGAACAAATGGTCTCTCTGCATTTCCGTAGTGCAGACACCAAATTATTCACCAGGGCTGTGAATGGTTGGATTTGAAGGCAGATTTCCTCCTTTGCCGTCTGCTTTCAGGATTTAAGCCTTTGCTTGGCCAATCATAGATTCATAGGTGTGTAAGGATCCTCCAGTTTGTGCGGTTTATGGAGGTTCTAAAAGATTCTAGGAACTGTTTGAGATTCTTCTGGTGTGTGAAGGCTAATTGTACATAATTTTCATAGCTATATGATCACTGAAATGT

SEQ ID NO: 661 - DNA, 1446 bp, Zea mays
  misc_feature (1)..(1446): Ceres cDNA ID no. 12354451
  misc_feature (1)..(1446): Ceres CLONE  ID no. 327863
  misc_feature (1)..(1446): Also known as  Ceres CDNA ID no. 23767336
acagctcgcgcgcgcaccagacagacgccttctccctctcccgcagtacagggtacagctcgcgctcacacaagacaccatctccctgcctgcgatccgatgcgtccaacgttttcagccggggtacggtcctaccaccgctgtgcctaataattggcggctagctagctagctagctgcagctgctgcgatcctggatcggcacagccggttcttgatgtggagggagcggcggcgggcgctgctcctgctggtggccggcgcggcgctgggactgatcggtgccgcgctcgcgagcgcgccgccggaggccgcgctgaaggtcgggttctaccatgcgacgtgccccatcgcggaggacgtggtcctcgccgagatgaggctcatcctcatggaggacgccacggtcgcgccgtccctgctccggatgcactaccacgactgcttcgtgcagggctgcgacgggtcgatcatgctccagtcgaggaagaaggggaaggcggagcgggacgcgctgcccaaccgtagcatgcgagggttcgacgccatcgagcggatcaaggcccggctcgagaccgtctgcccgctcaccgtctcctgcgccgacatcatcgccatggcggcgagggacgccgtctacctgagccacgggccgtggtacgacgtggagaccgggcggcgcgacggcaacgtcaccgtggccgagtacgtcgacaacgacctgccgccgccggactccaacattgtcgacgtgaagaccttcttcagcgtcaagtcgcttaactcgaaggacatcgccgtcctcttcgggtgccacagcatcgggacctcccactgcggcccgatccagaagcggctctacaacttcaccggcaacatggacggccaggacccgtcgctggacccggcctacgccgccgagctcaggaagctctgcccgcctcccagacccggcgacgatgctaggaaggtcaaggtgcctttggaccccggcagcaactacaccttcgacctgagctactaccgccacgtgctcgccacgggcgggctgttccagtccgacggcagcctcctgcacgaccccgtcaccagaggctacgtcgagaaggtggccaaggcgtcgtcgcccgacgagtactacgcggacttcgccgcggcgatggtcaagatgggccgcaccgacgtgcttgtcggcgatcatggggagatcaggccaacgtgtggcatttttgttgactaggttcaggattgggttgaagatgcgaagataatctgtacgggtttctgtcaacgtgtactgtgcgtgctgttagatcagaaagagcacggtcgctgttaactgtgtatccgggaatgctgttctgttcacacacggtcgtcactgatctactgaattgtcagccatgatgtaattatttatctacgtattagttgtatattcttctc

SEQ ID NO: 662 - protein, 1446 aa, Zea mays
  misc_feature: PFam Name: peroxidase; PFam Description: Peroxidase
  misc_feature: PFam Name: Mucin; PFam Description: Mucin-like glycoprotein
  misc_feature: PFam Name: MAGE; PFam Description: MAGE family
  misc_feature: PFam Name: Cornifin; PFam Description: Cornifin (SPRR) family
  misc_feature: GI Number: 51038055; NR Description: putative peroxidase
  misc_feature: GI Number: 34908760; NR Description: Peroxidase-like protein [Oryza sativa (japonica cultivar-group)] >gi|20161176|dbj|BAB90103.1| putative peroxidase [Oryza sativa
  misc_feature: GI Number: 50933681; NR Description: putative peroxidase 1 precursor [Oryza sativa (japonica cultivar-group)] >gi|22324453|dbj|BAC10368.1| putative peroxidase 1 precursor [Oryza sativa (japonica cultivar-group)]
  misc_feature: GI Number: 55701135; NR Description: TPA: class III
  misc_feature: GI Number: 55701023; NR Description: TPA: class III peroxidase 78 precursor [Oryza sativa (japonica cultivar-group)] gi|54290729|dbj|BAD62399.1| putative peroxidase 1 precursor [Oryza
ACAGCTCGCGCGCGCACCAGACAGACGCCTTCTCCCTCTCCCGCAGTACAGGGTACAGCTCGCGCTCACACAAGACACCATCTCCCTGCCTGCGATCCGATGCGTCCAACGTTTTCAGCCGGGGTACGGTCCTACCACCGCTGTGCCTAATAATTGGCGGCTAGCTAGCTAGCTAGCTGCAGCTGCTGCGATCCTGGATCGGCACAGCCGGTTCTTGATGTGGAGGGAGCGGCGGCGGGCGCTGCTCCTGCTGGTGGCCGGCGCGGCGCTGGGACTGATCGGTGCCGCGCTCGCGAGCGCGCCGCCGGAGGCCGCGCTGAAGGTCGGGTTCTACCATGCGACGTGCCCCATCGCGGAGGACGTGGTCCTCGCCGAGATGAGGCTCATCCTCATGGAGGACGCCACGGTCGCGCCGTCCCTGCTCCGGATGCACTACCACGACTGCTTCGTGCAGGGCTGCGACGGGTCGATCATGCTCCAGTCGAGGAAGAAGGGGAAGGCGGAGCGGGACGCGCTGCCCAACCGTAGCATGCGAGGGTTCGACGCCATCGAGCGGATCAAGGCCCGGCTCGAGACCGTCTGCCCGCTCACCGTCTCCTGCGCCGACATCATCGCCATGGCGGCGAGGGACGCCGTCTACCTGAGCCACGGGCCGTGGTACGACGTGGAGACCGGGCGGCGCGACGGCAACGTCACCGTGGCCGAGTACGTCGACAACGACCTGCCGCCGCCGGACTCCAACATTGTCGACGTGAAGACCTTCTTCAGCGTCAAGTCGCTTAACTCGAAGGACATCGCCGTCCTCTTCGGGTGCCACAGCATCGGGACCTCCCACTGCGGCCCGATCCAGAAGCGGCTCTACAACTTCACCGGCAACATGGACGGCCAGGACCCGTCGCTGGACCCGGCCTACGCCGCCGAGCTCAGGAAGCTCTGCCCGCCTCCCAGACCCGGCGACGATGCTAGGAAGGTCAAGGTGCCTTTGGACCCCGGCAGCAACTACACCTTCGACCTGAGCTACTACCGCCACGTGCTCGCCACGGGCGGGCTGTTCCAGTCCGACGGCAGCCTCCTGCACGACCCCGTCACCAGAGGCTACGTCGAGAAGGTGGCCAAGGCGTCGTCGCCCGACGAGTACTACGCGGACTTCGCCGCGGCGATGGTCAAGATGGGCCGCACCGACGTGCTTGTCGGCGATCATGGGGAGATCAGGCCAACGTGTGGCATTTTTGTTGACTAGGTTCAGGATTGGGTTGAAGATGCGAAGATAATCTGTACGGGTTTCTGTCAACGTGTACTGTGCGTGCTGTTAGATCAGAAAGAGCACGGTCGCTGTTAACTGTGTATCCGGGAATGCTGTTCTGTTCACACACGGTCGTCACTGATCTACTGAATTGTCAGCCATGATGTAATTATTTATCTACGTATTAGTTGTATATTCTTCTC

SEQ ID NO: 663 - DNA, 1736 bp, Zea mays
  misc_feature (1)..(1736): Ceres cDNA ID no. 12355141
  misc_feature (1)..(1736): Ceres CLONE  ID no. 325391
  misc_feature (1)..(1736): Also known as  Ceres CDNA ID no. 23792220
aaaatggatatacttgaggctgcgcaaacagatatcagtgtctgacgcggccgcgggcatgtcagctgcatgcgctgcctcatggcagagcccgaccctggcggcgtgggacgccacgtccctcgcctcctccctgaaggcggcggccgcccgccgctccgcggcccacgtcggtccattgcacgccgtgctcctcaagctgggcctctccgcctccgccatccacgccacctccctggcgcacgtggctctgcgggccgggcttgcgcggtacgcgcgggagctgttcgacgagatgccccgcccggacgtggtctcttggacgtcactcgtcaccggccacgcgcaccaggggctacaccgcgattccctcgcgctgctccggcgcatggcgggttctggcgtccagcccaacggctactccttgtccggtgggctgctggcctgcgccggtgtcgggcagagcgcgcttgttcacgggaaggagatccatgccagcgtggtcaagatgagctcgcgtggactagtggacccggtcgtggagaacggggttcttggcatgtactcgaggtgcggaagcatggagtacgcgctgagagtgttcagggcgatgcctgtcaggaacatagttgcttggaactcgatgatggcagcgcttcttgggagcgggcaggccgaggacgcgctgaggctgttcgtttccatggtttcttctggcgtcggtgtggatggtttctcactctctatagccgtggatgcgtgcggggagctggcgctgctgaagcaggggatgcaggcgcacgcacaggttgctggcaatggattcgaggcagatgtcgtcgtcaggaactccttagtggacatgtacgccaagtgtggctgtgtcgattcggccgagctcgtcttcgaagcagtatcgtcaaacgacgctgttctttggaccacaatggtctcagcttacgggaagtctggccgtgcacaggacgccgtcagcttgtttgacaggatggcgcgcatggggatataacaagatggcatagcgtatcttgcggttctgtcagcttgtagccatggcggactcgtcagagaagcctggcactacttcagttcgatttctgatggttcgagctcggttgagatgcgagccgagcactacggatgcatggcggatctcctgtgcaggagaggttacctagaagaagctcttgagtttatcaagaacatgccgtttgactcgagcgtcgctgcctggagtgcgctgctcaactcatctcgaatacacgggaatgccaggctaagtcagttcgcagcttcctgtttgctcaagcttgaccctgagaaccacagcaactgggttgctctgtcaagtgtgcatgcatcagggaatgactggcacgagacctggacaatcagggagagcatgagcagagagtgtgtgaagaaagagcctgcgtgtagctgggttgagctgtgtgatggcgttcatgtttttgtaacggccgaccagtctcgtcctgaactgtttcaaatactgcagagtcttgattatttgaaggaggatacatcggtgatgccttggcaagtttcgtagaaaattctatgttttatattacagctttgtggtaggtggtttaaatctcactgcacagtgggcgattattctaatcaaaacaatcagttatgtaaagttgttgctcaatatactcgaatatgatgagttgatgactaattgtttg

SEQ ID NO: 664 - protein, 1736 aa, Zea mays
  misc_feature: PFam Name: PPR; PFam Description: PPR repeat
  misc_feature: GI Number: 50252103; NR Description: putative pentatricopeptide (PPR) repeat-containing protein-like protein
  misc_feature: GI Number: 42565133; NR Description: pentatricopeptide (PPR)
  misc_feature: GI Number: 15230593; NR Description: pentatricopeptide (PPR)
  misc_feature: GI Number: 11994419; NR Description: selenium-binding
  misc_feature: GI Number: 28392910; NR Description: putative
AAAATGGATATACTTGAGGCTGCGCAAACAGATATCAGTGTCTGACGCGGCCGCGGGCATGTCAGCTGCATGCGCTGCCTCATGGCAGAGCCCGACCCTGGCGGCGTGGGACGCCACGTCCCTCGCCTCCTCCCTGAAGGCGGCGGCCGCCCGCCGCTCCGCGGCCCACGTCGGTCCATTGCACGCCGTGCTCCTCAAGCTGGGCCTCTCCGCCTCCGCCATCCACGCCACCTCCCTGGCGCACGTGGCTCTGCGGGCCGGGCTTGCGCGGTACGCGCGGGAGCTGTTCGACGAGATGCCCCGCCCGGACGTGGTCTCTTGGACGTCACTCGTCACCGGCCACGCGCACCAGGGGCTACACCGCGATTCCCTCGCGCTGCTCCGGCGCATGGCGGGTTCTGGCGTCCAGCCCAACGGCTACTCCTTGTCCGGTGGGCTGCTGGCCTGCGCCGGTGTCGGGCAGAGCGCGCTTGTTCACGGGAAGGAGATCCATGCCAGCGTGGTCAAGATGAGCTCGCGTGGACTAGTGGACCCGGTCGTGGAGAACGGGGTTCTTGGCATGTACTCGAGGTGCGGAAGCATGGAGTACGCGCTGAGAGTGTTCAGGGCGATGCCTGTCAGGAACATAGTTGCTTGGAACTCGATGATGGCAGCGCTTCTTGGGAGCGGGCAGGCCGAGGACGCGCTGAGGCTGTTCGTTTCCATGGTTTCTTCTGGCGTCGGTGTGGATGGTTTCTCACTCTCTATAGCCGTGGATGCGTGCGGGGAGCTGGCGCTGCTGAAGCAGGGGATGCAGGCGCACGCACAGGTTGCTGGCAATGGATTCGAGGCAGATGTCGTCGTCAGGAACTCCTTAGTGGACATGTACGCCAAGTGTGGCTGTGTCGATTCGGCCGAGCTCGTCTTCGAAGCAGTATCGTCAAACGACGCTGTTCTTTGGACCACAATGGTCTCAGCTTACGGGAAGTCTGGCCGTGCACAGGACGCCGTCAGCTTGTTTGACAGGATGGCGCGCATGGGGATATAACAAGATGGCATAGCGTATCTTGCGGTTCTGTCAGCTTGTAGCCATGGCGGACTCGTCAGAGAAGCCTGGCACTACTTCAGTTCGATTTCTGATGGTTCGAGCTCGGTTGAGATGCGAGCCGAGCACTACGGATGCATGGCGGATCTCCTGTGCAGGAGAGGTTACCTAGAAGAAGCTCTTGAGTTTATCAAGAACATGCCGTTTGACTCGAGCGTCGCTGCCTGGAGTGCGCTGCTCAACTCATCTCGAATACACGGGAATGCCAGGCTAAGTCAGTTCGCAGCTTCCTGTTTGCTCAAGCTTGACCCTGAGAACCACAGCAACTGGGTTGCTCTGTCAAGTGTGCATGCATCAGGGAATGACTGGCACGAGACCTGGACAATCAGGGAGAGCATGAGCAGAGAGTGTGTGAAGAAAGAGCCTGCGTGTAGCTGGGTTGAGCTGTGTGATGGCGTTCATGTTTTTGTAACGGCCGACCAGTCTCGTCCTGAACTGTTTCAAATACTGCAGAGTCTTGATTATTTGAAGGAGGATACATCGGTGATGCCTTGGCAAGTTTCGTAGAAAATTCTATGTTTTATATTACAGCTTTGTGGTAGGTGGTTTAAATCTCACTGCACAGTGGGCGATTATTCTAATCAAAACAATCAGTTATGTAAAGTTGTTGCTCAATATACTCGAATATGATGAGTTGATGACTAATTGTTTG

SEQ ID NO: 665 - DNA, 1174 bp, Zea mays
  misc_feature (1)..(1174): Ceres cDNA ID no. 12355225
  misc_feature (1)..(1174): Ceres CLONE  ID no. 321951
  misc_feature (1)..(1174): Also known as  Ceres CDNA ID no. 23768628
aaaggatagcctttcttcctgtgcagccactccagtgcacgccgccgcagcttgctacacgtgccgggcaagggcaatggattccagcagcagagtgatcgccttcgattgcagctccttcaaactctacatggacggccaagtcgagcgtgcggcccaacgcatgggaaaccgtgcccgccggcttcgacgcggacacgggcgtggcatccaaagacgtcgtcatcgacgtcgccaccggcgccaccgtgcggctctacctaccaccagtccagggagccacgacgaagctcccagtcgtcgtcttcttccatggcggctacttcatcgtcggctcagcccgcgagcctatgtaccatcgctatgtcaactcgctggtcgccagagcacgcgtcgtcgctgtctccgccgactaccgcctcgcgccagagcacccgctcccggcagcctacgacgactcctgggccgcgctcaagtgggcggtctccggcgcggaccagtggctgtccgaccacggcgacctcggccgcgtcttcctggtcggcatcagcgccggcggtaacattgcccacaacatggccatctctgtgggcgtgagcggcttgccggccgctgaaccaccgcgcatagaaggcgtgatcctgctccacccttccttttccggcgaacagaagatggatgtagaagaagaggagttctggcgatctaacaatagcaggtgggcggtcatcttcccgggcgcgaccggcggggcggacgatccaaggattaacccgatggcggacggcgcgccgagcctggagaagctagtgggtgaaaggctgctcgtctgcacggcgtctttggacccgagggcgccgagggggcccggatactgcgaggccgtacgggccagcgggtggcgcgggaaggtggagtggttcgagacggaaggtgaggaccacggtttcttcgtcctcaaccccggcagccacaaggcggttgaggtcatggatcgagtggttgctttccttgcggaccagtgatgacctcctcagggcacagcaaggtctagcagctcgccgcaaaaccggacgtcctagctacggcgcagccgttctcaggcgattgtttactgtctgtactcccaagagtgtcctagatgagttattggaataaacactacagtcaattc

SEQ ID NO: 666 - protein, 1174 aa, Zea mays
  misc_feature: PFam Name: Abhydrolase_3; PFam Description: alpha/beta
  misc_feature: PFam Name: COesterase; PFam Description: Carboxylesterase
  misc_feature: PFam Name: Mucin; PFam Description: Mucin-like glycoprotein
  misc_feature: PFam Name: Peptidase_S8; PFam Description: Subtilase family
  misc_feature: GI Number: 51536295; NR Description: putative PrMC3 [Oryza sativa (japonica cultivar-group)] >gi|51535241|dbj|BAD38290.1|
  misc_feature: GI Number: 51536287; NR Description: putative PrMC3 [Oryza sativa (japonica cultivar-group)] >gi|51535233|dbj|BAD38282.1|
  misc_feature: GI Number: 51535280; NR Description: putative PrMC3 [Oryza
  misc_feature: GI Number: 51535268; NR Description: putative PrMC3 [Oryza
  misc_feature: GI Number: 51535269; NR Description: putative PrMC3 [Oryza
AAAGGATAGCCTTTCTTCCTGTGCAGCCACTCCAGTGCACGCCGCCGCAGCTTGCTACACGTGCCGGGCAAGGGCAATGGATTCCAGCAGCAGAGTGATCGCCTTCGATTGCAGCTCCTTCAAACTCTACATGGACGGCCAAGTCGAGCGTGCGGCCCAACGCATGGGAAACCGTGCCCGCCGGCTTCGACGCGGACACGGGCGTGGCATCCAAAGACGTCGTCATCGACGTCGCCACCGGCGCCACCGTGCGGCTCTACCTACCACCAGTCCAGGGAGCCACGACGAAGCTCCCAGTCGTCGTCTTCTTCCATGGCGGCTACTTCATCGTCGGCTCAGCCCGCGAGCCTATGTACCATCGCTATGTCAACTCGCTGGTCGCCAGAGCACGCGTCGTCGCTGTCTCCGCCGACTACCGCCTCGCGCCAGAGCACCCGCTCCCGGCAGCCTACGACGACTCCTGGGCCGCGCTCAAGTGGGCGGTCTCCGGCGCGGACCAGTGGCTGTCCGACCACGGCGACCTCGGCCGCGTCTTCCTGGTCGGCATCAGCGCCGGCGGTAACATTGCCCACAACATGGCCATCTCTGTGGGCGTGAGCGGCTTGCCGGCCGCTGAACCACCGCGCATAGAAGGCGTGATCCTGCTCCACCCTTCCTTTTCCGGCGAACAGAAGATGGATGTAGAAGAAGAGGAGTTCTGGCGATCTAACAATAGCAGGTGGGCGGTCATCTTCCCGGGCGCGACCGGCGGGGCGGACGATCCAAGGATTAACCCGATGGCGGACGGCGCGCCGAGCCTGGAGAAGCTAGTGGGTGAAAGGCTGCTCGTCTGCACGGCGTCTTTGGACCCGAGGGCGCCGAGGGGGCCCGGATACTGCGAGGCCGTACGGGCCAGCGGGTGGCGCGGGAAGGTGGAGTGGTTCGAGACGGAAGGTGAGGACCACGGTTTCTTCGTCCTCAACCCCGGCAGCCACAAGGCGGTTGAGGTCATGGATCGAGTGGTTGCTTTCCTTGCGGACCAGTGATGACCTCCTCAGGGCACAGCAAGGTCTAGCAGCTCGCCGCAAAACCGGACGTCCTAGCTACGGCGCAGCCGTTCTCAGGCGATTGTTTACTGTCTGTACTCCCAAGAGTGTCCTAGATGAGTTATTGGAATAAACACTACAGTCAATTC

SEQ ID NO: 667 - DNA, 1261 bp, Zea mays
  misc_feature (1)..(1261): Ceres cDNA ID no. 12355390
  misc_feature (1)..(1261): Ceres CLONE  ID no. 321932
  misc_feature (1)..(1261): Also known as  Ceres CDNA ID no. 23764632
gacgccactcccacctctcttcttctctttcccttcgcattaatggccgctctctccctatcccctttcgtctcgctctcggagtaggacactcgcccgcttccggcttaaccttcaagattctccctcctcctcctacttcttcccgcttgggcgggcgcggcaccttccggttctgggcctcctatatatatacgcgcgcgaccgtcccccttccatactccctagcatgctcggctcgcaccccggattgatcgagctcgcccgtcgccgcgatggattcggtgccttccccctcctcttctacccgggccaccgctgctcccggtccctgctgccgctttgacgcgctgcggagggcgtgcgccaggcacgccgccgccgccgcgcgggccgccgggtgggcgctcggcgcgctgctcacctgcgtcttcgccgtcgtgggctcactcgtcggaatcttcattggtgccttcatggggatgtctacagaaagcggcatgttccgcggggctggtgtcggagcagtctcgggagcagtcttctccattgaggctgttgagtcctgcatcgagatttggaggtccagccattcgggaaaatacagcattctctatgtgctggacatcatctctagcctcttcagcggaagaattgtgtgggagaaagtcagtccagcgctacagcgtgcagtgcaaagccagatgagtctaatgagcacaccgttcatcgacaacaatgaccttttcgaaactggcagtacaggaggcatgtcaagggctctgattgataggatcccaaagatgaggttcagtgctgcaagcaattgtgacaaggaaactgatagcagctgctgctcagtctgcctgcaggattttggagcacagcaatttgtgagggccctgcctcagtgccaacacatattccatgtgcggtgcatcgacaactggctccttcggcacgcatcctgcccactatgccgggccggcgttcatattgaccatatacatatgtaaataaactcgcagggtggcacctggtgtattttcatagtgaatacccgtgctcctgttggatatcacaagtatagctggctgtatacataggttttctcctttttttttttgttacttctccggtcttatgtggggctatgctttcagctgcacgtttttgtcgaagtaatacctggattggctggatatgtacatcttgagaacggattgactaacaagctccctgaattatggtcctgtgtgct

SEQ ID NO: 668 - protein, 1261 aa, Zea mays
  misc_feature: PFam Name: zf-C3HC4; PFam Description: Zinc finger, C3HC4
  misc_feature: GI Number: 50937111; NR Description: putative NEP1-interacting protein 2 [Oryza sativa (japonica cultivar-group)] >gi|33146606|dbj|BAC79837.1| putative NEP1-interacting protein 2 [Oryza sativa (japonica cultivar-group)] [Oryza sativa (japonica
  misc_feature: GI Number: 50937113; NR Description: putative NEP1-interacting protein 2 [Oryza sativa (japonica cultivar-group)] >gi|33146607|dbj|BAC79838.1| putative NEP1-interacting protein 2 [Oryza sativa (japonica cultivar-group)] [Oryza sativa (japonica
  misc_feature: GI Number: 29367571; NR Description: unknown [Oryza sativa
  misc_feature: GI Number: 27524904; NR Description: NEP1-interacting protein 2 [Arabidopsis thaliana] >gi|30680091|ref|NP_179364.2| zinc finger
  misc_feature: GI Number: 18855037; NR Description: putative zinc finger
GACGCCACTCCCACCTCTCTTCTTCTCTTTCCCTTCGCATTAATGGCCGCTCTCTCCCTATCCCCTTTCGTCTCGCTCTCGGAGTAGGACACTCGCCCGCTTCCGGCTTAACCTTCAAGATTCTCCCTCCTCCTCCTACTTCTTCCCGCTTGGGCGGGCGCGGCACCTTCCGGTTCTGGGCCTCCTATATATATACGCGCGCGACCGTCCCCCTTCCATACTCCCTAGCATGCTCGGCTCGCACCCCGGATTGATCGAGCTCGCCCGTCGCCGCGATGGATTCGGTGCCTTCCCCCTCCTCTTCTACCCGGGCCACCGCTGCTCCCGGTCCCTGCTGCCGCTTTGACGCGCTGCGGAGGGCGTGCGCCAGGCACGCCGCCGCCGCCGCGCGGGCCGCCGGGTGGGCGCTCGGCGCGCTGCTCACCTGCGTCTTCGCCGTCGTGGGCTCACTCGTCGGAATCTTCATTGGTGCCTTCATGGGGATGTCTACAGAAAGCGGCATGTTCCGCGGGGCTGGTGTCGGAGCAGTCTCGGGAGCAGTCTTCTCCATTGAGGCTGTTGAGTCCTGCATCGAGATTTGGAGGTCCAGCCATTCGGGAAAATACAGCATTCTCTATGTGCTGGACATCATCTCTAGCCTCTTCAGCGGAAGAATTGTGTGGGAGAAAGTCAGTCCAGCGCTACAGCGTGCAGTGCAAAGCCAGATGAGTCTAATGAGCACACCGTTCATCGACAACAATGACCTTTTCGAAACTGGCAGTACAGGAGGCATGTCAAGGGCTCTGATTGATAGGATCCCAAAGATGAGGTTCAGTGCTGCAAGCAATTGTGACAAGGAAACTGATAGCAGCTGCTGCTCAGTCTGCCTGCAGGATTTTGGAGCACAGCAATTTGTGAGGGCCCTGCCTCAGTGCCAACACATATTCCATGTGCGGTGCATCGACAACTGGCTCCTTCGGCACGCATCCTGCCCACTATGCCGGGCCGGCGTTCATATTGACCATATACATATGTAAATAAACTCGCAGGGTGGCACCTGGTGTATTTTCATAGTGAATACCCGTGCTCCTGTTGGATATCACAAGTATAGCTGGCTGTATACATAGGTTTTCTCCTTTTTTTTTTTGTTACTTCTCCGGTCTTATGTGGGGCTATGCTTTCAGCTGCACGTTTTTGTCGAAGTAATACCTGGATTGGCTGGATATGTACATCTTGAGAACGGATTGACTAACAAGCTCCCTGAATTATGGTCCTGTGTGCT

SEQ ID NO: 669 - DNA, 1648 bp, Zea mays
  misc_feature (1)..(1648): Ceres cDNA ID no. 12355441
  misc_feature (1)..(1648): Ceres CLONE  ID no. 238367
  misc_feature (1)..(1648): Also known as  Ceres CDNA ID no. 23754675
  misc_feature (1392)..(1392): n is a, c, t, g, unknown, or other
  misc_feature (1431)..(1431): n is a, c, t, g, unknown, or other
  misc_feature (1435)..(1435): n is a, c, t, g, unknown, or other
  misc_feature (1604)..(1604): n is a, c, t, g, unknown, or other
  misc_feature (1605)..(1605): n is a, c, t, g, unknown, or other
  misc_feature (1606)..(1606): n is a, c, t, g, unknown, or other
  misc_feature (1607)..(1607): n is a, c, t, g, unknown, or other
  misc_feature (1608)..(1608): n is a, c, t, g, unknown, or other
acacagctagcaggccggcctgcgtatttcggcactgctagcacaatcacttcacagccatgccgcttgttctgctagtgctgctgctgctcttgtcctgttcttctccagttgccctgctagcagcagcgcatgaacatgacgagtacacactcgtggcgaagagctcgctgaaacccaaagctacgtgcaccggatacagggtgtctccaccccagaacatcacgtgggttccattgaacgcccctcacgggccgtgctcgccattgccgggctcggcggcgccgtccttggccgcgctgctcctccacgaccagctccgcgtcgacggcatcgagaggaggctctctgacaatccccatgatagtaagttggttccggctggcggagaggatttccaaacgaacggcaatttacttcaagtcaactacggcaattcaggacagcctatgagctccgaggcccagcagagcggcgtggttaatgcgtcggctgccggcggcggaagcagatccaagctgcccggagtgatccagacggtggttctggactcggcgagcgacgtgccgtgggtgcagtgcgtgccgtgccccatcccgccgtgccacccccaggtggacagcttctacgacccgagcaggtctcccagctctgcccccttctcgtgcagctccccgacctgcacggctctcggcccctacgccaatggctgcgccaacaaccagtgccagtacctggtccgctaccccgacgggtcgtccacgtcgggggcctacatcgccgacctgctcaccttggacgccggcaacgccgtgtcgggcttcaagttcgggtgcagccacgccgagcagggcagcttcgacgcccgggcagccggcatcatggcgctcggcggcgggcctgagtcgctgctgtcccagaccgcgtcccgctacgggaacgccttctcctactgcatcccggccacggctagtgactccggcttcttcaccctcggcgtgcccaggcgagcctcctccaggtacgtcgtcacgcccatggtcaggttcaggcaggcggccacgttctacggcgtgctcctccgcaccatcaccgtcggcggccagcggctcggcgtggcccccgcggtgttcgccgcgggctcggtactagactcccgcacggccatcacgcgcctgccgccgacggcgtaccaggccctgcgctccgcgttcaggagcagcatgaccatgtaccgctccgccccacccaaggggtatctggacacgtgctacgacttcactggcgtcgtcaacatcaggctgcccaagatctccctggtgttcgaccggaacgccgtgctgccgctcgacccgtcgggcatcctcttcaacgactgcctcgccttcaccncgaatgccgacgatcgcatgccgggcgtcctaggcagcntgcngcagcagaccatcgaggtgctatacgacgtcggcggcggcgccgtgggattccgccaaggcgcgtgctaagagatccatgtgaaggagacaataagctatactatatatatatatatatactatactatctagtgctaatttgcttggcaaccgagaacaaataaatcnnnnncaagacatgtaaaaggacatttgaagtatgtcaagaaatt

SEQ ID NO: 670 - protein, 1648 aa, Zea mays
  misc_feature: PFam Name: Asp; PFam Description: Eukaryotic aspartyl protease
  misc_feature: PFam Name: Pkinase; PFam Description: Protein kinase domain
  misc_feature: PFam Name: Cation_efflux; PFam Description: Cation efflux family
  misc_feature: GI Number: 50912211; NR Description: putative 41 kD chloroplast nucleoid DNA binding protein (CND41) [Oryza sativa (japonica cultivar-group)] gi|51964318|ref|XP_506944.1| PREDICTED
  misc_feature: GI Number: 34912520; NR Description: chloroplast nucleoid DNA-binding protein cnd41-like [Oryza sativa (japonica
  misc_feature: GI Number: 53792202; NR Description: nucleoid DNA-binding
  misc_feature: GI Number: 55296941; NR Description: putative nucleoid DNA-binding protein cnd41, chloroplast [Oryza sativa (japonica cultivar-group)] gi|55296886|dbj|BAD68338.1| putative nucleoid DNA-binding protein cnd41, chloroplast [Oryza sativa (japonica
  misc_feature: GI Number: 55296937; NR Description: putative nucleoid DNA-binding protein cnd41, chloroplast [Oryza sativa (japonica
ACACAGCTAGCAGGCCGGCCTGCGTATTTCGGCACTGCTAGCACAATCACTTCACAGCCATGCCGCTTGTTCTGCTAGTGCTGCTGCTGCTCTTGTCCTGTTCTTCTCCAGTTGCCCTGCTAGCAGCAGCGCATGAACATGACGAGTACACACTCGTGGCGAAGAGCTCGCTGAAACCCAAAGCTACGTGCACCGGATACAGGGTGTCTCCACCCCAGAACATCACGTGGGTTCCATTGAACGCCCCTCACGGGCCGTGCTCGCCATTGCCGGGCTCGGCGGCGCCGTCCTTGGCCGCGCTGCTCCTCCACGACCAGCTCCGCGTCGACGGCATCGAGAGGAGGCTCTCTGACAATCCCCATGATAGTAAGTTGGTTCCGGCTGGCGGAGAGGATTTCCAAACGAACGGCAATTTACTTCAAGTCAACTACGGCAATTCAGGACAGCCTATGAGCTCCGAGGCCCAGCAGAGCGGCGTGGTTAATGCGTCGGCTGCCGGCGGCGGAAGCAGATCCAAGCTGCCCGGAGTGATCCAGACGGTGGTTCTGGACTCGGCGAGCGACGTGCCGTGGGTGCAGTGCGTGCCGTGCCCCATCCCGCCGTGCCACCCCCAGGTGGACAGCTTCTACGACCCGAGCAGGTCTCCCAGCTCTGCCCCCTTCTCGTGCAGCTCCCCGACCTGCACGGCTCTCGGCCCCTACGCCAATGGCTGCGCCAACAACCAGTGCCAGTACCTGGTCCGCTACCCCGACGGGTCGTCCACGTCGGGGGCCTACATCGCCGACCTGCTCACCTTGGACGCCGGCAACGCCGTGTCGGGCTTCAAGTTCGGGTGCAGCCACGCCGAGCAGGGCAGCTTCGACGCCCGGGCAGCCGGCATCATGGCGCTCGGCGGCGGGCCTGAGTCGCTGCTGTCCCAGACCGCGTCCCGCTACGGGAACGCCTTCTCCTACTGCATCCCGGCCACGGCTAGTGACTCCGGCTTCTTCACCCTCGGCGTGCCCAGGCGAGCCTCCTCCAGGTACGTCGTCACGCCCATGGTCAGGTTCAGGCAGGCGGCCACGTTCTACGGCGTGCTCCTCCGCACCATCACCGTCGGCGGCCAGCGGCTCGGCGTGGCCCCCGCGGTGTTCGCCGCGGGCTCGGTACTAGACTCCCGCACGGCCATCACGCGCCTGCCGCCGACGGCGTACCAGGCCCTGCGCTCCGCGTTCAGGAGCAGCATGACCATGTACCGCTCCGCCCCACCCAAGGGGTATCTGGACACGTGCTACGACTTCACTGGCGTCGTCAACATCAGGCTGCCCAAGATCTCCCTGGTGTTCGACCGGAACGCCGTGCTGCCGCTCGACCCGTCGGGCATCCTCTTCAACGACTGCCTCGCCTTCACCNCGAATGCCGACGATCGCATGCCGGGCGTCCTAGGCAGCNTGCNGCAGCAGACCATCGAGGTGCTATACGACGTCGGCGGCGGCGCCGTGGGATTCCGCCAAGGCGCGTGCTAAGAGATCCATGTGAAGGAGACAATAAGCTATACTATATATATATATATATACTATACTATCTAGTGCTAATTTGCTTGGCAACCGAGAACAAATAAATCNNNNNCAAGACATGTAAAAGGACATTTGAAGTATGTCAAGAAATT

SEQ ID NO: 671 - DNA, 1449 bp, Zea mays
  misc_feature (1)..(1449): Ceres cDNA ID no. 12355833
  misc_feature (1)..(1449): Ceres CLONE  ID no. 237650
  misc_feature (1)..(1449): Also known as  Ceres CDNA ID no. 23770747
gaacaatccgttggcggattgctgcacatccgctcgatctgatagagtggttgattcagacgtcctccgctgccagtctgcgttgtcataccgtggagtttgttcgtccaggatattgccttcggaggacgatagtcttgcaagggctcttcgctcgtgccactcgcagcctttctcattcgtagaggaaggagacaccggtgcatcagggatgataagcttagcagagtatctaggaactaatgtagctgaccacatccctgaaactcccaacaacctgtcagaggagatggtgagatgcatggcggggatatactgcagactcgcagatcctcccttggttcaccacggctcgtcctcttcaccgtcgtcgtcgttctcctcgactagcgcaatctctccgcagtatgtgggggacatgtggagtcccaaatacaggagagaggcgactctggactcccgtctgataaacccgttccatgtcgatggtctgaaggagttcagtggaccttacaacacaatggttgaggttcctatgattagccgggacagtcggaggctgaaagaagccgaggacctgctccagacttacaagttgattttgtatcggttggaagccgttgatctgaggagaatgacagatgaagaaaagatcgcattctgggtcaacatacacaatgctttgctgatgcatgcttatctgaagaatggcgtcccacagaacaatctaaagaaaacatccctacttgttaaggctgcctgcaaaatagccggacgcaacatcaacgccgccgtcatccagagcattgttcttgggtgcaacacacactgccccggacagtggctacggacgctgctttaccccaggatcaaaagcaaggtgagcaaagcggggcatgagtggcgggcctttgccgttgcgcaaccggagcctcttttacgctttgcgctttgttccggcagccattctgatcccgcggtgagggtgtacactccgaagcggctgttccaccagctggagtcggccaaggaggagttcatccgggcgacggccggcgtgtggaaggagcagaagctgctgctccccaagctggtggaggcgtacgccaaggacgtgaagctctcgccgcagggcctcgtggacatggtccagcgctacctcccggagagcatgaggatggccgtgcagcggtgccagcacggcggcaggtcgtcgggcaaggtcgtggagtgggtgtcctacaacccggccttccgctacctgctcgccagggacctcgcgttccctcacctcagctgaccgttcgttaatctttagtagtatatgcgtgtgtgccatagggttagaagtagagaagggatcatgtgcagtttttgtgtggtggttgtcaatggcttttgtagatgatgaacaggaaacaggggaagaaatgagagaaagcacgtttg

SEQ ID NO: 672 - protein, 1449 aa, Zea mays
  misc_feature: GI Number: 28916180; NR Description: putative ternary complex
  misc_feature: GI Number: 50947619; NR Description: ternary complex factor-like [Oryza sativa (japonica cultivar-group)] >gi|42408754|dbj|BAD09990.1| ternary complex factor-like [Oryza
  misc_feature: GI Number: 53793306; NR Description: ternary complex factor MIP1-like [Oryza sativa (japonica cultivar-group)] >gi|53792826|dbj|BAD53859.1| ternary complex factor MIP1-like
  misc_feature: GI Number: 51535341; NR Description: ternary complex factor
  misc_feature: GI Number: 53791925; NR Description: ternary complex factor
GAACAATCCGTTGGCGGATTGCTGCACATCCGCTCGATCTGATAGAGTGGTTGATTCAGACGTCCTCCGCTGCCAGTCTGCGTTGTCATACCGTGGAGTTTGTTCGTCCAGGATATTGCCTTCGGAGGACGATAGTCTTGCAAGGGCTCTTCGCTCGTGCCACTCGCAGCCTTTCTCATTCGTAGAGGAAGGAGACACCGGTGCATCAGGGATGATAAGCTTAGCAGAGTATCTAGGAACTAATGTAGCTGACCACATCCCTGAAACTCCCAACAACCTGTCAGAGGAGATGGTGAGATGCATGGCGGGGATATACTGCAGACTCGCAGATCCTCCCTTGGTTCACCACGGCTCGTCCTCTTCACCGTCGTCGTCGTTCTCCTCGACTAGCGCAATCTCTCCGCAGTATGTGGGGGACATGTGGAGTCCCAAATACAGGAGAGAGGCGACTCTGGACTCCCGTCTGATAAACCCGTTCCATGTCGATGGTCTGAAGGAGTTCAGTGGACCTTACAACACAATGGTTGAGGTTCCTATGATTAGCCGGGACAGTCGGAGGCTGAAAGAAGCCGAGGACCTGCTCCAGACTTACAAGTTGATTTTGTATCGGTTGGAAGCCGTTGATCTGAGGAGAATGACAGATGAAGAAAAGATCGCATTCTGGGTCAACATACACAATGCTTTGCTGATGCATGCTTATCTGAAGAATGGCGTCCCACAGAACAATCTAAAGAAAACATCCCTACTTGTTAAGGCTGCCTGCAAAATAGCCGGACGCAACATCAACGCCGCCGTCATCCAGAGCATTGTTCTTGGGTGCAACACACACTGCCCCGGACAGTGGCTACGGACGCTGCTTTACCCCAGGATCAAAAGCAAGGTGAGCAAAGCGGGGCATGAGTGGCGGGCCTTTGCCGTTGCGCAACCGGAGCCTCTTTTACGCTTTGCGCTTTGTTCCGGCAGCCATTCTGATCCCGCGGTGAGGGTGTACACTCCGAAGCGGCTGTTCCACCAGCTGGAGTCGGCCAAGGAGGAGTTCATCCGGGCGACGGCCGGCGTGTGGAAGGAGCAGAAGCTGCTGCTCCCCAAGCTGGTGGAGGCGTACGCCAAGGACGTGAAGCTCTCGCCGCAGGGCCTCGTGGACATGGTCCAGCGCTACCTCCCGGAGAGCATGAGGATGGCCGTGCAGCGGTGCCAGCACGGCGGCAGGTCGTCGGGCAAGGTCGTGGAGTGGGTGTCCTACAACCCGGCCTTCCGCTACCTGCTCGCCAGGGACCTCGCGTTCCCTCACCTCAGCTGACCGTTCGTTAATCTTTAGTAGTATATGCGTGTGTGCCATAGGGTTAGAAGTAGAGAAGGGATCATGTGCAGTTTTTGTGTGGTGGTTGTCAATGGCTTTTGTAGATGATGAACAGGAAACAGGGGAAGAAATGAGAGAAAGCACGTTTG

SEQ ID NO: 673 - DNA, 1737 bp, Zea mays
  misc_feature (1)..(1737): Ceres cDNA ID no. 12356000
  misc_feature (1)..(1737): Ceres CLONE  ID no. 238542
  misc_feature (1)..(1737): Also known as  Ceres CDNA ID no. 23773104
gttcccccaaaaggaaggatttcattccttgccgttccatcgttccgacttgccgtcaagcaaatgcgaagcgtctcgcctgtgatcttcttgcaccttgccgagctgtgcgactgactggttgatccaggctgtacatacatagggtcaattaatgagcggcgccaattcttcgttgccgatgccgccaccggcgcccgctgcgtcggcgctcgacaacgtggaggccaagataagccccagcatcgtcttcgtcgtggccatcctggcgatcgtcttcttcgtctgcggcctgctgcacctgctggtgcgccacctgctgcggctgcggcgccggcgccgccgcgcgcgggaggacgcggacagcgtcacggcgttccagggccagctgcagcagctcttccacctgcacgacgccggcgtggaccaggccttcatcgacgcgctcccggtcttcctctaccgcaacgtcgtcggggccgcgccgggcggcaaggacccgttcgactgcgccgtctgcctgtgcgagttctcgcccgacgaccagctccgcctgctgcccaagtgcagccacgcgtttccacctcgagtgcatcgacacgtggctgctgtcccactccacctgcccgctctgccgccggagcctcctcgccgacctctcgcccacgtgcagccccgtcgtgatggtgctcgagtccgagagcgcccgcgacatggccgcgtccgcggctcgggccaccgacgccgagcccagcgccggggccggggccacgctgccgcggggccaaggagcggacgaggtggtcgaggtgaagctggggaagttcatgtgcgtcgaaggcagcaccgccaacgccaacgccaaggcggcggacggagcaggcaccagcggcgacggcgacgtcgacgccagtgccaaggaaggtctcggtctcgggcagagacggtgccactccatggggtcctacgagtacgtcatggacgaccgcgcctcgctccgcgtggcgatcaagccgcccaagaagaagcccgcggcctccaagtcgcgccgccgcggcgccatctcggagtgcgagttcggcgcgtccaagcgcggggagacctcgctccgcctgccattcccagcaacggcgcacaagcagcagcagcaggccgacgcgaacatggcgaagctcgccaaggacagcttctccgtgtcgaagacctggatggtgccgccgctcaagaaggatcccgccggcgagaggcgcgcggtgtcgttccggtggccggtgagcggcagggacgagggagaaggcaaggacaggaggagcgggagcgaggctgagtgggacgtggaggccgggagctgcggcagcgtgtcgtcgctggcggaggagaggccgtccttcgcgcggaggaccctgctctgggtcgtcggaggccggcagcagagccgagtcggcagctgttcgtgatcagcgcacggttgctcgaagatttaaaaaaaaaagaaggcagagaaatacttttgtgctctttcggcagattggtagtagcgagtagcggttgcaataggctagagatttgcagaacccgaaagctctgaaaaattctttctttcttcctgcttcgtttgaaaacaagtggcaatggcgagcagcggtgaactggacaaatgacgaacatctgcaggtcctaaaccgcaactaacaacagcttctgaaacagctagtgggcgttgctgctcagagatcc

SEQ ID NO: 674 - protein, 1737 aa, Zea mays
  misc_feature: PFam Name: zf-C3HC4; PFam Description: Zinc finger, C3HC4
  misc_feature: PFam Name: Pyr_redox_2; PFam Description: Pyridine
  misc_feature: PFam Name: FH2; PFam Description: Formin Homology 2 Domain
  misc_feature: PFam Name: HlyD; PFam Description: HlyD family secretion protein
  misc_feature: PFam Name: Pkinase; PFam Description: Protein kinase domain
  misc_feature: GI Number: 51091716; NR Description: RING finger 1-like
  misc_feature: GI Number: 50946255; NR Description: putative RING finger 1 [Oryza sativa (japonica cultivar-group)] >gi|42407444|dbj|BAD10051.1| putative RING finger 1 [Oryza sativa
  misc_feature: GI Number: 18417587; NR Description: zinc finger (C3HC4-type
  misc_feature: GI Number: 21655299; NR Description: AT4g30400/F17I23_260 [Arabidopsis thaliana] >gi|15809840|gb|AAL06848.1|
  misc_feature: GI Number: 4185131; NR Description: putative RING zinc finger protein [Arabidopsis thaliana] >gi|25411889|pir||H84566 probable RING zinc finger protein [imported] - Arabidopsis thaliana
GTTCCCCCAAAAGGAAGGATTTCATTCCTTGCCGTTCCATCGTTCCGACTTGCCGTCAAGCAAATGCGAAGCGTCTCGCCTGTGATCTTCTTGCACCTTGCCGAGCTGTGCGACTGACTGGTTGATCCAGGCTGTACATACATAGGGTCAATTAATGAGCGGCGCCAATTCTTCGTTGCCGATGCCGCCACCGGCGCCCGCTGCGTCGGCGCTCGACAACGTGGAGGCCAAGATAAGCCCCAGCATCGTCTTCGTCGTGGCCATCCTGGCGATCGTCTTCTTCGTCTGCGGCCTGCTGCACCTGCTGGTGCGCCACCTGCTGCGGCTGCGGCGCCGGCGCCGCCGCGCGCGGGAGGACGCGGACAGCGTCACGGCGTTCCAGGGCCAGCTGCAGCAGCTCTTCCACCTGCACGACGCCGGCGTGGACCAGGCCTTCATCGACGCGCTCCCGGTCTTCCTCTACCGCAACGTCGTCGGGGCCGCGCCGGGCGGCAAGGACCCGTTCGACTGCGCCGTCTGCCTGTGCGAGTTCTCGCCCGACGACCAGCTCCGCCTGCTGCCCAAGTGCAGCCACGCGTTTCCACCTCGAGTGCATCGACACGTGGCTGCTGTCCCACTCCACCTGCCCGCTCTGCCGCCGGAGCCTCCTCGCCGACCTCTCGCCCACGTGCAGCCCCGTCGTGATGGTGCTCGAGTCCGAGAGCGCCCGCGACATGGCCGCGTCCGCGGCTCGGGCCACCGACGCCGAGCCCAGCGCCGGGGCCGGGGCCACGCTGCCGCGGGGCCAAGGAGCGGACGAGGTGGTCGAGGTGAAGCTGGGGAAGTTCATGTGCGTCGAAGGCAGCACCGCCAACGCCAACGCCAAGGCGGCGGACGGAGCAGGCACCAGCGGCGACGGCGACGTCGACGCCAGTGCCAAGGAAGGTCTCGGTCTCGGGCAGAGACGGTGCCACTCCATGGGGTCCTACGAGTACGTCATGGACGACCGCGCCTCGCTCCGCGTGGCGATCAAGCCGCCCAAGAAGAAGCCCGCGGCCTCCAAGTCGCGCCGCCGCGGCGCCATCTCGGAGTGCGAGTTCGGCGCGTCCAAGCGCGGGGAGACCTCGCTCCGCCTGCCATTCCCAGCAACGGCGCACAAGCAGCAGCAGCAGGCCGACGCGAACATGGCGAAGCTCGCCAAGGACAGCTTCTCCGTGTCGAAGACCTGGATGGTGCCGCCGCTCAAGAAGGATCCCGCCGGCGAGAGGCGCGCGGTGTCGTTCCGGTGGCCGGTGAGCGGCAGGGACGAGGGAGAAGGCAAGGACAGGAGGAGCGGGAGCGAGGCTGAGTGGGACGTGGAGGCCGGGAGCTGCGGCAGCGTGTCGTCGCTGGCGGAGGAGAGGCCGTCCTTCGCGCGGAGGACCCTGCTCTGGGTCGTCGGAGGCCGGCAGCAGAGCCGAGTCGGCAGCTGTTCGTGATCAGCGCACGGTTGCTCGAAGATTTAAAAAAAAAAGAAGGCAGAGAAATACTTTTGTGCTCTTTCGGCAGATTGGTAGTAGCGAGTAGCGGTTGCAATAGGCTAGAGATTTGCAGAACCCGAAAGCTCTGAAAAATTCTTTCTTTCTTCCTGCTTCGTTTGAAAACAAGTGGCAATGGCGAGCAGCGGTGAACTGGACAAATGACGAACATCTGCAGGTCCTAAACCGCAACTAACAACAGCTTCTGAAACAGCTAGTGGGCGTTGCTGCTCAGAGATCC

SEQ ID NO: 675 - DNA, 1346 bp, Zea mays
  misc_feature (1)..(1346): Ceres cDNA ID no. 12356016
  misc_feature (1)..(1346): Ceres CLONE  ID no. 258392
  misc_feature (1)..(1346): Also known as  Ceres CDNA ID no. 23770045
gactcgtcctcttccctcgccgcgagctccgggttcccctgcgcatagctaggccaagccaggtataccccaaccatcgcatgggagccgcgactgccccgacgaagcggagacgcggccccagcaagacgcaggaggaggccatggcgcgcgcgagcccggaggcgcggcggcgaccgcggccgcgcctggtgggctatgaggagctgccggagtacctcaaggacaacgagtacatccgcgggcactaccgcgccgagtggcccgtccgcgacgcgctcctcagcgccttcgcctggcacaacgagacgctcaacgtctggacgcatctgggagggttcctgttcttcctagcgctcgcggtcgccggaggacggaaggaggccgccgacggtgccgctccgggtatcatgaggttcgttgtgagactagattcatggggcagcgaccatccgggccagccgaggcacgacgacgccggggcatcgctgcccagtgtgccgcggtggccgcggacggtgttcctggtgggggccatgtcgtgcctcgccatcagcgcggcggcgcacctgctggcgtgccactcgcggcgcgccagcgcggtgttctggcagctggactacgcgggcatctccgtgatgatcgtcgcctccttcgtgccgccggtgtactacgccttcctctgccacccgccggcgcgggcggcctacctgtgcgccatcgcggcgctgggcgcgctggtggtggccgcgctgctctccccgtcctgctcgtccccgcgctaccgccgcctccgcgcggcgctgttcctggccatgggcctgtcgggcgtcgtcccggcgctgcacgcgctctggctcaactggggccacgccgcctgctacctggcgctgggcatcgaggtcgtcatgggcctcacctacgccacgggcgcctggttctacgtcagccgcgtgccggagaagtggcgacccggggtgttcgacgtcgtcggccacagccaccagatcttccacgtcctcgtgctcgtcggcgccgtcacgcactacgtcgccgtcgccgtgctcatccactggcgggagaaggtggccgtcgcctgtggcgccgcgtcggcgtaggctcacctgtttggttggctcactcaacaaccattcgaatggcaaaccaagtagtcgcaacatagatcagctctagagtttgagtgtgaccttcgacgatttataatttaattgatggggtgattgagtatggtggttcattagttcatgagatttatctgtcgagtgagtgcgtgcctcagatttccagaccttttgtttccagcctactcaactttttgtcccgtc

SEQ ID NO: 676 - protein, 1346 aa, Zea mays
  misc_feature: PFam Name: HlyIII; PFam Description: Haemolysin-III related
  misc_feature: PFam Name: Transferase; PFam Description: Transferase family
  misc_feature: GI Number: 50252081; NR Description: putative adiponectin
  misc_feature: GI Number: 51535032; NR Description: putative adiponectin
  misc_feature: GI Number: 50761224; NR Description: PREDICTED: similar to
  misc_feature: GI Number: 51593696; NR Description: MGC85478 protein
  misc_feature: GI Number: 27696972; NR Description: Adipor1-prov protein
GACTCGTCCTCTTCCCTCGCCGCGAGCTCCGGGTTCCCCTGCGCATAGCTAGGCCAAGCCAGGTATACCCCAACCATCGCATGGGAGCCGCGACTGCCCCGACGAAGCGGAGACGCGGCCCCAGCAAGACGCAGGAGGAGGCCATGGCGCGCGCGAGCCCGGAGGCGCGGCGGCGACCGCGGCCGCGCCTGGTGGGCTATGAGGAGCTGCCGGAGTACCTCAAGGACAACGAGTACATCCGCGGGCACTACCGCGCCGAGTGGCCCGTCCGCGACGCGCTCCTCAGCGCCTTCGCCTGGCACAACGAGACGCTCAACGTCTGGACGCATCTGGGAGGGTTCCTGTTCTTCCTAGCGCTCGCGGTCGCCGGAGGACGGAAGGAGGCCGCCGACGGTGCCGCTCCGGGTATCATGAGGTTCGTTGTGAGACTAGATTCATGGGGCAGCGACCATCCGGGCCAGCCGAGGCACGACGACGCCGGGGCATCGCTGCCCAGTGTGCCGCGGTGGCCGCGGACGGTGTTCCTGGTGGGGGCCATGTCGTGCCTCGCCATCAGCGCGGCGGCGCACCTGCTGGCGTGCCACTCGCGGCGCGCCAGCGCGGTGTTCTGGCAGCTGGACTACGCGGGCATCTCCGTGATGATCGTCGCCTCCTTCGTGCCGCCGGTGTACTACGCCTTCCTCTGCCACCCGCCGGCGCGGGCGGCCTACCTGTGCGCCATCGCGGCGCTGGGCGCGCTGGTGGTGGCCGCGCTGCTCTCCCCGTCCTGCTCGTCCCCGCGCTACCGCCGCCTCCGCGCGGCGCTGTTCCTGGCCATGGGCCTGTCGGGCGTCGTCCCGGCGCTGCACGCGCTCTGGCTCAACTGGGGCCACGCCGCCTGCTACCTGGCGCTGGGCATCGAGGTCGTCATGGGCCTCACCTACGCCACGGGCGCCTGGTTCTACGTCAGCCGCGTGCCGGAGAAGTGGCGACCCGGGGTGTTCGACGTCGTCGGCCACAGCCACCAGATCTTCCACGTCCTCGTGCTCGTCGGCGCCGTCACGCACTACGTCGCCGTCGCCGTGCTCATCCACTGGCGGGAGAAGGTGGCCGTCGCCTGTGGCGCCGCGTCGGCGTAGGCTCACCTGTTTGGTTGGCTCACTCAACAACCATTCGAATGGCAAACCAAGTAGTCGCAACATAGATCAGCTCTAGAGTTTGAGTGTGACCTTCGACGATTTATAATTTAATTGATGGGGTGATTGAGTATGGTGGTTCATTAGTTCATGAGATTTATCTGTCGAGTGAGTGCGTGCCTCAGATTTCCAGACCTTTTGTTTCCAGCCTACTCAACTTTTTGTCCCGTC

SEQ ID NO: 677 - DNA, 1283 bp, Zea mays
  misc_feature (1)..(1283): Ceres cDNA ID no. 12356020
  misc_feature (1)..(1283): Ceres CLONE  ID no. 260106
  misc_feature (1)..(1283): Also known as  Ceres CDNA ID no. 23756679
gcccacctaccactaccagtcgcggacgctcctcccacaactcgcgggtctcgagatgttcaggggttgcggcctgttcgccggcgcccgccgggggcgcggcggcgacctcaggaagcgcggggagcaaggcggcgcgagctcgcgggtggcgccggccgagcccgtgtgcgtggacgaggcggaggacggcggcgccgcgcggcagctggcgtgggcggaggtggagaccgccacgggcggcttctcgtccagggtggtcggccgcggcggcttcagcacggtgtacctcgcctcgctctcctcctcgcggctcggcgccgtcaaggtgcactgcagcagcgagcgcctccgccgcgcgttccgccgggagctcgacgtgctgctctccctccgccacccgcacgtcgtccgcctcctcgcctactgcgacgagcgcgacgagggcgtgctggtgttcgagtacgcgcccaacggcgacctccacgagaggctccacggcggcgcgggcgcgggcaccctcccctgggcgcgccgcgtggcggtcgcgttccaggtggcctcggcgctggagtacctccacgagggccgcgacccggccgtcgtccacggggacatcaaggcctccaacgtcctcctcgacgccagcatggacgccaagctctgcgacttcggcttcgcgcacgtcggcgtctcggccacgatgggcggccgccggccctcggaccgcgccgtcatgggctctccgggctacgtcgacccgcacctcctccgctccggagtggccaccaaggcgagcgacgtgtacagctttggcgtgctgctgctcgagctcctgacgggcaaggaggccgtctgccgcgagacagggcaccggctcacggccgcggtgaggcctaagctcagcgatggtgatcaactgccgggcgttctggaccagaggctgggaggagactacgacgccgctgaggcggccgccgtggccgagctcgccatgcagtgcgtcagtgacagccctgggctccgcccgtccatggccgacgtggtgcgcgtgctccaggagaagacctccgccgctggatcgagagtcgaccgcaagcaagatggtgtcctaagttagatgcctatggagtagtgtgtaaatatgtccttgatggtgctataattgtgttgagggtagttagccacaagaattggcgcagtgagatgaggttttagaatcactagatctctgatagaaaattttgtcatgccatcgagttgtcaatttgtcttgttgtgtt

SEQ ID NO: 678 - protein, 1283 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 50911268; NR Description: putative serine/threonine-specific protein kinase [Oryza sativa (japonica cultivar-group)] >gi|49388396|dbj|BAD25532.1| putative serine/threonine-specific protein kinase [Oryza sativa (japonica
  misc_feature: GI Number: 37536060; NR Description: putative receptor protein kinase [Oryza sativa (japonica cultivar-group)] >gi|13786470|gb|AAK39595.1| putative receptor protein kinase [Oryza
  misc_feature: GI Number: 50252107; NR Description: serine/threonine-specific receptor protein kinase-like protein [Oryza sativa (japonica cultivar-group)] >gi|50251992|dbj|BAD27925.1| serine/threonine-specific receptor protein kinase-like protein
  misc_feature: GI Number: 29367339; NR Description: putative receptor
  misc_feature: GI Number: 42571731; NR Description: protein kinase family
GCCCACCTACCACTACCAGTCGCGGACGCTCCTCCCACAACTCGCGGGTCTCGAGATGTTCAGGGGTTGCGGCCTGTTCGCCGGCGCCCGCCGGGGGCGCGGCGGCGACCTCAGGAAGCGCGGGGAGCAAGGCGGCGCGAGCTCGCGGGTGGCGCCGGCCGAGCCCGTGTGCGTGGACGAGGCGGAGGACGGCGGCGCCGCGCGGCAGCTGGCGTGGGCGGAGGTGGAGACCGCCACGGGCGGCTTCTCGTCCAGGGTGGTCGGCCGCGGCGGCTTCAGCACGGTGTACCTCGCCTCGCTCTCCTCCTCGCGGCTCGGCGCCGTCAAGGTGCACTGCAGCAGCGAGCGCCTCCGCCGCGCGTTCCGCCGGGAGCTCGACGTGCTGCTCTCCCTCCGCCACCCGCACGTCGTCCGCCTCCTCGCCTACTGCGACGAGCGCGACGAGGGCGTGCTGGTGTTCGAGTACGCGCCCAACGGCGACCTCCACGAGAGGCTCCACGGCGGCGCGGGCGCGGGCACCCTCCCCTGGGCGCGCCGCGTGGCGGTCGCGTTCCAGGTGGCCTCGGCGCTGGAGTACCTCCACGAGGGCCGCGACCCGGCCGTCGTCCACGGGGACATCAAGGCCTCCAACGTCCTCCTCGACGCCAGCATGGACGCCAAGCTCTGCGACTTCGGCTTCGCGCACGTCGGCGTCTCGGCCACGATGGGCGGCCGCCGGCCCTCGGACCGCGCCGTCATGGGCTCTCCGGGCTACGTCGACCCGCACCTCCTCCGCTCCGGAGTGGCCACCAAGGCGAGCGACGTGTACAGCTTTGGCGTGCTGCTGCTCGAGCTCCTGACGGGCAAGGAGGCCGTCTGCCGCGAGACAGGGCACCGGCTCACGGCCGCGGTGAGGCCTAAGCTCAGCGATGGTGATCAACTGCCGGGCGTTCTGGACCAGAGGCTGGGAGGAGACTACGACGCCGCTGAGGCGGCCGCCGTGGCCGAGCTCGCCATGCAGTGCGTCAGTGACAGCCCTGGGCTCCGCCCGTCCATGGCCGACGTGGTGCGCGTGCTCCAGGAGAAGACCTCCGCCGCTGGATCGAGAGTCGACCGCAAGCAAGATGGTGTCCTAAGTTAGATGCCTATGGAGTAGTGTGTAAATATGTCCTTGATGGTGCTATAATTGTGTTGAGGGTAGTTAGCCACAAGAATTGGCGCAGTGAGATGAGGTTTTAGAATCACTAGATCTCTGATAGAAAATTTTGTCATGCCATCGAGTTGTCAATTTGTCTTGTTGTGTT

SEQ ID NO: 679 - DNA, 2047 bp, Zea mays
  misc_feature (1)..(2047): Ceres cDNA ID no. 12356085
  misc_feature (1)..(2047): Ceres CLONE  ID no. 262037
  misc_feature (1)..(2047): Also known as  Ceres CDNA ID no. 23760116
acaaacttccctgaattcctgttcgctaccttcgcttccgctccaaaaaccaaataaaaaacgcacctttccttcccttctcctccccttcgctttcccccgtcctcccttccctcgatcccctcgccggaaaagatcccattccatccacctccacgtcccggcgcaatcagagtttccggcggcaaagcaggaaggcggaagcgaaaggaatgttgcacctttaagtagcgcggcgacctggtgtttcttcctggccggcgatgggctgcttcccgtgcttcgactccccggcagatgagcagcttaaccccaaattcggtggcgccggtgggtacggcggcacgtcctctgccgtcgcggcgtacggaaacggcacaggcgccggcgtcagcatcggccggcacggggacagggggtacccggacctgcagcaggcgcccatggcggctccgcgcgtcgagaagctctcagcagcggctgagaaagcaagagtaaagagcaatgggctcaccaaagaggctttggtgccaaaggatgccaatggcaatgccatctcagcgcaaactttcaccttccgtgagcttgctaccgccaccaggaacttcaggcccgagtgcttcctgggagagggaggttttggacgtgtttacaagggccgccttgagagcacaggccaggttgttgctataaagcagcttaacagggatgggcttcaaggaaacagagaatttctagtagaagttctcatgctcagcttactacatcatcaaaacctggttaatttgattggttattgtgctgatggagaccagagacttcttgtttatgaatatatgccttctggatcacttgaagatcatttgcacgatctacctcttgataaagaggccttggactggaacaccaggatgaaaattgcagcaggtgctgccaaaggactggagtaccttcatgacaaagctaatccaccagttatttatagggatttcaagtcatcgaacattctgttggatgaaagtttccacccgaagctgtctgattttggacttgctaagttgggtccagttggcgacaaatcacatgtctcaacacgtgtaatgggtacatatggttattgtgcaccagaatatgctatgacagggcagctgacagtgaagtctgacgtgtatagttttggggttgtcttgctagagttgattactggccgtagggctattgacagcaccagaccacatggagaacaaaatcttgtctcatgggcacgtcctctgtttaacgacagaagaaagctccctaagatggctgacccgaggctggaagggcgataccccatgcgtgggctttaccaagcccttgcagtggcttcgatgtgcattcagtcggaggctgcttcacgcccactgattgcagatgtcgtgactgctctgtcctacttggcatcccagccatatgatcccaacgcagctcttgcttcaaggaagccaggcggcgatcagcgaagcaagcctggcgagaacggcagggcagtttccaggaatgatgaaactggaagctccggccacaaaacacctgccaaggaccgagaggactcacctagggacctcccagcgatcctgaacaaggaccttgaccgggagcgcatggtggccgaggcgaagatgtggggcgaccgggagcgcatggtggccgaggctaagatgtggggcgaccgagagcgcatggtggctgaggcgaagatgtggggtgaaaattggcgtgacaagcggcgtgcagagattgggcaggggagcctggattcggttactgggaacagctagggggcaattaagcgaacagaaacgtgacatccacccatgcatttcgtttgtttatttccaggtccattttcgttctggcggcggtcggcaggccccagggttgtacatttctaggtcagggaagagtgggaaagcggcagcgttgtactggacagtgaatgcatgtggttgtacatgtaaattctcagaaaagttttgtgagaatgaaaggacatatttgagttccg

SEQ ID NO: 680 - protein, 2047 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15238886; NR Description: protein kinase family
  misc_feature: GI Number: 7413555; NR Description: protein kinase-like [Arabidopsis thaliana] >gi|11259782|pir||T48301 protein kinase-like
  misc_feature: GI Number: 37625033; NR Description: protein kinase-like
  misc_feature: GI Number: 34907210; NR Description: putative serine/threonine kinase PBS1 protein [Oryza sativa (japonica cultivar-group)] >gi|15408807|dbj|BAB64203.1| putative serine/threonine kinase PBS1 protein [Oryza sativa (japonica
  misc_feature: GI Number: 50931229; NR Description: putative serine/threonine protein kinase [Oryza sativa (japonica cultivar-group)] >gi|49328131|gb|AAT58829.1| putative serine/threonine protein kinase [Oryza sativa (japonica
ACAAACTTCCCTGAATTCCTGTTCGCTACCTTCGCTTCCGCTCCAAAAACCAAATAAAAAACGCACCTTTCCTTCCCTTCTCCTCCCCTTCGCTTTCCCCCGTCCTCCCTTCCCTCGATCCCCTCGCCGGAAAAGATCCCATTCCATCCACCTCCACGTCCCGGCGCAATCAGAGTTTCCGGCGGCAAAGCAGGAAGGCGGAAGCGAAAGGAATGTTGCACCTTTAAGTAGCGCGGCGACCTGGTGTTTCTTCCTGGCCGGCGATGGGCTGCTTCCCGTGCTTCGACTCCCCGGCAGATGAGCAGCTTAACCCCAAATTCGGTGGCGCCGGTGGGTACGGCGGCACGTCCTCTGCCGTCGCGGCGTACGGAAACGGCACAGGCGCCGGCGTCAGCATCGGCCGGCACGGGGACAGGGGGTACCCGGACCTGCAGCAGGCGCCCATGGCGGCTCCGCGCGTCGAGAAGCTCTCAGCAGCGGCTGAGAAAGCAAGAGTAAAGAGCAATGGGCTCACCAAAGAGGCTTTGGTGCCAAAGGATGCCAATGGCAATGCCATCTCAGCGCAAACTTTCACCTTCCGTGAGCTTGCTACCGCCACCAGGAACTTCAGGCCCGAGTGCTTCCTGGGAGAGGGAGGTTTTGGACGTGTTTACAAGGGCCGCCTTGAGAGCACAGGCCAGGTTGTTGCTATAAAGCAGCTTAACAGGGATGGGCTTCAAGGAAACAGAGAATTTCTAGTAGAAGTTCTCATGCTCAGCTTACTACATCATCAAAACCTGGTTAATTTGATTGGTTATTGTGCTGATGGAGACCAGAGACTTCTTGTTTATGAATATATGCCTTCTGGATCACTTGAAGATCATTTGCACGATCTACCTCTTGATAAAGAGGCCTTGGACTGGAACACCAGGATGAAAATTGCAGCAGGTGCTGCCAAAGGACTGGAGTACCTTCATGACAAAGCTAATCCACCAGTTATTTATAGGGATTTCAAGTCATCGAACATTCTGTTGGATGAAAGTTTCCACCCGAAGCTGTCTGATTTTGGACTTGCTAAGTTGGGTCCAGTTGGCGACAAATCACATGTCTCAACACGTGTAATGGGTACATATGGTTATTGTGCACCAGAATATGCTATGACAGGGCAGCTGACAGTGAAGTCTGACGTGTATAGTTTTGGGGTTGTCTTGCTAGAGTTGATTACTGGCCGTAGGGCTATTGACAGCACCAGACCACATGGAGAACAAAATCTTGTCTCATGGGCACGTCCTCTGTTTAACGACAGAAGAAAGCTCCCTAAGATGGCTGACCCGAGGCTGGAAGGGCGATACCCCATGCGTGGGCTTTACCAAGCCCTTGCAGTGGCTTCGATGTGCATTCAGTCGGAGGCTGCTTCACGCCCACTGATTGCAGATGTCGTGACTGCTCTGTCCTACTTGGCATCCCAGCCATATGATCCCAACGCAGCTCTTGCTTCAAGGAAGCCAGGCGGCGATCAGCGAAGCAAGCCTGGCGAGAACGGCAGGGCAGTTTCCAGGAATGATGAAACTGGAAGCTCCGGCCACAAAACACCTGCCAAGGACCGAGAGGACTCACCTAGGGACCTCCCAGCGATCCTGAACAAGGACCTTGACCGGGAGCGCATGGTGGCCGAGGCGAAGATGTGGGGCGACCGGGAGCGCATGGTGGCCGAGGCTAAGATGTGGGGCGACCGAGAGCGCATGGTGGCTGAGGCGAAGATGTGGGGTGAAAATTGGCGTGACAAGCGGCGTGCAGAGATTGGGCAGGGGAGCCTGGATTCGGTTACTGGGAACAGCTAGGGGGCAATTAAGCGAACAGAAACGTGACATCCACCCATGCATTTCGTTTGTTTATTTCCAGGTCCATTTTCGTTCTGGCGGCGGTCGGCAGGCCCCAGGGTTGTACATTTCTAGGTCAGGGAAGAGTGGGAAAGCGGCAGCGTTGTACTGGACAGTGAATGCATGTGGTTGTACATGTAAATTCTCAGAAAAGTTTTGTGAGAATGAAAGGACATATTTGAGTTCCG

SEQ ID NO: 681 - DNA, 1657 bp, Zea mays
  misc_feature (1)..(1657): Ceres cDNA ID no. 12356149
  misc_feature (1)..(1657): Ceres CLONE  ID no. 277318
  misc_feature (1)..(1657): Also known as  Ceres CDNA ID no. 23759079
aattaattactttccccccaaaaaaaagccccccaccgcctcgacctcgattcctccgcccccatcgccgtcgtctcctcctccgcctccctgtctgtccgctccgcacctcccctaaaaaacccccccggccattgccgcaccgagctccccttcctcaaatgccccaggcccggacgcctcgacgcccagctccgtgctcgcatggctagcggcgtcctccatcgctccgcctccctatgtctccgcccggccgccggctcctccgccgactccggccggggccacggcgcggttatgatcggtgattcgaggacgcgcgttgctgctctgcggctgggaggatctagccggagagagttattatctgtcacaatggcctccagagatcacactggcttgacccgacaacttcttgattttcaacatgatacaatagatgaggtaggcgcaggacatgacccattcattgatttgaaagcgagattcatggactttaaacagagaaactatgtggaaaaattttcaaattaccaaacccttgctgagcagcaaacaccaaagttcatggtggttgcttgtgctgactccagggtctgccctaccgctgttttggggtttcagcctggggaagcatttacagttcgtaatgtggcaaatttggtaccaccatatgagcatggggggacagagactagtgcagcactagagtttgctgtcaataccctccaggtagaaaatgtactggtgataggccacagtaggtgtgggggcatccaggcactaatgagcatgaaagatgattcgacctccggaagcttcattaaaaactgggtttcaattgggaagagcgcaaggttaagcacgaaagctgcagctggaaatatgagttttgacatacagtgcaaacattgtgaaaaggaatcaataaatagttctctgttgaacttgttaacatacccattgattgagaagagggtgaatgaaggcactttgaatcttcatggaggctactacaacttcgtcgattgcacatttgagaaatggacattgttgtaccgtgaagggttggaaggtggaagcaagtatgccataaagaaccggtccacctggtgttgaccaacgaaggtcgtgtttacttgggtaaatttcactctgccccccgctgttcagcatggtttcgctttgccactacgttgtccatttcccattgcacctttgctccattgtggcatcgatgttctccgggtcccggtatcaaataactgtggcaaggctgttggcatgccagcttgaactgcgtgttgtagtgtcgcatacacatgcgcaggcacgtctgcatcgtagcagttatttgatacaggaactttttgatactgtagaagcacaataccacaatggagtgaggtgcaacgcgcgatggacaatatggttgcaaggtgaaagtctgtggaactgccgggggcaaagtgaattttatccaactatctgtaatatgtgtgctgttttccggttgaaactattaagaaaaaaataggaataagctgcaggatcggtcgtaatgcgtgtaattgtcgccacatttggcattaccttgctattgtaacatttgtaccatttgttgtatcattataactgagatatatacggtctcgcc

SEQ ID NO: 682 - protein, 1657 aa, Zea mays
  misc_feature: PFam Name: Pro_CA; PFam Description: Carbonic anhydrase
  misc_feature: PFam Name: Extensin_2; PFam Description: Extensin-like region
  misc_feature: PFam Name: Drf_FH1; PFam Description: Formin Homology Region 1
  misc_feature: PFam Name: Pyr_redox_2; PFam Description: Pyridine
  misc_feature: PFam Name: FH2; PFam Description: Formin Homology 2 Domain
  misc_feature: GI Number: 50725202; NR Description: putative carbonic
  misc_feature: GI Number: 12321261; NR Description: carbonic anhydrase, putative [Arabidopsis thaliana] >gi|30696223|ref|NP_176114.2| carbonic anhydrase family protein / carbonate dehydratase family
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 27652186; NR Description: carbonic anhydrase 3
AATTAATTACTTTCCCCCCAAAAAAAAGCCCCCCACCGCCTCGACCTCGATTCCTCCGCCCCCATCGCCGTCGTCTCCTCCTCCGCCTCCCTGTCTGTCCGCTCCGCACCTCCCCTAAAAAACCCCCCCGGCCATTGCCGCACCGAGCTCCCCTTCCTCAAATGCCCCAGGCCCGGACGCCTCGACGCCCAGCTCCGTGCTCGCATGGCTAGCGGCGTCCTCCATCGCTCCGCCTCCCTATGTCTCCGCCCGGCCGCCGGCTCCTCCGCCGACTCCGGCCGGGGCCACGGCGCGGTTATGATCGGTGATTCGAGGACGCGCGTTGCTGCTCTGCGGCTGGGAGGATCTAGCCGGAGAGAGTTATTATCTGTCACAATGGCCTCCAGAGATCACACTGGCTTGACCCGACAACTTCTTGATTTTCAACATGATACAATAGATGAGGTAGGCGCAGGACATGACCCATTCATTGATTTGAAAGCGAGATTCATGGACTTTAAACAGAGAAACTATGTGGAAAAATTTTCAAATTACCAAACCCTTGCTGAGCAGCAAACACCAAAGTTCATGGTGGTTGCTTGTGCTGACTCCAGGGTCTGCCCTACCGCTGTTTTGGGGTTTCAGCCTGGGGAAGCATTTACAGTTCGTAATGTGGCAAATTTGGTACCACCATATGAGCATGGGGGGACAGAGACTAGTGCAGCACTAGAGTTTGCTGTCAATACCCTCCAGGTAGAAAATGTACTGGTGATAGGCCACAGTAGGTGTGGGGGCATCCAGGCACTAATGAGCATGAAAGATGATTCGACCTCCGGAAGCTTCATTAAAAACTGGGTTTCAATTGGGAAGAGCGCAAGGTTAAGCACGAAAGCTGCAGCTGGAAATATGAGTTTTGACATACAGTGCAAACATTGTGAAAAGGAATCAATAAATAGTTCTCTGTTGAACTTGTTAACATACCCATTGATTGAGAAGAGGGTGAATGAAGGCACTTTGAATCTTCATGGAGGCTACTACAACTTCGTCGATTGCACATTTGAGAAATGGACATTGTTGTACCGTGAAGGGTTGGAAGGTGGAAGCAAGTATGCCATAAAGAACCGGTCCACCTGGTGTTGACCAACGAAGGTCGTGTTTACTTGGGTAAATTTCACTCTGCCCCCCGCTGTTCAGCATGGTTTCGCTTTGCCACTACGTTGTCCATTTCCCATTGCACCTTTGCTCCATTGTGGCATCGATGTTCTCCGGGTCCCGGTATCAAATAACTGTGGCAAGGCTGTTGGCATGCCAGCTTGAACTGCGTGTTGTAGTGTCGCATACACATGCGCAGGCACGTCTGCATCGTAGCAGTTATTTGATACAGGAACTTTTTGATACTGTAGAAGCACAATACCACAATGGAGTGAGGTGCAACGCGCGATGGACAATATGGTTGCAAGGTGAAAGTCTGTGGAACTGCCGGGGGCAAAGTGAATTTTATCCAACTATCTGTAATATGTGTGCTGTTTTCCGGTTGAAACTATTAAGAAAAAAATAGGAATAAGCTGCAGGATCGGTCGTAATGCGTGTAATTGTCGCCACATTTGGCATTACCTTGCTATTGTAACATTTGTACCATTTGTTGTATCATTATAACTGAGATATATACGGTCTCGCC

SEQ ID NO: 683 - DNA, 1486 bp, Zea mays
  misc_feature (1)..(1486): Ceres cDNA ID no. 12356243
  misc_feature (1)..(1486): Ceres CLONE  ID no. 283366
  misc_feature (1)..(1486): Also known as  Ceres CDNA ID no. 23770926
  misc_feature (943)..(943): n is a, c, t, g, unknown, or other
acgggaccggtaacttctagaacccaccaccttccatccttccttcctttcctctctctctctctctcctcgcgcccacggtgcccgccagccagatccgcgcgttcaccggcgccatggccgccgagcatgccaccgccgcggtgggtgagccgcctcccgccacgtcgcagccggcggagggcgtgacggcggcggcgggccagaggtccgtgcccacgccgttcctcagcaagacgtaccagctggtggacgacccggcggtggacgacatcatctcgtggaacgacgacgggtctgccttcatcgtgtggcgcccggcggagttcgcgcgcgatctgttgcccaagtacttcaagcacaacaacttctccagcttcgtgcgccagctcaacacctacgggttcaggaagatcgtgccggacaggtgggagttcgcgaacgactgcttccgccgaggggagaagcggctgctctgcgacatacaccgccggaaggtgtcgccggccacgggggcggtcacggtggccgccgccgccgctgcggccatcccgatggcgctgcccgtgggctctccggtgtactccggcgaggagcaggtgctgtcaagctcgtccccggagcccccgtcgctgcagcagcacccgccggcgccgtccgggtcgggctccggcggggtggtctcgggcgacgtgggcgaggagaacgagcggttgcggcgggagaacgcgcggctggcgcgcgagctcggacagatgaagaagctctgcaacaacatcctcctcctcatgtccaagtacgccgccactcagcagccggacgccgccaaggaggcggccgccgggaactgcaccggcgagtcgtcggatgccgccgcggcgcctccgctcccttcgatcctggagctcctaccctcgtgccgcgccgaccccgcgcccgctgnagccggaacggatcacgaggatgacgaaaaggcgggcgctaggctgttcggcgtctccatcgggcggaaacgaatgcgggacgagagcgaccaccacgccggcgtctgcgcagcggaggtgaaagccgagccggtggacgcgcgtcccgaccagcagcggcagcgcaacgccacggagccgcagtcgtggcccatttaccggcccaggcctgtgtaccacccgctccgggcctgcaacggctcgggcagcgctgggagcgaccacgacgggtccaacgactcgaggtgacgggagcaatcgtcgatctgccctcagtaaattagtattacacttactaatggtactaggtaactatattacaggttaaactaggatgtgagctctaaatctctaattatgtggggatttactgaccgatcctatgtaaaaatctccagtgtttatgtagttgatctcatattactgcaagtaccgagtatcctttctgtaccataaaactagaggttaacttatgcacagtagactaatattttctttaagtc

SEQ ID NO: 684 - protein, 1486 aa, Zea mays
  misc_feature: PFam Name: HSF_DNA-bind; PFam Description: HSF-type DNA-binding
  misc_feature: GI Number: 50948215; NR Description: putative heat shock factor RHSF2 [Oryza sativa (japonica cultivar-group)] >gi|42408097|dbj|BAD09238.1| putative heat shock factor RHSF2 [Oryza sativa (japonica cultivar-group)]
  misc_feature: GI Number: 33591098; NR Description: heat shock factor RHSF2
  misc_feature: GI Number: 30725616; NR Description: At4g11660 [Arabidopsis thaliana] >gi|4539457|emb|CAB39937.1| heat shock transcription factor-like protein [Arabidopsis thaliana] >gi|7267866|emb|CAB78209.1| heat shock transcription factor-like
  misc_feature: GI Number: 6624618; NR Description: heat shock factor 7
  misc_feature: GI Number: 52077316; NR Description: putative heat shock
ACGGGACCGGTAACTTCTAGAACCCACCACCTTCCATCCTTCCTTCCTTTCCTCTCTCTCTCTCTCTCCTCGCGCCCACGGTGCCCGCCAGCCAGATCCGCGCGTTCACCGGCGCCATGGCCGCCGAGCATGCCACCGCCGCGGTGGGTGAGCCGCCTCCCGCCACGTCGCAGCCGGCGGAGGGCGTGACGGCGGCGGCGGGCCAGAGGTCCGTGCCCACGCCGTTCCTCAGCAAGACGTACCAGCTGGTGGACGACCCGGCGGTGGACGACATCATCTCGTGGAACGACGACGGGTCTGCCTTCATCGTGTGGCGCCCGGCGGAGTTCGCGCGCGATCTGTTGCCCAAGTACTTCAAGCACAACAACTTCTCCAGCTTCGTGCGCCAGCTCAACACCTACGGGTTCAGGAAGATCGTGCCGGACAGGTGGGAGTTCGCGAACGACTGCTTCCGCCGAGGGGAGAAGCGGCTGCTCTGCGACATACACCGCCGGAAGGTGTCGCCGGCCACGGGGGCGGTCACGGTGGCCGCCGCCGCCGCTGCGGCCATCCCGATGGCGCTGCCCGTGGGCTCTCCGGTGTACTCCGGCGAGGAGCAGGTGCTGTCAAGCTCGTCCCCGGAGCCCCCGTCGCTGCAGCAGCACCCGCCGGCGCCGTCCGGGTCGGGCTCCGGCGGGGTGGTCTCGGGCGACGTGGGCGAGGAGAACGAGCGGTTGCGGCGGGAGAACGCGCGGCTGGCGCGCGAGCTCGGACAGATGAAGAAGCTCTGCAACAACATCCTCCTCCTCATGTCCAAGTACGCCGCCACTCAGCAGCCGGACGCCGCCAAGGAGGCGGCCGCCGGGAACTGCACCGGCGAGTCGTCGGATGCCGCCGCGGCGCCTCCGCTCCCTTCGATCCTGGAGCTCCTACCCTCGTGCCGCGCCGACCCCGCGCCCGCTGNAGCCGGAACGGATCACGAGGATGACGAAAAGGCGGGCGCTAGGCTGTTCGGCGTCTCCATCGGGCGGAAACGAATGCGGGACGAGAGCGACCACCACGCCGGCGTCTGCGCAGCGGAGGTGAAAGCCGAGCCGGTGGACGCGCGTCCCGACCAGCAGCGGCAGCGCAACGCCACGGAGCCGCAGTCGTGGCCCATTTACCGGCCCAGGCCTGTGTACCACCCGCTCCGGGCCTGCAACGGCTCGGGCAGCGCTGGGAGCGACCACGACGGGTCCAACGACTCGAGGTGACGGGAGCAATCGTCGATCTGCCCTCAGTAAATTAGTATTACACTTACTAATGGTACTAGGTAACTATATTACAGGTTAAACTAGGATGTGAGCTCTAAATCTCTAATTATGTGGGGATTTACTGACCGATCCTATGTAAAAATCTCCAGTGTTTATGTAGTTGATCTCATATTACTGCAAGTACCGAGTATCCTTTCTGTACCATAAAACTAGAGGTTAACTTATGCACAGTAGACTAATATTTTCTTTAAGTC

SEQ ID NO: 685 - DNA, 1254 bp, Zea mays
  misc_feature (1)..(1254): Ceres cDNA ID no. 12356329
  misc_feature (1)..(1254): Ceres CLONE  ID no. 287673
  misc_feature (1)..(1254): Also known as  Ceres CDNA ID no. 23780066
aatttacgacaccagctagttgttgttttcttcgaagcttcttacaggtggcgactggcgagtgccgacctcgaccgattcttcttcgaaatcctccactagaggatcgcagcttctcttttgagcgaacaataaagcaccagctgctctcacgcttccgcgtttagccaggccggccccggccacgagcccacgacaatgaagccgcccgcgtcgtccaccgccacctcctacctcctcctggccccgctcgcgatcctcctgctcgtcttcgtgctaccgtcgctccgcccttggtcccgcgtaggctccgactccgacggcctcggcatcctctgcgcccgccgcaccggcggcttcgtcgacgtcgccgctcgacgcgccggcgccgccaccgggccagacgacacgggcggcggagttcagcctactggtgggcgtgctgaccgtgccgggccggcgggagcggcgcgacatcgtgcgcacggcgtacgcgctgcagccggccgcggagggcgcgcgcgtggacgtgcgcttcgtgttctgccgcgtgacggaccccgtggacgcggcgctgctggcggtggaggcgaggcggcacggggacgtcctggtgctggacggctgcgccgagaacatgaacgacggcaagacgtacgcgtacctgtcgtcggtgccgcgcctcttcgcggcggagccgtacgactacgtgatgaaggccgacgacgacacgtacctgcgcgtggcggcgctggcgggcgagctgcggggcaagccccgccacgacgtgtacctgggctacggctacgccatgggcgggcagccgatgccgttcatgcacggcatggggtacgtggtgtcgtgggacgtggcggcctgggtggccggcgcgcgggagatcctggagcgcaacgacaccctgggccccgaggacctcatggtcggcaagtggctcaacctcgccggcaggggcaggaaccgctacgacctcaagccccggatgtacgacctcagctgggacatggacaacttcaggcccgacaccgtcgccgtgcacacgctcaagacgaaccgccggtgggcggcggcgttcaggtacttcaacgtcgtcactgcggggatcacgccgtcgtccgaactgtaccacctgccgtgatcgtctcatcgatcgaccaacactttttttttttgtaattgtctgcgacccttgccaattgtataacaattatctggcaatacatgaatggatcgtgg

SEQ ID NO: 686 - protein, 1254 aa, Zea mays
  misc_feature: PFam Name: Galactosyl_T; PFam Description: Galactosyltransferase
  misc_feature: PFam Name: Peptidase_S8; PFam Description: Subtilase family
  misc_feature: GI Number: 55741077; NR Description: hypro1 [Zea mays]
  misc_feature: GI Number: 21537037; NR Description: unknown [Arabidopsis thaliana]
  misc_feature: GI Number: 50904917; NR Description: Non-ribosomal peptide synthetase modules and related proteins-like [Oryza sativa (japonica cultivar-group)] >gi|41053033|dbj|BAD07964.1| Non-ribosomal peptide synthetase modules and related
  misc_feature: GI Number: 29830954; NR Description: putative GntR-family transcriptional regulator [Streptomyces avermitilis MA-4680] >gi|29608067|dbj|BAC72123.1| putative GntR-family transcriptional
  misc_feature: GI Number: 34900164; NR Description: putative BKRF1 encodes EBNA-1 protein, latent cycle gene [Oryza sativa (japonica cultivar-group)] >gi|23495798|dbj|BAC20008.1| putative BKRF1 encodes EBNA-1 protein, latent cycle gene [Oryza sativa (japonica
AATTTACGACACCAGCTAGTTGTTGTTTTCTTCGAAGCTTCTTACAGGTGGCGACTGGCGAGTGCCGACCTCGACCGATTCTTCTTCGAAATCCTCCACTAGAGGATCGCAGCTTCTCTTTTGAGCGAACAATAAAGCACCAGCTGCTCTCACGCTTCCGCGTTTAGCCAGGCCGGCCCCGGCCACGAGCCCACGACAATGAAGCCGCCCGCGTCGTCCACCGCCACCTCCTACCTCCTCCTGGCCCCGCTCGCGATCCTCCTGCTCGTCTTCGTGCTACCGTCGCTCCGCCCTTGGTCCCGCGTAGGCTCCGACTCCGACGGCCTCGGCATCCTCTGCGCCCGCCGCACCGGCGGCTTCGTCGACGTCGCCGCTCGACGCGCCGGCGCCGCCACCGGGCCAGACGACACGGGCGGCGGAGTTCAGCCTACTGGTGGGCGTGCTGACCGTGCCGGGCCGGCGGGAGCGGCGCGACATCGTGCGCACGGCGTACGCGCTGCAGCCGGCCGCGGAGGGCGCGCGCGTGGACGTGCGCTTCGTGTTCTGCCGCGTGACGGACCCCGTGGACGCGGCGCTGCTGGCGGTGGAGGCGAGGCGGCACGGGGACGTCCTGGTGCTGGACGGCTGCGCCGAGAACATGAACGACGGCAAGACGTACGCGTACCTGTCGTCGGTGCCGCGCCTCTTCGCGGCGGAGCCGTACGACTACGTGATGAAGGCCGACGACGACACGTACCTGCGCGTGGCGGCGCTGGCGGGCGAGCTGCGGGGCAAGCCCCGCCACGACGTGTACCTGGGCTACGGCTACGCCATGGGCGGGCAGCCGATGCCGTTCATGCACGGCATGGGGTACGTGGTGTCGTGGGACGTGGCGGCCTGGGTGGCCGGCGCGCGGGAGATCCTGGAGCGCAACGACACCCTGGGCCCCGAGGACCTCATGGTCGGCAAGTGGCTCAACCTCGCCGGCAGGGGCAGGAACCGCTACGACCTCAAGCCCCGGATGTACGACCTCAGCTGGGACATGGACAACTTCAGGCCCGACACCGTCGCCGTGCACACGCTCAAGACGAACCGCCGGTGGGCGGCGGCGTTCAGGTACTTCAACGTCGTCACTGCGGGGATCACGCCGTCGTCCGAACTGTACCACCTGCCGTGATCGTCTCATCGATCGACCAACACTTTTTTTTTTTGTAATTGTCTGCGACCCTTGCCAATTGTATAACAATTATCTGGCAATACATGAATGGATCGTGG

SEQ ID NO: 687 - DNA, 1602 bp, Zea mays
  misc_feature (1)..(1602): Ceres cDNA ID no. 12356556
  misc_feature (1)..(1602): Ceres CLONE  ID no. 306237
  misc_feature (1)..(1602): Also known as  Ceres CDNA ID no. 23782067
aaacgaaaacgagccagccgggcaaacaacactcacatcttacaccagccgcactcccctgtcctcctctccgagacgagacggacgggacggcaggcaccaccgcaccggcgccaccccacccgccggctcagagcgggggcccggccacccgaatcacacagatcggaacgccggaggaggagcaacgcgggcgcggagaggcccgccagcgaaggcgcagtgcaagctctgggttcccggatccgataccaccggtctctcggcgagtgtgtaatccagcgagcgagcgctcggtttttgccgtgagagcgggagatgagtgctctgaagaaatccgacaagaaagccgccctcgacttcgcggcatggagcttcaacgtcaccacgtcggtcggactcatcatggtcaacaaggcgttgatggctacgtatggattcagttttgccacgacattaactgggcttcattttgtgaccactaccttgatgactatcgtatttcgatggttaggcctgagccagccatcccacttacccctagcagatctagttaaatttgtgatattttcgaacttgtcaattgttgggatgaatgtgagcttgatgtggaactctgtgggcttttatcagatagcaaagctgtgcatgatacctgcatcctgtcttctggaggttgtctttgatcatgtacattattcccgggacacaaagctgagcataatggtcgtgcttataggagttgcagtctgcacagttactgatgtcagtgtgaatgcaagaggtctaatcgcggctgttatagctgtttggagcacagctttgcaacaatattatgtccattttctccaacgcaagtactctttgaactcattcaacctgctgggccacactgctccagcccaagctgggtcactcctgctagtgggaccatttgcagattacttgttgacaggcaaaagggtggatcacttcagtttctcatcacttgctctgtttttcctggcactctcatgcttcatcgccattggtgttaatctgagccaattcatctgtattgggcgcttctctgctgtatccttccaagtcttaggccacatgaagaccgtacttgttctgtcccttgggttcctactctttggcaaggagggcctgaatcttcaggtagtccttgggatggttctggccgttcttggaatgatatggtacgggaacgcatctgccaaaccaggcggcaaagagcggcgcagcgtcctaccgctgaggtctgcaagtctcaagggaagttcggaagaaaagggcggtgccgagaaatagtcttgctctctctgattgccaacttgaacggggagttttccgttccaaggttgaatttctggtgaggtgacgtgaagtaccacatattgggaactcttgcctaatatttgacgcagagaacaaactcgttccatctagaaacccaggattgttatagttacaggtatactgtaaaggttcattttttttggcgctctgaatcaatttgcagtgaggggaaagacagacatggttgttacgagtcttcaagacagttttttatcgaatatataatgcagttgtttg

SEQ ID NO: 688 - protein, 1602 aa, Zea mays
  misc_feature: GI Number: 50933293; NR Description: putative transmembrane protein [Oryza sativa (japonica cultivar-group)] >gi|48843759|gb|AAT47018.1| putative transmembrane protein [Oryza
  misc_feature: GI Number: 30313364; NR Description: putative transmembrane
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
  misc_feature: GI Number: 21593003; NR Description: unknown [Arabidopsis thaliana]
  misc_feature: GI Number: 21595054; NR Description: unknown [Arabidopsis thaliana]
AAACGAAAACGAGCCAGCCGGGCAAACAACACTCACATCTTACACCAGCCGCACTCCCCTGTCCTCCTCTCCGAGACGAGACGGACGGGACGGCAGGCACCACCGCACCGGCGCCACCCCACCCGCCGGCTCAGAGCGGGGGCCCGGCCACCCGAATCACACAGATCGGAACGCCGGAGGAGGAGCAACGCGGGCGCGGAGAGGCCCGCCAGCGAAGGCGCAGTGCAAGCTCTGGGTTCCCGGATCCGATACCACCGGTCTCTCGGCGAGTGTGTAATCCAGCGAGCGAGCGCTCGGTTTTTGCCGTGAGAGCGGGAGATGAGTGCTCTGAAGAAATCCGACAAGAAAGCCGCCCTCGACTTCGCGGCATGGAGCTTCAACGTCACCACGTCGGTCGGACTCATCATGGTCAACAAGGCGTTGATGGCTACGTATGGATTCAGTTTTGCCACGACATTAACTGGGCTTCATTTTGTGACCACTACCTTGATGACTATCGTATTTCGATGGTTAGGCCTGAGCCAGCCATCCCACTTACCCCTAGCAGATCTAGTTAAATTTGTGATATTTTCGAACTTGTCAATTGTTGGGATGAATGTGAGCTTGATGTGGAACTCTGTGGGCTTTTATCAGATAGCAAAGCTGTGCATGATACCTGCATCCTGTCTTCTGGAGGTTGTCTTTGATCATGTACATTATTCCCGGGACACAAAGCTGAGCATAATGGTCGTGCTTATAGGAGTTGCAGTCTGCACAGTTACTGATGTCAGTGTGAATGCAAGAGGTCTAATCGCGGCTGTTATAGCTGTTTGGAGCACAGCTTTGCAACAATATTATGTCCATTTTCTCCAACGCAAGTACTCTTTGAACTCATTCAACCTGCTGGGCCACACTGCTCCAGCCCAAGCTGGGTCACTCCTGCTAGTGGGACCATTTGCAGATTACTTGTTGACAGGCAAAAGGGTGGATCACTTCAGTTTCTCATCACTTGCTCTGTTTTTCCTGGCACTCTCATGCTTCATCGCCATTGGTGTTAATCTGAGCCAATTCATCTGTATTGGGCGCTTCTCTGCTGTATCCTTCCAAGTCTTAGGCCACATGAAGACCGTACTTGTTCTGTCCCTTGGGTTCCTACTCTTTGGCAAGGAGGGCCTGAATCTTCAGGTAGTCCTTGGGATGGTTCTGGCCGTTCTTGGAATGATATGGTACGGGAACGCATCTGCCAAACCAGGCGGCAAAGAGCGGCGCAGCGTCCTACCGCTGAGGTCTGCAAGTCTCAAGGGAAGTTCGGAAGAAAAGGGCGGTGCCGAGAAATAGTCTTGCTCTCTCTGATTGCCAACTTGAACGGGGAGTTTTCCGTTCCAAGGTTGAATTTCTGGTGAGGTGACGTGAAGTACCACATATTGGGAACTCTTGCCTAATATTTGACGCAGAGAACAAACTCGTTCCATCTAGAAACCCAGGATTGTTATAGTTACAGGTATACTGTAAAGGTTCATTTTTTTTGGCGCTCTGAATCAATTTGCAGTGAGGGGAAAGACAGACATGGTTGTTACGAGTCTTCAAGACAGTTTTTTATCGAATATATAATGCAGTTGTTTG

SEQ ID NO: 689 - DNA, 1422 bp, Zea mays
  misc_feature (1)..(1422): Ceres cDNA ID no. 12356590
  misc_feature (1)..(1422): Ceres CLONE  ID no. 299665
  misc_feature (1)..(1422): Also known as  Ceres CDNA ID no. 23761651
attctccaccttcttcaaaggttcaactcagagaggagagaactagagaaagatccccacccccaggcgacgcgaccggcgagccccgaaaccctaggtcgcgcgacccgggcagcgcgcttctgcgtgactgcgtgtctttcggggaggggacagcgttaggacgcgacgaggttagcgaggccgtctggccgactataagcggaagaatctcctccgaagccttcctagagctgtgaagagcgcgtggatctcctggatttgcagactcgaggggagctgagacaagacatgggttggggaatatccaggttgattggactgaaggctgctgccctgctttctgtagcatgttttttccaaggactaggagtgacccttatctcatttcctctcatatatgcatccataattgcaatactagtctcgatagcttcccgcccatctattgatcttcctttactccttggcaaggcatccgatggaagttttccattgtggtcatggatcatcttctcaccatttcttcttttcattcacctgttcgtgctgctacggagatttgtgaaaaacgagcccttatacactgaggttgcagatggtgtgtttgttggagggtggccttcttcagttgaacacctgccaccaggtgaccccgcgatcatagattgcacgtgcgagctgccaaaaagctcgactatctctaacaatgcatatttgtgcattgctacctgggacacgagggctcctcagccatcacagattgagtctgccgtgcaatgggctgtgagaaagcggtcacagaacaagcctgtctatgtccactgtgcctatggtcatggcagaagtgtctgtgtgatgtgtgcgcttcttgtcgcattagggttcgctgaagattggaaagctgctgcacaaatgatccgtgagaagcgaccttctattagcatgaatactcttcaccgcaaaagcttggaggaatggtcaaaacatttgctctcctctaaaagaagtggggaatcagatgtgagttctgttatacattcggattataaccggaaataaaattgaaccagcaagggacaggcgtgttcagttgctgtgacattgaagatgcattacattcggtagtattgtttgctgctgtcctagtgaatgcctatggttcattttaaattatccttttgtggcatttgtgttgtaaaaactatatgtatcaaattatattagtactgtaggtttacccggctagttcttcaaggaagatgtactgtccttgtctccttttttctgataccagtgcccttgcctctcatcgaatgcttgccagggaagtgctgttgccggaccctttggggcgagaaaaccctgcattcttgcattcctgctgggttctcatttatagctatatgtgatatgtttcgt

SEQ ID NO: 690 - protein, 1422 aa, Zea mays
  misc_feature: PFam Name: DSPc; PFam Description: Dual specificity
  misc_feature: GI Number: 34908470; NR Description: P0489B03.9 [Oryza sativa (japonica cultivar-group)] >gi|20161641|dbj|BAB90560.1| P0489B03.9 [Oryza sativa (japonica cultivar-group)] >gi|20521237|dbj|BAB91753.1| P0679C12.2 [Oryza sativa (japonica
  misc_feature: GI Number: 45517361; NR Description: COG0671: Membrane-associated phospholipid phosphatase [Ralstonia eutropha
  misc_feature: GI Number: 48864307; NR Description: COG1597: Sphingosine kinase and enzymes related to eukaryotic diacylglycerol kinase
  misc_feature: GI Number: 46320260; NR Description: COG0671: Membrane-associated phospholipid phosphatase [Burkholderia cepacia
  misc_feature: GI Number: 50084824; NR Description: putative phosphatase [Acinetobacter sp. ADP1] >gi|49530800|emb|CAG68512.1| putative
ATTCTCCACCTTCTTCAAAGGTTCAACTCAGAGAGGAGAGAACTAGAGAAAGATCCCCACCCCCAGGCGACGCGACCGGCGAGCCCCGAAACCCTAGGTCGCGCGACCCGGGCAGCGCGCTTCTGCGTGACTGCGTGTCTTTCGGGGAGGGGACAGCGTTAGGACGCGACGAGGTTAGCGAGGCCGTCTGGCCGACTATAAGCGGAAGAATCTCCTCCGAAGCCTTCCTAGAGCTGTGAAGAGCGCGTGGATCTCCTGGATTTGCAGACTCGAGGGGAGCTGAGACAAGACATGGGTTGGGGAATATCCAGGTTGATTGGACTGAAGGCTGCTGCCCTGCTTTCTGTAGCATGTTTTTTCCAAGGACTAGGAGTGACCCTTATCTCATTTCCTCTCATATATGCATCCATAATTGCAATACTAGTCTCGATAGCTTCCCGCCCATCTATTGATCTTCCTTTACTCCTTGGCAAGGCATCCGATGGAAGTTTTCCATTGTGGTCATGGATCATCTTCTCACCATTTCTTCTTTTCATTCACCTGTTCGTGCTGCTACGGAGATTTGTGAAAAACGAGCCCTTATACACTGAGGTTGCAGATGGTGTGTTTGTTGGAGGGTGGCCTTCTTCAGTTGAACACCTGCCACCAGGTGACCCCGCGATCATAGATTGCACGTGCGAGCTGCCAAAAAGCTCGACTATCTCTAACAATGCATATTTGTGCATTGCTACCTGGGACACGAGGGCTCCTCAGCCATCACAGATTGAGTCTGCCGTGCAATGGGCTGTGAGAAAGCGGTCACAGAACAAGCCTGTCTATGTCCACTGTGCCTATGGTCATGGCAGAAGTGTCTGTGTGATGTGTGCGCTTCTTGTCGCATTAGGGTTCGCTGAAGATTGGAAAGCTGCTGCACAAATGATCCGTGAGAAGCGACCTTCTATTAGCATGAATACTCTTCACCGCAAAAGCTTGGAGGAATGGTCAAAACATTTGCTCTCCTCTAAAAGAAGTGGGGAATCAGATGTGAGTTCTGTTATACATTCGGATTATAACCGGAAATAAAATTGAACCAGCAAGGGACAGGCGTGTTCAGTTGCTGTGACATTGAAGATGCATTACATTCGGTAGTATTGTTTGCTGCTGTCCTAGTGAATGCCTATGGTTCATTTTAAATTATCCTTTTGTGGCATTTGTGTTGTAAAAACTATATGTATCAAATTATATTAGTACTGTAGGTTTACCCGGCTAGTTCTTCAAGGAAGATGTACTGTCCTTGTCTCCTTTTTTCTGATACCAGTGCCCTTGCCTCTCATCGAATGCTTGCCAGGGAAGTGCTGTTGCCGGACCCTTTGGGGCGAGAAAACCCTGCATTCTTGCATTCCTGCTGGGTTCTCATTTATAGCTATATGTGATATGTTTCGT

SEQ ID NO: 691 - DNA, 1918 bp, Zea mays
  misc_feature (1)..(1918): Ceres cDNA ID no. 12356802
  misc_feature (1)..(1918): Ceres CLONE  ID no. 327253
  misc_feature (1)..(1918): Also known as  Ceres CDNA ID no. 23767372
agattgacctgttgccctgttgagtgtgaaggaggcgcacgcgcttgagctgaagaaactgccgcgctgatctagcccgccgggatgggcgcctcggggcctgcggctccgccggcaacgcatcgccgccgctgcatccagctgctgctgctgctcgccctggccgtcgcgccgcttggcagccgtgggcttcgcgtccgtgccgcgggggcggacacgggagggctgagccgggacgcgttcccgaaggggttcgtcttcgggacggcgacgtccgcgtaccaggtcgagggcgcggcgacgtccggcggccgcgggccctgcatctgggatcccttcgtccacacccccggaaagattgctgaagacgccaacgcagatgttacaacagatgaatatcatcgctacaaggaagatgttgatctcatgaaaagcctaaattttgatgcataccggttttcaatctcctggtccaggatcttcccagatggcgaagggaaaattaatgaagaaggagtacagtattacaacaatcttatagactacatgattaagcaaggccttactccttacgccaaccttaaccactatgatcttccgcttgcgcttcagaagaagtaccaaggctggttaggcccaaaaattgtggacatatttgctgactatgctgatttttgtttcaagacttttggcaatcgagtcaagaactggttcacattaaatgagccaaggatagtagcattccttggttatgataaagggcttaacccccctaaccggtgcacacaatgcactgccggtgggaactcatcgacagaaccttacattgttgttcataacattctcctatctcatgctactgcagttgcaagataccgcaataaataccaggcaactcagaaaggcaaggtcgggatagttcttgacttcaactggtatgaaccttttacaaactcaactgaagatcaaaaagcagcgcaaagggccagggacttccatattggttggtttcttgatccattaataaatgggcaatatccaaagataatgcaagacattgtgaaagaccggctaccaagtttcacacctgaacaggccaagctagtcaagggctcatcagactatttcgggatcaatcaatatactacatactacattgcagatcaacaaactcctccgcagggaccaccgagctactcgtccgactggggcgtccaatattactttcaaaggaatggcgtgcaaattggacagatggcgcactcaatttggctttacatcgtcccatcggggcatgtatggagtcgtgaactacctaaaggaaaagtaccataatccaatcatcatcatatcggaaaacggaatggatcagcctggaaacctcacgcgcgaggagtacgtgcacgacgccgtgaggatcgacttctacaagaactacctgacggagctaaagagagggatcgacggcggcgcgaacgtgatcggctacttcgcgtggtctctcctggacaacttcgagtggctgtcgggctacacgtccaagttcggcatcgtctacgtcgacttcgcgacgctgaagcggtaccccaaggactcggcgtactggttcagagacatgctttcggggacgggctccaaggctgctaccccgcagactggttcaggcggccggccggctggttcggcttcagccacctcgaacggacctgccttgctggtctcccttttggtctccttgggtgttctgcttccatccatcttcatggtttcctcggtctaattagaaatgtattttcatagtacggatttgtagttgtgtggatgacaacatgttccttttaagaatcaggacatgttgcatcgatgcgggacctgttgtaggaatgagaccatgattcagggcttattgttcagagtc

SEQ ID NO: 692 - protein, 1918 aa, Zea mays
  misc_feature: PFam Name: Glyco_hydro_1; PFam Description: Glycosyl
  misc_feature: GI Number: 62733403; NR Description: Putative Glycosyl
  misc_feature: GI Number: 50918079; NR Description: beta-glucosidase (with alternative splicing) [Oryza sativa (japonica cultivar-group)] >gi|41469453|gb|AAS07254.1| beta-glucosidase (with alternative
  misc_feature: GI Number: 9294062; NR Description: beta-glucosidase
  misc_feature: GI Number: 18875458; NR Description: beta-glucosidase [Oryza
  misc_feature: GI Number: 50881478; NR Description: beta-glucosidase,
AGATTGACCTGTTGCCCTGTTGAGTGTGAAGGAGGCGCACGCGCTTGAGCTGAAGAAACTGCCGCGCTGATCTAGCCCGCCGGGATGGGCGCCTCGGGGCCTGCGGCTCCGCCGGCAACGCATCGCCGCCGCTGCATCCAGCTGCTGCTGCTGCTCGCCCTGGCCGTCGCGCCGCTTGGCAGCCGTGGGCTTCGCGTCCGTGCCGCGGGGGCGGACACGGGAGGGCTGAGCCGGGACGCGTTCCCGAAGGGGTTCGTCTTCGGGACGGCGACGTCCGCGTACCAGGTCGAGGGCGCGGCGACGTCCGGCGGCCGCGGGCCCTGCATCTGGGATCCCTTCGTCCACACCCCCGGAAAGATTGCTGAAGACGCCAACGCAGATGTTACAACAGATGAATATCATCGCTACAAGGAAGATGTTGATCTCATGAAAAGCCTAAATTTTGATGCATACCGGTTTTCAATCTCCTGGTCCAGGATCTTCCCAGATGGCGAAGGGAAAATTAATGAAGAAGGAGTACAGTATTACAACAATCTTATAGACTACATGATTAAGCAAGGCCTTACTCCTTACGCCAACCTTAACCACTATGATCTTCCGCTTGCGCTTCAGAAGAAGTACCAAGGCTGGTTAGGCCCAAAAATTGTGGACATATTTGCTGACTATGCTGATTTTTGTTTCAAGACTTTTGGCAATCGAGTCAAGAACTGGTTCACATTAAATGAGCCAAGGATAGTAGCATTCCTTGGTTATGATAAAGGGCTTAACCCCCCTAACCGGTGCACACAATGCACTGCCGGTGGGAACTCATCGACAGAACCTTACATTGTTGTTCATAACATTCTCCTATCTCATGCTACTGCAGTTGCAAGATACCGCAATAAATACCAGGCAACTCAGAAAGGCAAGGTCGGGATAGTTCTTGACTTCAACTGGTATGAACCTTTTACAAACTCAACTGAAGATCAAAAAGCAGCGCAAAGGGCCAGGGACTTCCATATTGGTTGGTTTCTTGATCCATTAATAAATGGGCAATATCCAAAGATAATGCAAGACATTGTGAAAGACCGGCTACCAAGTTTCACACCTGAACAGGCCAAGCTAGTCAAGGGCTCATCAGACTATTTCGGGATCAATCAATATACTACATACTACATTGCAGATCAACAAACTCCTCCGCAGGGACCACCGAGCTACTCGTCCGACTGGGGCGTCCAATATTACTTTCAAAGGAATGGCGTGCAAATTGGACAGATGGCGCACTCAATTTGGCTTTACATCGTCCCATCGGGGCATGTATGGAGTCGTGAACTACCTAAAGGAAAAGTACCATAATCCAATCATCATCATATCGGAAAACGGAATGGATCAGCCTGGAAACCTCACGCGCGAGGAGTACGTGCACGACGCCGTGAGGATCGACTTCTACAAGAACTACCTGACGGAGCTAAAGAGAGGGATCGACGGCGGCGCGAACGTGATCGGCTACTTCGCGTGGTCTCTCCTGGACAACTTCGAGTGGCTGTCGGGCTACACGTCCAAGTTCGGCATCGTCTACGTCGACTTCGCGACGCTGAAGCGGTACCCCAAGGACTCGGCGTACTGGTTCAGAGACATGCTTTCGGGGACGGGCTCCAAGGCTGCTACCCCGCAGACTGGTTCAGGCGGCCGGCCGGCTGGTTCGGCTTCAGCCACCTCGAACGGACCTGCCTTGCTGGTCTCCCTTTTGGTCTCCTTGGGTGTTCTGCTTCCATCCATCTTCATGGTTTCCTCGGTCTAATTAGAAATGTATTTTCATAGTACGGATTTGTAGTTGTGTGGATGACAACATGTTCCTTTTAAGAATCAGGACATGTTGCATCGATGCGGGACCTGTTGTAGGAATGAGACCATGATTCAGGGCTTATTGTTCAGAGTC

SEQ ID NO: 693 - DNA, 1192 bp, Zea mays
  misc_feature (1)..(1192): Ceres cDNA ID no. 12356872
  misc_feature (1)..(1192): Ceres CLONE  ID no. 322788
  misc_feature (1)..(1192): Also known as  Ceres CDNA ID no. 23788635
accgtctctgcctcctctcgcgcagatccgcccctggccaagagcccaagaccatcgcgtccctcttcctggactccggggagtagtccttcgccaactcctcggcgcggacgacgcgccacgtggactgcgcgtccgacagccagtccaccgagtccgaggccccggcggccgacgacttcgcggacgccatcgtccgggggctccgctccgacgaccgcctcctcttcgagccccacgggccctccagctccatcctcgagaggaagcctccggcggcgcctgccctgcggccgcgagcagcggcgtcctcctcgtccttcgttgacggcgtcgcggtggcgttcgactccgccgacccgtcagatggtgatggtgtcaggcggcggggggaacgcgtgggcgaaggagatgaccctccgccgcaggatagccagcatattcaacaagacgcaggaacacttccctactctgaaggactacaacgattatctggaagaagttgaggatatgactttcaacctgatcgaagggatagatgtcgaggagattgaagcaaaaattgcaagataccaacaggaaaatgcggagcagatatacttgtccagagctaaaagggcggaagatcttgcggcagcacttaaagcaagcaggatgaaccctgtaaaggccgaggccaatgatacggctgctgggagttctcagggtattagtggcggggcaggagttcagggccagtatgcacctgccgctgttcttgggggagtggctcagccccgccccacaggtatggcgccccaactaatcggcagtgggtcggatcctctgcaaggagacgacgaggagaccaggagactacgcgcagagcgagcagcacgggctggcggatggactgctgaattgagcaagagaagagcgcttgaggaggcgtttagcgccatattcatctaggattagatcaaaaggcaacacatggcctgcattggcattggtaaaacctgcactagttctgcagggcaaagaataagaactactcaatcagatgccgccatgcaaaagttaaaatgtgtctctatccatggcagggctactctaaaactaactaaatatattactagtggtctttcacatttgcatggttggtcttattgtgaccggcaagtcagtaagtgggcagccgagccttttgttc

SEQ ID NO: 694 - protein, 1192 aa, Zea mays
  misc_feature: PFam Name: MAT1; PFam Description: CDK-activating kinase
  misc_feature: PFam Name: FH2; PFam Description: Formin Homology 2 Domain
  misc_feature: GI Number: 50949197; NR Description: Similar to Arabidopsis thaliana chromosome 4 BAC F6I18; membrane-associated salt-inducible protein. (AL022198) [Oryza sativa (japonica cultivar-group)] >gi|8096402|dbj|BAA95872.1| Similar to
  misc_feature: GI Number: 21553393; NR Description: unknown [Arabidopsis thaliana]
  misc_feature: GI Number: 7269983; NR Description: puative protein [Arabidopsis thaliana] >gi|2980784|emb|CAA18211.1| puative protein [Arabidopsis thaliana] >gi|25407684|pir||G85360 puative protein
  misc_feature: GI Number: 34908538; NR Description: P0423B08.18 [Oryza sativa (japonica cultivar-group)] >gi|15290117|dbj|BAB63809.1|
  misc_feature: GI Number: 1708933; NR Description: CDK-activating kinase assembly factor MAT1 (RING finger protein MAT1) (Menage a trois) (CDK7/cyclin H assembly factor) >gi|2133774|pir||S60118 RING finger protein MAT1 - starfish (Marthasterias glacialis)
ACCGTCTCTGCCTCCTCTCGCGCAGATCCGCCCCTGGCCAAGAGCCCAAGACCATCGCGTCCCTCTTCCTGGACTCCGGGGAGTAGTCCTTCGCCAACTCCTCGGCGCGGACGACGCGCCACGTGGACTGCGCGTCCGACAGCCAGTCCACCGAGTCCGAGGCCCCGGCGGCCGACGACTTCGCGGACGCCATCGTCCGGGGGCTCCGCTCCGACGACCGCCTCCTCTTCGAGCCCCACGGGCCCTCCAGCTCCATCCTCGAGAGGAAGCCTCCGGCGGCGCCTGCCCTGCGGCCGCGAGCAGCGGCGTCCTCCTCGTCCTTCGTTGACGGCGTCGCGGTGGCGTTCGACTCCGCCGACCCGTCAGATGGTGATGGTGTCAGGCGGCGGGGGGAACGCGTGGGCGAAGGAGATGACCCTCCGCCGCAGGATAGCCAGCATATTCAACAAGACGCAGGAACACTTCCCTACTCTGAAGGACTACAACGATTATCTGGAAGAAGTTGAGGATATGACTTTCAACCTGATCGAAGGGATAGATGTCGAGGAGATTGAAGCAAAAATTGCAAGATACCAACAGGAAAATGCGGAGCAGATATACTTGTCCAGAGCTAAAAGGGCGGAAGATCTTGCGGCAGCACTTAAAGCAAGCAGGATGAACCCTGTAAAGGCCGAGGCCAATGATACGGCTGCTGGGAGTTCTCAGGGTATTAGTGGCGGGGCAGGAGTTCAGGGCCAGTATGCACCTGCCGCTGTTCTTGGGGGAGTGGCTCAGCCCCGCCCCACAGGTATGGCGCCCCAACTAATCGGCAGTGGGTCGGATCCTCTGCAAGGAGACGACGAGGAGACCAGGAGACTACGCGCAGAGCGAGCAGCACGGGCTGGCGGATGGACTGCTGAATTGAGCAAGAGAAGAGCGCTTGAGGAGGCGTTTAGCGCCATATTCATCTAGGATTAGATCAAAAGGCAACACATGGCCTGCATTGGCATTGGTAAAACCTGCACTAGTTCTGCAGGGCAAAGAATAAGAACTACTCAATCAGATGCCGCCATGCAAAAGTTAAAATGTGTCTCTATCCATGGCAGGGCTACTCTAAAACTAACTAAATATATTACTAGTGGTCTTTCACATTTGCATGGTTGGTCTTATTGTGACCGGCAAGTCAGTAAGTGGGCAGCCGAGCCTTTTGTTC

SEQ ID NO: 695 - DNA, 1487 bp, Zea mays
  misc_feature (1)..(1487): Ceres cDNA ID no. 12357130
  misc_feature (1)..(1487): Ceres CLONE  ID no. 342615
  misc_feature (1)..(1487): Also known as  Ceres CDNA ID no. 23755556
cgagggcatgctggcccacgacgccggccgcggcgtgttcgactcgggccgcgaccccggattcctggatgtgctcgaccaacacccggagaacgccgaccgcgtccgcaacatggtctccatcctccgccgcgggcccatcgcgcacttcctctcctggcactcgggccgccctgcccacgcctccgagctcctctccttccactcctcagaatacatagaggagctcgtccagacgaacgccaccggagccaagaagaagctctgtgagggcacgttcttgaacccgggctcctggggtgcggcgcttctagcggccgggaccacgctctcctccgcgaagcacatactagacgggcaggggaacctggcctacgcgttggttcgcccccctggccaccacgcgcagcccgaccacgccgatggctactgctttctgaacaatgccggacttgctgtgcaactggctctggattccgggcgcgcaaaggtcgccgttgtggatattgatgtgcactacgggaatggcaccgcggagggcttctatcggacagacaccgtgttgacgatgtctcttcacatgatgcatggttcttgggggccatcgcatccgcagagtggctccgtcgatgagattggtgagggcaaggggcttgggtacaatctcaatatacctttgcctaatggaagtggagatgctgggtatgaatatgcgatgaacgagttggttgttccatcgattgataagtttcagcctcaactgttgtttcttgtggttggccaagattccagtgcgtttgatcccaatggaagacagtgcttgaccatggaaggctacaggaaaattggacaaataatgaggcgcctggctgatcgccattgcaatgggcaaatactggttgtccaggaagggggttaccacatcacttattcggcatattgtctgcatgctacactggaaggagttttggatctggaagccccgctgcttgatgacccaatcgcttattatccggaggatgataaatacactatgaaagtcgttgacatgataaagagctactggaaggaatcggttcctttcctaaaggaaatttagaggaaataatgttcgcgccctcaatgttcaaattgcaggaaactccacattcctggacatcttcaattgaattgggaagaacattgcacgtctacgttttcaggccgtttaagattatctgattgacagtttcacgcctaacattgtacaggatagattaagaacattgtttgctgctgctcttgaatttctgcaatcaggatctcgtcagcctatttttgataaacagtcgatctttttttttccctgagatgcttttggcggcagtagaaggtaggcggtgcttgagagtgacagagggccatgtaaccaggggataaatcttgattgactagtccaagcaaagggtgatgctcgctaccagaacttgaatgtgtttttttttttc

SEQ ID NO: 696 - protein, 1487 aa, Zea mays
  misc_feature: PFam Name: Hist_deacetyl; PFam Description: Histone
  misc_feature: GI Number: 20453297; NR Description: At1g08460/T27G7_7 [Arabidopsis thaliana] >gi|21360988|gb|AAM49769.1| HDA8 [Arabidopsis thaliana] >gi|15294162|gb|AAK95258.1| At1g08460/T27G7_7 [Arabidopsis thaliana]
  misc_feature: GI Number: 25407044; NR Description: protein T27G7.14 [imported] - Arabidopsis thaliana >gi|6664310|gb|AAF22892.1|
  misc_feature: GI Number: 16226923; NR Description: At1g08460/T27G7_7
  misc_feature: GI Number: 53717749; NR Description: histone deacetylase family protein [Burkholderia pseudomallei K96243] >gi|52208163|emb|CAH34093.1| histone deacetylase family protein
  misc_feature: GI Number: 32038919; NR Description: COG0123: Deacetylases, including yeast histone deacetylase and acetoin utilization protein
CGAGGGCATGCTGGCCCACGACGCCGGCCGCGGCGTGTTCGACTCGGGCCGCGACCCCGGATTCCTGGATGTGCTCGACCAACACCCGGAGAACGCCGACCGCGTCCGCAACATGGTCTCCATCCTCCGCCGCGGGCCCATCGCGCACTTCCTCTCCTGGCACTCGGGCCGCCCTGCCCACGCCTCCGAGCTCCTCTCCTTCCACTCCTCAGAATACATAGAGGAGCTCGTCCAGACGAACGCCACCGGAGCCAAGAAGAAGCTCTGTGAGGGCACGTTCTTGAACCCGGGCTCCTGGGGTGCGGCGCTTCTAGCGGCCGGGACCACGCTCTCCTCCGCGAAGCACATACTAGACGGGCAGGGGAACCTGGCCTACGCGTTGGTTCGCCCCCCTGGCCACCACGCGCAGCCCGACCACGCCGATGGCTACTGCTTTCTGAACAATGCCGGACTTGCTGTGCAACTGGCTCTGGATTCCGGGCGCGCAAAGGTCGCCGTTGTGGATATTGATGTGCACTACGGGAATGGCACCGCGGAGGGCTTCTATCGGACAGACACCGTGTTGACGATGTCTCTTCACATGATGCATGGTTCTTGGGGGCCATCGCATCCGCAGAGTGGCTCCGTCGATGAGATTGGTGAGGGCAAGGGGCTTGGGTACAATCTCAATATACCTTTGCCTAATGGAAGTGGAGATGCTGGGTATGAATATGCGATGAACGAGTTGGTTGTTCCATCGATTGATAAGTTTCAGCCTCAACTGTTGTTTCTTGTGGTTGGCCAAGATTCCAGTGCGTTTGATCCCAATGGAAGACAGTGCTTGACCATGGAAGGCTACAGGAAAATTGGACAAATAATGAGGCGCCTGGCTGATCGCCATTGCAATGGGCAAATACTGGTTGTCCAGGAAGGGGGTTACCACATCACTTATTCGGCATATTGTCTGCATGCTACACTGGAAGGAGTTTTGGATCTGGAAGCCCCGCTGCTTGATGACCCAATCGCTTATTATCCGGAGGATGATAAATACACTATGAAAGTCGTTGACATGATAAAGAGCTACTGGAAGGAATCGGTTCCTTTCCTAAAGGAAATTTAGAGGAAATAATGTTCGCGCCCTCAATGTTCAAATTGCAGGAAACTCCACATTCCTGGACATCTTCAATTGAATTGGGAAGAACATTGCACGTCTACGTTTTCAGGCCGTTTAAGATTATCTGATTGACAGTTTCACGCCTAACATTGTACAGGATAGATTAAGAACATTGTTTGCTGCTGCTCTTGAATTTCTGCAATCAGGATCTCGTCAGCCTATTTTTGATAAACAGTCGATCTTTTTTTTTCCCTGAGATGCTTTTGGCGGCAGTAGAAGGTAGGCGGTGCTTGAGAGTGACAGAGGGCCATGTAACCAGGGGATAAATCTTGATTGACTAGTCCAAGCAAAGGGTGATGCTCGCTACCAGAACTTGAATGTGTTTTTTTTTTTC

SEQ ID NO: 697 - DNA, 1828 bp, Zea mays
  misc_feature (1)..(1828): Ceres cDNA ID no. 12357360
  misc_feature (1)..(1828): Ceres CLONE  ID no. 327734
  misc_feature (1)..(1828): Also known as  Ceres CDNA ID no. 23767787
aaaaaaaccagcgactcacacacccgcgcgccgcttctgtagggccccaaccaaccgcgcagggagaaaaccaccacagcacatgcagcgcctcgcctcctcccggaggctcctccaggccgcgctcgcccccgcccgggccaactccagcctctccgcggccgccgtcgccgcgcccgcgccagcgaatggcgccttcccgaagatgccggccttcgactacacgccgccgccgtacgacgggccgcgcgccgaggagatcttccggaagcgcgctcagttcctcagcccatccctttttcatttctacgatcgcccattgaacatagtcgaaggaaagatgcagtacctatttgatgaggatggccgtcgttacctggatgctttcggtggcattgcaacagtttgttgtgggcactgccatccagatgttgttgaagccatagtaaaccaggcaaagcggatccagcactccacagttctatatctcaatcatgcaattgcagattttgccgaggcattggcttccaaaatgcctggtgatctgaaggttgttttcttcacaaattcaggcacggaggcaaatgagcttgcactgatgattgcacggctttacactggttgcaatgacattatctctcttaggaatggataccatgggaatgctgctggaacaatgggtgctactgctcaatccaattggaaattcaatgttgttcagacgggagtacaccatgcgcttaatccagaccccttcagaggtgcttttggttctgacggggagaaatacgccagagatgttcaggaaatggtcgaatttggaactacagggagagttggtgggttcatttcggaagccatacagggggttggtggaatagtggaactggcaccaggatacttgcccgtggcatacagtatggtaaggaaagccggtgggctctgcatcgccgacgaagttcaggcaggagtcgcgagaactggaagccacttctggggattcgaagggcatggtgtcatcccggacatagtcaccatggccaagggtatcgggaatggcatacccataggagctgtagtaacgacgccagagatcgctcaggtgttgacccgcagaagctacttcaatacctttggtggtaaccctgtcagcactgcaggcgggcatgcggtgctcaaagtgctggagaaggagaagctccaggagaatgcgtttgttgtgggctcctacctaaaggaacagcttaacaatctgaaagacaagcatgagatcatcggtgacgttaggggcaaaggcttccttcttggagttgagctggtgacagaccatgaaaagaaaaccccagccaaagctgagatctcacgtgtcatgaaccatatgaaagatatgggagtgttggttggtaagggtggtttctacgggaacgtttttaggataacaccaccgttgtgcttcaccaaagaggattccgacttcttcattgaggtgatggacattgcgctctcgaagctgtgaggcaagcagggcgaagatgatgtgcaaaccctggtccgtcgccatgggatttttgcccatgaataatattaagattaatgagacagcacctcgttgtctcttaatctaagacgatgccatgtcatccggtggcatggtattcctaatcctacctgccaaatcactggtattgctcgctgtctcgtaatcagacccatggagcaatatgattcttgtaaactctagcttcatccaatctgttcctcctgatctaactagtctgaatagcagctgttcgtttgtgaccaatatcaacttcttttcagatgctcc

SEQ ID NO: 698 - protein, 1828 aa, Zea mays
  misc_feature: PFam Name: Aminotran_3; PFam Description: Aminotransferase
  misc_feature: GI Number: 25141217; NR Description: At4g39660/T19P19_50 [Arabidopsis thaliana] >gi|15809992|gb|AAL06923.1| AT4g39660/T19P19_50 [Arabidopsis thaliana] >gi|18420498|ref|NP_568064.1| alanine--glyoxylate
  misc_feature: GI Number: 5731259; NR Description: alanine:glyoxylate
  misc_feature: GI Number: 6403506; NR Description: putative aminotransferase [Arabidopsis thaliana] >gi|20466700|gb|AAM20667.1| putative aminotransferase [Arabidopsis thaliana] >gi|15231974|ref|NP_187498.1| alanine--glyoxylate
  misc_feature: GI Number: 52353685; NR Description: putative aminotransferase [Oryza sativa (japonica cultivar-group)] >gi|52353616|gb|AAU44182.1| putative aminotransferase class-III
  misc_feature: GI Number: 15028237; NR Description: putative
AAAAAAACCAGCGACTCACACACCCGCGCGCCGCTTCTGTAGGGCCCCAACCAACCGCGCAGGGAGAAAACCACCACAGCACATGCAGCGCCTCGCCTCCTCCCGGAGGCTCCTCCAGGCCGCGCTCGCCCCCGCCCGGGCCAACTCCAGCCTCTCCGCGGCCGCCGTCGCCGCGCCCGCGCCAGCGAATGGCGCCTTCCCGAAGATGCCGGCCTTCGACTACACGCCGCCGCCGTACGACGGGCCGCGCGCCGAGGAGATCTTCCGGAAGCGCGCTCAGTTCCTCAGCCCATCCCTTTTTCATTTCTACGATCGCCCATTGAACATAGTCGAAGGAAAGATGCAGTACCTATTTGATGAGGATGGCCGTCGTTACCTGGATGCTTTCGGTGGCATTGCAACAGTTTGTTGTGGGCACTGCCATCCAGATGTTGTTGAAGCCATAGTAAACCAGGCAAAGCGGATCCAGCACTCCACAGTTCTATATCTCAATCATGCAATTGCAGATTTTGCCGAGGCATTGGCTTCCAAAATGCCTGGTGATCTGAAGGTTGTTTTCTTCACAAATTCAGGCACGGAGGCAAATGAGCTTGCACTGATGATTGCACGGCTTTACACTGGTTGCAATGACATTATCTCTCTTAGGAATGGATACCATGGGAATGCTGCTGGAACAATGGGTGCTACTGCTCAATCCAATTGGAAATTCAATGTTGTTCAGACGGGAGTACACCATGCGCTTAATCCAGACCCCTTCAGAGGTGCTTTTGGTTCTGACGGGGAGAAATACGCCAGAGATGTTCAGGAAATGGTCGAATTTGGAACTACAGGGAGAGTTGGTGGGTTCATTTCGGAAGCCATACAGGGGGTTGGTGGAATAGTGGAACTGGCACCAGGATACTTGCCCGTGGCATACAGTATGGTAAGGAAAGCCGGTGGGCTCTGCATCGCCGACGAAGTTCAGGCAGGAGTCGCGAGAACTGGAAGCCACTTCTGGGGATTCGAAGGGCATGGTGTCATCCCGGACATAGTCACCATGGCCAAGGGTATCGGGAATGGCATACCCATAGGAGCTGTAGTAACGACGCCAGAGATCGCTCAGGTGTTGACCCGCAGAAGCTACTTCAATACCTTTGGTGGTAACCCTGTCAGCACTGCAGGCGGGCATGCGGTGCTCAAAGTGCTGGAGAAGGAGAAGCTCCAGGAGAATGCGTTTGTTGTGGGCTCCTACCTAAAGGAACAGCTTAACAATCTGAAAGACAAGCATGAGATCATCGGTGACGTTAGGGGCAAAGGCTTCCTTCTTGGAGTTGAGCTGGTGACAGACCATGAAAAGAAAACCCCAGCCAAAGCTGAGATCTCACGTGTCATGAACCATATGAAAGATATGGGAGTGTTGGTTGGTAAGGGTGGTTTCTACGGGAACGTTTTTAGGATAACACCACCGTTGTGCTTCACCAAAGAGGATTCCGACTTCTTCATTGAGGTGATGGACATTGCGCTCTCGAAGCTGTGAGGCAAGCAGGGCGAAGATGATGTGCAAACCCTGGTCCGTCGCCATGGGATTTTTGCCCATGAATAATATTAAGATTAATGAGACAGCACCTCGTTGTCTCTTAATCTAAGACGATGCCATGTCATCCGGTGGCATGGTATTCCTAATCCTACCTGCCAAATCACTGGTATTGCTCGCTGTCTCGTAATCAGACCCATGGAGCAATATGATTCTTGTAAACTCTAGCTTCATCCAATCTGTTCCTCCTGATCTAACTAGTCTGAATAGCAGCTGTTCGTTTGTGACCAATATCAACTTCTTTTCAGATGCTCC

SEQ ID NO: 699 - DNA, 1168 bp, Zea mays
  misc_feature (1)..(1168): Ceres cDNA ID no. 12357881
  misc_feature (1)..(1168): Ceres CLONE  ID no. 283941
  misc_feature (1)..(1168): Also known as  Ceres CDNA ID no. 23758646
agaataggataggatagcccctgttcttctagcctgctagtctgctacactccacgtctctacctctaccgcacattttgctacgctccagctccatcgactatcgagtgcttgctggacgccggggccgggcaatggatccgggcagcgcggagatcgttttcgactgcgatttcttccggatatacagcgacggtcgcgtcgagcgtttcgccggcatggaaaccgtgcccgcgggcttcgacgccgacaccggcgtcacctcaaaagacgtggtcgtcgacgccgccaccggcatcgcgacgcggctctacctgccagccatccctacggccccgtcatctccccagtcggacggcaacggcaacggcaacggcagcgccacggcgaagcttcccatcctcgtcatcttccacggcggcggcttcgtcatcggctcaccggctgatcctggtttccaccgctacatgaactcgctggtcgctagcgcccgcgtcgtcgctgtctccgtcggctaccgcctcgcgcccgaaaacccgctccctgcagcctacaaggactcctggaccgcgctcaactgggctgtttccggcgcggacccgtggctgtccgcccacggtgacctcggccgcgtcttcgtggccggttacagcgccgggtcgaacatcgcccacaacatggccatcgccgcgggcgtcagaggcttgcgcgccgcggaaccaccacgagtagaaggcgtgatcctgctccacccttcgtttgccggtgaacagaggatggaagaagaggatgacagattctggcaagttaataagaggaggtggaaggccatcttccccggtgcgagagacgggctggacgatccgagaatcaacccggtcgtcgctggcgcgccgagcttggcgaagctggtgggcgagcggctgctcgtgtgcacggcgtcggaggacccgagggcaccgaggggccgggcatactgcgaggcggtgagggccagctgttggccgggaaaggtggagagcttcgaatcacaaaacgagggacacgggttcttcgtttccggccacggcagcacccaggccattgcgctgatggatcgagtggttggtttcattgttggccattaacttcgattgttcaaaataaatgaaattaagggttgtttgct

SEQ ID NO: 700 - protein, 1168 aa, Zea mays
  misc_feature: PFam Name: Abhydrolase_3; PFam Description: alpha/beta
  misc_feature: PFam Name: COesterase; PFam Description: Carboxylesterase
  misc_feature: PFam Name: TT_ORF1; PFam Description: TT viral orf 1
  misc_feature: GI Number: 51536295; NR Description: putative PrMC3 [Oryza sativa (japonica cultivar-group)] >gi|51535241|dbj|BAD38290.1|
  misc_feature: GI Number: 51536287; NR Description: putative PrMC3 [Oryza sativa (japonica cultivar-group)] >gi|51535233|dbj|BAD38282.1|
  misc_feature: GI Number: 51535280; NR Description: putative PrMC3 [Oryza
  misc_feature: GI Number: 51535271; NR Description: putative PrMC3 [Oryza
  misc_feature: GI Number: 51535273; NR Description: putative PrMC3 [Oryza
AGAATAGGATAGGATAGCCCCTGTTCTTCTAGCCTGCTAGTCTGCTACACTCCACGTCTCTACCTCTACCGCACATTTTGCTACGCTCCAGCTCCATCGACTATCGAGTGCTTGCTGGACGCCGGGGCCGGGCAATGGATCCGGGCAGCGCGGAGATCGTTTTCGACTGCGATTTCTTCCGGATATACAGCGACGGTCGCGTCGAGCGTTTCGCCGGCATGGAAACCGTGCCCGCGGGCTTCGACGCCGACACCGGCGTCACCTCAAAAGACGTGGTCGTCGACGCCGCCACCGGCATCGCGACGCGGCTCTACCTGCCAGCCATCCCTACGGCCCCGTCATCTCCCCAGTCGGACGGCAACGGCAACGGCAACGGCAGCGCCACGGCGAAGCTTCCCATCCTCGTCATCTTCCACGGCGGCGGCTTCGTCATCGGCTCACCGGCTGATCCTGGTTTCCACCGCTACATGAACTCGCTGGTCGCTAGCGCCCGCGTCGTCGCTGTCTCCGTCGGCTACCGCCTCGCGCCCGAAAACCCGCTCCCTGCAGCCTACAAGGACTCCTGGACCGCGCTCAACTGGGCTGTTTCCGGCGCGGACCCGTGGCTGTCCGCCCACGGTGACCTCGGCCGCGTCTTCGTGGCCGGTTACAGCGCCGGGTCGAACATCGCCCACAACATGGCCATCGCCGCGGGCGTCAGAGGCTTGCGCGCCGCGGAACCACCACGAGTAGAAGGCGTGATCCTGCTCCACCCTTCGTTTGCCGGTGAACAGAGGATGGAAGAAGAGGATGACAGATTCTGGCAAGTTAATAAGAGGAGGTGGAAGGCCATCTTCCCCGGTGCGAGAGACGGGCTGGACGATCCGAGAATCAACCCGGTCGTCGCTGGCGCGCCGAGCTTGGCGAAGCTGGTGGGCGAGCGGCTGCTCGTGTGCACGGCGTCGGAGGACCCGAGGGCACCGAGGGGCCGGGCATACTGCGAGGCGGTGAGGGCCAGCTGTTGGCCGGGAAAGGTGGAGAGCTTCGAATCACAAAACGAGGGACACGGGTTCTTCGTTTCCGGCCACGGCAGCACCCAGGCCATTGCGCTGATGGATCGAGTGGTTGGTTTCATTGTTGGCCATTAACTTCGATTGTTCAAAATAAATGAAATTAAGGGTTGTTTGCT

SEQ ID NO: 701 - DNA, 915 bp, Zea mays
  misc_feature (1)..(915): Ceres cDNA ID no. 12358048
  misc_feature (1)..(915): Ceres CLONE  ID no. 238678
  misc_feature (1)..(915): Also known as  Ceres CDNA ID no. 23773120
catcaccagttcagtccaccgttccgccggcccgcccgtacccgcctgcgcctacacatcgctgctccaggtccccatggcgaagactacgcaacccaccgcggggatgcgggatcccctgctccccacctccaccgccgcctcaccgccgccctacctcgacccgcatcccgccgactcctacacctacacggtcctccttgtccccgttcgcctccaccgcggcctctgtcgcggcggccgttgcatcgtcccctgcctcaccgttctcttccttctcgcgctcgcgggcttcctcctctggcccgcggacccggacatctccctggcccgcctccacctagcgcacgtctccgtcgtggcacgccctgccgtcgccgtcactatatccgccacgctcaaggttcgcgttcgcaatcctgacctcttcgcgctcgactacacccgcctcgacgtcgctatcggctaccgcggtgcggggcttggccgggtaacatccggcggcggacgggtccgggcgcgcgctgtctcgtacgtcgacgccaacctgcagctcgacggcatacgcgtcgtcgaggacgcgatgtacctgctcgaggacctcgcgcaaggatccgtgcccttcgacaccatcgccgaggtcgagggccacctccacttccttttcctcagcatcccggtcaaggggagaatatcttgcgtaatgcatattaatccacacaaccaaaccatagtacatcaggactgctatcctgagtgaattgcttatggcgtggaaatgtggaagggtgtaagctatgttgccttgcgaatggatcgtttgatttgtttctaacctttgcttccagtcgtggttgtaaaagtaagaaccaactaaggggtgtttgaatgtaattgagctaatagttagttcgc

SEQ ID NO: 702 - protein, 915 aa, Zea mays
  misc_feature: PFam Name: Hin1; PFam Description: Harpin-induced protein 1 (Hin1)
  misc_feature: PFam Name: FH2; PFam Description: Formin Homology 2 Domain
  misc_feature: PFam Name: Kinesin; PFam Description: Kinesin motor domain
  misc_feature: PFam Name: Pyr_redox_2; PFam Description: Pyridine
  misc_feature: PFam Name: Cation_efflux; PFam Description: Cation efflux family
  misc_feature: GI Number: 29247944; NR Description: GLP_26_54603_52153
  misc_feature: GI Number: 53767310; NR Description: COG1309: Transcriptional
  misc_feature: GI Number: 34809534; NR Description: Epa4p [Candida glabrata]
  misc_feature: GI Number: 13592175; NR Description: ppg3 [Leishmania major]
  misc_feature: GI Number: 34809533; NR Description: Epa5p [Candida glabrata]
CATCACCAGTTCAGTCCACCGTTCCGCCGGCCCGCCCGTACCCGCCTGCGCCTACACATCGCTGCTCCAGGTCCCCATGGCGAAGACTACGCAACCCACCGCGGGGATGCGGGATCCCCTGCTCCCCACCTCCACCGCCGCCTCACCGCCGCCCTACCTCGACCCGCATCCCGCCGACTCCTACACCTACACGGTCCTCCTTGTCCCCGTTCGCCTCCACCGCGGCCTCTGTCGCGGCGGCCGTTGCATCGTCCCCTGCCTCACCGTTCTCTTCCTTCTCGCGCTCGCGGGCTTCCTCCTCTGGCCCGCGGACCCGGACATCTCCCTGGCCCGCCTCCACCTAGCGCACGTCTCCGTCGTGGCACGCCCTGCCGTCGCCGTCACTATATCCGCCACGCTCAAGGTTCGCGTTCGCAATCCTGACCTCTTCGCGCTCGACTACACCCGCCTCGACGTCGCTATCGGCTACCGCGGTGCGGGGCTTGGCCGGGTAACATCCGGCGGCGGACGGGTCCGGGCGCGCGCTGTCTCGTACGTCGACGCCAACCTGCAGCTCGACGGCATACGCGTCGTCGAGGACGCGATGTACCTGCTCGAGGACCTCGCGCAAGGATCCGTGCCCTTCGACACCATCGCCGAGGTCGAGGGCCACCTCCACTTCCTTTTCCTCAGCATCCCGGTCAAGGGGAGAATATCTTGCGTAATGCATATTAATCCACACAACCAAACCATAGTACATCAGGACTGCTATCCTGAGTGAATTGCTTATGGCGTGGAAATGTGGAAGGGTGTAAGCTATGTTGCCTTGCGAATGGATCGTTTGATTTGTTTCTAACCTTTGCTTCCAGTCGTGGTTGTAAAAGTAAGAACCAACTAAGGGGTGTTTGAATGTAATTGAGCTAATAGTTAGTTCGC

SEQ ID NO: 703 - DNA, 1316 bp, Zea mays
  misc_feature (1)..(1316): Ceres cDNA ID no. 12358113
  misc_feature (1)..(1316): Ceres CLONE  ID no. 228832
  misc_feature (1)..(1316): Also known as  Ceres CDNA ID no. 23781333
gtgtgccccgtctcggaacagcgcggaccaccagagcgtgcgcgtccgtgccccacccctccctctctatccatggcggtcccccgcgggtgcctcgggctccccctggtcgccgtgctcctcgcgtccctctgccgcggccaggcggcggtgagggagctcaaggtcgggtactacgccgagacgtgcccggaggccgaggacatcgtccgtgagaccatggcgcgcgcgcgcgcacgcgaggcccgcagcgtcgcctccgtcatgcgcctccagttccacgactgcttcgtcaacgggtgcgacggctcggtgctgatggacgccacgccgacgatgcccggcgagaaggatgcgctctccaacatcaactccctgcgctcgttcgaggtcgtcgacgagatcaaggacgcgctggaggagcgctgccccggagtggtctcctgcgccgacatcgtcatcattgccgcccgcgacgccgtcgtcctgaccggtgggcctaactgggaggtgcggctcgggcgcgaggacagcatgacggcgagccaggaggacgcggacaacatcatgccgagcccgcgcgcaaacgcgagcgctctcatccggctcttcgcggggctcaacctcagcgtcaccgacctggtcgcgctctcgggctcgcactccatcggcgaggcccgctgcttctccatcgtcttccgcctctacaaccagtctggatccggccgccccgacccgcacatggacaccgcctaccgccgctcgctcgacgcactctgccccaagggcggcgacgaggaggtcacgggaggcctggacgccaccccacgcatcttcgacaaccagtacttcgaggacctcgtcgcgctccgcggcttcctcaactccgaccagacgctcttctctgacaacaccaggacccgtcgggtcgtcgagcggctcagcaaggaccaggacgccttcttcagggccttcatcgaggggatgataaagatgggggagctccaaaaccccaggaaaggggagatacggcgcaactgtcgcgttgctaacaactcgccgtggcaaccaaggacggggatggcgtccggacagtcgacatctgagctccggtgatgaggttggtgtttcagaagaaatcgagccctgatatggtactaatatgttgacatgcattgttgtttttttggtcgtgtgtaagttttgcacctacctatggctgtggtgcccgagctgcgctcattgctgacgtggggaataattgagacattgtgccttagctccaataacgttcaatatatttatcctttatatcg

SEQ ID NO: 704 - protein, 1316 aa, Zea mays
  misc_feature: PFam Name: peroxidase; PFam Description: Peroxidase
  misc_feature: GI Number: 57635159; NR Description: peroxidase 7 [Triticum
  misc_feature: GI Number: 50900376; NR Description: putative peroxidase [Oryza sativa (japonica cultivar-group)] >gi|47848367|dbj|BAD22227.1| putative peroxidase [Oryza sativa
  misc_feature: GI Number: 19698448; NR Description: gaiacol peroxidase
  misc_feature: GI Number: 28827478; NR Description: putative peroxidase [Arabidopsis thaliana] >gi|28393257|gb|AAO42057.1| putative peroxidase [Arabidopsis thaliana] >gi|4544449|gb|AAD22357.1| putative peroxidase [Arabidopsis thaliana]
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
GTGTGCCCCGTCTCGGAACAGCGCGGACCACCAGAGCGTGCGCGTCCGTGCCCCACCCCTCCCTCTCTATCCATGGCGGTCCCCCGCGGGTGCCTCGGGCTCCCCCTGGTCGCCGTGCTCCTCGCGTCCCTCTGCCGCGGCCAGGCGGCGGTGAGGGAGCTCAAGGTCGGGTACTACGCCGAGACGTGCCCGGAGGCCGAGGACATCGTCCGTGAGACCATGGCGCGCGCGCGCGCACGCGAGGCCCGCAGCGTCGCCTCCGTCATGCGCCTCCAGTTCCACGACTGCTTCGTCAACGGGTGCGACGGCTCGGTGCTGATGGACGCCACGCCGACGATGCCCGGCGAGAAGGATGCGCTCTCCAACATCAACTCCCTGCGCTCGTTCGAGGTCGTCGACGAGATCAAGGACGCGCTGGAGGAGCGCTGCCCCGGAGTGGTCTCCTGCGCCGACATCGTCATCATTGCCGCCCGCGACGCCGTCGTCCTGACCGGTGGGCCTAACTGGGAGGTGCGGCTCGGGCGCGAGGACAGCATGACGGCGAGCCAGGAGGACGCGGACAACATCATGCCGAGCCCGCGCGCAAACGCGAGCGCTCTCATCCGGCTCTTCGCGGGGCTCAACCTCAGCGTCACCGACCTGGTCGCGCTCTCGGGCTCGCACTCCATCGGCGAGGCCCGCTGCTTCTCCATCGTCTTCCGCCTCTACAACCAGTCTGGATCCGGCCGCCCCGACCCGCACATGGACACCGCCTACCGCCGCTCGCTCGACGCACTCTGCCCCAAGGGCGGCGACGAGGAGGTCACGGGAGGCCTGGACGCCACCCCACGCATCTTCGACAACCAGTACTTCGAGGACCTCGTCGCGCTCCGCGGCTTCCTCAACTCCGACCAGACGCTCTTCTCTGACAACACCAGGACCCGTCGGGTCGTCGAGCGGCTCAGCAAGGACCAGGACGCCTTCTTCAGGGCCTTCATCGAGGGGATGATAAAGATGGGGGAGCTCCAAAACCCCAGGAAAGGGGAGATACGGCGCAACTGTCGCGTTGCTAACAACTCGCCGTGGCAACCAAGGACGGGGATGGCGTCCGGACAGTCGACATCTGAGCTCCGGTGATGAGGTTGGTGTTTCAGAAGAAATCGAGCCCTGATATGGTACTAATATGTTGACATGCATTGTTGTTTTTTTGGTCGTGTGTAAGTTTTGCACCTACCTATGGCTGTGGTGCCCGAGCTGCGCTCATTGCTGACGTGGGGAATAATTGAGACATTGTGCCTTAGCTCCAATAACGTTCAATATATTTATCCTTTATATCG

SEQ ID NO: 705 - DNA, 1425 bp, Zea mays
  misc_feature (1)..(1425): Ceres cDNA ID no. 12358365
  misc_feature (1)..(1425): Ceres CLONE  ID no. 316720
  misc_feature (1)..(1425): Also known as  Ceres CDNA ID no. 23764041
aacatctagagcttggaggaaagctagctagcgagaggaataggatcgcaatggtggaacggccgggcagatcggcaggcgtcagggaggccaataagacttccgctgccgccatggtgaagacgacgacgacgacgaccaccaataaggaggagctggagagcccgtcctacaggttagcagcgttcaagagcctcttctcgtgcaggaacagccacgcgcggccgcgggcgccggacaccggcaacaggagcaagagggggctgggctgctccgcgccgtccatctgcaagctcaaggacgacagcgtgcccgtgccgcccaaggaaaccacgggcacggcgtcggcaggcgagccctgcaagcgccgcgcgtccgtgagcgggagcagcgatcggtgcgtgaagaagccccaatgtggcgctggcagcaacaagcagctgcagcgtggcgggtcgtcgtcgtcgtcgggcgggtcgtcgttcagggccggcatgcagctgaggcggctttcggggtgctacgagtgccacatggtggtggcgggcagcgcctccatgagggccaccaccatctgcccctgcccggactgcggcgaggtgttcgtcaggcaggagagcctccagctccaccagtccatcaggcacgcagtgtccgagcttggcactgacgacacgagccgcaacatcatcgagatcatcttccagtccagctggctcaagaagcagagccccgtgtgcaaggtcgaccgcatcctcaaggtgaacaacacgcccagaacgctggcccgcttcgaggagtaccgcgacgctgtcaaggccagggcgggcgccgagcagctggcggtagcggcggccaacagcaacaggcacccgcgctgcaccgccgacggcaacgagctgctccggttccactgcgccaccctggcctgctcgctcggcctcaacggcgccacgcacctctgcgacgccgcggggacctgcgcagcgtgcggcatcatccgcgacggcttcagcagcggcggggtgctgaccatggccacgagcggccgcgcgcacgacgccgtgcccgctgcggaggctggcgccggactggatgaggaaaccactccaagggcgatgctggtgtgccgggtcatcgcgggaagggtgaagcggcccaaagaagcggtaccagaggaggaggccgtcgccgaagccgccgaggagtcggagtacgactcggttgcggggtcggccggggtgtactccaacctggaggagctgctggtgttcaaccccagggccatcctcccatgctttgtcgttgtctacaaggcttagctactggtggttacactttacaatccatgcaatgcagtccttgtattaagtaacaaacaattcatgataaacctaatgtattgactgacgaatggtcactctc

SEQ ID NO: 706 - protein, 1425 aa, Zea mays
  misc_feature: PFam Name: zf-C2H2; PFam Description: Zinc finger, C2H2 type
  misc_feature: PFam Name: Mucin; PFam Description: Mucin-like glycoprotein
  misc_feature: GI Number: 5777616; NR Description: CAA30374.1 protein [Oryza
  misc_feature: GI Number: 15222333; NR Description: zinc finger (C2H2 type) family protein [Arabidopsis thaliana] >gi|9369383|gb|AAF87132.1|
  misc_feature: GI Number: 9802582; NR Description: T2E6.3 [Arabidopsis thaliana]
  misc_feature: GI Number: 62701936; NR Description: Zinc finger, C2H2 type,
  misc_feature: GI Number: 52076893; NR Description: zinc finger (C2H2 type) protein-like [Oryza sativa (japonica cultivar-group)] >gi|52076647|dbj|BAD45547.1| zinc finger (C2H2 type) protein-like
AACATCTAGAGCTTGGAGGAAAGCTAGCTAGCGAGAGGAATAGGATCGCAATGGTGGAACGGCCGGGCAGATCGGCAGGCGTCAGGGAGGCCAATAAGACTTCCGCTGCCGCCATGGTGAAGACGACGACGACGACGACCACCAATAAGGAGGAGCTGGAGAGCCCGTCCTACAGGTTAGCAGCGTTCAAGAGCCTCTTCTCGTGCAGGAACAGCCACGCGCGGCCGCGGGCGCCGGACACCGGCAACAGGAGCAAGAGGGGGCTGGGCTGCTCCGCGCCGTCCATCTGCAAGCTCAAGGACGACAGCGTGCCCGTGCCGCCCAAGGAAACCACGGGCACGGCGTCGGCAGGCGAGCCCTGCAAGCGCCGCGCGTCCGTGAGCGGGAGCAGCGATCGGTGCGTGAAGAAGCCCCAATGTGGCGCTGGCAGCAACAAGCAGCTGCAGCGTGGCGGGTCGTCGTCGTCGTCGGGCGGGTCGTCGTTCAGGGCCGGCATGCAGCTGAGGCGGCTTTCGGGGTGCTACGAGTGCCACATGGTGGTGGCGGGCAGCGCCTCCATGAGGGCCACCACCATCTGCCCCTGCCCGGACTGCGGCGAGGTGTTCGTCAGGCAGGAGAGCCTCCAGCTCCACCAGTCCATCAGGCACGCAGTGTCCGAGCTTGGCACTGACGACACGAGCCGCAACATCATCGAGATCATCTTCCAGTCCAGCTGGCTCAAGAAGCAGAGCCCCGTGTGCAAGGTCGACCGCATCCTCAAGGTGAACAACACGCCCAGAACGCTGGCCCGCTTCGAGGAGTACCGCGACGCTGTCAAGGCCAGGGCGGGCGCCGAGCAGCTGGCGGTAGCGGCGGCCAACAGCAACAGGCACCCGCGCTGCACCGCCGACGGCAACGAGCTGCTCCGGTTCCACTGCGCCACCCTGGCCTGCTCGCTCGGCCTCAACGGCGCCACGCACCTCTGCGACGCCGCGGGGACCTGCGCAGCGTGCGGCATCATCCGCGACGGCTTCAGCAGCGGCGGGGTGCTGACCATGGCCACGAGCGGCCGCGCGCACGACGCCGTGCCCGCTGCGGAGGCTGGCGCCGGACTGGATGAGGAAACCACTCCAAGGGCGATGCTGGTGTGCCGGGTCATCGCGGGAAGGGTGAAGCGGCCCAAAGAAGCGGTACCAGAGGAGGAGGCCGTCGCCGAAGCCGCCGAGGAGTCGGAGTACGACTCGGTTGCGGGGTCGGCCGGGGTGTACTCCAACCTGGAGGAGCTGCTGGTGTTCAACCCCAGGGCCATCCTCCCATGCTTTGTCGTTGTCTACAAGGCTTAGCTACTGGTGGTTACACTTTACAATCCATGCAATGCAGTCCTTGTATTAAGTAACAAACAATTCATGATAAACCTAATGTATTGACTGACGAATGGTCACTCTC

SEQ ID NO: 707 - DNA, 1883 bp, Zea mays
  misc_feature (1)..(1883): Ceres cDNA ID no. 12359147
  misc_feature (1)..(1883): Ceres CLONE  ID no. 392819
  misc_feature (1)..(1883): Also known as  Ceres CDNA ID no. 23813751
aaaaaggagctagcactagccaggaaacacacagagagacgaaataagcagcgaggcaatgggcaacctgcttcaccaggaaatacgacgagcacgagcacgagataccaatcaccacggacccgccgcggcggacgtcgatgccggtgtaccggccgccccggccccgcgatgacaaggcgcaggaggtgccgctatactcgggctcggaccgccggccgtcctaccgtccgccgcggcttccggtcttcccgtcgggcccgggatcgacgggccggcggcggccgcccaccggccagacgggcacggtcctggaccggcacacggtggacgtgcggacgctgttccacctggagcggaagctggggagcgggcagttcggcaccacgtacctgtgcacggagcgcgcgacggggaagaagtacgcgtgcaagtcggtgtccaagcgcaagctggtgcggcgcgccgacatcgcggacatgcgccgggagatcaccatcctgcagcacctcagcggccagcccaacgtggcggagttcaagggcgcgttcgaggaccgcgacgacgtgcacgtcgtcatggagctctgctccggcggcgagctcttcgaccgcatcaccgccaaggggagctactccgagcgccaggccgccgccgtgtgccgcgacgtcctcaccgtcgtcaacgtctgccacttcatgggggtcatgcaccgcgacctcaagcccgagaacttcctgctcgccagccccgccgacgacgcgccgctcaaggccatcgacttcggcctgtccgtcttcatcgaagaaggcaaagtttacaaggacgtggtggggagcgcgtactacgtggcgcccgaggtgttgcgccggaactacggcagggagatcgacgtctggagtgctggcgtgatcctatacatccttctatgcgggtcgccgcctttctgggaagaaacgcagaaaggcatatttgacgcaatattggccgacgagctcgatctggtctcctccccgtggccctccatatctgaaagcgcgaaggatctcattagaaaaatgctgaacaaggaccctcagaggcgcattacggcttcacaggccctagaacatccatggctcaaaggtggtgcacctgacaggcctatcgacagcgcggtcctgtcaagaatgaagcagttcaaggcgatgaacaagctaaagcaacttgcactgaaggtaatcgcagagaacctaacagaggacgagatcaaggggctgaagcagatgttcaacaacatggatacagacaggagcggcacgatcacggtcgaggaactcaaggacgggctggcgaagctcgggtccaagattagcgaagcggaggttcagaagcttatggaagcagttgacgtggacaagagtggcagcattgactacaccgagttcctcactgccatgatgaacaggcataaactggagaaggaggaggatttgttccttgcttttcaacacttcgacaaagacgatagcgggtacataacaagagacgaactggaacaagccatggcggagtatggggtgggtgatgaagcaagcattaaggaagtgctggacgaagttgataaagacaaggatgggagaatcgactacgaagagtttgtagaaatgatgaggaagggaagttatacctgaggaagctctgttctcatggtgggagaggttgtgtatatatgtttcagcaaatgtgtcaagtacaagcaacgaagcaagtttaacttagaacaagttgcttctgcagctatggtccgaggcaagcatgtacagctatttatttattgaccgaatatgcaacgagagagaaaatgtccagtttacttgaaagaaaagttcagagttcgtgct

SEQ ID NO: 708 - protein, 1883 aa, Zea mays
  misc_feature: PFam Name: Pkinase; PFam Description: Protein kinase domain
  misc_feature: GI Number: 31711962; NR Description: At3g20410 [Arabidopsis thaliana] >gi|9294561|dbj|BAB02824.1| calmodulin-domain protein kinase CDPK isoform 9 [Arabidopsis thaliana] >gi|21539465|gb|AAM53285.1| calmodulin-domain protein kinase CDPK
  misc_feature: GI Number: 1345719; NR Description: Calcium-dependent protein kinase 2 (CDPK 2) >gi|7428010|pir||T02259 calcium-dependent protein kinase (EC 2.7.1.-) 2 - maize >gi|886821|gb|AAA69507.1|
  misc_feature: GI Number: 50948895; NR Description: ESTs C22369(C12239),C22370(C12239), AU057852(S21844),AU057853(S21844) correspond to a region of the predicted gene.~similar to calcium dependent protein kinase. (AF048691) [Oryza sativa (japonica
  misc_feature: GI Number: 51963444; NR Description: PREDICTED P0048D08.105 gene product [Oryza sativa (japonica cultivar-group)] >gi|50937751|ref|XP_478403.1| CDP2_ORYSA Calcium-dependent protein kinase [Oryza sativa (japonica cultivar-group)]
  misc_feature: GI Number: 62732966; NR Description: Protein kinase domain,
AAAAAGGAGCTAGCACTAGCCAGGAAACACACAGAGAGACGAAATAAGCAGCGAGGCAATGGGCAACCTGCTTCACCAGGAAATACGACGAGCACGAGCACGAGATACCAATCACCACGGACCCGCCGCGGCGGACGTCGATGCCGGTGTACCGGCCGCCCCGGCCCCGCGATGACAAGGCGCAGGAGGTGCCGCTATACTCGGGCTCGGACCGCCGGCCGTCCTACCGTCCGCCGCGGCTTCCGGTCTTCCCGTCGGGCCCGGGATCGACGGGCCGGCGGCGGCCGCCCACCGGCCAGACGGGCACGGTCCTGGACCGGCACACGGTGGACGTGCGGACGCTGTTCCACCTGGAGCGGAAGCTGGGGAGCGGGCAGTTCGGCACCACGTACCTGTGCACGGAGCGCGCGACGGGGAAGAAGTACGCGTGCAAGTCGGTGTCCAAGCGCAAGCTGGTGCGGCGCGCCGACATCGCGGACATGCGCCGGGAGATCACCATCCTGCAGCACCTCAGCGGCCAGCCCAACGTGGCGGAGTTCAAGGGCGCGTTCGAGGACCGCGACGACGTGCACGTCGTCATGGAGCTCTGCTCCGGCGGCGAGCTCTTCGACCGCATCACCGCCAAGGGGAGCTACTCCGAGCGCCAGGCCGCCGCCGTGTGCCGCGACGTCCTCACCGTCGTCAACGTCTGCCACTTCATGGGGGTCATGCACCGCGACCTCAAGCCCGAGAACTTCCTGCTCGCCAGCCCCGCCGACGACGCGCCGCTCAAGGCCATCGACTTCGGCCTGTCCGTCTTCATCGAAGAAGGCAAAGTTTACAAGGACGTGGTGGGGAGCGCGTACTACGTGGCGCCCGAGGTGTTGCGCCGGAACTACGGCAGGGAGATCGACGTCTGGAGTGCTGGCGTGATCCTATACATCCTTCTATGCGGGTCGCCGCCTTTCTGGGAAGAAACGCAGAAAGGCATATTTGACGCAATATTGGCCGACGAGCTCGATCTGGTCTCCTCCCCGTGGCCCTCCATATCTGAAAGCGCGAAGGATCTCATTAGAAAAATGCTGAACAAGGACCCTCAGAGGCGCATTACGGCTTCACAGGCCCTAGAACATCCATGGCTCAAAGGTGGTGCACCTGACAGGCCTATCGACAGCGCGGTCCTGTCAAGAATGAAGCAGTTCAAGGCGATGAACAAGCTAAAGCAACTTGCACTGAAGGTAATCGCAGAGAACCTAACAGAGGACGAGATCAAGGGGCTGAAGCAGATGTTCAACAACATGGATACAGACAGGAGCGGCACGATCACGGTCGAGGAACTCAAGGACGGGCTGGCGAAGCTCGGGTCCAAGATTAGCGAAGCGGAGGTTCAGAAGCTTATGGAAGCAGTTGACGTGGACAAGAGTGGCAGCATTGACTACACCGAGTTCCTCACTGCCATGATGAACAGGCATAAACTGGAGAAGGAGGAGGATTTGTTCCTTGCTTTTCAACACTTCGACAAAGACGATAGCGGGTACATAACAAGAGACGAACTGGAACAAGCCATGGCGGAGTATGGGGTGGGTGATGAAGCAAGCATTAAGGAAGTGCTGGACGAAGTTGATAAAGACAAGGATGGGAGAATCGACTACGAAGAGTTTGTAGAAATGATGAGGAAGGGAAGTTATACCTGAGGAAGCTCTGTTCTCATGGTGGGAGAGGTTGTGTATATATGTTTCAGCAAATGTGTCAAGTACAAGCAACGAAGCAAGTTTAACTTAGAACAAGTTGCTTCTGCAGCTATGGTCCGAGGCAAGCATGTACAGCTATTTATTTATTGACCGAATATGCAACGAGAGAGAAAATGTCCAGTTTACTTGAAAGAAAAGTTCAGAGTTCGTGCT

SEQ ID NO: 709 - DNA, 1478 bp, Zea mays
  misc_feature (1)..(1478): Ceres cDNA ID no. 12359879
  misc_feature (1)..(1478): Ceres CLONE  ID no. 386908
  misc_feature (1)..(1478): Also known as  Ceres CDNA ID no. 23808999
atagcatattagcatatggtattggagatgggcccccggacccgaaatccccgccgcacttaagtactacaatcccaggggccaggccaccggcatgttcgcttccatctgccggcggcggctcttccgcctctgtcaaatccccttcggcaccggcgcaatccctagcgacgccctcccccactgccactccttagcaaccatcgcggacgctcccgtctccgagccctgtgctgcccttgtctcttgcgggctctcccccgccgccgcggtcgcccacaagctcccaatccgctccaccgccaaggccgacgccgtccgtgcgctcctccgcagctacggcttcaccgacgcggaggtcgccgacctagtccgccgattatcgcagatcctcagcgtcgaccccgaccggatccgccccaagcttgacctcttcgcctccctcggcgtcaagccgcggcggctcgccagatatcctgccctcctcacgcgcagcctcgacaagcacctcgtcccctgcatccagttcctccgcaacattctcagcaccgatgaggacgtctgcctcgccatctcgcgcaccccgcgcgccctctcggctggcctggagaagatcatgcggcccgccgtggacaccctccgccgtcttgggctccccgatgagtctatctcgaagttagtagtcatcgagatgggcgtgctcatgatgtcgcccgaccgcatatgccagatcttcgaggccctcaaggagttcggcttgggcgtaacggagaagcgctttccttacggcatccgcgccttgtgctgcattagtagggagaagtggctgcatagggtggccctttaccggagcttcggggtgtccgagggtgagctgcagagagcgttcaagaaacagccgaatatagttaacttctctgatgagatcataaagaagaagatccggttcttcctggatgtgctgaagcttgaactaagcgaagtaatggagcaacctgcgattatagggtatagcttggagaggaacatcataccaaggtgtgccgtgctaagcttgttgatgagggagggaaagattgggcccaacgtcaagttgatttcggcattgcttggtagtgccaacatgttctccacaaggtatgtattgaggtatgccaatgagttgccagatgttgttaaggcatatgagggtaagatcacatttgatgtcttcagggaacaggatcttttagttccactgaagctgtgagacaagtttagcaagattatgtcacaagtttaggcgccatgctttccaatgccattgagatcatagcatgctatgattctaacactgttttattgttatgttaattctggacatttttcacataaccatctttgtagcatttccctttttttatcctcgctaacaaatgtaaaaatacggatcttgtgatgctgtcttagttatttgatctggtgagctgaactggttc

SEQ ID NO: 710 - protein, 1478 aa, Zea mays
  misc_feature: PFam Name: mTERF; PFam Description: mTERF
  misc_feature: PFam Name: Pyr_redox_2; PFam Description: Pyridine
  misc_feature: PFam Name: Pkinase; PFam Description: Protein kinase domain
  misc_feature: PFam Name: FH2; PFam Description: Formin Homology 2 Domain
  misc_feature: PFam Name: Extensin_2; PFam Description: Extensin-like region
  misc_feature: GI Number: 15218140; NR Description: mitochondrial transcription termination factor family protein / mTERF family
  misc_feature: GI Number: 25511650; NR Description: T22I11.2 protein - Arabidopsis thaliana >gi|8886986|gb|AAF80646.1| Contains similarity to F28O16.19 a putative translation initiation factor IF-2 gi|6143896 from Arabidopsis thaliana gb|AC010718. It is a
  misc_feature: GI Number: 62732917; NR Description: mTERF, putative [Oryza
  misc_feature: GI Number: 50912803; NR Description: mitochondrial transcription termination factor-like [Oryza sativa (japonica cultivar-group)] >gi|46390202|dbj|BAD15633.1| mitochondrial transcription termination factor-like [Oryza sativa (japonica
  misc_feature: GI Number: 51536072; NR Description: mitochondrial transcription termination factor-like [Oryza sativa (japonica cultivar-group)] >gi|51535002|dbj|BAD37286.1| mitochondrial transcription termination factor-like [Oryza sativa (japonica
ATAGCATATTAGCATATGGTATTGGAGATGGGCCCCCGGACCCGAAATCCCCGCCGCACTTAAGTACTACAATCCCAGGGGCCAGGCCACCGGCATGTTCGCTTCCATCTGCCGGCGGCGGCTCTTCCGCCTCTGTCAAATCCCCTTCGGCACCGGCGCAATCCCTAGCGACGCCCTCCCCCACTGCCACTCCTTAGCAACCATCGCGGACGCTCCCGTCTCCGAGCCCTGTGCTGCCCTTGTCTCTTGCGGGCTCTCCCCCGCCGCCGCGGTCGCCCACAAGCTCCCAATCCGCTCCACCGCCAAGGCCGACGCCGTCCGTGCGCTCCTCCGCAGCTACGGCTTCACCGACGCGGAGGTCGCCGACCTAGTCCGCCGATTATCGCAGATCCTCAGCGTCGACCCCGACCGGATCCGCCCCAAGCTTGACCTCTTCGCCTCCCTCGGCGTCAAGCCGCGGCGGCTCGCCAGATATCCTGCCCTCCTCACGCGCAGCCTCGACAAGCACCTCGTCCCCTGCATCCAGTTCCTCCGCAACATTCTCAGCACCGATGAGGACGTCTGCCTCGCCATCTCGCGCACCCCGCGCGCCCTCTCGGCTGGCCTGGAGAAGATCATGCGGCCCGCCGTGGACACCCTCCGCCGTCTTGGGCTCCCCGATGAGTCTATCTCGAAGTTAGTAGTCATCGAGATGGGCGTGCTCATGATGTCGCCCGACCGCATATGCCAGATCTTCGAGGCCCTCAAGGAGTTCGGCTTGGGCGTAACGGAGAAGCGCTTTCCTTACGGCATCCGCGCCTTGTGCTGCATTAGTAGGGAGAAGTGGCTGCATAGGGTGGCCCTTTACCGGAGCTTCGGGGTGTCCGAGGGTGAGCTGCAGAGAGCGTTCAAGAAACAGCCGAATATAGTTAACTTCTCTGATGAGATCATAAAGAAGAAGATCCGGTTCTTCCTGGATGTGCTGAAGCTTGAACTAAGCGAAGTAATGGAGCAACCTGCGATTATAGGGTATAGCTTGGAGAGGAACATCATACCAAGGTGTGCCGTGCTAAGCTTGTTGATGAGGGAGGGAAAGATTGGGCCCAACGTCAAGTTGATTTCGGCATTGCTTGGTAGTGCCAACATGTTCTCCACAAGGTATGTATTGAGGTATGCCAATGAGTTGCCAGATGTTGTTAAGGCATATGAGGGTAAGATCACATTTGATGTCTTCAGGGAACAGGATCTTTTAGTTCCACTGAAGCTGTGAGACAAGTTTAGCAAGATTATGTCACAAGTTTAGGCGCCATGCTTTCCAATGCCATTGAGATCATAGCATGCTATGATTCTAACACTGTTTTATTGTTATGTTAATTCTGGACATTTTTCACATAACCATCTTTGTAGCATTTCCCTTTTTTTATCCTCGCTAACAAATGTAAAAATACGGATCTTGTGATGCTGTCTTAGTTATTTGATCTGGTGAGCTGAACTGGTTC

SEQ ID NO: 711 - DNA, 1680 bp, Zea mays
  misc_feature (1)..(1680): Ceres cDNA ID no. 12360613
  misc_feature (1)..(1680): Ceres CLONE  ID no. 337281
  misc_feature (1)..(1680): Also known as  Ceres CDNA ID no. 23783291
  misc_feature (1019)..(1019): n is a, c, t, g, unknown, or other
aaggcctccactcattcctgcccccgacactcccactgccaccagtcctctcaccgccaggcgccagccacagcggcacaatgcagccgcctactacccttctcccgctaggcgccgtcgtggtcgccatcctcctgctcgccaccgccccgagccccgccgtctcccgccaccgccactcgtccgccgcggacacggagacgctcgatgtagccgcctcgctctcccgcgcccgcgccgcgctctccaccgacgccgtctcgctgcaccagtccgcggccgccgccgccgccggggcgaagcgctccccgcgagcgcgggagggcggcctcacgttgcggctccactcccgggacttcctgcccgaggagcaggggcggcacgagacgtaccgctcgctcctgctctcccgcctccgccgcgactcggcgcgcgccgcggcggtgtcggcccgcgcgacgctggcggcggacgccgtgacccggctggacctgcgccccgcgaacgggtcggcggtgttcgcggcgtccgcggcgatccagggccccgtggtgtccggcgtcgggcagggcagcggcgagtacttctcccgcgtgggcatcggcagccccgcgcggcagctgtacatggtgctggacaccggcagcgacgtcacctgggtgcagtgccagccctgcgccgactgctaccagcagtccgacccggtgttcgacccgtccctctccgcctcctacgccgccgtctcctgcgactcccagcgctgccgggacctggacaccgcggcgtgccgcaacgccacgggcgcctgcctctacgaggtggcctacggcgacggctcctacaccgttgggcgacttcgccaccgagacgctcacgctgggggactccaccccggtcggcaacgtcgccatcgggtgcggccacgacaacgagggccttttcgtcggcgccgcggggctgctggcgctgggcggcgggccgctctccttcccgtcccagatctccgcgtccaccttctnctactgcctcgtggaccgcgactccccggccgcgtccacgctccagttcggcgacggcgccgccgaggcgggcaccgtgacggcgcctctcgtgcgcagcccgcgcacgagcaccttctactacgtggcgctgtcgggcatctcggtgggcgggcagccgctgtccatcccggcatccgccttcgccatggacgccacgtcgggctcgggcggcgtcatcgtggactccggcaccaccgtgacgcggctccagtccgccgcctacgcggcgctccgcgacgccttcgtccagggcgcgccgtcgctgccccggacctccggggtgtcgctgttcgacacgtgctacgacctgtcggaccggacgagcgtggaggtgcccgcggtgtcgctgcggttcgagggcggcggcgcgctgcggctgccggcgaagaactacctgatccccgtggacggagccggcacctactgcctggccttcgcgccgacgaacgcggccgtgtccatcatcgggaacgtgcagcagcagggcacccgcgtcagcttcgacaccgccaggggcgccgtcggcttcacccccaacaagtgctagcctagcctagcctaagcctgccttctggccctgttagccacggttgtcagtagtaatgacaagccggtgttt

SEQ ID NO: 712 - protein, 1680 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: GATase_2; PFam Description: Glutamine
  misc_feature: GI Number: 34895664; NR Description: nucleoid DNA-binding protein cnd41-like protein [Oryza sativa (japonica cultivar-group)] >gi|12328547|dbj|BAB21205.1| nucleoid DNA-binding protein
  misc_feature: GI Number: 19424106; NR Description: putative chloroplast
  misc_feature: GI Number: 23297732; NR Description: putative chloroplast nucleoid DNA-binding protein [Arabidopsis thaliana] >gi|11994113|dbj|BAB01116.1| CND41, chloroplast nucleoid DNA binding protein-like [Arabidopsis thaliana]
  misc_feature: GI Number: 50901910; NR Description: nucleoid DNA-binding protein cnd41-like protein [Oryza sativa (japonica cultivar-group)] >gi|15290061|dbj|BAB63755.1| nucleoid DNA-binding protein
  misc_feature: GI Number: 21594980; NR Description: chloroplast nucleoid DNA
AAGGCCTCCACTCATTCCTGCCCCCGACACTCCCACTGCCACCAGTCCTCTCACCGCCAGGCGCCAGCCACAGCGGCACAATGCAGCCGCCTACTACCCTTCTCCCGCTAGGCGCCGTCGTGGTCGCCATCCTCCTGCTCGCCACCGCCCCGAGCCCCGCCGTCTCCCGCCACCGCCACTCGTCCGCCGCGGACACGGAGACGCTCGATGTAGCCGCCTCGCTCTCCCGCGCCCGCGCCGCGCTCTCCACCGACGCCGTCTCGCTGCACCAGTCCGCGGCCGCCGCCGCCGCCGGGGCGAAGCGCTCCCCGCGAGCGCGGGAGGGCGGCCTCACGTTGCGGCTCCACTCCCGGGACTTCCTGCCCGAGGAGCAGGGGCGGCACGAGACGTACCGCTCGCTCCTGCTCTCCCGCCTCCGCCGCGACTCGGCGCGCGCCGCGGCGGTGTCGGCCCGCGCGACGCTGGCGGCGGACGCCGTGACCCGGCTGGACCTGCGCCCCGCGAACGGGTCGGCGGTGTTCGCGGCGTCCGCGGCGATCCAGGGCCCCGTGGTGTCCGGCGTCGGGCAGGGCAGCGGCGAGTACTTCTCCCGCGTGGGCATCGGCAGCCCCGCGCGGCAGCTGTACATGGTGCTGGACACCGGCAGCGACGTCACCTGGGTGCAGTGCCAGCCCTGCGCCGACTGCTACCAGCAGTCCGACCCGGTGTTCGACCCGTCCCTCTCCGCCTCCTACGCCGCCGTCTCCTGCGACTCCCAGCGCTGCCGGGACCTGGACACCGCGGCGTGCCGCAACGCCACGGGCGCCTGCCTCTACGAGGTGGCCTACGGCGACGGCTCCTACACCGTTGGGCGACTTCGCCACCGAGACGCTCACGCTGGGGGACTCCACCCCGGTCGGCAACGTCGCCATCGGGTGCGGCCACGACAACGAGGGCCTTTTCGTCGGCGCCGCGGGGCTGCTGGCGCTGGGCGGCGGGCCGCTCTCCTTCCCGTCCCAGATCTCCGCGTCCACCTTCTNCTACTGCCTCGTGGACCGCGACTCCCCGGCCGCGTCCACGCTCCAGTTCGGCGACGGCGCCGCCGAGGCGGGCACCGTGACGGCGCCTCTCGTGCGCAGCCCGCGCACGAGCACCTTCTACTACGTGGCGCTGTCGGGCATCTCGGTGGGCGGGCAGCCGCTGTCCATCCCGGCATCCGCCTTCGCCATGGACGCCACGTCGGGCTCGGGCGGCGTCATCGTGGACTCCGGCACCACCGTGACGCGGCTCCAGTCCGCCGCCTACGCGGCGCTCCGCGACGCCTTCGTCCAGGGCGCGCCGTCGCTGCCCCGGACCTCCGGGGTGTCGCTGTTCGACACGTGCTACGACCTGTCGGACCGGACGAGCGTGGAGGTGCCCGCGGTGTCGCTGCGGTTCGAGGGCGGCGGCGCGCTGCGGCTGCCGGCGAAGAACTACCTGATCCCCGTGGACGGAGCCGGCACCTACTGCCTGGCCTTCGCGCCGACGAACGCGGCCGTGTCCATCATCGGGAACGTGCAGCAGCAGGGCACCCGCGTCAGCTTCGACACCGCCAGGGGCGCCGTCGGCTTCACCCCCAACAAGTGCTAGCCTAGCCTAGCCTAAGCCTGCCTTCTGGCCCTGTTAGCCACGGTTGTCAGTAGTAATGACAAGCCGGTGTTT

SEQ ID NO: 713 - DNA, 647 bp, Zea mays
  misc_feature (1)..(647): Ceres cDNA ID no. 12360706
  misc_feature (1)..(647): Ceres CLONE  ID no. 390560
  misc_feature (1)..(647): Also known as  Ceres CDNA ID no. 23810604
acttgcttcaaaggctatattcttggaagaattagtgtgattcatggcaggttctcagagcgcccaagagaatggcacgcatctgaactgaaatggaaactgtgctgtcaccaccactgcaggagtggaggatgtgatcgccgactccaaggcgcacaaggtgctggtgaaggggaagaaggcggccgccgaccccatgaaggtggtggagcgcgtgcagaagaagactggccgcaaggtcgagctgctgtcgccgatgccgcccccgccggaggtggaggagaagaaggaagatgaggcggagaagaagaaggacgatgagaagaaggcagagcccgagccgccgaagccggaggagaagaaggagccgccggtgatcgctgtggtgctgaaggtgcacatgcactgcgaggcgtggtattcgtgtctctgcacctcagttcgtccaatgccgccaaacccagggcttcctcgtctgaatacagatgatgttttgatatgcaaggtcaagagacttttggtactcctatgttctagtagtctatatatttaaccaaatgagaattcgtgttattgtatgataagaattgttcctactagtatatctcatgatatactgatagtgcaatctcgttttttgttgtctt

SEQ ID NO: 714 - protein, 647 aa, Zea mays
  misc_feature: PFam Name: HMA; PFam Description: Heavy-metal-associated domain
  misc_feature: PFam Name: Protamine_P1; PFam Description: Protamine P1
  misc_feature: PFam Name: TT_ORF1; PFam Description: TT viral orf 1
  misc_feature: PFam Name: Trypan_PARP; PFam Description: Procyclic acidic
  misc_feature: PFam Name: HSP90; PFam Description: Hsp90 protein
  misc_feature: GI Number: 50908877; NR Description: putative farnesylated protein [Oryza sativa (japonica cultivar-group)] >gi|48716470|dbj|BAD23076.1| putative farnesylated protein [Oryza
  misc_feature: GI Number: 50908879; NR Description: putative farnesylated protein [Oryza sativa (japonica cultivar-group)] >gi|48716472|dbj|BAD23078.1| putative farnesylated protein [Oryza
  misc_feature: GI Number: 4097547; NR Description: ATFP3 [Arabidopsis thaliana]
  misc_feature: GI Number: 24417342; NR Description: unknown [Arabidopsis thaliana]
  misc_feature: GI Number: 50936147; NR Description: putative heavy-metal-associated domain-containing protein [Oryza sativa (japonica cultivar-group)] >gi|34394290|dbj|BAC84772.1| putative heavy-metal-associated domain-containing protein [Oryza sativa
ACTTGCTTCAAAGGCTATATTCTTGGAAGAATTAGTGTGATTCATGGCAGGTTCTCAGAGCGCCCAAGAGAATGGCACGCATCTGAACTGAAATGGAAACTGTGCTGTCACCACCACTGCAGGAGTGGAGGATGTGATCGCCGACTCCAAGGCGCACAAGGTGCTGGTGAAGGGGAAGAAGGCGGCCGCCGACCCCATGAAGGTGGTGGAGCGCGTGCAGAAGAAGACTGGCCGCAAGGTCGAGCTGCTGTCGCCGATGCCGCCCCCGCCGGAGGTGGAGGAGAAGAAGGAAGATGAGGCGGAGAAGAAGAAGGACGATGAGAAGAAGGCAGAGCCCGAGCCGCCGAAGCCGGAGGAGAAGAAGGAGCCGCCGGTGATCGCTGTGGTGCTGAAGGTGCACATGCACTGCGAGGCGTGGTATTCGTGTCTCTGCACCTCAGTTCGTCCAATGCCGCCAAACCCAGGGCTTCCTCGTCTGAATACAGATGATGTTTTGATATGCAAGGTCAAGAGACTTTTGGTACTCCTATGTTCTAGTAGTCTATATATTTAACCAAATGAGAATTCGTGTTATTGTATGATAAGAATTGTTCCTACTAGTATATCTCATGATATACTGATAGTGCAATCTCGTTTTTTGTTGTCTT

SEQ ID NO: 715 - DNA, 1537 bp, Zea mays
  misc_feature (1)..(1537): Ceres cDNA ID no. 12361456
  misc_feature (1)..(1537): Ceres CLONE  ID no. 325089
  misc_feature (1)..(1537): Also known as  Ceres CDNA ID no. 23793372
gcacgagaccattacctagaacatcctaatcgaaaaagctattcgcgggaccgtatccgagcaggacagcaggttgttcagcgatcactcgagcggtcgagccctcgcgccgcggagagtgtctccagtctcaagtacagcggaggatggagagcggcttgcttgacaccgccgcggctgccggtctctgcccggtggcggccgggcgccgccgcgtcgggagcacgggcacggcgaggtgcttcctcagctgctcctgcgcttccagagactgcagggtgagcgcgtcctactcccactccatcagccggatgctgagcggggtgcggtcggcggcgcgcaagaggctcttcaggagcgacccggccgagctgctgggcgtcgccaactggtcggagacgggcggcggcggcgccgggggccaccagcactggtggacggcgctggagaacaacttcgtgctggaggccaccgacgacgagtacggcggggtcgtcgtcgacgccgatcggctgccggccgacagggccgccttcgcgcgctccctcgcggcgtcgctctcctactggaagtccgtggggaagaaaggggtgtggttgaaattaccggtggatctagccgagttcgtccctttagcagtgaaggaaggcttcaagtaccaccacgcggaggaagcgtatttgatgatgacgtactggatccccgatgaaccgaatatgctcccagcaaatgcttctcatcaggttggggttgggggttttgtgatcaacgaccaaatggaggttctagtggtgcaagagaagtaccgcggatcgtcgctggatggcgtatggaaactccccacaggcttcattcttgcgtctgaggaaatctacacgggggccagcagagaggtgaaggaggaaaccggggtcgacaccgagttcgttgacgtcgttgctttcaggcatgcccacaacgtggcgtttcacaagtccgacctcttcttcatctgcatgctgaggcctgtgtcgagtgagatcaagattgacgagacagagattcaggcagcgaagtggatggcgctggaggagttcgtgaagcagcccttcatccaggaagaccacatcttccagaagatcatggacatctgcatccagcgcctccgcaagtgctactgtgggctgacgccgcaccacgtcgtctccaagttcgacgacagaacgtccacgctctactacaatgtcgccgagcccgaggacgtgaactgcagcgccgcctgatgtaatatgatgtgagggggagggggagccaccccagcatctactagtctaatttttgctgcgcagaagtttcatgatgcagcagtgttagtcgtgcgattactgagagtgaaatactagtggcagactgcgcgaggcaatagagttgccgagcctgtacatatacgtgtagggcatatgcataaccagagagctgtatatcccggggcggatccccgggcaggaggaaaattttcattgccgccgtaaattacaatttaactttagctcgccct

SEQ ID NO: 716 - protein, 1537 aa, Zea mays
  misc_feature: PFam Name: NUDIX; PFam Description: NUDIX domain
  misc_feature: GI Number: 61656669; NR Description: OSJNBa0065H10.6 [Oryza
  misc_feature: GI Number: 23308325; NR Description: At5g47240/MQL5_10 [Arabidopsis thaliana] >gi|21928133|gb|AAM78094.1|
  misc_feature: GI Number: 18422772; NR Description: MutT/nudix family
  misc_feature: GI Number: 8809607; NR Description: mutT domain protein-like
  misc_feature: GI Number: 21593371; NR Description: mutT domain protein-like
GCACGAGACCATTACCTAGAACATCCTAATCGAAAAAGCTATTCGCGGGACCGTATCCGAGCAGGACAGCAGGTTGTTCAGCGATCACTCGAGCGGTCGAGCCCTCGCGCCGCGGAGAGTGTCTCCAGTCTCAAGTACAGCGGAGGATGGAGAGCGGCTTGCTTGACACCGCCGCGGCTGCCGGTCTCTGCCCGGTGGCGGCCGGGCGCCGCCGCGTCGGGAGCACGGGCACGGCGAGGTGCTTCCTCAGCTGCTCCTGCGCTTCCAGAGACTGCAGGGTGAGCGCGTCCTACTCCCACTCCATCAGCCGGATGCTGAGCGGGGTGCGGTCGGCGGCGCGCAAGAGGCTCTTCAGGAGCGACCCGGCCGAGCTGCTGGGCGTCGCCAACTGGTCGGAGACGGGCGGCGGCGGCGCCGGGGGCCACCAGCACTGGTGGACGGCGCTGGAGAACAACTTCGTGCTGGAGGCCACCGACGACGAGTACGGCGGGGTCGTCGTCGACGCCGATCGGCTGCCGGCCGACAGGGCCGCCTTCGCGCGCTCCCTCGCGGCGTCGCTCTCCTACTGGAAGTCCGTGGGGAAGAAAGGGGTGTGGTTGAAATTACCGGTGGATCTAGCCGAGTTCGTCCCTTTAGCAGTGAAGGAAGGCTTCAAGTACCACCACGCGGAGGAAGCGTATTTGATGATGACGTACTGGATCCCCGATGAACCGAATATGCTCCCAGCAAATGCTTCTCATCAGGTTGGGGTTGGGGGTTTTGTGATCAACGACCAAATGGAGGTTCTAGTGGTGCAAGAGAAGTACCGCGGATCGTCGCTGGATGGCGTATGGAAACTCCCCACAGGCTTCATTCTTGCGTCTGAGGAAATCTACACGGGGGCCAGCAGAGAGGTGAAGGAGGAAACCGGGGTCGACACCGAGTTCGTTGACGTCGTTGCTTTCAGGCATGCCCACAACGTGGCGTTTCACAAGTCCGACCTCTTCTTCATCTGCATGCTGAGGCCTGTGTCGAGTGAGATCAAGATTGACGAGACAGAGATTCAGGCAGCGAAGTGGATGGCGCTGGAGGAGTTCGTGAAGCAGCCCTTCATCCAGGAAGACCACATCTTCCAGAAGATCATGGACATCTGCATCCAGCGCCTCCGCAAGTGCTACTGTGGGCTGACGCCGCACCACGTCGTCTCCAAGTTCGACGACAGAACGTCCACGCTCTACTACAATGTCGCCGAGCCCGAGGACGTGAACTGCAGCGCCGCCTGATGTAATATGATGTGAGGGGGAGGGGGAGCCACCCCAGCATCTACTAGTCTAATTTTTGCTGCGCAGAAGTTTCATGATGCAGCAGTGTTAGTCGTGCGATTACTGAGAGTGAAATACTAGTGGCAGACTGCGCGAGGCAATAGAGTTGCCGAGCCTGTACATATACGTGTAGGGCATATGCATAACCAGAGAGCTGTATATCCCGGGGCGGATCCCCGGGCAGGAGGAAAATTTTCATTGCCGCCGTAAATTACAATTTAACTTTAGCTCGCCCT

SEQ ID NO: 717 - DNA, 1698 bp, Zea mays
  misc_feature (1)..(1698): Ceres cDNA ID no. 12361474
  misc_feature (1)..(1698): Ceres CLONE  ID no. 376901
  misc_feature (1)..(1698): Also known as  Ceres CDNA ID no. 23800220
gcacgagaccattacctagaacatcctaatcgaaaaagccagtggctcagcggctgcgcccgtgcctgtcacgtcttgtcctcaatctctctctctctctctcaatcctcacctctccggctctctttctcctccccagtccccaacggtgaggcccccgccgcgcagcccatcgacgcattgccgctgcaagcgcggacaccgagggctagaagcggcggcggtgccagggttcggcgctcggtcggcaatggcgaggcggcttatgctggcgctccctgtgctcctcttcttattgctcgtcgggcaatgccacggcggcaagattggcgtctgctacggccgcaacgccgacgaccttccggcgccagacaaggtggcgcagctaatccagcagcagtccatcaagtacgtgcgcatctacgacaccaacatcgacgtcatcaaggcattcgccaacaccggcgtcgagctcatggtcggcgtccccaactccgacctcctcgccttcgcgcagtaccagtccaacgtcgacacatggctcaagaacagcatcctcccatactacccggacaccatgatcacctacatcaccgtcggcgccgaggtcaccgagagccccgccaacgtctccgccctcgtcgtgccagccatgcgcaatgtgcacaccgcgctcaagaaggccggcctgcacaagaagatcaccatctccagcacccactcgctcgggatactgtcccggtcgttcccgccgtctgctggggcgttcaacagcagctacgcctacttcttgaagcctatgctccagttccttgtggagaatcaggcaccgttcatggtggatttgtacccctactatgcgtaccagaactcacggagcaatgtgtccctcaactacgcgctgttctcgccagagtcccaggatgtgattgacccaaacactggactggtttacactaacatgttcgacgcccaggtcgattccatcttctttgcgctcatggctctgaacttcaagactttgaagatcatgatcactgagtcagggtggccaaacaaaggggcggtcaaggagactggagccacaccagacaatgctcagacctacaataccaatttgatacgccatgttgttaatgacagcggcacaccggcgaaaccaggggaagagattgatgtctacatattttcattgttcaatgagaacaggaaacctggcatcgagtcggagaggaactggggactgttttttcctgataagagctctatctacagccttgattggacgggccgaggcaatgtggatgttatgactggagcaaacattacaagtgctaatggtacctggtgtattgcttcaactaatgcatcagaaactgatctgcagaatgccctcaactgggcatgtggtccaggcaacgtagattgttctgccatacagccaagccaaccctgctaccagccggacactttaacttcccatgcttcatatgcattcaatagctactaccagcaaaatggagccaacgttgtggcctgtgactttggaggtgcggggatacgaacgacaaaagatccaagtaagagtcccatccttttttactgttatgataatcatgatgctatgcatggtttcatgataacatccatttgcatatattcaggttgtggattatgtctttagttgatgttggagtt

SEQ ID NO: 718 - protein, 1698 aa, Zea mays
  misc_feature: PFam Name: Glyco_hydro_17; PFam Description: Glycosyl
  misc_feature: PFam Name: X8; PFam Description: X8 domain
  misc_feature: PFam Name: Mucin; PFam Description: Mucin-like glycoprotein
  misc_feature: GI Number: 34909360; NR Description: P0638D12.12 [Oryza sativa (japonica cultivar-group)] >gi|14090345|dbj|BAB55504.1|
  misc_feature: GI Number: 57899486; NR Description: putative elicitor inducible beta-1,3-glucanase NtEIG-E76 [Oryza sativa (japonica
  misc_feature: GI Number: 21593929; NR Description: beta-1,3-glucanase-like protein [Arabidopsis thaliana] >gi|30688300|ref|NP_567828.3|
  misc_feature: GI Number: 20465905; NR Description: putative beta-1,3-glucanase [Arabidopsis thaliana] >gi|18175943|gb|AAL59955.1| putative beta-1,3-glucanase [Arabidopsis thaliana] >gi|30688297|ref|NP_849556.1| glycosyl
  misc_feature: GI Number: 7269834; NR Description: beta-1, 3-glucanase-like protein [Arabidopsis thaliana] >gi|25407609|pir||F85342 beta-1,
GCACGAGACCATTACCTAGAACATCCTAATCGAAAAAGCCAGTGGCTCAGCGGCTGCGCCCGTGCCTGTCACGTCTTGTCCTCAATCTCTCTCTCTCTCTCTCAATCCTCACCTCTCCGGCTCTCTTTCTCCTCCCCAGTCCCCAACGGTGAGGCCCCCGCCGCGCAGCCCATCGACGCATTGCCGCTGCAAGCGCGGACACCGAGGGCTAGAAGCGGCGGCGGTGCCAGGGTTCGGCGCTCGGTCGGCAATGGCGAGGCGGCTTATGCTGGCGCTCCCTGTGCTCCTCTTCTTATTGCTCGTCGGGCAATGCCACGGCGGCAAGATTGGCGTCTGCTACGGCCGCAACGCCGACGACCTTCCGGCGCCAGACAAGGTGGCGCAGCTAATCCAGCAGCAGTCCATCAAGTACGTGCGCATCTACGACACCAACATCGACGTCATCAAGGCATTCGCCAACACCGGCGTCGAGCTCATGGTCGGCGTCCCCAACTCCGACCTCCTCGCCTTCGCGCAGTACCAGTCCAACGTCGACACATGGCTCAAGAACAGCATCCTCCCATACTACCCGGACACCATGATCACCTACATCACCGTCGGCGCCGAGGTCACCGAGAGCCCCGCCAACGTCTCCGCCCTCGTCGTGCCAGCCATGCGCAATGTGCACACCGCGCTCAAGAAGGCCGGCCTGCACAAGAAGATCACCATCTCCAGCACCCACTCGCTCGGGATACTGTCCCGGTCGTTCCCGCCGTCTGCTGGGGCGTTCAACAGCAGCTACGCCTACTTCTTGAAGCCTATGCTCCAGTTCCTTGTGGAGAATCAGGCACCGTTCATGGTGGATTTGTACCCCTACTATGCGTACCAGAACTCACGGAGCAATGTGTCCCTCAACTACGCGCTGTTCTCGCCAGAGTCCCAGGATGTGATTGACCCAAACACTGGACTGGTTTACACTAACATGTTCGACGCCCAGGTCGATTCCATCTTCTTTGCGCTCATGGCTCTGAACTTCAAGACTTTGAAGATCATGATCACTGAGTCAGGGTGGCCAAACAAAGGGGCGGTCAAGGAGACTGGAGCCACACCAGACAATGCTCAGACCTACAATACCAATTTGATACGCCATGTTGTTAATGACAGCGGCACACCGGCGAAACCAGGGGAAGAGATTGATGTCTACATATTTTCATTGTTCAATGAGAACAGGAAACCTGGCATCGAGTCGGAGAGGAACTGGGGACTGTTTTTTCCTGATAAGAGCTCTATCTACAGCCTTGATTGGACGGGCCGAGGCAATGTGGATGTTATGACTGGAGCAAACATTACAAGTGCTAATGGTACCTGGTGTATTGCTTCAACTAATGCATCAGAAACTGATCTGCAGAATGCCCTCAACTGGGCATGTGGTCCAGGCAACGTAGATTGTTCTGCCATACAGCCAAGCCAACCCTGCTACCAGCCGGACACTTTAACTTCCCATGCTTCATATGCATTCAATAGCTACTACCAGCAAAATGGAGCCAACGTTGTGGCCTGTGACTTTGGAGGTGCGGGGATACGAACGACAAAAGATCCAAGTAAGAGTCCCATCCTTTTTTACTGTTATGATAATCATGATGCTATGCATGGTTTCATGATAACATCCATTTGCATATATTCAGGTTGTGGATTATGTCTTTAGTTGATGTTGGAGTT

SEQ ID NO: 719 - DNA, 1050 bp, Zea mays
  misc_feature (1)..(1050): Ceres cDNA ID no. 12361487
  misc_feature (1)..(1050): Ceres CLONE  ID no. 276247
  misc_feature (1)..(1050): Also known as  Ceres CDNA ID no. 23748989
gcacgagaccattacctagaacatcctaatcgaaaaatccaaactcacagcacgctagctcttcagaacttgcggacgaaagactgaccgtgcaccgctagcagatcgatcgaccatggcgtcgtcctctcttctcctcctcgccgccgtcgccctcttcgccgcctccgcagacgcggccaccttcaacgtcatcaaccgctgcaagaacacgctgtggccggccgccctccccggcggcggcgcgcgcctggaccctggcaagacgtggaccgtgcaggtgccggcgggcacggcgcacgcgcgggtgtgggcgcgcacggggtgcagcttcgacggcagcggccgcgggacgtgccagacgggggactgcggcggcgcgctggcgtgcaccgtgtccgggagaacccccgcgacgctgggctgagtacacgctcaacaggaacggcccggactacatcgacatctccctcgtggatggcttcaacgtgcccatgtccttccagtgccgcggcaggggccccagctgcaaggccgacatcaacgcccagtgccccgccgcgctcaaggtgcccggcggctgcgccagcgcctgcgagaagctcggcggcgacacctactgctgccggggccagtacaaggacaagtgcccgcccacggactactccaggttcttcaagaggctgtgcccggacgcctacagctacgccaaggacgaccagaccagcaccttcacctgcccacagggctccaactacgatgtcgtgctctgcccgtgagccacatgttcgagagatcaacgaccatgcattcgcagctcgcaacaagtgcacactagtacaactatacacaagaaataagagtcgcgatatttattattatcgcgcgtggagtagttggtaaataaatcgcttattgcgagtattttggcccatgaataaggccttacttactggccatcatttccgacatatatacgtttgttcatgaataaagaaactttgcaaaacagcacaatatataatttagcacaatatataattttggagc

SEQ ID NO: 720 - protein, 1050 aa, Zea mays
  misc_feature: PFam Name: Thaumatin; PFam Description: Thaumatin family
  misc_feature: PFam Name: IER; PFam Description: Immediate early response
  misc_feature: PFam Name: Cation_efflux; PFam Description: Cation efflux family
  misc_feature: PFam Name: FH2; PFam Description: Formin Homology 2 Domain
  misc_feature: PFam Name: Pyr_redox_2; PFam Description: Pyridine
  misc_feature: GI Number: 1373392; NR Description: permatin precursor
  misc_feature: GI Number: 20257409; NR Description: thaumatin-like protein
  misc_feature: GI Number: 14164981; NR Description: thaumatin-like protein
  misc_feature: GI Number: 14164979; NR Description: thaumatin-like protein
  misc_feature: GI Number: 2454602; NR Description: Barperm1 [Hordeum
GCACGAGACCATTACCTAGAACATCCTAATCGAAAAATCCAAACTCACAGCACGCTAGCTCTTCAGAACTTGCGGACGAAAGACTGACCGTGCACCGCTAGCAGATCGATCGACCATGGCGTCGTCCTCTCTTCTCCTCCTCGCCGCCGTCGCCCTCTTCGCCGCCTCCGCAGACGCGGCCACCTTCAACGTCATCAACCGCTGCAAGAACACGCTGTGGCCGGCCGCCCTCCCCGGCGGCGGCGCGCGCCTGGACCCTGGCAAGACGTGGACCGTGCAGGTGCCGGCGGGCACGGCGCACGCGCGGGTGTGGGCGCGCACGGGGTGCAGCTTCGACGGCAGCGGCCGCGGGACGTGCCAGACGGGGGACTGCGGCGGCGCGCTGGCGTGCACCGTGTCCGGGAGAACCCCCGCGACGCTGGGCTGAGTACACGCTCAACAGGAACGGCCCGGACTACATCGACATCTCCCTCGTGGATGGCTTCAACGTGCCCATGTCCTTCCAGTGCCGCGGCAGGGGCCCCAGCTGCAAGGCCGACATCAACGCCCAGTGCCCCGCCGCGCTCAAGGTGCCCGGCGGCTGCGCCAGCGCCTGCGAGAAGCTCGGCGGCGACACCTACTGCTGCCGGGGCCAGTACAAGGACAAGTGCCCGCCCACGGACTACTCCAGGTTCTTCAAGAGGCTGTGCCCGGACGCCTACAGCTACGCCAAGGACGACCAGACCAGCACCTTCACCTGCCCACAGGGCTCCAACTACGATGTCGTGCTCTGCCCGTGAGCCACATGTTCGAGAGATCAACGACCATGCATTCGCAGCTCGCAACAAGTGCACACTAGTACAACTATACACAAGAAATAAGAGTCGCGATATTTATTATTATCGCGCGTGGAGTAGTTGGTAAATAAATCGCTTATTGCGAGTATTTTGGCCCATGAATAAGGCCTTACTTACTGGCCATCATTTCCGACATATATACGTTTGTTCATGAATAAAGAAACTTTGCAAAACAGCACAATATATAATTTAGCACAATATATAATTTTGGAGC

SEQ ID NO: 721 - DNA, 2782 bp, Zea mays
  misc_feature (1)..(2782): Ceres cDNA ID no. 12361524
  misc_feature (1)..(2782): Ceres CLONE  ID no. 390733
  misc_feature (1)..(2782): Also known as  Ceres CDNA ID no. 23799494
gaaaaatcccaccccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggcgtagatttccggcggccatggggggcgccgtgatggtcgccatcgcggcctctatcggcaacttgctgcagggctgggacaatgcgacaattgctggagccgtcctgtacataaagaaggaattcaacctgcagagcgagcctctgatcgagggcctcatcgtcgccatgtccctcattggggcaacagtcatcacgacgttctccggggcagcggccgactgcgttggtaggaggcccatgctggtcgcctcggctgtcctctacttcgtcagtgggctggtgatgctttgggcgccaagtgtgtacatcttgctcctcgcaaggctcattgatgggttcggtatcggtttggcggtcacacttgttcctctctacatctccgagactgcaccgacagacattcgtgggctgttgaacacgttgccgcagttcagtgggtcaggagggatgttcctctcctactgcatggtgtttgggatgtccctcatgcccaaacctgattggaggctcatgcttggagttctgtcgatcccgtcacttatttactttggactgactgtcttctacttgcctgaatcaccaaggtggcttgtgagcaaaggaaggatggcggaggcgaagagagtgttgcaaaggctgcggggaagagaagatgtctcaggggagatggctcttctagttgaaggtttgggggtcggtaaagatacacgtattgaagaatacataattggtcccgatgatgaacttgctgatgaagggctggctccagatccagagaagatcaaactatatggacctgaagaaggcctatcttgggttgcccgacctgttcggggacaaagtgctcttggaagcgcgttaggtctcatctctcgtcatgggagtatggcggctagtcagggtaagcccctcgtggatcctatggtcactcttttcggaagtgttcatgaaaagatgcctgagatcatggggagcatgaggagcacattgtttcccaactttggcagcatgtttagtgttgccgaccagcagcaggtgaaagctgactgggacgccgagagtcaaagggaaggtgaagattatgcttcggatcatggtggcgatgacatcgaggataacctccaaagcccacttatttctcgtcaggcaacaagtgtggaaggaaaggagatcgctgcacctcatggtagcatattgggtgctgtgggaaggagcagtagcttgcagggaggggaggcagtaagcagcatgggcattggcggaggatggcagttggcgtggaaatggaccgagagagagggcgaagatgggcaaaaggaaggtggcttccagcgtatttacttgcatgaggagggcgtacaaggcaacaggggttctatattgtcattaccaggcggggatgttcctcctggtggtgagttcatccaggctgcagctcttgtgagccaaccagctctttactctaaggaactgctggagcaacgtgctgctggtcctgcgatgatgcatccatctgaagcagttactaaaggtccaagatgggccgacctatttgagcctggggtgaagcatgcactgtttgttggcataggaatacagatcctgcaacagtttgctggcatcaacggcgttctctactacactcctcaaattcttgagcaagcaggcgttggtgttcttctgtcgaacctcggccttaacgcttcttcggcatcaatcctcattagcgccctgacgaccttactgatgctcccaagcatcggcattgcgatgaggctcatggatatgtccggaaggaggtttctcctcctcgcgacgatcccagtcctaatagtcgcgctactcgtcctggtggtgtccaacatcgtggacgtgggggacgtggcgcacgcggcgctctccacggccagcgtcatagtctacttctgcttcttcgtcatggggttcgggcccgtccccaacatcctctgcgcagagatcttccccaccacggtccgcggtgtctgcatcgccatctgcgccctggccttctggctcggtgacatcatcgtgacgtacactctccccgtgatgctgaacgtcgtcgggctcgccggcgtctttggggtgtacgccgtcgtgtgcgtcctagccctcgcgttcgtgttcgtcaaggtgcccgagacgaagggcatgcctctcgaggtcatcaccgagttcttctccgttggggcaaagcaagccaaggaagaggaggaggaggaggccagggaaggttgatcacccggacggccggacccagttaccggcaccgcctgtggggatttttgtggtctgcacacttcactgtggttggtcctgtgatgatgtatttgtgaaaaaaaaaactttgggtagggggcagagatgatttggctgtacaatgtgaggcttgattctgccaaaggctggccttcagaactaggaagggtgtctgttatcttcttttgttgcttggagaccttgtgcttgtgttggttggaattttgttgcctatgtaactagtggtgtatgacagttatgctattggtttc

SEQ ID NO: 722 - protein, 2782 aa, Zea mays
  misc_feature: PFam Name: Sugar_tr; PFam Description: Sugar (and other)
  misc_feature: PFam Name: MFS_1; PFam Description: Major Facilitator Superfamily
  misc_feature: GI Number: 20453189; NR Description: AT4g35300/F23E12_140 [Arabidopsis thaliana] >gi|30690286|ref|NP_849565.1|
  misc_feature: GI Number: 25402933; NR Description: Sugar transporter [imported] - Arabidopsis thaliana >gi|4836905|gb|AAD30608.1| Sugar
  misc_feature: GI Number: 26986186; NR Description: hexose transporter
  misc_feature: GI Number: 50906569; NR Description: putative hexose transporter [Oryza sativa (japonica cultivar-group)] >gi|49388943|dbj|BAD26163.1| putative hexose transporter [Oryza
  misc_feature: GI Number: 37536506; NR Description: putative sugar transporter [Oryza sativa (japonica cultivar-group)] >gi|12039327|gb|AAG46115.1| putative sugar transporter [Oryza sativa] >gi|31433313|gb|AAP54842.1| putative sugar transporter
GAAAAATCCCACCCCCCCTCCACTCCACTACCACGGCGGCACGGCCTGCCTCTGCAGCTCTGCCCTGCTCCGCACCCCTCGCTCTCCAACCCCAACGCGCGGCGTTGCTAAAATTCACCGCAGCGCTTACTCCAGTTTGGCCACCTCACCACCCGCCGCCGCTGTTTAAGAAGGCCCCGCGCCCGATCGGGGATCACGAACCTTGGCCGCCGCTGCCGGAGTGGGGGCGTAGATTTCCGGCGGCCATGGGGGGCGCCGTGATGGTCGCCATCGCGGCCTCTATCGGCAACTTGCTGCAGGGCTGGGACAATGCGACAATTGCTGGAGCCGTCCTGTACATAAAGAAGGAATTCAACCTGCAGAGCGAGCCTCTGATCGAGGGCCTCATCGTCGCCATGTCCCTCATTGGGGCAACAGTCATCACGACGTTCTCCGGGGCAGCGGCCGACTGCGTTGGTAGGAGGCCCATGCTGGTCGCCTCGGCTGTCCTCTACTTCGTCAGTGGGCTGGTGATGCTTTGGGCGCCAAGTGTGTACATCTTGCTCCTCGCAAGGCTCATTGATGGGTTCGGTATCGGTTTGGCGGTCACACTTGTTCCTCTCTACATCTCCGAGACTGCACCGACAGACATTCGTGGGCTGTTGAACACGTTGCCGCAGTTCAGTGGGTCAGGAGGGATGTTCCTCTCCTACTGCATGGTGTTTGGGATGTCCCTCATGCCCAAACCTGATTGGAGGCTCATGCTTGGAGTTCTGTCGATCCCGTCACTTATTTACTTTGGACTGACTGTCTTCTACTTGCCTGAATCACCAAGGTGGCTTGTGAGCAAAGGAAGGATGGCGGAGGCGAAGAGAGTGTTGCAAAGGCTGCGGGGAAGAGAAGATGTCTCAGGGGAGATGGCTCTTCTAGTTGAAGGTTTGGGGGTCGGTAAAGATACACGTATTGAAGAATACATAATTGGTCCCGATGATGAACTTGCTGATGAAGGGCTGGCTCCAGATCCAGAGAAGATCAAACTATATGGACCTGAAGAAGGCCTATCTTGGGTTGCCCGACCTGTTCGGGGACAAAGTGCTCTTGGAAGCGCGTTAGGTCTCATCTCTCGTCATGGGAGTATGGCGGCTAGTCAGGGTAAGCCCCTCGTGGATCCTATGGTCACTCTTTTCGGAAGTGTTCATGAAAAGATGCCTGAGATCATGGGGAGCATGAGGAGCACATTGTTTCCCAACTTTGGCAGCATGTTTAGTGTTGCCGACCAGCAGCAGGTGAAAGCTGACTGGGACGCCGAGAGTCAAAGGGAAGGTGAAGATTATGCTTCGGATCATGGTGGCGATGACATCGAGGATAACCTCCAAAGCCCACTTATTTCTCGTCAGGCAACAAGTGTGGAAGGAAAGGAGATCGCTGCACCTCATGGTAGCATATTGGGTGCTGTGGGAAGGAGCAGTAGCTTGCAGGGAGGGGAGGCAGTAAGCAGCATGGGCATTGGCGGAGGATGGCAGTTGGCGTGGAAATGGACCGAGAGAGAGGGCGAAGATGGGCAAAAGGAAGGTGGCTTCCAGCGTATTTACTTGCATGAGGAGGGCGTACAAGGCAACAGGGGTTCTATATTGTCATTACCAGGCGGGGATGTTCCTCCTGGTGGTGAGTTCATCCAGGCTGCAGCTCTTGTGAGCCAACCAGCTCTTTACTCTAAGGAACTGCTGGAGCAACGTGCTGCTGGTCCTGCGATGATGCATCCATCTGAAGCAGTTACTAAAGGTCCAAGATGGGCCGACCTATTTGAGCCTGGGGTGAAGCATGCACTGTTTGTTGGCATAGGAATACAGATCCTGCAACAGTTTGCTGGCATCAACGGCGTTCTCTACTACACTCCTCAAATTCTTGAGCAAGCAGGCGTTGGTGTTCTTCTGTCGAACCTCGGCCTTAACGCTTCTTCGGCATCAATCCTCATTAGCGCCCTGACGACCTTACTGATGCTCCCAAGCATCGGCATTGCGATGAGGCTCATGGATATGTCCGGAAGGAGGTTTCTCCTCCTCGCGACGATCCCAGTCCTAATAGTCGCGCTACTCGTCCTGGTGGTGTCCAACATCGTGGACGTGGGGGACGTGGCGCACGCGGCGCTCTCCACGGCCAGCGTCATAGTCTACTTCTGCTTCTTCGTCATGGGGTTCGGGCCCGTCCCCAACATCCTCTGCGCAGAGATCTTCCCCACCACGGTCCGCGGTGTCTGCATCGCCATCTGCGCCCTGGCCTTCTGGCTCGGTGACATCATCGTGACGTACACTCTCCCCGTGATGCTGAACGTCGTCGGGCTCGCCGGCGTCTTTGGGGTGTACGCCGTCGTGTGCGTCCTAGCCCTCGCGTTCGTGTTCGTCAAGGTGCCCGAGACGAAGGGCATGCCTCTCGAGGTCATCACCGAGTTCTTCTCCGTTGGGGCAAAGCAAGCCAAGGAAGAGGAGGAGGAGGAGGCCAGGGAAGGTTGATCACCCGGACGGCCGGACCCAGTTACCGGCACCGCCTGTGGGGATTTTTGTGGTCTGCACACTTCACTGTGGTTGGTCCTGTGATGATGTATTTGTGAAAAAAAAAACTTTGGGTAGGGGGCAGAGATGATTTGGCTGTACAATGTGAGGCTTGATTCTGCCAAAGGCTGGCCTTCAGAACTAGGAAGGGTGTCTGTTATCTTCTTTTGTTGCTTGGAGACCTTGTGCTTGTGTTGGTTGGAATTTTGTTGCCTATGTAACTAGTGGTGTATGACAGTTATGCTATTGGTTTC

SEQ ID NO: 723 - DNA, 1050 bp, Zea mays
  misc_feature (1)..(1050): Ceres cDNA ID no. 12361897
  misc_feature (1)..(1050): Ceres CLONE  ID no. 337464
  misc_feature (1)..(1050): Also known as  Ceres CDNA ID no. 23764218
gacatttatggcaaaagagaggtcatacagaagctaagacagcacctcaagaaacgtgatgagatgatcatggagatgcaaactcagattgctgatcttaagaactctcttaacattcaggtgacacagtccagcaatctgcagtctcaattggatgctgccaatcgtgatctgtttgaatctgaacgagagattcagcatctaaggaagattattgcagatcattgtgtcacagaagcactctctcatgataaacctttgcaagctgcgcattggcagccagatgccgcaaatgggcattctaatggctatggtgatggttgtgttgatgatgctgacctgcattgtattagcatcgagaagaggaaggtagaagtagagagggtggagatgctcaagaaagaggtggttgaactgaaggaagtcattgagggaaaggactttgtgcttcagagctacaaggaacagaaggtggaactcttctcaaagatcagggagttgcaggaaaagctctcagcacaagtgccaatcatcttgtaggatctatctgtgatactttttagaagattgaatctaagcataatgttgccatgtcccatgagcagcagagggggtcccgcttcagtgaagattgcagaaggtcttggcatttggcaatcgtcacgcatgccaaacaccatgctaggatctttgtggaatgcttctcttttcctttgaggggagctttgcataatgttaggttgatttgtttctttcttggttgtcataatgttaggttggtttgctttcttccttcttcaatatctagcccttggttgctcaaagtttacaaagggattctttttttcagttgctaggcctcaggtaactcaattgaacttcatactcaagttgctgtacaggttctcagatttcaggagacacagaagtctgtactgtgcctctgcctcctgtttcatgcttttttttttgttaagtgatctttggaatgttaggtccatgacatttctactatgagatttgaagactatggcattgcccttttttgtg

SEQ ID NO: 724 - protein, 1050 aa, Zea mays
  misc_feature: GI Number: 21536672; NR Description: unknown [Arabidopsis thaliana]
GACATTTATGGCAAAAGAGAGGTCATACAGAAGCTAAGACAGCACCTCAAGAAACGTGATGAGATGATCATGGAGATGCAAACTCAGATTGCTGATCTTAAGAACTCTCTTAACATTCAGGTGACACAGTCCAGCAATCTGCAGTCTCAATTGGATGCTGCCAATCGTGATCTGTTTGAATCTGAACGAGAGATTCAGCATCTAAGGAAGATTATTGCAGATCATTGTGTCACAGAAGCACTCTCTCATGATAAACCTTTGCAAGCTGCGCATTGGCAGCCAGATGCCGCAAATGGGCATTCTAATGGCTATGGTGATGGTTGTGTTGATGATGCTGACCTGCATTGTATTAGCATCGAGAAGAGGAAGGTAGAAGTAGAGAGGGTGGAGATGCTCAAGAAAGAGGTGGTTGAACTGAAGGAAGTCATTGAGGGAAAGGACTTTGTGCTTCAGAGCTACAAGGAACAGAAGGTGGAACTCTTCTCAAAGATCAGGGAGTTGCAGGAAAAGCTCTCAGCACAAGTGCCAATCATCTTGTAGGATCTATCTGTGATACTTTTTAGAAGATTGAATCTAAGCATAATGTTGCCATGTCCCATGAGCAGCAGAGGGGGTCCCGCTTCAGTGAAGATTGCAGAAGGTCTTGGCATTTGGCAATCGTCACGCATGCCAAACACCATGCTAGGATCTTTGTGGAATGCTTCTCTTTTCCTTTGAGGGGAGCTTTGCATAATGTTAGGTTGATTTGTTTCTTTCTTGGTTGTCATAATGTTAGGTTGGTTTGCTTTCTTCCTTCTTCAATATCTAGCCCTTGGTTGCTCAAAGTTTACAAAGGGATTCTTTTTTTCAGTTGCTAGGCCTCAGGTAACTCAATTGAACTTCATACTCAAGTTGCTGTACAGGTTCTCAGATTTCAGGAGACACAGAAGTCTGTACTGTGCCTCTGCCTCCTGTTTCATGCTTTTTTTTTTGTTAAGTGATCTTTGGAATGTTAGGTCCATGACATTTCTACTATGAGATTTGAAGACTATGGCATTGCCCTTTTTTGTG

SEQ ID NO: 725 - DNA, 1741 bp, Zea mays
  misc_feature (1)..(1741): Ceres cDNA ID no. 12362368
  misc_feature (1)..(1741): Ceres CLONE  ID no. 260965
  misc_feature (1)..(1741): Also known as  Ceres CDNA ID no. 23783708
gcacgagaccattacctagaacatcctaatcgaaaaaccccccgttctgtagctctcctctaatcctgatttttgtatgcgtggtggtcgctcttccgtctctcccagcccagcagccagcagtcgtctccttctctacctccctcgcatatcctgctcctctgtaaccactgtactaaaactagcctgtacctgtactgtgctgacattatatacagccccttctctttgcttcttgctcgtgccaattggcagttgccattgccaatcaccacgtagagctgcattattgcttgcttcgaggccatgggaactgcaagagttcgcttcgtggtccttgttctgatctctacgtttctcagagtcagagaaggcagagccgcgacattcacgttcgtgaaccggtgcacggggacggtgtggccgggcatccagtccaacgccggaagctcgaggctggacacgacgggcttcgtgctgccgccgggcacgtcgcgcgcggtcccggcgccgtcggggtggtccggccgcgtctgggcccgcaccggctgcgggcaggacggcagcggcaaggtggtgtgcgcgacgggcgactgcgggtccgggtccctggagtgcaacgggcagaacgcggcgacgcctgcgacgctggccgagttcacgctggcctccgcgggcggcaacgacttctacgacgtgagcctggtggacggctacaacctgccgatcctggtggagcccgcgggcggcgccgccaccggcgccagtgccacgacgtgcgccgcggccgggtgcacggcggacctcaacgagcggtgccccgcggagctgcgcgccgagggcggcgccgggtgccgcaccgcctgccacgccttcggcaggcccgagtactgctgcagcggcgcctacgccaaccccaacacctgccgccccaccgcctactcgcagctcttcaagtccgcctgccccaactcgtacagctacgcatacgacgaccccaccagcaccttcacctgcgccggcggccgcgactacaccatcaccttctgccccgtcgccaccccaagcgtgaaatcgtcgagtggccctggagcggcaacaacgacggcggcaccgacaggcccgacgccgacgctgccgggggcgacgccgcggtcggcaggcggcggcccggaggggcagggcgtgatgctgggcgacaactcctggctcgccagcctcgccacgggcgacgcgtcgtccgcgccggcgctccgggccttgcccctcgcgccgctcctgctcgtcggcctgctcctgcttgtgctgctatagcaccaccagcgggaaacccaggcaaccgaccgcgtcacgggcgtgtgaggcgaaagcttttgatctcggacagcctaccgaacgcgcgcgctcctgctacgtttgatgaatcatctcctagtcacggtgcaggcctgcagtgcggcggatgattttgacggctagccgaatgcgcgcacccccatccccagtcagcagctgaaggaaaaaaagtttaagtggcctactcatggatgaggtggctgcagcatggactagacacaaatactattagtgctgatggtgtatagtaccgctgccgctttaaagtagtgtacagtgcagtgcagctctgatggcgctgtccctcggcacatgggaggagatgtgcccatgccatgccatctgatctgtgcttgcggatcaatcaaatactacgtacgtgtcc

SEQ ID NO: 726 - protein, 1741 aa, Zea mays
  misc_feature: PFam Name: Thaumatin; PFam Description: Thaumatin family
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: 7tm_1; PFam Description: 7 transmembrane receptor
  misc_feature: GI Number: 31430155; NR Description: putative thaumatin-like protein [Oryza sativa (japonica cultivar-group)] gi|37531036|ref|NP_919820.1| putative thaumatin-like protein [Oryza sativa (japonica cultivar-group)]
  misc_feature: GI Number: 50726592; NR Description: putative thaumatin-like
  misc_feature: GI Number: 21592749; NR Description: putative thaumatin-like
  misc_feature: GI Number: 20466021; NR Description: putative thaumatin [Arabidopsis thaliana] >gi|17979355|gb|AAL49903.1| putative thaumatin protein [Arabidopsis thaliana] >gi|18420282|ref|NP_568046.1| thaumatin, putative [Arabidopsis
  misc_feature: GI Number: 7270849; NR Description: putative thaumatin-like protein [Arabidopsis thaliana] >gi|4467153|emb|CAB37522.1| putative thaumatin-like protein [Arabidopsis thaliana] >gi|7442168|pir||T05694 pathogenesis-related protein F20M13.220 -
GCACGAGACCATTACCTAGAACATCCTAATCGAAAAACCCCCCGTTCTGTAGCTCTCCTCTAATCCTGATTTTTGTATGCGTGGTGGTCGCTCTTCCGTCTCTCCCAGCCCAGCAGCCAGCAGTCGTCTCCTTCTCTACCTCCCTCGCATATCCTGCTCCTCTGTAACCACTGTACTAAAACTAGCCTGTACCTGTACTGTGCTGACATTATATACAGCCCCTTCTCTTTGCTTCTTGCTCGTGCCAATTGGCAGTTGCCATTGCCAATCACCACGTAGAGCTGCATTATTGCTTGCTTCGAGGCCATGGGAACTGCAAGAGTTCGCTTCGTGGTCCTTGTTCTGATCTCTACGTTTCTCAGAGTCAGAGAAGGCAGAGCCGCGACATTCACGTTCGTGAACCGGTGCACGGGGACGGTGTGGCCGGGCATCCAGTCCAACGCCGGAAGCTCGAGGCTGGACACGACGGGCTTCGTGCTGCCGCCGGGCACGTCGCGCGCGGTCCCGGCGCCGTCGGGGTGGTCCGGCCGCGTCTGGGCCCGCACCGGCTGCGGGCAGGACGGCAGCGGCAAGGTGGTGTGCGCGACGGGCGACTGCGGGTCCGGGTCCCTGGAGTGCAACGGGCAGAACGCGGCGACGCCTGCGACGCTGGCCGAGTTCACGCTGGCCTCCGCGGGCGGCAACGACTTCTACGACGTGAGCCTGGTGGACGGCTACAACCTGCCGATCCTGGTGGAGCCCGCGGGCGGCGCCGCCACCGGCGCCAGTGCCACGACGTGCGCCGCGGCCGGGTGCACGGCGGACCTCAACGAGCGGTGCCCCGCGGAGCTGCGCGCCGAGGGCGGCGCCGGGTGCCGCACCGCCTGCCACGCCTTCGGCAGGCCCGAGTACTGCTGCAGCGGCGCCTACGCCAACCCCAACACCTGCCGCCCCACCGCCTACTCGCAGCTCTTCAAGTCCGCCTGCCCCAACTCGTACAGCTACGCATACGACGACCCCACCAGCACCTTCACCTGCGCCGGCGGCCGCGACTACACCATCACCTTCTGCCCCGTCGCCACCCCAAGCGTGAAATCGTCGAGTGGCCCTGGAGCGGCAACAACGACGGCGGCACCGACAGGCCCGACGCCGACGCTGCCGGGGGCGACGCCGCGGTCGGCAGGCGGCGGCCCGGAGGGGCAGGGCGTGATGCTGGGCGACAACTCCTGGCTCGCCAGCCTCGCCACGGGCGACGCGTCGTCCGCGCCGGCGCTCCGGGCCTTGCCCCTCGCGCCGCTCCTGCTCGTCGGCCTGCTCCTGCTTGTGCTGCTATAGCACCACCAGCGGGAAACCCAGGCAACCGACCGCGTCACGGGCGTGTGAGGCGAAAGCTTTTGATCTCGGACAGCCTACCGAACGCGCGCGCTCCTGCTACGTTTGATGAATCATCTCCTAGTCACGGTGCAGGCCTGCAGTGCGGCGGATGATTTTGACGGCTAGCCGAATGCGCGCACCCCCATCCCCAGTCAGCAGCTGAAGGAAAAAAAGTTTAAGTGGCCTACTCATGGATGAGGTGGCTGCAGCATGGACTAGACACAAATACTATTAGTGCTGATGGTGTATAGTACCGCTGCCGCTTTAAAGTAGTGTACAGTGCAGTGCAGCTCTGATGGCGCTGTCCCTCGGCACATGGGAGGAGATGTGCCCATGCCATGCCATCTGATCTGTGCTTGCGGATCAATCAAATACTACGTACGTGTCC

SEQ ID NO: 727 - DNA, 1940 bp, Zea mays
  misc_feature (1)..(1940): Ceres cDNA ID no. 12362442
  misc_feature (1)..(1940): Ceres CLONE  ID no. 395495
  misc_feature (1)..(1940): Also known as  Ceres CDNA ID no. 23850113
agactctagtgtaccccagtcccggggtctagtctgagggccgttcccatggccaaccgggcgaggccactccacgccatctacatgaccagcagctcccatgaccctgacaagtgggcgcacctcgtcaaggagtacgcctcgcaatccttgctccgggaagccgccctcgtctacgccaggaacctgccccgccggacgcaccaccagcccctcctccccgtcctcctcaaggccgccgctgcctcctccccgaccgagctaggtctcggcaagtccctccatgcggaggccctcaagtccgcctttgcccgcgatctgctcgtcggcaccacgatcgtgtcgatgtactgcaagtgtggcgcactcgccgacgcgcgcagggcgttcgacgaaatgccggaccggaacgtcatcagttacaacgcgcttctcgccgggtacgccgtggcgggggacatggacggtgccctggcctctgttcggtggcatgcgctcctggacgcacgtcacgtgggcgacgctgatccgcgggttcgcggagaagggcgacatggcggaggctcggaggtggttcgaggccacgccgccggggatgcgaaccgttgtcacgtggaccgtgctggtgcagggctacgtgtgcgcgggtgacatggagacagcgagggaggtgttcgacaggatgcccgcgaggaacgcctttgtgtggtcgtcgatggtcacgggatacttcaaggccggcgacgccgaggaggcgcgggcggtgttcgataggatcccgacgcggaacctggtgaactggaacgcgctgatcgccgggtacgcgcaaatcgggtgcagtgagcaggcgcttgaggcttttcatttgatgctgcaggagagggtaaaaccggacgagttcaccatggcgagcttgctttcagcgtgcgcgcagctcgggtcgctagagcaggggaagaaagttcatgacttcattaaccaggagcatatccggaagaaccactttgtgatgaacggtttgatagacatgtatgccaagtgtggtgacctcgcgcacgcccgatacatctttgatagcatgagatggaagaacaacgaatgctggaacaccatgatctccgcacttgcaagccatggtcagagcgatgaagcactccacctgttcttccagatggagcgctctgggcggaagcccaacacaatcactgttcttgccgtgcttggagcttgcacgcacggaggcttcgttgatgaaggattacaaatcttcaacaagctcgatgcatatggagttggagcgggagtggaacattacggttgcctggtcgatctattaggcagggctggaaaactgaaggaagcctacgagattgtcaataacatgtctgaggaacccaacgaggtgatctgggggtcattgcttggagcttgcagagtgcatcgtgatgcggaaatgtcaagattggtaacggaggagatccttcgattgcattcttttcacgcgtcgtctaacgatgcagagtacatcatgctcgcaaatatcatggctgcatcagagaggtgggagcaggcagaacaaatgaggaggaaaatggcgcgacgtggggttgagaagactcccggctgcagttcgcttgagcttggcattccaggatgccaagtgtatgcaggcagtgggcagtagtgctttgtttcgagtaggttactctaaatctgtttaataattttgtttcatatttttcagcggtccgatttcagtacataaccctgagaagaaatgatcttgatgtgatgcattcgatagggaacaaaaatatcagacatcgatcattgcagtcatgttctataactttgagagctgcagacgccgaacttccaggttttgaagtttgatttcagaaaatgtatccatggaagtaaaatgcagaagaaattattgt

SEQ ID NO: 728 - protein, 1940 aa, Zea mays
  misc_feature: PFam Name: PPR; PFam Description: PPR repeat
  misc_feature: PFam Name: FH2; PFam Description: Formin Homology 2 Domain
  misc_feature: GI Number: 34907412; NR Description: P0018C10.32 [Oryza sativa (japonica cultivar-group)] >gi|21952815|dbj|BAC06231.1|
  misc_feature: GI Number: 34900958; NR Description: selenium-binding protein-like protein [Oryza sativa (japonica cultivar-group)] >gi|22293716|dbj|BAC10060.1| selenium-binding protein-like protein
  misc_feature: GI Number: 50899520; NR Description: putative pentatricopeptide (PPR) repeat-containing protein [Oryza sativa (japonica cultivar-group)] >gi|48716903|dbj|BAD23598.1| putative pentatricopeptide (PPR) repeat-containing protein [Oryza sativa
  misc_feature: GI Number: 51091564; NR Description: pentatricopeptide (PPR) repeat-containing protein-like [Oryza sativa (japonica cultivar-group)] gi|51091508|dbj|BAD36246.1| pentatricopeptide (PPR) repeat-containing protein-like [Oryza sativa (japonica
  misc_feature: GI Number: 15233234; NR Description: pentatricopeptide (PPR)
AGACTCTAGTGTACCCCAGTCCCGGGGTCTAGTCTGAGGGCCGTTCCCATGGCCAACCGGGCGAGGCCACTCCACGCCATCTACATGACCAGCAGCTCCCATGACCCTGACAAGTGGGCGCACCTCGTCAAGGAGTACGCCTCGCAATCCTTGCTCCGGGAAGCCGCCCTCGTCTACGCCAGGAACCTGCCCCGCCGGACGCACCACCAGCCCCTCCTCCCCGTCCTCCTCAAGGCCGCCGCTGCCTCCTCCCCGACCGAGCTAGGTCTCGGCAAGTCCCTCCATGCGGAGGCCCTCAAGTCCGCCTTTGCCCGCGATCTGCTCGTCGGCACCACGATCGTGTCGATGTACTGCAAGTGTGGCGCACTCGCCGACGCGCGCAGGGCGTTCGACGAAATGCCGGACCGGAACGTCATCAGTTACAACGCGCTTCTCGCCGGGTACGCCGTGGCGGGGGACATGGACGGTGCCCTGGCCTCTGTTCGGTGGCATGCGCTCCTGGACGCACGTCACGTGGGCGACGCTGATCCGCGGGTTCGCGGAGAAGGGCGACATGGCGGAGGCTCGGAGGTGGTTCGAGGCCACGCCGCCGGGGATGCGAACCGTTGTCACGTGGACCGTGCTGGTGCAGGGCTACGTGTGCGCGGGTGACATGGAGACAGCGAGGGAGGTGTTCGACAGGATGCCCGCGAGGAACGCCTTTGTGTGGTCGTCGATGGTCACGGGATACTTCAAGGCCGGCGACGCCGAGGAGGCGCGGGCGGTGTTCGATAGGATCCCGACGCGGAACCTGGTGAACTGGAACGCGCTGATCGCCGGGTACGCGCAAATCGGGTGCAGTGAGCAGGCGCTTGAGGCTTTTCATTTGATGCTGCAGGAGAGGGTAAAACCGGACGAGTTCACCATGGCGAGCTTGCTTTCAGCGTGCGCGCAGCTCGGGTCGCTAGAGCAGGGGAAGAAAGTTCATGACTTCATTAACCAGGAGCATATCCGGAAGAACCACTTTGTGATGAACGGTTTGATAGACATGTATGCCAAGTGTGGTGACCTCGCGCACGCCCGATACATCTTTGATAGCATGAGATGGAAGAACAACGAATGCTGGAACACCATGATCTCCGCACTTGCAAGCCATGGTCAGAGCGATGAAGCACTCCACCTGTTCTTCCAGATGGAGCGCTCTGGGCGGAAGCCCAACACAATCACTGTTCTTGCCGTGCTTGGAGCTTGCACGCACGGAGGCTTCGTTGATGAAGGATTACAAATCTTCAACAAGCTCGATGCATATGGAGTTGGAGCGGGAGTGGAACATTACGGTTGCCTGGTCGATCTATTAGGCAGGGCTGGAAAACTGAAGGAAGCCTACGAGATTGTCAATAACATGTCTGAGGAACCCAACGAGGTGATCTGGGGGTCATTGCTTGGAGCTTGCAGAGTGCATCGTGATGCGGAAATGTCAAGATTGGTAACGGAGGAGATCCTTCGATTGCATTCTTTTCACGCGTCGTCTAACGATGCAGAGTACATCATGCTCGCAAATATCATGGCTGCATCAGAGAGGTGGGAGCAGGCAGAACAAATGAGGAGGAAAATGGCGCGACGTGGGGTTGAGAAGACTCCCGGCTGCAGTTCGCTTGAGCTTGGCATTCCAGGATGCCAAGTGTATGCAGGCAGTGGGCAGTAGTGCTTTGTTTCGAGTAGGTTACTCTAAATCTGTTTAATAATTTTGTTTCATATTTTTCAGCGGTCCGATTTCAGTACATAACCCTGAGAAGAAATGATCTTGATGTGATGCATTCGATAGGGAACAAAAATATCAGACATCGATCATTGCAGTCATGTTCTATAACTTTGAGAGCTGCAGACGCCGAACTTCCAGGTTTTGAAGTTTGATTTCAGAAAATGTATCCATGGAAGTAAAATGCAGAAGAAATTATTGT

SEQ ID NO: 729 - DNA, 1968 bp, Zea mays
  misc_feature (1)..(1968): Ceres cDNA ID no. 12362596
  misc_feature (1)..(1968): Ceres CLONE  ID no. 421956
  misc_feature (1)..(1968): Also known as  Ceres CDNA ID no. 23776004
gcacgagaccattacctagaacatcctaatcaaaacccgactccctcggctgcctcccgcagccgcccgctgctccggtccttccgaacgctggcctgttcttccctgcctttggcccattcgtcaggcggcccctccgcaggcgacgcaggcgcggtcacgacggcgcgtggccccgactacgtagacagctaaccggtctccgcctccggcccttctcctgtcgcccgattgagtcgctgctgcaactgccaacttcacccccggcgagctcaccacagtcttccggaaaggtgctatcaatttggaagatggcagatgaggagcaggccccaagctctaggaaaagggttgcaggtactcaaatcaacaaggataatccggaacctgatgatgaaggaacagaacaagagatgggtacatttaagaaagctactgaagaagttatggcaacacggaggattgtaaaggttcggcgccagcagacgtcatcagcttcttctaaccctttctctgcaatcagatttgcccccactgattctagtgctcaaacaagtgctcctgtcccagaggtccaaccttcagatgtcaaagttgacgagggaagcaatggtagcgggaaagatactttgtctctgcccgacaagactgctggctctggggtaaatacggactctagtgcctcaactgaagcaccacctcagcctgttgaaaccagtgacaaggcagaagacacaaaggacgaatctagtggagacaaagtggtagttggagaacccaatgaaggcagttgcatgccatctgaagttgagggcaaaacaaaagagggagatgctgaagaaaaggaaaggacagatgaagctggaaatatcgataaaattagcaaggatgacactgggaagaaagatggagatgacactgagaagaaagatggaggtgatgatactggaggtgaatcagagcagaaagggcaaacaccatcagcaacaccccttttctcgtttaagaatctgtcaagtggtcaaaatgctttcacaggtctgaccggaactggattttcaagcacatcattctcgtttggctcagcctctaaagatggctcaagtgctggtcccctatttgggctgaaagctgatggttcttcgttcccttcttttaatcttggtgctgccaccaatgggggttctgccacagctcttgctacttcagcagaggcacccaagatgtttgctatgacagagggccctgtcgaaaccggtgaagaaaatgagaaggctgtattcagcgctgattctgctttgtacgagtacttagatgggggctggaaagaaagaggaaaaggtgaactgaagctgaacgtccccgtatctgggggcgagcgagcccggcctcgtcatgaggacaaaaggcaactaccggctggtcctgaatgcaagcctctacaacgacatgtcgctcaaggacatggacaagaagggcgtgacatttgcctgtatgaacagcattggggagtcgccgagcagcctcgctacatttgctctgaagttcaaggacacggccaccagggaggaattcaaggatgcggtggagtctcacaagacaagcaaggcacaggaactgccgctgaagacgcccgagaactctccgaaggcagcagaagtctgaagccgcacccgagtcacgcttgctcgtgtcttttgtacgtgtccaggaaggaaggaactgagagagtttctgttgttgcggagtttttaagaatgtcgcgtcatgacatatgatgtcctgagttgtattttgcgtacgggttccctggtgctgtttttgggaacttaccattactacaggcgcataatcttgggatcctggacaagggactcgttttatctatttgctcgtcttgtgctccgttatgttctatcggttaagttgcgcgtgacgctattatgtcatgaataaatgtatgcaatt

SEQ ID NO: 730 - protein, 1968 aa, Zea mays
  misc_feature: PFam Name: Ran_BP1; PFam Description: RanBP1 domain
  misc_feature: PFam Name: S-antigen; PFam Description: S-antigen protein
  misc_feature: GI Number: 21536684; NR Description: unknown [Arabidopsis thaliana]
  misc_feature: GI Number: 66853052; NR Description: brefeldin A resistance
  misc_feature: GI Number: 49671149; NR Description: MGC79798 protein [Xenopus tropicalis] >gi|52345654|ref|NP_001004874.1| MGC79798
  misc_feature: GI Number: 4506409; NR Description: RAN binding protein 3 isoform RANBP3-a; RAN-binding protein-3 [Homo sapiens]
  misc_feature: GI Number: 51770322; NR Description: RIKEN cDNA 2610024N24
GCACGAGACCATTACCTAGAACATCCTAATCAAAACCCGACTCCCTCGGCTGCCTCCCGCAGCCGCCCGCTGCTCCGGTCCTTCCGAACGCTGGCCTGTTCTTCCCTGCCTTTGGCCCATTCGTCAGGCGGCCCCTCCGCAGGCGACGCAGGCGCGGTCACGACGGCGCGTGGCCCCGACTACGTAGACAGCTAACCGGTCTCCGCCTCCGGCCCTTCTCCTGTCGCCCGATTGAGTCGCTGCTGCAACTGCCAACTTCACCCCCGGCGAGCTCACCACAGTCTTCCGGAAAGGTGCTATCAATTTGGAAGATGGCAGATGAGGAGCAGGCCCCAAGCTCTAGGAAAAGGGTTGCAGGTACTCAAATCAACAAGGATAATCCGGAACCTGATGATGAAGGAACAGAACAAGAGATGGGTACATTTAAGAAAGCTACTGAAGAAGTTATGGCAACACGGAGGATTGTAAAGGTTCGGCGCCAGCAGACGTCATCAGCTTCTTCTAACCCTTTCTCTGCAATCAGATTTGCCCCCACTGATTCTAGTGCTCAAACAAGTGCTCCTGTCCCAGAGGTCCAACCTTCAGATGTCAAAGTTGACGAGGGAAGCAATGGTAGCGGGAAAGATACTTTGTCTCTGCCCGACAAGACTGCTGGCTCTGGGGTAAATACGGACTCTAGTGCCTCAACTGAAGCACCACCTCAGCCTGTTGAAACCAGTGACAAGGCAGAAGACACAAAGGACGAATCTAGTGGAGACAAAGTGGTAGTTGGAGAACCCAATGAAGGCAGTTGCATGCCATCTGAAGTTGAGGGCAAAACAAAAGAGGGAGATGCTGAAGAAAAGGAAAGGACAGATGAAGCTGGAAATATCGATAAAATTAGCAAGGATGACACTGGGAAGAAAGATGGAGATGACACTGAGAAGAAAGATGGAGGTGATGATACTGGAGGTGAATCAGAGCAGAAAGGGCAAACACCATCAGCAACACCCCTTTTCTCGTTTAAGAATCTGTCAAGTGGTCAAAATGCTTTCACAGGTCTGACCGGAACTGGATTTTCAAGCACATCATTCTCGTTTGGCTCAGCCTCTAAAGATGGCTCAAGTGCTGGTCCCCTATTTGGGCTGAAAGCTGATGGTTCTTCGTTCCCTTCTTTTAATCTTGGTGCTGCCACCAATGGGGGTTCTGCCACAGCTCTTGCTACTTCAGCAGAGGCACCCAAGATGTTTGCTATGACAGAGGGCCCTGTCGAAACCGGTGAAGAAAATGAGAAGGCTGTATTCAGCGCTGATTCTGCTTTGTACGAGTACTTAGATGGGGGCTGGAAAGAAAGAGGAAAAGGTGAACTGAAGCTGAACGTCCCCGTATCTGGGGGCGAGCGAGCCCGGCCTCGTCATGAGGACAAAAGGCAACTACCGGCTGGTCCTGAATGCAAGCCTCTACAACGACATGTCGCTCAAGGACATGGACAAGAAGGGCGTGACATTTGCCTGTATGAACAGCATTGGGGAGTCGCCGAGCAGCCTCGCTACATTTGCTCTGAAGTTCAAGGACACGGCCACCAGGGAGGAATTCAAGGATGCGGTGGAGTCTCACAAGACAAGCAAGGCACAGGAACTGCCGCTGAAGACGCCCGAGAACTCTCCGAAGGCAGCAGAAGTCTGAAGCCGCACCCGAGTCACGCTTGCTCGTGTCTTTTGTACGTGTCCAGGAAGGAAGGAACTGAGAGAGTTTCTGTTGTTGCGGAGTTTTTAAGAATGTCGCGTCATGACATATGATGTCCTGAGTTGTATTTTGCGTACGGGTTCCCTGGTGCTGTTTTTGGGAACTTACCATTACTACAGGCGCATAATCTTGGGATCCTGGACAAGGGACTCGTTTTATCTATTTGCTCGTCTTGTGCTCCGTTATGTTCTATCGGTTAAGTTGCGCGTGACGCTATTATGTCATGAATAAATGTATGCAATT

SEQ ID NO: 731 - DNA, 1818 bp, Zea mays
  misc_feature (1)..(1818): Ceres cDNA ID no. 12362619
  misc_feature (1)..(1818): Ceres CLONE  ID no. 366281
  misc_feature (1)..(1818): Also known as  Ceres CDNA ID no. 23789385
gcacgagaccattacctagaacatcctaatcaaaaaaaccacgggaagaaagagggccgagacaacagacagccgcagagcatagcagcactagtgcctgtactgacaagacccggtggcctccagcgcgcacggaacacgaggcaatgctgtcccgtcgccgcagctcgccgcgcccgctcgtacctggcctcctcctgttactcctcgccatggcgccgccaccgccggcttccgcggtgggtgtgaactggggcttcgcgtcctcccactcgcttccggcggcgcaggtcgtacggggcctcctcctccccaactctgttccccgcgtccgcctcgccgccgcctcctccgacgcgctcacggcgctcgaaggcaccggcatcgccgtcagcgtcgggatccccgacgcgctgctccggcccctcgcctcctccaccaaggcagccgccgcgtgggtccacgacaacatcacccgttactcctccagcgtgcggttcgagtatattgttgttggggatgagccctttcttctacgtcatggacaaaattttcatccttttgtagttcgagcagcagaaaatgttcaacaagcattagtccatgcaaaattgtctggcaagatgaaggtggtagtaccttgcagtgctgacacattccagaatgcatctactctgcccacgaaagctagcttcagacctgatgttaacaagaccatggcagatctcctctcatttcttgctaacagcagttctccatttatggtcgagctggatccattcttgagctttcaacacaacagaaatttgtcattggactattttcttttccaactaatgtctcatcctgtaaaagatggcgaaaacaagtatgacaactacgttgatgcaagcatagatgctctggttacttctctaaccaaagctggcttcagtgacatggacatcattgttgggagagcaggatggccaacagatggagccatgaacgcaactcctgctattgctcaatcattcatgactggcctagtcaaccacctggccaaaaagtctgggactccacttcgcccaaaagtccctccagttgagatgtatctcttcagccttttagatgaagatcaacggagtatagctagtggaggctatgaaaggcaccatggcatttttacctttgatggccaggcaaagtactatgccaacataggtcaaggtcctaaatcgctcaagaatgcccctgatgtcaattaccttccatcaaaatggtgtgtggtagacaacaacaaggatttgtccaatgtttcttctagtttctcgtcagcttgcgccaatggcgactgcacttctctgttacctggtggctcctgctcaggtcttgcctggcctggcaatgtgtcatacgcgttcaacaactactaccagcagcatgatcagagtgaggatagttgctacttcaatggcctaggtttgataactactgtcgatccatctgtcgacaattgtttgtttcctctcacaattcacgtttcttccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtg

SEQ ID NO: 732 - protein, 1818 aa, Zea mays
  misc_feature: PFam Name: Glyco_hydro_17; PFam Description: Glycosyl
  misc_feature: PFam Name: X8; PFam Description: X8 domain
  misc_feature: GI Number: 50944207; NR Description: putative glycosyl hydrolase [Oryza sativa (japonica cultivar-group)] >gi|38423964|dbj|BAD01673.1| putative glycosyl hydrolase [Oryza sativa (japonica cultivar-group)] >gi|38637006|dbj|BAD03265.1|
  misc_feature: GI Number: 50899254; NR Description: putative elicitor inducible beta-1,3-glucanase [Oryza sativa (japonica cultivar-group)] >gi|49388994|dbj|BAD26208.1| putative elicitor inducible beta-1,3-glucanase [Oryza sativa (japonica
  misc_feature: GI Number: 7268469; NR Description: glucanase like protein [Arabidopsis thaliana] >gi|2245077|emb|CAB10499.1| glucanase like protein [Arabidopsis thaliana] >gi|7488109|pir||F71440 probable
  misc_feature: GI Number: 7270016; NR Description: 1, 3-beta-glucanase-like protein [Arabidopsis thaliana] >gi|38257777|sp|Q9M088|E135_ARATH Putative glucan endo-1,3-beta-glucosidase 5 precursor ((1->3)-beta-glucan endohydrolase) ((1->3)-beta-glucanase)
  misc_feature: GI Number: 48374979; NR Description: putative 3-glucanase
GCACGAGACCATTACCTAGAACATCCTAATCAAAAAAACCACGGGAAGAAAGAGGGCCGAGACAACAGACAGCCGCAGAGCATAGCAGCACTAGTGCCTGTACTGACAAGACCCGGTGGCCTCCAGCGCGCACGGAACACGAGGCAATGCTGTCCCGTCGCCGCAGCTCGCCGCGCCCGCTCGTACCTGGCCTCCTCCTGTTACTCCTCGCCATGGCGCCGCCACCGCCGGCTTCCGCGGTGGGTGTGAACTGGGGCTTCGCGTCCTCCCACTCGCTTCCGGCGGCGCAGGTCGTACGGGGCCTCCTCCTCCCCAACTCTGTTCCCCGCGTCCGCCTCGCCGCCGCCTCCTCCGACGCGCTCACGGCGCTCGAAGGCACCGGCATCGCCGTCAGCGTCGGGATCCCCGACGCGCTGCTCCGGCCCCTCGCCTCCTCCACCAAGGCAGCCGCCGCGTGGGTCCACGACAACATCACCCGTTACTCCTCCAGCGTGCGGTTCGAGTATATTGTTGTTGGGGATGAGCCCTTTCTTCTACGTCATGGACAAAATTTTCATCCTTTTGTAGTTCGAGCAGCAGAAAATGTTCAACAAGCATTAGTCCATGCAAAATTGTCTGGCAAGATGAAGGTGGTAGTACCTTGCAGTGCTGACACATTCCAGAATGCATCTACTCTGCCCACGAAAGCTAGCTTCAGACCTGATGTTAACAAGACCATGGCAGATCTCCTCTCATTTCTTGCTAACAGCAGTTCTCCATTTATGGTCGAGCTGGATCCATTCTTGAGCTTTCAACACAACAGAAATTTGTCATTGGACTATTTTCTTTTCCAACTAATGTCTCATCCTGTAAAAGATGGCGAAAACAAGTATGACAACTACGTTGATGCAAGCATAGATGCTCTGGTTACTTCTCTAACCAAAGCTGGCTTCAGTGACATGGACATCATTGTTGGGAGAGCAGGATGGCCAACAGATGGAGCCATGAACGCAACTCCTGCTATTGCTCAATCATTCATGACTGGCCTAGTCAACCACCTGGCCAAAAAGTCTGGGACTCCACTTCGCCCAAAAGTCCCTCCAGTTGAGATGTATCTCTTCAGCCTTTTAGATGAAGATCAACGGAGTATAGCTAGTGGAGGCTATGAAAGGCACCATGGCATTTTTACCTTTGATGGCCAGGCAAAGTACTATGCCAACATAGGTCAAGGTCCTAAATCGCTCAAGAATGCCCCTGATGTCAATTACCTTCCATCAAAATGGTGTGTGGTAGACAACAACAAGGATTTGTCCAATGTTTCTTCTAGTTTCTCGTCAGCTTGCGCCAATGGCGACTGCACTTCTCTGTTACCTGGTGGCTCCTGCTCAGGTCTTGCCTGGCCTGGCAATGTGTCATACGCGTTCAACAACTACTACCAGCAGCATGATCAGAGTGAGGATAGTTGCTACTTCAATGGCCTAGGTTTGATAACTACTGTCGATCCATCTGTCGACAATTGTTTGTTTCCTCTCACAATTCACGTTTCTTCCGCCACTTCTTTGCACCTAACATTGCCCGTGTCGCTGTTATTAGTTTTGTGGTTTTGCATTGTCTGTATATAGTCTGATGAGGCTATAGATTGAGCCTTCAAAAGTGTTTCGTTGGGCCTCTTGTTGAATGTACTCCAAAGTCTCGGTGCACCATCAGACGTATTCCTAGAATGGCACAATCTGGCTATCAGAACTGGTAGGTTTAGTCCAAATGTAATGATGTGTTCTAAAGTAGTCGGGCTGAGTCAAACAGCAGCTTCTTCTCTTGTTCAAAATTTTGAACCTGGTG

SEQ ID NO: 733 - DNA, 1233 bp, Zea mays
  misc_feature (1)..(1233): Ceres cDNA ID no. 12363228
  misc_feature (1)..(1233): Ceres CLONE  ID no. 285080
  misc_feature (1)..(1233): Also known as  Ceres CDNA ID no. 23846180
gacacccttcctctcgtcgcccacggcccacctcacagtcacggacgccttcgcggtgagccgcgacggctccctaacgtaaacgccggcggcgcgcgcggaaagctgcacggcagcacgggcgcggcctcgtctccgcgcctgggctgcaagggcggcggctcggcgcggtgggaggcggggggcggccatccggtcaggtccagcccaggactccaggtgaccaggtcggcaggtccgcgctccgcaacggttctggcgttctgcggctgagtacagacgacagaggaattggggatttacattagcgatttacaaggcaacttggaagacaagcagggtttcatcccgcaatgtcagctcccaacagcgatagcaacatgcagcagctagtccctatagcaccaccaggaaaggcttctggtggtgacagtgagaaggggctggttgtggtggatcttgcaggtaagagatcaggaggtgtaaaactacgagaggatgaggaagacctggaggtgaagctcaggcgcatcatggagaatgtccctgtgcgtgtcagtaacacatcagggtcctctgctggctctggctctggtgatttccaccagtatcggcaaatgaggaggagagagcaggaccggctagctcgaatggatgctgactaccagaagagaaagaagatggctgagttcgaactgcggagggaggagaggatgaaagcagctgaggagcggacagccaagaagcgcctgaaacggcaaaagaagaagcagcgtaagaaagagaagagagctaaaacgggtaataacggtggtgatgaacctaacagagtggagtcttctgatgacgatcacggttcggatgacgatgatgagtccaagcaatgacacgtcagttgcatctgaagatgatttcggacactggttgtctgggcattgaactaacgtctgtatggccgttgtaacaggttacaggccgaatctggtgctctatctgtaagaggacgtgatattttgagcagagaatgatagcactagataatttcatgttagtgttcatcattaaggtcttattcgtttacacaaattcagctctacattagcatggattgatgtgaggtatggatttatctaatctaaacctagattaaatctatgatgtgattccataccttgtaaccgaacaagtcctaagagagctagaatcatatcgtgtgcctgcgcgcttagtgtg

SEQ ID NO: 734 - protein, 1233 aa, Zea mays
  misc_feature: GI Number: 31240511; NR Description: ENSANGP00000021234 [Anopheles gambiae] >gi|21287802|gb|EAA00123.1| ENSANGP00000021234
  misc_feature: GI Number: 50758092; NR Description: PREDICTED: similar to adaptor protein with pleckstrin homology and src homology 2 domains
GACACCCTTCCTCTCGTCGCCCACGGCCCACCTCACAGTCACGGACGCCTTCGCGGTGAGCCGCGACGGCTCCCTAACGTAAACGCCGGCGGCGCGCGCGGAAAGCTGCACGGCAGCACGGGCGCGGCCTCGTCTCCGCGCCTGGGCTGCAAGGGCGGCGGCTCGGCGCGGTGGGAGGCGGGGGGCGGCCATCCGGTCAGGTCCAGCCCAGGACTCCAGGTGACCAGGTCGGCAGGTCCGCGCTCCGCAACGGTTCTGGCGTTCTGCGGCTGAGTACAGACGACAGAGGAATTGGGGATTTACATTAGCGATTTACAAGGCAACTTGGAAGACAAGCAGGGTTTCATCCCGCAATGTCAGCTCCCAACAGCGATAGCAACATGCAGCAGCTAGTCCCTATAGCACCACCAGGAAAGGCTTCTGGTGGTGACAGTGAGAAGGGGCTGGTTGTGGTGGATCTTGCAGGTAAGAGATCAGGAGGTGTAAAACTACGAGAGGATGAGGAAGACCTGGAGGTGAAGCTCAGGCGCATCATGGAGAATGTCCCTGTGCGTGTCAGTAACACATCAGGGTCCTCTGCTGGCTCTGGCTCTGGTGATTTCCACCAGTATCGGCAAATGAGGAGGAGAGAGCAGGACCGGCTAGCTCGAATGGATGCTGACTACCAGAAGAGAAAGAAGATGGCTGAGTTCGAACTGCGGAGGGAGGAGAGGATGAAAGCAGCTGAGGAGCGGACAGCCAAGAAGCGCCTGAAACGGCAAAAGAAGAAGCAGCGTAAGAAAGAGAAGAGAGCTAAAACGGGTAATAACGGTGGTGATGAACCTAACAGAGTGGAGTCTTCTGATGACGATCACGGTTCGGATGACGATGATGAGTCCAAGCAATGACACGTCAGTTGCATCTGAAGATGATTTCGGACACTGGTTGTCTGGGCATTGAACTAACGTCTGTATGGCCGTTGTAACAGGTTACAGGCCGAATCTGGTGCTCTATCTGTAAGAGGACGTGATATTTTGAGCAGAGAATGATAGCACTAGATAATTTCATGTTAGTGTTCATCATTAAGGTCTTATTCGTTTACACAAATTCAGCTCTACATTAGCATGGATTGATGTGAGGTATGGATTTATCTAATCTAAACCTAGATTAAATCTATGATGTGATTCCATACCTTGTAACCGAACAAGTCCTAAGAGAGCTAGAATCATATCGTGTGCCTGCGCGCTTAGTGTG

SEQ ID NO: 735 - DNA, 1314 bp, Zea mays
  misc_feature (1)..(1314): Ceres cDNA ID no. 12363419
  misc_feature (1)..(1314): Ceres CLONE  ID no. 330738
  misc_feature (1)..(1314): Also known as  Ceres CDNA ID no. 23763384
gcacgagaccattacctagaacatcctaatcgaaaaatttttcgacatgccgcgcgagctggaggtccggtacggtggctggctggacgctgggatccgggaggagtacgagcactacgcggacgtctgcttcggggcgttcggcgaccgggtgcggctctggacgaccttcaacgagcccaacctgctggtcaagttccagtacatgctgggcgcgtacccgcccagccgctgctccccgccgttcggcagctgcgggagcggcgactcgcgccgggagccgtacgccgcggcgcacaacatcatcatgtcccccgccgccgtccgcgcctacagggacaagtaccaggcgacgcagggcggctccgtcgggatcgtggccgccatgaaatggtacgagccgctgacgaactccacggacgacatcctggccgcgcggcgcgcgcaggctttcgagacggactggtttctggagccgatattcttgggcgattaccccggagcgatgcgggagatcctgggatcggacctgccgaccttcaccgcggaggagaaggcgctgctgctgcggtacaaggcggacttcatcgggctgaaccactacacggcgatctacgccagggactgcctgcgctccccgtgcaacctcgggtcgtacgaagggaacgccttcgtctcggcgactggggaaagggacgacggggtcaagatcgggggagatactgcgctggcaggtttcttcgacgtcccagaggccatagagctggctatccagtacgtgaacgggaggtacaagggcacgcctgtgtatattactgagaacggttactcgcagtggagtgatgccagcagggaggagctgatcaacgatgtgaggagaaagaactacctgcagggctacatcacgtatctatccaaagcagtcaggaacggagcaaacgtgcggggctacttcgtgtggacgctgctggacaacttcgagtgggcgttcggttacaggttgaagtacgggctgtaccacgtcgacttcgacacacaggagaggacgccccggatgtctgcgaggtggtaccagggcttcctcacggcccgcaccagccagcgcgacgaagcagcgcaggcacggagagcagactcgtgatgaaccattcccacttccaccgatatatatcatcgaacgccttgctagacagccgagggtctcatgactcgtgctcatttccgtcctcgcggtatattggaataactgtggctgtggtgtcctaatgtctgtatatgcatatatcatatattttgacctcaaaagaggtttag

SEQ ID NO: 736 - protein, 1314 aa, Zea mays
  misc_feature: PFam Name: Glyco_hydro_1; PFam Description: Glycosyl
  misc_feature: GI Number: 22328863; NR Description: glycosyl hydrolase
  misc_feature: GI Number: 52421273; NR Description: At1g61820 [Arabidopsis thaliana] >gi|51536432|gb|AAU05454.1| At1g61820 [Arabidopsis
  misc_feature: GI Number: 3367517; NR Description: Similar to F4I1.26 putative beta-glucosidase gi|3128187 from A. thaliana BAC gb|AC004521. ESTs gb|N97083, gb|F19868 and gb|F15482 come from this
  misc_feature: GI Number: 30696622; NR Description: glycosyl hydrolase
  misc_feature: GI Number: 42571953; NR Description: glycosyl hydrolase
GCACGAGACCATTACCTAGAACATCCTAATCGAAAAATTTTTCGACATGCCGCGCGAGCTGGAGGTCCGGTACGGTGGCTGGCTGGACGCTGGGATCCGGGAGGAGTACGAGCACTACGCGGACGTCTGCTTCGGGGCGTTCGGCGACCGGGTGCGGCTCTGGACGACCTTCAACGAGCCCAACCTGCTGGTCAAGTTCCAGTACATGCTGGGCGCGTACCCGCCCAGCCGCTGCTCCCCGCCGTTCGGCAGCTGCGGGAGCGGCGACTCGCGCCGGGAGCCGTACGCCGCGGCGCACAACATCATCATGTCCCCCGCCGCCGTCCGCGCCTACAGGGACAAGTACCAGGCGACGCAGGGCGGCTCCGTCGGGATCGTGGCCGCCATGAAATGGTACGAGCCGCTGACGAACTCCACGGACGACATCCTGGCCGCGCGGCGCGCGCAGGCTTTCGAGACGGACTGGTTTCTGGAGCCGATATTCTTGGGCGATTACCCCGGAGCGATGCGGGAGATCCTGGGATCGGACCTGCCGACCTTCACCGCGGAGGAGAAGGCGCTGCTGCTGCGGTACAAGGCGGACTTCATCGGGCTGAACCACTACACGGCGATCTACGCCAGGGACTGCCTGCGCTCCCCGTGCAACCTCGGGTCGTACGAAGGGAACGCCTTCGTCTCGGCGACTGGGGAAAGGGACGACGGGGTCAAGATCGGGGGAGATACTGCGCTGGCAGGTTTCTTCGACGTCCCAGAGGCCATAGAGCTGGCTATCCAGTACGTGAACGGGAGGTACAAGGGCACGCCTGTGTATATTACTGAGAACGGTTACTCGCAGTGGAGTGATGCCAGCAGGGAGGAGCTGATCAACGATGTGAGGAGAAAGAACTACCTGCAGGGCTACATCACGTATCTATCCAAAGCAGTCAGGAACGGAGCAAACGTGCGGGGCTACTTCGTGTGGACGCTGCTGGACAACTTCGAGTGGGCGTTCGGTTACAGGTTGAAGTACGGGCTGTACCACGTCGACTTCGACACACAGGAGAGGACGCCCCGGATGTCTGCGAGGTGGTACCAGGGCTTCCTCACGGCCCGCACCAGCCAGCGCGACGAAGCAGCGCAGGCACGGAGAGCAGACTCGTGATGAACCATTCCCACTTCCACCGATATATATCATCGAACGCCTTGCTAGACAGCCGAGGGTCTCATGACTCGTGCTCATTTCCGTCCTCGCGGTATATTGGAATAACTGTGGCTGTGGTGTCCTAATGTCTGTATATGCATATATCATATATTTTGACCTCAAAAGAGGTTTAG

SEQ ID NO: 737 - DNA, 1403 bp, Zea mays
  misc_feature (1)..(1403): Ceres cDNA ID no. 12363423
  misc_feature (1)..(1403): Ceres CLONE  ID no. 374928
  misc_feature (1)..(1403): Also known as  Ceres CDNA ID no. 23800138
  misc_feature (1037)..(1037): n is a, c, t, g, unknown, or other
  misc_feature (1117)..(1117): n is a, c, t, g, unknown, or other
  misc_feature (1118)..(1118): n is a, c, t, g, unknown, or other
  misc_feature (1121)..(1121): n is a, c, t, g, unknown, or other
gcacgagaccattacctagaacatcctaatcgaaaaatacatacccaccggccggcgtcacagacacgcgagcagagcacagacacagagcacacagcacagaggcagccaccaccacaggcactcacccgcaccgctcggtcaccgaggagtggaggagctttgcagtcgcagcagcagcagtacagtgtgtgagtgtgaagggactagagcagggcacacagcgcaggccgcatgggcgaggcggaggtggagaagcccaaggaggcggcagaggaggagaagaagaaggaagacaagcccatggacgccacggcggcggcggaggacaagcccaaggacgccgcggcggcggaggacaagcccaaggacggggaggagaagaaggacgacgcgccccctcccccgccgccgccgccgcctgaggaggtcgagatgcgggtctacatgcactgcgagggatgcgcccgcaaggtcaagaagatcctcaagcgcttcgacggagtggaggacgtggtcgccgactccaagtcgcacaaggtggtggtgaaggggaagaaggcggccgccgaccccatgagggtggtggagcgcgtgcagaagaagaccggccgcaaggtggagttgctgtcgccgatcccgccgccaacgccgccggaggagaagaaggcagaggaggagcccgagccgccaaagccggaggagaagaaggagccgccggtgatcgccgtggtgctgaaggtgcacatgcactgcgaggcctgcgcccaggggatcaggaagaggatcctcaagatgaaaggcgtgcaatctgcagagccagacctcaaggcgtcggaggtggcagtgaagggcgtgttcgaggagtccaagctggcggagtacgtgtacaagcgcaccggcaagcacgcggccgtcgtcaagtccgagccggtcccggcgccaccgccggagagcggcgccggcgacaacacgggggccaaggaggaggagaaggggcaggaggaggagaaggagaaggaaggaggaggcgatgncggtggcgaggagaagaagaaggaagggggcaaggaggaagagaagaaggacggcgagaagcaggaggaggagaaggagnncgncggtggcggcgagaaggtggaggaaaaggagggagataaagacgctgccgctgccgccgccgccagcatgtacatgcactacccgaggttcccgttcccgggaggctactacgcgccgcctccggggtacgtctaccagccggtgtacccggcgccggcgtacgcggcgtacgcgccgccgcaccaccagcccatggcgccgcagatcttcagcgacgagaaccccaacgcatgctccgtcatgtaactaaaaaacagaaggagccttggcgagagaggggg

SEQ ID NO: 738 - protein, 1403 aa, Zea mays
  misc_feature: PFam Name: HMA; PFam Description: Heavy-metal-associated domain
  misc_feature: PFam Name: S-antigen; PFam Description: S-antigen protein
  misc_feature: PFam Name: Glutenin_hmw; PFam Description: High molecular
  misc_feature: PFam Name: Chromadorea_ALT; PFam Description: Chromadorea
  misc_feature: PFam Name: TT_ORF1; PFam Description: TT viral orf 1
  misc_feature: GI Number: 50908877; NR Description: putative farnesylated protein [Oryza sativa (japonica cultivar-group)] >gi|48716470|dbj|BAD23076.1| putative farnesylated protein [Oryza
  misc_feature: GI Number: 4097547; NR Description: ATFP3 [Arabidopsis thaliana]
  misc_feature: GI Number: 50908879; NR Description: putative farnesylated protein [Oryza sativa (japonica cultivar-group)] >gi|48716472|dbj|BAD23078.1| putative farnesylated protein [Oryza
  misc_feature: GI Number: 24417342; NR Description: unknown [Arabidopsis thaliana]
  misc_feature: GI Number: 21594005; NR Description: unknown [Arabidopsis thaliana]
GCACGAGACCATTACCTAGAACATCCTAATCGAAAAATACATACCCACCGGCCGGCGTCACAGACACGCGAGCAGAGCACAGACACAGAGCACACAGCACAGAGGCAGCCACCACCACAGGCACTCACCCGCACCGCTCGGTCACCGAGGAGTGGAGGAGCTTTGCAGTCGCAGCAGCAGCAGTACAGTGTGTGAGTGTGAAGGGACTAGAGCAGGGCACACAGCGCAGGCCGCATGGGCGAGGCGGAGGTGGAGAAGCCCAAGGAGGCGGCAGAGGAGGAGAAGAAGAAGGAAGACAAGCCCATGGACGCCACGGCGGCGGCGGAGGACAAGCCCAAGGACGCCGCGGCGGCGGAGGACAAGCCCAAGGACGGGGAGGAGAAGAAGGACGACGCGCCCCCTCCCCCGCCGCCGCCGCCGCCTGAGGAGGTCGAGATGCGGGTCTACATGCACTGCGAGGGATGCGCCCGCAAGGTCAAGAAGATCCTCAAGCGCTTCGACGGAGTGGAGGACGTGGTCGCCGACTCCAAGTCGCACAAGGTGGTGGTGAAGGGGAAGAAGGCGGCCGCCGACCCCATGAGGGTGGTGGAGCGCGTGCAGAAGAAGACCGGCCGCAAGGTGGAGTTGCTGTCGCCGATCCCGCCGCCAACGCCGCCGGAGGAGAAGAAGGCAGAGGAGGAGCCCGAGCCGCCAAAGCCGGAGGAGAAGAAGGAGCCGCCGGTGATCGCCGTGGTGCTGAAGGTGCACATGCACTGCGAGGCCTGCGCCCAGGGGATCAGGAAGAGGATCCTCAAGATGAAAGGCGTGCAATCTGCAGAGCCAGACCTCAAGGCGTCGGAGGTGGCAGTGAAGGGCGTGTTCGAGGAGTCCAAGCTGGCGGAGTACGTGTACAAGCGCACCGGCAAGCACGCGGCCGTCGTCAAGTCCGAGCCGGTCCCGGCGCCACCGCCGGAGAGCGGCGCCGGCGACAACACGGGGGCCAAGGAGGAGGAGAAGGGGCAGGAGGAGGAGAAGGAGAAGGAAGGAGGAGGCGATGNCGGTGGCGAGGAGAAGAAGAAGGAAGGGGGCAAGGAGGAAGAGAAGAAGGACGGCGAGAAGCAGGAGGAGGAGAAGGAGNNCGNCGGTGGCGGCGAGAAGGTGGAGGAAAAGGAGGGAGATAAAGACGCTGCCGCTGCCGCCGCCGCCAGCATGTACATGCACTACCCGAGGTTCCCGTTCCCGGGAGGCTACTACGCGCCGCCTCCGGGGTACGTCTACCAGCCGGTGTACCCGGCGCCGGCGTACGCGGCGTACGCGCCGCCGCACCACCAGCCCATGGCGCCGCAGATCTTCAGCGACGAGAACCCCAACGCATGCTCCGTCATGTAACTAAAAAACAGAAGGAGCCTTGGCGAGAGAGGGGG

SEQ ID NO: 739 - DNA, 1714 bp, Zea mays
  misc_feature (1)..(1714): Ceres cDNA ID no. 12363889
  misc_feature (1)..(1714): Ceres CLONE  ID no. 328412
  misc_feature (1)..(1714): Also known as  Ceres CDNA ID no. 23783776
gcacgagaccattacctagaacatcctaatcgaaaagatttgccggaaggcgcctcggcggaagctgctatctagttgaagccagccatggccgccgagcccccggcgtacttgctgctccttcccctcatcgccataccgctcatcgtcttcctcgtcctgtcccgccgaagggatgaccagcggcgcttcccaccggcgccgtgggcgctgccggtcatcggccacctgcaccacctcgccggcgcgccaccgcaccgtgccctgcgggaccttgcgaggcgccacggcccgctcatgacgctccgcttctggcgagctccgggtcgtggtcgcctcgtcgccggacgccgcgcgggagatcttgaggacccacgacgtggacttcgcgtcgcggcccatcgggccgatgctgcagctcgtgttccggggcgccgagggcctcatcttcgcgccctacggcgacgggtggcggcagctccgcaagatctgcaccctcgaactcctcagcgcccgccgcgtccactccttccggcccgtccgcgaggacgaggtcggccgcctcctcggctcggtcgcgtccgccgcggcggcggggttgcccgtgaacctgagtgagaggatcacggcgttcgtcgcggacgcagcggtgcgcgccatcatcggcagccgggagcgagcaccgcgacgagttcttgcgcctgctgatggacgggctcaagataattccgggattgagcctgccggacctcttcccgtcgtcacgcctcgcgatgctcgtcagcagcgttcccggtaaaatcgagcgccgccggaaaggcctccttgacatcgtcgaccccatcattctggagcatcaggagaagagagcggccggtggcatagacgaagatgaggacttgcttgacgtgctcttgagactccagaaagacatggactcccagtaccctctcaccaccgacaacatcaaatccgtcctcatcgacatgtttggagcaagcagcgagacgtcggcgacgacgctgaagtggacaatggccgagctgatgcggaacccggcggtgatgcggaaggcgcaagatgaggtcaggggagcactcgccggccacgacgaggtggcggaggacagcctggtcaatctgcggtacctgcagctagtcataaaggagacgctgcggctgcacccgccggcgccattgctgctgccgcgggagtgccgcagcccgtgccaggtgctcggctacgacgtgcctcgtggcaccatggtgctggtgaacgcgtgggcaataggcagggacccagcgctgtgggacgcgccggaggatttcgtgccggaaaggttcgaggagagtggacgagacttcaagggcatggattttgagttcatcccgttcggtgcgggaaggaggatgtgccccggcatggcgttcgggctggcgcacattgagctcgctctcgcggcgttgctgtttcacttcgactggaagctaccggaaggggtggtcggctggtcgccgaggagatagacatggccgaggcggtcgcgatcacggcccctccgcgatctgatttagtggtgctccctgttactaggctaccggtgtcaatataatgtgcttcggcccaaaagcttattttctttcagtatgctagaaatagaacaacaacttttctttcgctttcggcggttgtgaaggtcgaaaccttttcctcg

SEQ ID NO: 740 - protein, 1714 aa, Zea mays
  misc_feature: PFam Name: p450; PFam Description: Cytochrome P450
  misc_feature: GI Number: 51535458; NR Description: putative cytochrome P450
  misc_feature: GI Number: 51535459; NR Description: putative cytochrome P450
  misc_feature: GI Number: 51536372; NR Description: putative cytochrome P450
  misc_feature: GI Number: 34914838; NR Description: putative cytochrome P450 [Oryza sativa (japonica cultivar-group)] >gi|13365974|dbj|BAB39252.1| putative cytochrome P450 [Oryza sativa (japonica cultivar-group)] >gi|14587241|dbj|BAB61166.1|
  misc_feature: GI Number: 50905779; NR Description: putative cytochrome P450 [Oryza sativa (japonica cultivar-group)] >gi|46390042|dbj|BAD15418.1| putative cytochrome P450 [Oryza sativa (japonica cultivar-group)] >gi|46390073|dbj|BAD15448.1|
GCACGAGACCATTACCTAGAACATCCTAATCGAAAAGATTTGCCGGAAGGCGCCTCGGCGGAAGCTGCTATCTAGTTGAAGCCAGCCATGGCCGCCGAGCCCCCGGCGTACTTGCTGCTCCTTCCCCTCATCGCCATACCGCTCATCGTCTTCCTCGTCCTGTCCCGCCGAAGGGATGACCAGCGGCGCTTCCCACCGGCGCCGTGGGCGCTGCCGGTCATCGGCCACCTGCACCACCTCGCCGGCGCGCCACCGCACCGTGCCCTGCGGGACCTTGCGAGGCGCCACGGCCCGCTCATGACGCTCCGCTTCTGGCGAGCTCCGGGTCGTGGTCGCCTCGTCGCCGGACGCCGCGCGGGAGATCTTGAGGACCCACGACGTGGACTTCGCGTCGCGGCCCATCGGGCCGATGCTGCAGCTCGTGTTCCGGGGCGCCGAGGGCCTCATCTTCGCGCCCTACGGCGACGGGTGGCGGCAGCTCCGCAAGATCTGCACCCTCGAACTCCTCAGCGCCCGCCGCGTCCACTCCTTCCGGCCCGTCCGCGAGGACGAGGTCGGCCGCCTCCTCGGCTCGGTCGCGTCCGCCGCGGCGGCGGGGTTGCCCGTGAACCTGAGTGAGAGGATCACGGCGTTCGTCGCGGACGCAGCGGTGCGCGCCATCATCGGCAGCCGGGAGCGAGCACCGCGACGAGTTCTTGCGCCTGCTGATGGACGGGCTCAAGATAATTCCGGGATTGAGCCTGCCGGACCTCTTCCCGTCGTCACGCCTCGCGATGCTCGTCAGCAGCGTTCCCGGTAAAATCGAGCGCCGCCGGAAAGGCCTCCTTGACATCGTCGACCCCATCATTCTGGAGCATCAGGAGAAGAGAGCGGCCGGTGGCATAGACGAAGATGAGGACTTGCTTGACGTGCTCTTGAGACTCCAGAAAGACATGGACTCCCAGTACCCTCTCACCACCGACAACATCAAATCCGTCCTCATCGACATGTTTGGAGCAAGCAGCGAGACGTCGGCGACGACGCTGAAGTGGACAATGGCCGAGCTGATGCGGAACCCGGCGGTGATGCGGAAGGCGCAAGATGAGGTCAGGGGAGCACTCGCCGGCCACGACGAGGTGGCGGAGGACAGCCTGGTCAATCTGCGGTACCTGCAGCTAGTCATAAAGGAGACGCTGCGGCTGCACCCGCCGGCGCCATTGCTGCTGCCGCGGGAGTGCCGCAGCCCGTGCCAGGTGCTCGGCTACGACGTGCCTCGTGGCACCATGGTGCTGGTGAACGCGTGGGCAATAGGCAGGGACCCAGCGCTGTGGGACGCGCCGGAGGATTTCGTGCCGGAAAGGTTCGAGGAGAGTGGACGAGACTTCAAGGGCATGGATTTTGAGTTCATCCCGTTCGGTGCGGGAAGGAGGATGTGCCCCGGCATGGCGTTCGGGCTGGCGCACATTGAGCTCGCTCTCGCGGCGTTGCTGTTTCACTTCGACTGGAAGCTACCGGAAGGGGTGGTCGGCTGGTCGCCGAGGAGATAGACATGGCCGAGGCGGTCGCGATCACGGCCCCTCCGCGATCTGATTTAGTGGTGCTCCCTGTTACTAGGCTACCGGTGTCAATATAATGTGCTTCGGCCCAAAAGCTTATTTTCTTTCAGTATGCTAGAAATAGAACAACAACTTTTCTTTCGCTTTCGGCGGTTGTGAAGGTCGAAACCTTTTCCTCG

SEQ ID NO: 741 - DNA, 1518 bp, Zea mays
  misc_feature (1)..(1518): Ceres cDNA ID no. 12364176
  misc_feature (1)..(1518): Ceres CLONE  ID no. 381491
  misc_feature (1)..(1518): Also known as  Ceres CDNA ID no. 23802288
gaaccagcacgccggtcctcctgatggccgccgccggcgagggcgaggctgagcgtgtgtcagcgctgctgcggggaaataacgggggagggcgggttcgctttcgtcgcctcggcggataaggcgggggcgggggacctgcgcgcggcggaggcggcgcgggagatggcgtgggagcagctccactcgggcccctggagcgaggtcggcaccgcctggagggacgcctacgcgctcgcctgcctcaacgtcgcgcggctccgcacccacgcggccagcggcggagatagcgaccgctccgccgcgctccgggcactcgacatggggctcatcatgggaggcaacctactgcgcgccgacctcgaggcggcactggcgcgcatctccgcggaagcgtgtggcggaagcgaaggtggcgagggggtcgtggataaggaggaccagaggtggagggaagcgctcgacaggaaccgagacatcgctgatgcactgaaaattcttccagcgaactctttatcctgtaagaaagttgagaggcgatcatgcatttccttggaggagttcatatgtaattactttttgcgcgacacccccgtcataattagtggcaccatcgaacattggcctgcaaggacaaaatggaaggacattgagtacctcaagaaggttgctggagatcgtactgttcctgttgaagttggaaagaattacgtgtgtagtgagtggaagcaggagcttatcacattttctcagttcctggatagaatgtcgtcaactgtctgtccatcaaacttgacatatctggctcagcatccattgtttgagcagataaaagagctcagtgaagacataattgttcccgaatactgttacgctggtggaggtgaactccaatcacttaatgcttggtttggtccagagggtacagtgacaccattgcaccatgatccgcatcacaacatcttagctcaggtattgggcaggaagtatattagactctatcctgctttcatagctgaggacttgtatccacacacagagactatgttaagcaataccagtcaggtagatgttgacaatattgatttgaaggagtttccaagggttgaaaacctggaattcattgactgtatattggaggagggcgacctgctttacatccccccaaaatggtggcactacgtcagatctctctccaccagtttctcggttagcttttggtggcgtgcagcagttcaaccttcaggaggctcatagcgtcaatttcatgtttcccatattatcaaaaccagattgcagaaaaccaaagtaacctgacaggaccctttgtttcaggtgactccgcttttgaatggatgtacacacgtcatcaccaatgtccattgttagttttacttttaccacagtgattaaaatattgaaattgcttatatgccgaccatcatgctatcatgtgattcttgaaagcagaggttgaaggatgtcttcactgctacaatgtcaaattcttgaaattgt

SEQ ID NO: 742 - protein, 1518 aa, Zea mays
  misc_feature: PFam Name: JmjC; PFam Description: JmjC domain
  misc_feature: PFam Name: Cupin_4; PFam Description: Cupin superfamily protein
  misc_feature: GI Number: 50947487; NR Description: N-acetyltransferase and Transcription factor-like protein [Oryza sativa (japonica cultivar-group)] >gi|42408989|dbj|BAD10244.1| N-acetyltransferase and Transcription factor-like protein [Oryza sativa (japonica
  misc_feature: GI Number: 21928039; NR Description: AT3g20810/MOE17_10 [Arabidopsis thaliana] >gi|20147203|gb|AAM10317.1| AT3g20810/MOE17_10 [Arabidopsis thaliana] >gi|30685945|ref|NP_850617.1| transcription factor jumonji (jmjC)
  misc_feature: GI Number: 62641259; NR Description: PREDICTED: similar to
  misc_feature: GI Number: 28317179; NR Description: GM21055p [Drosophila
  misc_feature: GI Number: 48784171; NR Description: COG2850: Uncharacterized
GAACCAGCACGCCGGTCCTCCTGATGGCCGCCGCCGGCGAGGGCGAGGCTGAGCGTGTGTCAGCGCTGCTGCGGGGAAATAACGGGGGAGGGCGGGTTCGCTTTCGTCGCCTCGGCGGATAAGGCGGGGGCGGGGGACCTGCGCGCGGCGGAGGCGGCGCGGGAGATGGCGTGGGAGCAGCTCCACTCGGGCCCCTGGAGCGAGGTCGGCACCGCCTGGAGGGACGCCTACGCGCTCGCCTGCCTCAACGTCGCGCGGCTCCGCACCCACGCGGCCAGCGGCGGAGATAGCGACCGCTCCGCCGCGCTCCGGGCACTCGACATGGGGCTCATCATGGGAGGCAACCTACTGCGCGCCGACCTCGAGGCGGCACTGGCGCGCATCTCCGCGGAAGCGTGTGGCGGAAGCGAAGGTGGCGAGGGGGTCGTGGATAAGGAGGACCAGAGGTGGAGGGAAGCGCTCGACAGGAACCGAGACATCGCTGATGCACTGAAAATTCTTCCAGCGAACTCTTTATCCTGTAAGAAAGTTGAGAGGCGATCATGCATTTCCTTGGAGGAGTTCATATGTAATTACTTTTTGCGCGACACCCCCGTCATAATTAGTGGCACCATCGAACATTGGCCTGCAAGGACAAAATGGAAGGACATTGAGTACCTCAAGAAGGTTGCTGGAGATCGTACTGTTCCTGTTGAAGTTGGAAAGAATTACGTGTGTAGTGAGTGGAAGCAGGAGCTTATCACATTTTCTCAGTTCCTGGATAGAATGTCGTCAACTGTCTGTCCATCAAACTTGACATATCTGGCTCAGCATCCATTGTTTGAGCAGATAAAAGAGCTCAGTGAAGACATAATTGTTCCCGAATACTGTTACGCTGGTGGAGGTGAACTCCAATCACTTAATGCTTGGTTTGGTCCAGAGGGTACAGTGACACCATTGCACCATGATCCGCATCACAACATCTTAGCTCAGGTATTGGGCAGGAAGTATATTAGACTCTATCCTGCTTTCATAGCTGAGGACTTGTATCCACACACAGAGACTATGTTAAGCAATACCAGTCAGGTAGATGTTGACAATATTGATTTGAAGGAGTTTCCAAGGGTTGAAAACCTGGAATTCATTGACTGTATATTGGAGGAGGGCGACCTGCTTTACATCCCCCCAAAATGGTGGCACTACGTCAGATCTCTCTCCACCAGTTTCTCGGTTAGCTTTTGGTGGCGTGCAGCAGTTCAACCTTCAGGAGGCTCATAGCGTCAATTTCATGTTTCCCATATTATCAAAACCAGATTGCAGAAAACCAAAGTAACCTGACAGGACCCTTTGTTTCAGGTGACTCCGCTTTTGAATGGATGTACACACGTCATCACCAATGTCCATTGTTAGTTTTACTTTTACCACAGTGATTAAAATATTGAAATTGCTTATATGCCGACCATCATGCTATCATGTGATTCTTGAAAGCAGAGGTTGAAGGATGTCTTCACTGCTACAATGTCAAATTCTTGAAATTGT

SEQ ID NO: 743 - DNA, 1268 bp, Zea mays
  misc_feature (1)..(1268): Ceres cDNA ID no. 12364236
  misc_feature (1)..(1268): Ceres CLONE  ID no. 329776
  misc_feature (1)..(1268): Also known as  Ceres CDNA ID no. 23771495
gcacgagaccattacctagaacatcctaatcgaaaaatcagagataggagagacgaacaagaaaagacgagatcatatataccgtacgttatagagtaggaaaatagaaatacgaatgatgatcacgggacggcagcgaaaccctgcaaggctgcaggtgtcgtcgtccttcctgcttgcccttgttttcgcatcatcggtgctcgtcggcatcgtggccggcggcagcttctacgaggagtgcgacgcgacttgggagccccagaactgctgggcctacgacgatggcaacaggctctccctcgcgctcgtcagcagttcctcaggttccatgatccggtcgaagcggcagttcgtgtacgggaccgtgtccaccatgatccagcttgtccccggcgactccgccggcaccgtcaccacctactatacgtcgtcgctgggcgacaaccacgacgagatcgacttcgagttcttgggcaacgtgagcgggcagccctacaccatccacaccaacgtgtacgctgccggcgtgggcaacaaggagatgcagttcaagccatggttcgaccccaccgccgactaccacaactacaccatctcctggactccctgcatgatcgcgtggtacgtcgacggcgtccccatccgcgtgttccgcaactacgcggcgagccacggcgtggcgttcccgacgagccagcccatgtacgcctactctagcatctgggcggcggaggactgggccacgcagggcggccgcgtcaaggccgactggtccaaggcgcccttcgtcgccagctaccacggcatcgacctcggcgtctgcgagtgctacggcgggggcgcctgcgtctccagctgcgccgcggcgttcgccgccagccactgcagcctgagcgacgcgcaggtgggggagatgcgctgggtgcagggcagctacaggatctacgactactgcgtcgaccccaagcgcttggtcaacggccagaggccggtcgagtgcgacctgccgcagtactgaacggatcggagctccgatcaggtccttgttgcgtatgaatgaggaagcaataatcatacgtatttactcaatcaacagtgcaaggggccggccgggaattccaacaagccgacatatacccaccaggttgggtcgagtcacgacgatcaaagaggccgcccgtctcactcgtctattttcatggataatgcaattggttttgtgctcattttactcttttaccgatatataactatgagtttttgag

SEQ ID NO: 744 - protein, 1268 aa, Zea mays
  misc_feature: PFam Name: Glyco_hydro_16; PFam Description: Glycosyl
  misc_feature: PFam Name: XET_C; PFam Description: Xyloglucan
  misc_feature: PFam Name: Kinesin; PFam Description: Kinesin motor domain
  misc_feature: PFam Name: MAGE; PFam Description: MAGE family
  misc_feature: PFam Name: Mucin; PFam Description: Mucin-like glycoprotein
  misc_feature: GI Number: 50252388; NR Description: putative Xet3 protein
  misc_feature: GI Number: 50252389; NR Description: putative Xet3 protein
  misc_feature: GI Number: 14330336; NR Description: Xet3 protein
  misc_feature: GI Number: 563235; NR Description: xyloglucan endo-transglycosylase homolog; similar to Triticum aestivum endo-xyloglucan transferase, PIR Accession Number E49539 >gi|563927|gb|AAC49011.1| xyloglucan endo-transglycosylase
  misc_feature: GI Number: 51039064; NR Description:
GCACGAGACCATTACCTAGAACATCCTAATCGAAAAATCAGAGATAGGAGAGACGAACAAGAAAAGACGAGATCATATATACCGTACGTTATAGAGTAGGAAAATAGAAATACGAATGATGATCACGGGACGGCAGCGAAACCCTGCAAGGCTGCAGGTGTCGTCGTCCTTCCTGCTTGCCCTTGTTTTCGCATCATCGGTGCTCGTCGGCATCGTGGCCGGCGGCAGCTTCTACGAGGAGTGCGACGCGACTTGGGAGCCCCAGAACTGCTGGGCCTACGACGATGGCAACAGGCTCTCCCTCGCGCTCGTCAGCAGTTCCTCAGGTTCCATGATCCGGTCGAAGCGGCAGTTCGTGTACGGGACCGTGTCCACCATGATCCAGCTTGTCCCCGGCGACTCCGCCGGCACCGTCACCACCTACTATACGTCGTCGCTGGGCGACAACCACGACGAGATCGACTTCGAGTTCTTGGGCAACGTGAGCGGGCAGCCCTACACCATCCACACCAACGTGTACGCTGCCGGCGTGGGCAACAAGGAGATGCAGTTCAAGCCATGGTTCGACCCCACCGCCGACTACCACAACTACACCATCTCCTGGACTCCCTGCATGATCGCGTGGTACGTCGACGGCGTCCCCATCCGCGTGTTCCGCAACTACGCGGCGAGCCACGGCGTGGCGTTCCCGACGAGCCAGCCCATGTACGCCTACTCTAGCATCTGGGCGGCGGAGGACTGGGCCACGCAGGGCGGCCGCGTCAAGGCCGACTGGTCCAAGGCGCCCTTCGTCGCCAGCTACCACGGCATCGACCTCGGCGTCTGCGAGTGCTACGGCGGGGGCGCCTGCGTCTCCAGCTGCGCCGCGGCGTTCGCCGCCAGCCACTGCAGCCTGAGCGACGCGCAGGTGGGGGAGATGCGCTGGGTGCAGGGCAGCTACAGGATCTACGACTACTGCGTCGACCCCAAGCGCTTGGTCAACGGCCAGAGGCCGGTCGAGTGCGACCTGCCGCAGTACTGAACGGATCGGAGCTCCGATCAGGTCCTTGTTGCGTATGAATGAGGAAGCAATAATCATACGTATTTACTCAATCAACAGTGCAAGGGGCCGGCCGGGAATTCCAACAAGCCGACATATACCCACCAGGTTGGGTCGAGTCACGACGATCAAAGAGGCCGCCCGTCTCACTCGTCTATTTTCATGGATAATGCAATTGGTTTTGTGCTCATTTTACTCTTTTACCGATATATAACTATGAGTTTTTGAG

SEQ ID NO: 745 - DNA, 1869 bp, Zea mays
  misc_feature (1)..(1869): Ceres cDNA ID no. 12364442
  misc_feature (1)..(1869): Ceres CLONE  ID no. 259302
  misc_feature (1)..(1869): Also known as  Ceres CDNA ID no. 23765151
gcacgagaccattacctagaacatcctaatcgcaaaataaagcgacggggcccttgcgctgggcgcggagactggagagggcgagagtcctcccatccacaagttcttagcttttgcgagattgagatccggctggggacagaccgacagaggaaggtgaattgtgggaaagaggacagaaaaatggggattggagatggatcttcaaatgggaaccagcaaccggtgcataaggaaatacgagatgagaccacaccacttcttccagtcaaggtggaggaggacgaggggtttcatgagttcaatggagcttcattctctggggcagttttcaatctgtcgaccaccatagttggggctggaattatggctcttccagcaagtatcaagatgctgggcatcatcccggggattctgttgatcatccttgtggcactgctcacagaggcatccatcgacatgcttgtaaggtgcagccaccagggcaagattacatcatatgggtggctgatgggcgaggttttcgggcagtgggggagaattgcgctgcaggcctccgtcatcataaacaatgttggcgtgctaattgtttacatgattatcattggtgatgtattatctggaacaacatcaggcgatgttcatcatcgtggtatattggagggctggtttggagctcatttgtggaattctcgtgccattgttcttcttgccacagctcttttggtgttcgctccgttggtgagctttaagcgcttggattcattaagatacacatctgcgctatcagttgccctggcagtagtttttgtcgtaattactgctgggattgccatcatcaaactcttcaatggaactgtagcgatgcccaaactttttccagaattagatggtcttaattctatctggaatctttttacagctgtccctgttcttgttacggcctatatctgccactataacgttcacagcattgacaatgaacttgaagacagaacacagatcaagccgattgtgcgaacatcgctgttcctgtgctccagtgtttacattgccacaagtttctttgcttatctcctcttcggtgaaggcacactggacgacgtgctcgccaactttgacgcaaatcttggcattccattcagttcagtcttcgatgacatagtgcgagtgagctatgcagcacatgtcatgcttgtctttcccattgtcttctttgccctccggctcaacttggatgggttgctcttccccacgtcaaggcacatctctcgtgacaacaagagattcgccatcatcaccgtctctctcctcgcagtaatttatcttgctgccattctcataccaagcatctgggacgcgttccagtttactggtgccacagctgctgtcctgattggttttatatttcctgccatggtcatacttagggattcttacggaatcgcgagcaagcgcgacaagattctggctgtaaccatgatcgtgcttgctgtcctgtcaaattctgtcgccctatacagtgacgcgatgaacatcttccgtaagaaggaagtggcctgatctcagatttcaaaagtagtcagtgctggatgaagaatggtctcgcaatgcaagactcgatggtacgaaggaaaacgatgcgcttggattccgtgaaggaacgatttctttgtcagcacctcagaatttggccacttgaaagaatctgatgcttgaagtttcctggttctgtgtacacaagtcggctcaatgtcagaattgagccgcttgaaatatatttagttatattctatgcggagagtaggtcttggaaacagccttttccacaataatgtacagttattatgccaatttctgagttcagtt

SEQ ID NO: 746 - protein, 1869 aa, Zea mays
  misc_feature: PFam Name: Aa_trans; PFam Description: Transmembrane amino
  misc_feature: GI Number: 15241555; NR Description: amino acid transporter
  misc_feature: GI Number: 9758059; NR Description: amino acid
  misc_feature: GI Number: 50905855; NR Description: putative amino acid transporter A1 [Oryza sativa (japonica cultivar-group)] >gi|46390972|dbj|BAD16485.1| putative amino acid transporter A1 [Oryza sativa (japonica cultivar-group)] [Oryza sativa (japonica
  misc_feature: GI Number: 50912345; NR Description: putative amino acid transporter [Oryza sativa (japonica cultivar-group)] >gi|46390604|dbj|BAD16088.1| putative amino acid transporter [Oryza
  misc_feature: GI Number: 51535770; NR Description: putative system A
GCACGAGACCATTACCTAGAACATCCTAATCGCAAAATAAAGCGACGGGGCCCTTGCGCTGGGCGCGGAGACTGGAGAGGGCGAGAGTCCTCCCATCCACAAGTTCTTAGCTTTTGCGAGATTGAGATCCGGCTGGGGACAGACCGACAGAGGAAGGTGAATTGTGGGAAAGAGGACAGAAAAATGGGGATTGGAGATGGATCTTCAAATGGGAACCAGCAACCGGTGCATAAGGAAATACGAGATGAGACCACACCACTTCTTCCAGTCAAGGTGGAGGAGGACGAGGGGTTTCATGAGTTCAATGGAGCTTCATTCTCTGGGGCAGTTTTCAATCTGTCGACCACCATAGTTGGGGCTGGAATTATGGCTCTTCCAGCAAGTATCAAGATGCTGGGCATCATCCCGGGGATTCTGTTGATCATCCTTGTGGCACTGCTCACAGAGGCATCCATCGACATGCTTGTAAGGTGCAGCCACCAGGGCAAGATTACATCATATGGGTGGCTGATGGGCGAGGTTTTCGGGCAGTGGGGGAGAATTGCGCTGCAGGCCTCCGTCATCATAAACAATGTTGGCGTGCTAATTGTTTACATGATTATCATTGGTGATGTATTATCTGGAACAACATCAGGCGATGTTCATCATCGTGGTATATTGGAGGGCTGGTTTGGAGCTCATTTGTGGAATTCTCGTGCCATTGTTCTTCTTGCCACAGCTCTTTTGGTGTTCGCTCCGTTGGTGAGCTTTAAGCGCTTGGATTCATTAAGATACACATCTGCGCTATCAGTTGCCCTGGCAGTAGTTTTTGTCGTAATTACTGCTGGGATTGCCATCATCAAACTCTTCAATGGAACTGTAGCGATGCCCAAACTTTTTCCAGAATTAGATGGTCTTAATTCTATCTGGAATCTTTTTACAGCTGTCCCTGTTCTTGTTACGGCCTATATCTGCCACTATAACGTTCACAGCATTGACAATGAACTTGAAGACAGAACACAGATCAAGCCGATTGTGCGAACATCGCTGTTCCTGTGCTCCAGTGTTTACATTGCCACAAGTTTCTTTGCTTATCTCCTCTTCGGTGAAGGCACACTGGACGACGTGCTCGCCAACTTTGACGCAAATCTTGGCATTCCATTCAGTTCAGTCTTCGATGACATAGTGCGAGTGAGCTATGCAGCACATGTCATGCTTGTCTTTCCCATTGTCTTCTTTGCCCTCCGGCTCAACTTGGATGGGTTGCTCTTCCCCACGTCAAGGCACATCTCTCGTGACAACAAGAGATTCGCCATCATCACCGTCTCTCTCCTCGCAGTAATTTATCTTGCTGCCATTCTCATACCAAGCATCTGGGACGCGTTCCAGTTTACTGGTGCCACAGCTGCTGTCCTGATTGGTTTTATATTTCCTGCCATGGTCATACTTAGGGATTCTTACGGAATCGCGAGCAAGCGCGACAAGATTCTGGCTGTAACCATGATCGTGCTTGCTGTCCTGTCAAATTCTGTCGCCCTATACAGTGACGCGATGAACATCTTCCGTAAGAAGGAAGTGGCCTGATCTCAGATTTCAAAAGTAGTCAGTGCTGGATGAAGAATGGTCTCGCAATGCAAGACTCGATGGTACGAAGGAAAACGATGCGCTTGGATTCCGTGAAGGAACGATTTCTTTGTCAGCACCTCAGAATTTGGCCACTTGAAAGAATCTGATGCTTGAAGTTTCCTGGTTCTGTGTACACAAGTCGGCTCAATGTCAGAATTGAGCCGCTTGAAATATATTTAGTTATATTCTATGCGGAGAGTAGGTCTTGGAAACAGCCTTTTCCACAATAATGTACAGTTATTATGCCAATTTCTGAGTTCAGTT

SEQ ID NO: 747 - DNA, 2127 bp, Zea mays
  misc_feature (1)..(2127): Ceres cDNA ID no. 12364464
  misc_feature (1)..(2127): Ceres CLONE  ID no. 407581
  misc_feature (1)..(2127): Also known as  Ceres CDNA ID no. 23808467
gcacgagaccattacctagaacatcctaatcgaaaaaccagtgttcaaaaactctgaaaattcccacctctccctccctctctcgcgcgtccgcgcccgcgcccgcggcctcgttcaatcgccagcgctcccccgccccccggtggtagcgggctctacggcagcgctcctctccggttcccctgcgctccgcgtcttcatctgtggcggccgacgctccgtcggtgtctcgtcggacggagcgagcggagctagggttccgtttcatgctcaggatcggcgagatctagggtctcgatttcagggtgattgtactggatagctgctgctgatattgcaagacaatgaaagctcatcagcagcaaggtaatgcatctggcacaggagcaaagaccaaatctggttttgataagatacaaagcctgaaagctggtgcacatatcaacaaatcatcaggcaatgtggctgcaaagcgtagaaaggtctctccttttgaatcacataccaaaagcaagatagcatcaaagactggcagtcttatggaagcgccagcaagtgatgctaagttgtctgctcggccacctaatcactctggaaagatcaaacttcaacttttcccattatatgaaaccattcaagagattatgcagcaagaaaaacacaatccttaccttgaattgactttggctcctcgaaagaagatgtcctcaattttacatcatctgaatacaaaatggggcagttctcagtgtgcaaaaggcgagctcatgctcttccctaatgatactagactggacactataggtggcagtgcaaaatggactcttaaggattcttgcacagctgctgatgtgcatgttgcagttggctgcccttcaacatttcgtttaaggtatggttggtttggacctgatttgaaccaacaaagtagtgaaccatccttggcatcagcgtactctgaagacaagattattggcagcaggcctcctgatcttgttttcaatgaacaaaaacatatggctggttcagatgaatttgcaaatcattttgtgacaccctccattgtggataaaataaatacatcacaaatggcggagaatccaagcaaggtggcacaactttcatggcttgactccatatctaatattagttttggagcactgttatctgaagctgcgccttctcaagacaccaaacaaccaccttcacaaaatagcatttgtctccagcagatccctgccacatgtgattcatttgacgctgctattgcttcactgattgcccgtcagcaaccaagtaaccaaccaaaggtgttaaatccatccctttgggaagccgaagaaacttgccatgcatttcccttccagaatcaaactccacatgcatcaagttcagttcctggcaacagctttgctgctatgacctcatcagtcttgtgtgccattccagaaactggcacagatgatcagcaatgtgctacggatggtaggaaagaggaactaaacagtcaaacatcagtagagggcgatggtattaatgcaaagccagagatttcaatgcaggagtcagctggtgacccagagcgtgaagcatcttgccccagactcttgggtggaaccgacagtataggactaagctctttgctcactgacagcctggatgcgttccagaaattctctgttttctgaagctcagaaatccataaagaacgacgggcttatacaatatgaactaagcggaggtatatattaaccaggtttctgtttcgtgaacagaactaattgttttgggcttcctaagttatttctgtagataaaaccccccatatctgtattgtgaagttttttttattatctctagtttactactgttcttgtttatttgtcgcggtttagtttaaaaatgtactagctgacgacaaatattcgagaacggaggtagtacttggaagaaatatgtattctgaagttgaaatttctttcgctttattttatcttaaggtagcaagtgcctagcctatagtgaggctctgccaactgggctgtcacccagttatatttgtcattgcatcttgctgttaattgaacatttgttctttggaacattgatcggctgtggtattatagt

SEQ ID NO: 748 - protein, 2127 aa, Zea mays
  misc_feature: GI Number: 34906224; NR Description: P0666G04.18 [Oryza sativa (japonica cultivar-group)] >gi|13122435|dbj|BAB32916.1|
  misc_feature: GI Number: 34913318; NR Description: putative myb/SANT domain protein [Oryza sativa (japonica cultivar-group)] >gi|22093830|dbj|BAC07117.1| putative myb/SANT domain protein
  misc_feature: GI Number: 30686982; NR Description: myb family transcription
  misc_feature: GI Number: 22218300; NR Description: myb/SANT domain protein
GCACGAGACCATTACCTAGAACATCCTAATCGAAAAACCAGTGTTCAAAAACTCTGAAAATTCCCACCTCTCCCTCCCTCTCTCGCGCGTCCGCGCCCGCGCCCGCGGCCTCGTTCAATCGCCAGCGCTCCCCCGCCCCCCGGTGGTAGCGGGCTCTACGGCAGCGCTCCTCTCCGGTTCCCCTGCGCTCCGCGTCTTCATCTGTGGCGGCCGACGCTCCGTCGGTGTCTCGTCGGACGGAGCGAGCGGAGCTAGGGTTCCGTTTCATGCTCAGGATCGGCGAGATCTAGGGTCTCGATTTCAGGGTGATTGTACTGGATAGCTGCTGCTGATATTGCAAGACAATGAAAGCTCATCAGCAGCAAGGTAATGCATCTGGCACAGGAGCAAAGACCAAATCTGGTTTTGATAAGATACAAAGCCTGAAAGCTGGTGCACATATCAACAAATCATCAGGCAATGTGGCTGCAAAGCGTAGAAAGGTCTCTCCTTTTGAATCACATACCAAAAGCAAGATAGCATCAAAGACTGGCAGTCTTATGGAAGCGCCAGCAAGTGATGCTAAGTTGTCTGCTCGGCCACCTAATCACTCTGGAAAGATCAAACTTCAACTTTTCCCATTATATGAAACCATTCAAGAGATTATGCAGCAAGAAAAACACAATCCTTACCTTGAATTGACTTTGGCTCCTCGAAAGAAGATGTCCTCAATTTTACATCATCTGAATACAAAATGGGGCAGTTCTCAGTGTGCAAAAGGCGAGCTCATGCTCTTCCCTAATGATACTAGACTGGACACTATAGGTGGCAGTGCAAAATGGACTCTTAAGGATTCTTGCACAGCTGCTGATGTGCATGTTGCAGTTGGCTGCCCTTCAACATTTCGTTTAAGGTATGGTTGGTTTGGACCTGATTTGAACCAACAAAGTAGTGAACCATCCTTGGCATCAGCGTACTCTGAAGACAAGATTATTGGCAGCAGGCCTCCTGATCTTGTTTTCAATGAACAAAAACATATGGCTGGTTCAGATGAATTTGCAAATCATTTTGTGACACCCTCCATTGTGGATAAAATAAATACATCACAAATGGCGGAGAATCCAAGCAAGGTGGCACAACTTTCATGGCTTGACTCCATATCTAATATTAGTTTTGGAGCACTGTTATCTGAAGCTGCGCCTTCTCAAGACACCAAACAACCACCTTCACAAAATAGCATTTGTCTCCAGCAGATCCCTGCCACATGTGATTCATTTGACGCTGCTATTGCTTCACTGATTGCCCGTCAGCAACCAAGTAACCAACCAAAGGTGTTAAATCCATCCCTTTGGGAAGCCGAAGAAACTTGCCATGCATTTCCCTTCCAGAATCAAACTCCACATGCATCAAGTTCAGTTCCTGGCAACAGCTTTGCTGCTATGACCTCATCAGTCTTGTGTGCCATTCCAGAAACTGGCACAGATGATCAGCAATGTGCTACGGATGGTAGGAAAGAGGAACTAAACAGTCAAACATCAGTAGAGGGCGATGGTATTAATGCAAAGCCAGAGATTTCAATGCAGGAGTCAGCTGGTGACCCAGAGCGTGAAGCATCTTGCCCCAGACTCTTGGGTGGAACCGACAGTATAGGACTAAGCTCTTTGCTCACTGACAGCCTGGATGCGTTCCAGAAATTCTCTGTTTTCTGAAGCTCAGAAATCCATAAAGAACGACGGGCTTATACAATATGAACTAAGCGGAGGTATATATTAACCAGGTTTCTGTTTCGTGAACAGAACTAATTGTTTTGGGCTTCCTAAGTTATTTCTGTAGATAAAACCCCCCATATCTGTATTGTGAAGTTTTTTTTATTATCTCTAGTTTACTACTGTTCTTGTTTATTTGTCGCGGTTTAGTTTAAAAATGTACTAGCTGACGACAAATATTCGAGAACGGAGGTAGTACTTGGAAGAAATATGTATTCTGAAGTTGAAATTTCTTTCGCTTTATTTTATCTTAAGGTAGCAAGTGCCTAGCCTATAGTGAGGCTCTGCCAACTGGGCTGTCACCCAGTTATATTTGTCATTGCATCTTGCTGTTAATTGAACATTTGTTCTTTGGAACATTGATCGGCTGTGGTATTATAGT

SEQ ID NO: 749 - DNA, 1296 bp, Zea mays
  misc_feature (1)..(1296): Ceres cDNA ID no. 12364476
  misc_feature (1)..(1296): Ceres CLONE  ID no. 424293
  misc_feature (1)..(1296): Also known as  Ceres CDNA ID no. 23805964
gcacgagaccattacctagaacatcctaatcgaaaaatccaattgaggaagagaagaggcgataagcacactaatggctgacgagtcatggagggtgccaaccccagtgcaagaactggccgcaggcgtggtggagccaccgacccagttcgtgctgcaggagcaggatcgtcctggatctgggaccctgctcttcgccactgacatgccggagcccattcccgtcgttgacctcagcaggctggcggctgccgacgaggcttccaagctccggtcagcactggagacctgggggctcttcctggttactaagcatgggatagaagcatctctcatggacgatgtgatggccgcgtcacgcgattttttctaccagccgctcgaagcgaagcaggaatacagtaacctgataggcggcaagcggttccagatggagggttatggtaatgacatggtgaaatccaaagatcagatactggactggcaagatcggctgcagctcagggtggaaccccaagatgagaggaacctcgcttattggcccaaacaccctgattctttcagggatcttctggagaagtatgcatcaaaaaccaagatagttaggaacaaagtcttacgggcgatgggcaaaacattggagcttggcgaagactatttcatcagccagattggtgacagggcctcagcaattgctaggttcaactactaccctccctgtccaaggcctgatcttgtctttggcattaagcctcactctgacggtggcgcggtgacgatacttctcgtcgacaaggatgttgggggcctgcaagttcagaaagatggcgtttggtacactgttccgtccatgcctcacacgctgcttgtcaacttgggtgactccatggagataatgaacaatgggatcttcaaaagtccggtgcacagggttgtgacgaatgcagagaaagagagactctcactcgccatgttctacggcgtggaaggccagagagtgcttgagccagcgcttggtttgctgggtgaggagcgaccagcacggtacaggaaaattatggcctcagactacattattgggctccgtcaaggaattgcggaaggacagagatttatcgagactttgaagatatagtcaatcgtgaatgctcaagaataataaagagttgcttcgcccattgctaaatcagatcagagtccaatgtccattctgtaatgcattaccacattgttatacatgctcggaagacttcagagaagatgtaatcctgctcgttttactaaatttggggcatt

SEQ ID NO: 750 - protein, 1296 aa, Zea mays
  misc_feature: PFam Name: 2OG-FeII_Oxy; PFam Description: 2OG-Fe(II)
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
GCACGAGACCATTACCTAGAACATCCTAATCGAAAAATCCAATTGAGGAAGAGAAGAGGCGATAAGCACACTAATGGCTGACGAGTCATGGAGGGTGCCAACCCCAGTGCAAGAACTGGCCGCAGGCGTGGTGGAGCCACCGACCCAGTTCGTGCTGCAGGAGCAGGATCGTCCTGGATCTGGGACCCTGCTCTTCGCCACTGACATGCCGGAGCCCATTCCCGTCGTTGACCTCAGCAGGCTGGCGGCTGCCGACGAGGCTTCCAAGCTCCGGTCAGCACTGGAGACCTGGGGGCTCTTCCTGGTTACTAAGCATGGGATAGAAGCATCTCTCATGGACGATGTGATGGCCGCGTCACGCGATTTTTTCTACCAGCCGCTCGAAGCGAAGCAGGAATACAGTAACCTGATAGGCGGCAAGCGGTTCCAGATGGAGGGTTATGGTAATGACATGGTGAAATCCAAAGATCAGATACTGGACTGGCAAGATCGGCTGCAGCTCAGGGTGGAACCCCAAGATGAGAGGAACCTCGCTTATTGGCCCAAACACCCTGATTCTTTCAGGGATCTTCTGGAGAAGTATGCATCAAAAACCAAGATAGTTAGGAACAAAGTCTTACGGGCGATGGGCAAAACATTGGAGCTTGGCGAAGACTATTTCATCAGCCAGATTGGTGACAGGGCCTCAGCAATTGCTAGGTTCAACTACTACCCTCCCTGTCCAAGGCCTGATCTTGTCTTTGGCATTAAGCCTCACTCTGACGGTGGCGCGGTGACGATACTTCTCGTCGACAAGGATGTTGGGGGCCTGCAAGTTCAGAAAGATGGCGTTTGGTACACTGTTCCGTCCATGCCTCACACGCTGCTTGTCAACTTGGGTGACTCCATGGAGATAATGAACAATGGGATCTTCAAAAGTCCGGTGCACAGGGTTGTGACGAATGCAGAGAAAGAGAGACTCTCACTCGCCATGTTCTACGGCGTGGAAGGCCAGAGAGTGCTTGAGCCAGCGCTTGGTTTGCTGGGTGAGGAGCGACCAGCACGGTACAGGAAAATTATGGCCTCAGACTACATTATTGGGCTCCGTCAAGGAATTGCGGAAGGACAGAGATTTATCGAGACTTTGAAGATATAGTCAATCGTGAATGCTCAAGAATAATAAAGAGTTGCTTCGCCCATTGCTAAATCAGATCAGAGTCCAATGTCCATTCTGTAATGCATTACCACATTGTTATACATGCTCGGAAGACTTCAGAGAAGATGTAATCCTGCTCGTTTTACTAAATTTGGGGCATT

SEQ ID NO: 751 - DNA, 1480 bp, Zea mays
  misc_feature (1)..(1480): Ceres cDNA ID no. 12364480
  misc_feature (1)..(1480): Ceres CLONE  ID no. 407884
  misc_feature (1)..(1480): Also known as  Ceres CDNA ID no. 23803748
gcacgagaccattacctagaacatcctaatcgaaaagccaaattgcattgacagagaacgagagaaaaaaaaatcctaatccaccctcgccgcgagatcgccggtcgctcccatgtcgactccagccgccgctgcgaagcaatacttttgctaccaatgcaaccgcaccgtcctcatcgcggcctccgccgtcgccgccggggagctctcgtgccccgagtgccacggcaacttcctcgaggaggtcaccatccctgccccaaccttcatccagctccctttcccttttgcttccaccacgatccctaccgccagtaccgccccgcgccccgccccagcagccggcaccggcaggcccccttccttctcgtcctcctccgctgcgacctctcggtccgagccccgctacatctcctccatcctcaactccttcgtcggacccggcgaacaacccaacaggatcagcggctccagcatacgtttcgcccctggcacggccacccacaggaacgagcccgagcccttcgacccggtaatgttcttccagaattacatccaaagcctcgtggagggaggcgccaacatccaggtcctcttcgacgatgccagcgcgagcctcggctccggacccggcctagggcgcctcggcggggcaagcttcggggattacttcgtcggcccaggcttggaacaactcatcgagcagctcgccgagaacgaccccaaccgctatggcacgccgccggctgccaagtcggccctctcctcgctccccgacgtcgtcgtgactcacaccatggtcgcagctgcggagggcgctgagtgcgccgtctgcaaggaggatttctctcctggagaggtggccaagcagatgccctgtaaccacatctaccacaccgactgcatcatgccgtggcttgagcttcacaactcgtgccccatctgtcgctttgagcttcccactgacgatcctgattatgaggtgcggaagggctctaattctcagcaggctgttggtattgctgctgctgcatcagggagctctactgctgctgagggacaaatggagaggcaggagaatccaagggtggttgagaggaggttcaatgtgtcgctgccatggccattcagtggattgggagggcaaacatcgcagcaggacgggaacagtggaggcagtggtagcaactcacaaggcagtggctcgcaggatggtggcccacccagcagcaagaattgataaaaaatcagctggaggttcaccttttggcgatctgttaagaagtctgcagtatatacgtgtcaccatgactatacacctacaggaatttacagtctctgtttgttacgaaacaatcgtttgtttttcatgtagacacggcgcaaaaactgccactgcagcagaatttgcgcgctgagagagttgggacttcatgtgtagatttgttgattgatcctggtccatgaaatggtaaacccc

SEQ ID NO: 752 - protein, 1480 aa, Zea mays
  misc_feature: PFam Name: zf-C3HC4; PFam Description: Zinc finger, C3HC4
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Atrophin-1; PFam Description: Atrophin-1 family
  misc_feature: GI Number: 55296745; NR Description: putative ring finger protein 126 isoform 1 [Oryza sativa (japonica cultivar-group)] gi|55296657|dbj|BAD69377.1| putative ring finger protein 126
  misc_feature: GI Number: 23308365; NR Description: At3g19950/MPN9_19 [Arabidopsis thaliana] >gi|20465263|gb|AAM19951.1| AT3g19950/MPN9_19 [Arabidopsis thaliana] >gi|15231003|ref|NP_188629.1| zinc finger (C3HC4-type RING
  misc_feature: GI Number: 50949043; NR Description: putative RING-H2 finger protein [Oryza sativa] >gi|14719329|gb|AAK73147.1| putative RING-H2
  misc_feature: GI Number: 38454178; NR Description: At3g13430 [Arabidopsis thaliana] >gi|44681454|gb|AAS47667.1| At3g13430 [Arabidopsis
  misc_feature: GI Number: 50913127; NR Description: zinc finger -like [Oryza sativa (japonica cultivar-group)] >gi|46805440|dbj|BAD16922.1| zinc finger -like [Oryza sativa (japonica cultivar-group)] >gi|46806079|dbj|BAD17327.1| zinc finger -like [Oryza sativa
GCACGAGACCATTACCTAGAACATCCTAATCGAAAAGCCAAATTGCATTGACAGAGAACGAGAGAAAAAAAAATCCTAATCCACCCTCGCCGCGAGATCGCCGGTCGCTCCCATGTCGACTCCAGCCGCCGCTGCGAAGCAATACTTTTGCTACCAATGCAACCGCACCGTCCTCATCGCGGCCTCCGCCGTCGCCGCCGGGGAGCTCTCGTGCCCCGAGTGCCACGGCAACTTCCTCGAGGAGGTCACCATCCCTGCCCCAACCTTCATCCAGCTCCCTTTCCCTTTTGCTTCCACCACGATCCCTACCGCCAGTACCGCCCCGCGCCCCGCCCCAGCAGCCGGCACCGGCAGGCCCCCTTCCTTCTCGTCCTCCTCCGCTGCGACCTCTCGGTCCGAGCCCCGCTACATCTCCTCCATCCTCAACTCCTTCGTCGGACCCGGCGAACAACCCAACAGGATCAGCGGCTCCAGCATACGTTTCGCCCCTGGCACGGCCACCCACAGGAACGAGCCCGAGCCCTTCGACCCGGTAATGTTCTTCCAGAATTACATCCAAAGCCTCGTGGAGGGAGGCGCCAACATCCAGGTCCTCTTCGACGATGCCAGCGCGAGCCTCGGCTCCGGACCCGGCCTAGGGCGCCTCGGCGGGGCAAGCTTCGGGGATTACTTCGTCGGCCCAGGCTTGGAACAACTCATCGAGCAGCTCGCCGAGAACGACCCCAACCGCTATGGCACGCCGCCGGCTGCCAAGTCGGCCCTCTCCTCGCTCCCCGACGTCGTCGTGACTCACACCATGGTCGCAGCTGCGGAGGGCGCTGAGTGCGCCGTCTGCAAGGAGGATTTCTCTCCTGGAGAGGTGGCCAAGCAGATGCCCTGTAACCACATCTACCACACCGACTGCATCATGCCGTGGCTTGAGCTTCACAACTCGTGCCCCATCTGTCGCTTTGAGCTTCCCACTGACGATCCTGATTATGAGGTGCGGAAGGGCTCTAATTCTCAGCAGGCTGTTGGTATTGCTGCTGCTGCATCAGGGAGCTCTACTGCTGCTGAGGGACAAATGGAGAGGCAGGAGAATCCAAGGGTGGTTGAGAGGAGGTTCAATGTGTCGCTGCCATGGCCATTCAGTGGATTGGGAGGGCAAACATCGCAGCAGGACGGGAACAGTGGAGGCAGTGGTAGCAACTCACAAGGCAGTGGCTCGCAGGATGGTGGCCCACCCAGCAGCAAGAATTGATAAAAAATCAGCTGGAGGTTCACCTTTTGGCGATCTGTTAAGAAGTCTGCAGTATATACGTGTCACCATGACTATACACCTACAGGAATTTACAGTCTCTGTTTGTTACGAAACAATCGTTTGTTTTTCATGTAGACACGGCGCAAAAACTGCCACTGCAGCAGAATTTGCGCGCTGAGAGAGTTGGGACTTCATGTGTAGATTTGTTGATTGATCCTGGTCCATGAAATGGTAAACCCC

SEQ ID NO: 753 - DNA, 1600 bp, Zea mays
  misc_feature (1)..(1600): Ceres cDNA ID no. 12364490
  misc_feature (1)..(1600): Ceres CLONE  ID no. 424395
  misc_feature (1)..(1600): Also known as  Ceres CDNA ID no. 23808548
gcacgagaccattacctagaacatcctaatcgaaaacccagacccagagcttctcttctcaaaagatgcaggagcaggacgtggacgatggcggcggcaggacgacccagcagcaggagaagtcgatcgacgactggctccctatcaactcctccaggaaggccaagtggtggtactccgccttccacaatgtcaccgccatggtcggcgccggcgtgctcggcctcccctacgccatgtccgagcttggctggggccctggcatcgcggtgatgatcctgtcgtggataatcaccctatacacgctatggcagatggtggagatgcacgagatggtgcctgggaagcggttcgaccggtaccacgagctcgggcagcacgtcttcggcgacaggctgggcctctggatcgtggtgccgcagcagctggcagtagaggtgagcctgaacatcatctacatggtcaccggcggccagtccctcaagaagttccacgacgtcatctgcgacggcggcaggtgcggcggcgacttgaagctctcctacttcatcatgatcttcgcctccgtccacctggtcctctcccagctccccaacttcaactccatctccgccgtgtcgctcgccgccgccgtcatgtcgctcagttactccaccattgcgtggggcgcgtcgctgcacagagggaggagagaggacgtggactaccacctgcgcgccacgaccaccccagggaaggtgttcggcttcctgggaggcctaggggacgtggcgttcgcctactcggggcacaacgtggtgctggagatccaggccaccatcccgtccacgccggacaagccgtccaagaaggccatgtggaagggcgcctttgtcgcctacgtcgtcgtcgccatctgctacttccccgtcacgttcgtcgggtactgggccttcggcagcggcgtcgacgagaacatcctcatcacgctctccaagcccaagtggctcattgccctcgccaacatgatggtcgtcgtccatgtcattggcagttaccaggtttatgccatgccggtgtttgacatgatagagacggtgctggtcaagaaaatgaggttcgctccgagcctcacgctccgtcttattgcccggagcgtctatgttgcgttcacaatgtttctaggcatcactttccccttcttcggtggattgctcagtttcttcggcggattagccttcgcaccgacaacttattttcttccctgcatcatgtggctcaaggtttacaagcccaaacggttcggcctttcatggttcatcaactggatctgcatcgttattggagtgctgctgttgattctgggtccgataggagggctccggcagatcattttgtcagccaccacatacaaattctaccagtaaaatcgatcaactggagtcgtatggcgtggctgttttgttagcattacatttcttagggtggattggcttttaatgtacacgagcgagtgagattgatgctagtagctcctaggagtatatatatttctatcatccacagagcttaatgtatcttgtagttgggacattaaaagagcaagtaggctttactcgct

SEQ ID NO: 754 - protein, 1600 aa, Zea mays
  misc_feature: PFam Name: Aa_trans; PFam Description: Transmembrane amino
  misc_feature: PFam Name: MAGE; PFam Description: MAGE family
  misc_feature: PFam Name: Pyr_redox_2; PFam Description: Pyridine
  misc_feature: PFam Name: Trp_Tyr_perm; PFam Description:
  misc_feature: GI Number: 22137070; NR Description: At5g40780/K1B16_3 [Arabidopsis thaliana] >gi|14194151|gb|AAK56270.1| AT5g40780/K1B16_3 [Arabidopsis thaliana] >gi|30693663|ref|NP_851109.1| lysine and histidine specific
  misc_feature: GI Number: 9293860; NR Description: amino acid transporter-like protein 2 [Arabidopsis thaliana] >gi|18395471|ref|NP_564217.1| lysine and histidine specific transporter, putative [Arabidopsis thaliana]
  misc_feature: GI Number: 30409136; NR Description: histidine amino acid
  misc_feature: GI Number: 2576361; NR Description: lysine and histidine
  misc_feature: GI Number: 12597815; NR Description: lysine and histidine
GCACGAGACCATTACCTAGAACATCCTAATCGAAAACCCAGACCCAGAGCTTCTCTTCTCAAAAGATGCAGGAGCAGGACGTGGACGATGGCGGCGGCAGGACGACCCAGCAGCAGGAGAAGTCGATCGACGACTGGCTCCCTATCAACTCCTCCAGGAAGGCCAAGTGGTGGTACTCCGCCTTCCACAATGTCACCGCCATGGTCGGCGCCGGCGTGCTCGGCCTCCCCTACGCCATGTCCGAGCTTGGCTGGGGCCCTGGCATCGCGGTGATGATCCTGTCGTGGATAATCACCCTATACACGCTATGGCAGATGGTGGAGATGCACGAGATGGTGCCTGGGAAGCGGTTCGACCGGTACCACGAGCTCGGGCAGCACGTCTTCGGCGACAGGCTGGGCCTCTGGATCGTGGTGCCGCAGCAGCTGGCAGTAGAGGTGAGCCTGAACATCATCTACATGGTCACCGGCGGCCAGTCCCTCAAGAAGTTCCACGACGTCATCTGCGACGGCGGCAGGTGCGGCGGCGACTTGAAGCTCTCCTACTTCATCATGATCTTCGCCTCCGTCCACCTGGTCCTCTCCCAGCTCCCCAACTTCAACTCCATCTCCGCCGTGTCGCTCGCCGCCGCCGTCATGTCGCTCAGTTACTCCACCATTGCGTGGGGCGCGTCGCTGCACAGAGGGAGGAGAGAGGACGTGGACTACCACCTGCGCGCCACGACCACCCCAGGGAAGGTGTTCGGCTTCCTGGGAGGCCTAGGGGACGTGGCGTTCGCCTACTCGGGGCACAACGTGGTGCTGGAGATCCAGGCCACCATCCCGTCCACGCCGGACAAGCCGTCCAAGAAGGCCATGTGGAAGGGCGCCTTTGTCGCCTACGTCGTCGTCGCCATCTGCTACTTCCCCGTCACGTTCGTCGGGTACTGGGCCTTCGGCAGCGGCGTCGACGAGAACATCCTCATCACGCTCTCCAAGCCCAAGTGGCTCATTGCCCTCGCCAACATGATGGTCGTCGTCCATGTCATTGGCAGTTACCAGGTTTATGCCATGCCGGTGTTTGACATGATAGAGACGGTGCTGGTCAAGAAAATGAGGTTCGCTCCGAGCCTCACGCTCCGTCTTATTGCCCGGAGCGTCTATGTTGCGTTCACAATGTTTCTAGGCATCACTTTCCCCTTCTTCGGTGGATTGCTCAGTTTCTTCGGCGGATTAGCCTTCGCACCGACAACTTATTTTCTTCCCTGCATCATGTGGCTCAAGGTTTACAAGCCCAAACGGTTCGGCCTTTCATGGTTCATCAACTGGATCTGCATCGTTATTGGAGTGCTGCTGTTGATTCTGGGTCCGATAGGAGGGCTCCGGCAGATCATTTTGTCAGCCACCACATACAAATTCTACCAGTAAAATCGATCAACTGGAGTCGTATGGCGTGGCTGTTTTGTTAGCATTACATTTCTTAGGGTGGATTGGCTTTTAATGTACACGAGCGAGTGAGATTGATGCTAGTAGCTCCTAGGAGTATATATATTTCTATCATCCACAGAGCTTAATGTATCTTGTAGTTGGGACATTAAAAGAGCAAGTAGGCTTTACTCGCT

SEQ ID NO: 755 - DNA, 1156 bp, Zea mays
  misc_feature (1)..(1156): Ceres cDNA ID no. 12364587
  misc_feature (1)..(1156): Ceres CLONE  ID no. 452399
  misc_feature (1)..(1156): Also known as  Ceres CDNA ID no. 23755897
gcattcagcgtgcgaccgaagctagctagcagttattcttgctttgcattaattattgcgagatcgatgacgatgtccattgttgctgccgtgctgctgttgctgctcgtcgtacatccacgggcggcagcgtcgcagccttctccgggctacttcccgagctccacggtgaggcccatggccttctcggatggatacgacaacctgtgggggccgcagcaccagacgctgtcgcaggacaggatggcgctcacgctcttgatggaccgcacctcaggcagcgggttcaagtccaagcgctcgtaccggaacggctacttcggcgtctccatcaaggtgcagccgggctacaccgccggcgtcaacaccgccttctacctgtccaacaacgagctgtacccggggaggcacgacgagatcgacatggagctgctgggcaccgtgccgggggagccctacacgctgcagaccaacgtgtacgtgcggggcaccggcgacggcgcgcgcctcgtgggccgggagatgcgcttccacctctggttcgacccggccgccgacttccaccactacgccatcctctggaaccccgaccagatcgtcttcctcgtcgacgacgtccccatcaggcgctacgccgccgccagtgcgccgttcttccccgaccgccagatgtgggcgtacggctccatctgggacgcctccgactgggccaccgacggcggccgctacagggccgactaccgctaccagcccttcctggcgggattccgggggttcaggaccgccggatgcgaggacgcccagtgccgtcccgtgccggcgtcccccgccggcgccggactcagcgtgcagcagcgggacgccatgcgctgggcgcagcagacctccatggtctactactactgccaggattacaccaaggatcgctccttgtacccagagtgctcgctcgctagctagcctagctaccactaccagagcaagagcatgcatggaggaggcgtgcgagtgaagaagcgccgccctacgtacgtaccgttctaaaattgtatgtacaattaagtctccatccacatccatatatacatatgtaatgtataattaagtccattattaatttaatcatcaaaaaatggaacatgcctatatatttcct

SEQ ID NO: 756 - protein, 1156 aa, Zea mays
  misc_feature: PFam Name: Glyco_hydro_16; PFam Description: Glycosyl
  misc_feature: PFam Name: XET_C; PFam Description: Xyloglucan
  misc_feature: PFam Name: Mucin; PFam Description: Mucin-like glycoprotein
  misc_feature: PFam Name: 7tm_1; PFam Description: 7 transmembrane receptor
  misc_feature: PFam Name: MAGE; PFam Description: MAGE family
  misc_feature: GI Number: 37536586; NR Description: putative cellulase [Oryza sativa (japonica cultivar-group)] >gi|13357258|gb|AAK20055.1| putative cellulase [Oryza sativa (japonica cultivar-group)] >gi|31433363|gb|AAP54882.1| putative
  misc_feature: GI Number: 34902398; NR Description: Putative cellulase [Oryza sativa (japonica cultivar-group)] >gi|24476042|gb|AAN62784.1| Putative cellulase [Oryza sativa
  misc_feature: GI Number: 34901732; NR Description: putative xyloglucan endo-transglycosylase [Oryza sativa (japonica cultivar-group)] >gi|27261015|dbj|BAC45131.1| putative xyloglucan
  misc_feature: GI Number: 14029149; NR Description: xyloglucan
  misc_feature: GI Number: 17402583; NR Description: Xyloglucan
GCATTCAGCGTGCGACCGAAGCTAGCTAGCAGTTATTCTTGCTTTGCATTAATTATTGCGAGATCGATGACGATGTCCATTGTTGCTGCCGTGCTGCTGTTGCTGCTCGTCGTACATCCACGGGCGGCAGCGTCGCAGCCTTCTCCGGGCTACTTCCCGAGCTCCACGGTGAGGCCCATGGCCTTCTCGGATGGATACGACAACCTGTGGGGGCCGCAGCACCAGACGCTGTCGCAGGACAGGATGGCGCTCACGCTCTTGATGGACCGCACCTCAGGCAGCGGGTTCAAGTCCAAGCGCTCGTACCGGAACGGCTACTTCGGCGTCTCCATCAAGGTGCAGCCGGGCTACACCGCCGGCGTCAACACCGCCTTCTACCTGTCCAACAACGAGCTGTACCCGGGGAGGCACGACGAGATCGACATGGAGCTGCTGGGCACCGTGCCGGGGGAGCCCTACACGCTGCAGACCAACGTGTACGTGCGGGGCACCGGCGACGGCGCGCGCCTCGTGGGCCGGGAGATGCGCTTCCACCTCTGGTTCGACCCGGCCGCCGACTTCCACCACTACGCCATCCTCTGGAACCCCGACCAGATCGTCTTCCTCGTCGACGACGTCCCCATCAGGCGCTACGCCGCCGCCAGTGCGCCGTTCTTCCCCGACCGCCAGATGTGGGCGTACGGCTCCATCTGGGACGCCTCCGACTGGGCCACCGACGGCGGCCGCTACAGGGCCGACTACCGCTACCAGCCCTTCCTGGCGGGATTCCGGGGGTTCAGGACCGCCGGATGCGAGGACGCCCAGTGCCGTCCCGTGCCGGCGTCCCCCGCCGGCGCCGGACTCAGCGTGCAGCAGCGGGACGCCATGCGCTGGGCGCAGCAGACCTCCATGGTCTACTACTACTGCCAGGATTACACCAAGGATCGCTCCTTGTACCCAGAGTGCTCGCTCGCTAGCTAGCCTAGCTACCACTACCAGAGCAAGAGCATGCATGGAGGAGGCGTGCGAGTGAAGAAGCGCCGCCCTACGTACGTACCGTTCTAAAATTGTATGTACAATTAAGTCTCCATCCACATCCATATATACATATGTAATGTATAATTAAGTCCATTATTAATTTAATCATCAAAAAATGGAACATGCCTATATATTTCCT

SEQ ID NO: 757 - DNA, 1479 bp, Zea mays
  misc_feature (1)..(1479): Ceres cDNA ID no. 12364992
  misc_feature (1)..(1479): Ceres CLONE  ID no. 225486
  misc_feature (1)..(1479): Also known as  Ceres CDNA ID no. 23777251
atccgccgcccgcgcacttcttccttcgggcacacaggacaccaccgtcgacggattcatcgcgacgatggggctcgacgtcatggagatcgggatgggcgccgatttgagcctggatctgaggcacttcgcctccaaggccgtgaggcagagcaaggacgacacgccggcgccggacatggacgcatgcatccgccgcctcgaggaggagcggggtaagatcgagatgttcaagcgggacctcccgctctgcgcgcgcctcctcgccgacgtaattgatgtcatgaaggaggaggcggggaagaagaagacgacgacaaggaggagtgaccgcaggctggcgtctgcggcagctgatgaggaggaggaggaggaggacggcgccaccgcggacaagagcaagtggatgagcacggcgcagctctggacgggcgattccgggcgggaggacggggaatcagagaagcaagacaaggggcggtgctcgccggaggccaggtcccgcggcgctctcttaccgttcaaggctgatgtgggttctggcgcgccggcgttggcgccgctctgcttgagaacggacgacaaggctgcggctgcgcgcgtcggggtgccggatctgtcgtccttgctgtcgccgccggcgaccatgcctcctgcggacgccggcgccgaggagagccgtcgccaggttgtgggatttgcgcaagctgcggccagggcggctgccatggccccgtgtgcccctgcgcttgggctccagtcccagtcgcagcagcagcagcagcagcagcagcaggcaaggaaggctcggcgttgctggtcgacggagctgcatcgcaagttcgtcgccgccttggatcagctcggtggcccccaagttgccacgccgaagcaaatcagggagctgatgaaggtggatgggctgacaaacgacgaagtgaaaagccatcttcagaaataccggctgcacaaccggagggcgcctggatccggcgtggtgcgccagccgatcgtgctcgtgggagggctgtggattccccaggagcaaggcagccctcagtctggatctccccacggccccctccaccacctgtccacctcggtggccgccgtctcgtccgccgccaccgccagctgcgaggaggaagacggccggtccgagagctatggctggcaatgatgtctggctgctgctgctgctgcaccaccaatgtgtgttcactgttcagagaggggaggtttcttggcatggtggggatcgccatgggccatggcggaggccaccagttgcagcttcaggaatcgggaggggaattgagtgtagtgtagctgtctgtacacatacatacatacatacagtgagatgggatgagatgagagcgggccttgagcgctcgagatcagaactgatggtgcttcgtcgtcgggtttgtacatcccaaagagaaagagatactagctacagttttgcggcttgct

SEQ ID NO: 758 - protein, 1479 aa, Zea mays
  misc_feature: PFam Name: Myb_DNA-binding; PFam Description: Myb-like
  misc_feature: GI Number: 50933785; NR Description: putative cytoskeletal protein-like protein [Oryza sativa (japonica cultivar-group)] >gi|33146555|dbj|BAC79732.1| putative cytoskeletal protein-like
  misc_feature: GI Number: 34910306; NR Description: P0013F10.12 [Oryza sativa (japonica cultivar-group)] >gi|11034542|dbj|BAB17066.1|
  misc_feature: GI Number: 14532434; NR Description: AT4g37180/C7A10_180
  misc_feature: GI Number: 18419989; NR Description: myb family transcription
  misc_feature: GI Number: 30690890; NR Description: myb family transcription
ATCCGCCGCCCGCGCACTTCTTCCTTCGGGCACACAGGACACCACCGTCGACGGATTCATCGCGACGATGGGGCTCGACGTCATGGAGATCGGGATGGGCGCCGATTTGAGCCTGGATCTGAGGCACTTCGCCTCCAAGGCCGTGAGGCAGAGCAAGGACGACACGCCGGCGCCGGACATGGACGCATGCATCCGCCGCCTCGAGGAGGAGCGGGGTAAGATCGAGATGTTCAAGCGGGACCTCCCGCTCTGCGCGCGCCTCCTCGCCGACGTAATTGATGTCATGAAGGAGGAGGCGGGGAAGAAGAAGACGACGACAAGGAGGAGTGACCGCAGGCTGGCGTCTGCGGCAGCTGATGAGGAGGAGGAGGAGGAGGACGGCGCCACCGCGGACAAGAGCAAGTGGATGAGCACGGCGCAGCTCTGGACGGGCGATTCCGGGCGGGAGGACGGGGAATCAGAGAAGCAAGACAAGGGGCGGTGCTCGCCGGAGGCCAGGTCCCGCGGCGCTCTCTTACCGTTCAAGGCTGATGTGGGTTCTGGCGCGCCGGCGTTGGCGCCGCTCTGCTTGAGAACGGACGACAAGGCTGCGGCTGCGCGCGTCGGGGTGCCGGATCTGTCGTCCTTGCTGTCGCCGCCGGCGACCATGCCTCCTGCGGACGCCGGCGCCGAGGAGAGCCGTCGCCAGGTTGTGGGATTTGCGCAAGCTGCGGCCAGGGCGGCTGCCATGGCCCCGTGTGCCCCTGCGCTTGGGCTCCAGTCCCAGTCGCAGCAGCAGCAGCAGCAGCAGCAGCAGGCAAGGAAGGCTCGGCGTTGCTGGTCGACGGAGCTGCATCGCAAGTTCGTCGCCGCCTTGGATCAGCTCGGTGGCCCCCAAGTTGCCACGCCGAAGCAAATCAGGGAGCTGATGAAGGTGGATGGGCTGACAAACGACGAAGTGAAAAGCCATCTTCAGAAATACCGGCTGCACAACCGGAGGGCGCCTGGATCCGGCGTGGTGCGCCAGCCGATCGTGCTCGTGGGAGGGCTGTGGATTCCCCAGGAGCAAGGCAGCCCTCAGTCTGGATCTCCCCACGGCCCCCTCCACCACCTGTCCACCTCGGTGGCCGCCGTCTCGTCCGCCGCCACCGCCAGCTGCGAGGAGGAAGACGGCCGGTCCGAGAGCTATGGCTGGCAATGATGTCTGGCTGCTGCTGCTGCTGCACCACCAATGTGTGTTCACTGTTCAGAGAGGGGAGGTTTCTTGGCATGGTGGGGATCGCCATGGGCCATGGCGGAGGCCACCAGTTGCAGCTTCAGGAATCGGGAGGGGAATTGAGTGTAGTGTAGCTGTCTGTACACATACATACATACATACAGTGAGATGGGATGAGATGAGAGCGGGCCTTGAGCGCTCGAGATCAGAACTGATGGTGCTTCGTCGTCGGGTTTGTACATCCCAAAGAGAAAGAGATACTAGCTACAGTTTTGCGGCTTGCT

SEQ ID NO: 759 - DNA, 1641 bp, Zea mays
  misc_feature (1)..(1641): Ceres cDNA ID no. 12365124
  misc_feature (1)..(1641): Ceres CLONE  ID no. 237122
  misc_feature (1)..(1641): Also known as  Ceres CDNA ID no. 23772709
  misc_feature (1137)..(1137): n is a, c, t, g, unknown, or other
  misc_feature (1139)..(1139): n is a, c, t, g, unknown, or other
aacacggccacaccccgacaccggcatggccacatccctttcccttaaatagacgccatcgccgccgagccgcgcattgggatcgtgcggcaatggcggcggcggcggcggcgcacgtgctggtgttcccggcccctgcgcagggccacctcaacagtttcctccacttctccacggggctcctccgcgcgggcctccacgtcaccttcctgcacaccgaccacaacctccgccgcctcggtactgctgccgccgaggctacggtcgcctcgccgcgtctccgcttcctatccgtgcccgacggcctccccgacgacgacccgcgcaccgtcgacggcctcccggagctcatggagtccctgcgcaccaaggccagcgcctcgtaccgcgcactgctcgcctcgctgcgcgcgggaggcggaggcttcccgccggtgacgtgcgtcgttgccgacggcataatgccgttcgtggtcgacgtcgcagaggagcttggagtcccggcgatctccttccgtacggtgagcgcgtgcgcggtcctggcgtacctgtccgtgcccaagctcatcgccctcggcgagctccccttccccaaaggtggcgacctcgacgcgcccatccgcggcgtcccggggatggagagcttcctgcgtcgacgagacctcccgatccagttccgccagctcaccagcacgtacgaggagcccttggtagcgggcggtggtcgcggccaccgtgcacagctgctgcaaggccagagctctcatcgtcaacacgaccacgtccctggagaggtcatccctcgggcacctcacgcaggagatgcgcgacgtattcgccgtcgggcctctgcacgccatgtcccccgcgccggcggtggcctcgagcctgtggcgccccgacgacgggtgcatggcgtggctcgacaaccagcaggcggagcgggccgtggtgtacatcagcctgggtagcctcgccgtcatctcccacgagcagttcaccgagttcctgcacgggctcgtcgccaccggctacccgttcctctgggtgctccggccggatatgctcgtggccagccaggacgccgcgctccgggaagccatcggcgcggtcgggaaagacagggcgtgcgtcgtncngtgggtgccgcagcgagacgtgctgcggcaccgcgccgtggggtgctttctgacgcacagcgggtggaactcgacgatggagggcatcgtcgagggcgtgcccatggtgtgctggcccttcttcgccgaccagcagatcaacagccgcttcgtaggcgccgtgtggaggaacgggctggacatgaaggacgtgtgcgacagagttgtggtggagagcacggtgagggaagcaatggagtccgaagagatcaggaggtcggttcatgctctggcggagcaggtgaagcgtgacgtcgccgacgacggggcatcggcgttggaattcaagcgcctcatcagcttcatcacggagctcagcacgtcagcagcacagggaaccccatcttcaaaatcgtgaagtgaatgaatgaatcgaaagtaaacttgatagatacgcaccggattcaacaaccggctgaggggtgttttggaatgttatttttgaaggaatttctattttctc

SEQ ID NO: 760 - protein, 1641 aa, Zea mays
  misc_feature: PFam Name: UDPGT; PFam Description: UDP-glucoronosyl and
  misc_feature: PFam Name: Glyco_transf_28; PFam Description:
  misc_feature: PFam Name: Peptidase_S8; PFam Description: Subtilase family
  misc_feature: GI Number: 50898576; NR Description: UDP-glucose glucosyltransferase-like protein [Oryza sativa (japonica cultivar-group)] >gi|47496949|dbj|BAD20019.1| UDP-glucose glucosyltransferase-like protein [Oryza sativa (japonica
  misc_feature: GI Number: 50937249; NR Description: putative UDP-glucose glucosyltransferase [Oryza sativa (japonica cultivar-group)] >gi|34394122|dbj|BAC84378.1| putative UDP-glucose
  misc_feature: GI Number: 50937225; NR Description: putative UDP-glucose glucosyltransferase [Oryza sativa (japonica cultivar-group)] >gi|50937205|ref|XP_478130.1| putative glucosyltransferase-2 [Oryza
  misc_feature: GI Number: 50937251; NR Description: putative glucosyltransferase-12 [Oryza sativa (japonica cultivar-group)] >gi|33146981|dbj|BAC80053.1| putative glucosyltransferase-12 [Oryza sativa (japonica cultivar-group)]
  misc_feature: GI Number: 50937197; NR Description: putative glucosyltransferase-2 [Oryza sativa (japonica cultivar-group)] >gi|28564775|dbj|BAC57706.1| putative glucosyltransferase-2 [Oryza
AACACGGCCACACCCCGACACCGGCATGGCCACATCCCTTTCCCTTAAATAGACGCCATCGCCGCCGAGCCGCGCATTGGGATCGTGCGGCAATGGCGGCGGCGGCGGCGGCGCACGTGCTGGTGTTCCCGGCCCCTGCGCAGGGCCACCTCAACAGTTTCCTCCACTTCTCCACGGGGCTCCTCCGCGCGGGCCTCCACGTCACCTTCCTGCACACCGACCACAACCTCCGCCGCCTCGGTACTGCTGCCGCCGAGGCTACGGTCGCCTCGCCGCGTCTCCGCTTCCTATCCGTGCCCGACGGCCTCCCCGACGACGACCCGCGCACCGTCGACGGCCTCCCGGAGCTCATGGAGTCCCTGCGCACCAAGGCCAGCGCCTCGTACCGCGCACTGCTCGCCTCGCTGCGCGCGGGAGGCGGAGGCTTCCCGCCGGTGACGTGCGTCGTTGCCGACGGCATAATGCCGTTCGTGGTCGACGTCGCAGAGGAGCTTGGAGTCCCGGCGATCTCCTTCCGTACGGTGAGCGCGTGCGCGGTCCTGGCGTACCTGTCCGTGCCCAAGCTCATCGCCCTCGGCGAGCTCCCCTTCCCCAAAGGTGGCGACCTCGACGCGCCCATCCGCGGCGTCCCGGGGATGGAGAGCTTCCTGCGTCGACGAGACCTCCCGATCCAGTTCCGCCAGCTCACCAGCACGTACGAGGAGCCCTTGGTAGCGGGCGGTGGTCGCGGCCACCGTGCACAGCTGCTGCAAGGCCAGAGCTCTCATCGTCAACACGACCACGTCCCTGGAGAGGTCATCCCTCGGGCACCTCACGCAGGAGATGCGCGACGTATTCGCCGTCGGGCCTCTGCACGCCATGTCCCCCGCGCCGGCGGTGGCCTCGAGCCTGTGGCGCCCCGACGACGGGTGCATGGCGTGGCTCGACAACCAGCAGGCGGAGCGGGCCGTGGTGTACATCAGCCTGGGTAGCCTCGCCGTCATCTCCCACGAGCAGTTCACCGAGTTCCTGCACGGGCTCGTCGCCACCGGCTACCCGTTCCTCTGGGTGCTCCGGCCGGATATGCTCGTGGCCAGCCAGGACGCCGCGCTCCGGGAAGCCATCGGCGCGGTCGGGAAAGACAGGGCGTGCGTCGTNCNGTGGGTGCCGCAGCGAGACGTGCTGCGGCACCGCGCCGTGGGGTGCTTTCTGACGCACAGCGGGTGGAACTCGACGATGGAGGGCATCGTCGAGGGCGTGCCCATGGTGTGCTGGCCCTTCTTCGCCGACCAGCAGATCAACAGCCGCTTCGTAGGCGCCGTGTGGAGGAACGGGCTGGACATGAAGGACGTGTGCGACAGAGTTGTGGTGGAGAGCACGGTGAGGGAAGCAATGGAGTCCGAAGAGATCAGGAGGTCGGTTCATGCTCTGGCGGAGCAGGTGAAGCGTGACGTCGCCGACGACGGGGCATCGGCGTTGGAATTCAAGCGCCTCATCAGCTTCATCACGGAGCTCAGCACGTCAGCAGCACAGGGAACCCCATCTTCAAAATCGTGAAGTGAATGAATGAATCGAAAGTAAACTTGATAGATACGCACCGGATTCAACAACCGGCTGAGGGGTGTTTTGGAATGTTATTTTTGAAGGAATTTCTATTTTCTC

SEQ ID NO: 761 - DNA, 1691 bp, Zea mays
  misc_feature (1)..(1691): Ceres cDNA ID no. 12365235
  misc_feature (1)..(1691): Ceres CLONE  ID no. 243030
  misc_feature (1)..(1691): Also known as  Ceres CDNA ID no. 23757200
ctgggccgttactagcttagctcatatacgtacgtacgcaggctgcaagtgatcgagaggagcaatataatggctggttcttccatggacactgaagctgcaggcaaggagctcaagcagggcagcggcggcggcggcggctacaccatgccggctactgctcatgcggtggacacagactcgtggcagcaggtggggctgctcctggtgatcggcttcaactgcgcctacgtgctcagcttctccaacctcatgatggtgcccctgggctgggcgtggggcgtcgcctgcctgctgctcgtcggcgccgccgcgtggtacgccaactggctcctcgccggcctccacttcgtcgacggccagaggttcatccgctacagggacctcatgggcttcatattcgggaggaacatgtactacatcacctggttcctgcagttcgcaactctacttctgtgcaacatgggcttcattttgctaggagcaagagcgctcaaggcaatcaacacggagtttacccacaccccagccaggctgcagtggttcatcacggccacgggaatcgtctacttcgccttcgcctacttcgtgccgacgatttctgccatgaggaactggctcgccacgtcggcggcgctgacgttagcttacgacgtcgctctgctggctatcttgatcagagatgggaaatcgaacaagcagaaggactatgacgtccatgccggatcccaagccgagaaggtgttcaacgcgttgggcgccgtcgctgccatcctcgtctgcaacacgtccgggctgctcccggagatacagtcgacggtgcgggagccggcggtgcgcggcatgaggcgggcgctgctgctgcagtacaccgccggcgccgcggggtactacggcatcagcgtggcggggtactgggcgtacgggtcagcggtgtcggagtacctccccaacgagctcggcggcccgaggtgggccgccgtcctcatcaacgccaccgccttcctgcagagcattgtgtcccaacacctgtttacggtgccgatccacgaggcgatggacacgcggctgcagcggctggacgaaggcatattctcccgctacaacctcacgcgccgcgtgcgcgcgggggctcgtcttcggcttcaacgtcttcgtcaccgcgctgttcccgttcatgggggatttcgtcaacctcgtcggctccttagcgctcgtcccgctcaccttcacgttccccagcatggccgtcctcaagatcaaaggcaagagctgtgggagatgtaacagactttggcattggggcatcatagttctgtcctcggctctctgcgttgctaccaccgccgccgccgttcgtttgatcttcaacaatgctaggatctaccacttcttcgccgacatgtagcgagcgagtagtagtgggattgacatgtgtatcgtcaccatgaggtgatagtatggccacttcgttctcaattttttgtttgcttcaagagtggaagggtacggtggtcacttagctcatgtttgataatggcactacatgattaataagcatgcatcatgtacgtagtcatcctatcaaaatttagaaatgagcttattgtaatcgatggaccacctccctctaaccaaacatctctgttttccgtgaaagcttaaaaggcaactcgtgaatgtgttctttt

SEQ ID NO: 762 - protein, 1691 aa, Zea mays
  misc_feature: PFam Name: Aa_trans; PFam Description: Transmembrane amino
  misc_feature: GI Number: 50902312; NR Description: proline transport protein-like [Oryza sativa (japonica cultivar-group)] >gi|20804893|dbj|BAB92574.1| proline transport protein-like [Oryza sativa (japonica cultivar-group)]
  misc_feature: GI Number: 53749423; NR Description: proline transporter, putative [Oryza sativa (japonica cultivar-group)] >gi|11358960|pir||T50690 proline transport protein [imported] -
  misc_feature: GI Number: 31376371; NR Description: At3g55740 [Arabidopsis thaliana] >gi|7263562|emb|CAB81599.1| proline transporter 2 [Arabidopsis thaliana] >gi|1769903|emb|CAA65053.1| proline transporter 2 [Arabidopsis thaliana] >gi|19698891|gb|AAL91181.1|
  misc_feature: GI Number: 28393251; NR Description: putative proline transporter [Arabidopsis thaliana] >gi|4581157|gb|AAD24641.1| putative proline transporter [Arabidopsis thaliana] >gi|25408488|pir||D84782 probable proline transporter [imported]
  misc_feature: GI Number: 4584850; NR Description: proline transporter 2 [Lycopersicon esculentum] >gi|11358949|pir||T50688 proline
CTGGGCCGTTACTAGCTTAGCTCATATACGTACGTACGCAGGCTGCAAGTGATCGAGAGGAGCAATATAATGGCTGGTTCTTCCATGGACACTGAAGCTGCAGGCAAGGAGCTCAAGCAGGGCAGCGGCGGCGGCGGCGGCTACACCATGCCGGCTACTGCTCATGCGGTGGACACAGACTCGTGGCAGCAGGTGGGGCTGCTCCTGGTGATCGGCTTCAACTGCGCCTACGTGCTCAGCTTCTCCAACCTCATGATGGTGCCCCTGGGCTGGGCGTGGGGCGTCGCCTGCCTGCTGCTCGTCGGCGCCGCCGCGTGGTACGCCAACTGGCTCCTCGCCGGCCTCCACTTCGTCGACGGCCAGAGGTTCATCCGCTACAGGGACCTCATGGGCTTCATATTCGGGAGGAACATGTACTACATCACCTGGTTCCTGCAGTTCGCAACTCTACTTCTGTGCAACATGGGCTTCATTTTGCTAGGAGCAAGAGCGCTCAAGGCAATCAACACGGAGTTTACCCACACCCCAGCCAGGCTGCAGTGGTTCATCACGGCCACGGGAATCGTCTACTTCGCCTTCGCCTACTTCGTGCCGACGATTTCTGCCATGAGGAACTGGCTCGCCACGTCGGCGGCGCTGACGTTAGCTTACGACGTCGCTCTGCTGGCTATCTTGATCAGAGATGGGAAATCGAACAAGCAGAAGGACTATGACGTCCATGCCGGATCCCAAGCCGAGAAGGTGTTCAACGCGTTGGGCGCCGTCGCTGCCATCCTCGTCTGCAACACGTCCGGGCTGCTCCCGGAGATACAGTCGACGGTGCGGGAGCCGGCGGTGCGCGGCATGAGGCGGGCGCTGCTGCTGCAGTACACCGCCGGCGCCGCGGGGTACTACGGCATCAGCGTGGCGGGGTACTGGGCGTACGGGTCAGCGGTGTCGGAGTACCTCCCCAACGAGCTCGGCGGCCCGAGGTGGGCCGCCGTCCTCATCAACGCCACCGCCTTCCTGCAGAGCATTGTGTCCCAACACCTGTTTACGGTGCCGATCCACGAGGCGATGGACACGCGGCTGCAGCGGCTGGACGAAGGCATATTCTCCCGCTACAACCTCACGCGCCGCGTGCGCGCGGGGGCTCGTCTTCGGCTTCAACGTCTTCGTCACCGCGCTGTTCCCGTTCATGGGGGATTTCGTCAACCTCGTCGGCTCCTTAGCGCTCGTCCCGCTCACCTTCACGTTCCCCAGCATGGCCGTCCTCAAGATCAAAGGCAAGAGCTGTGGGAGATGTAACAGACTTTGGCATTGGGGCATCATAGTTCTGTCCTCGGCTCTCTGCGTTGCTACCACCGCCGCCGCCGTTCGTTTGATCTTCAACAATGCTAGGATCTACCACTTCTTCGCCGACATGTAGCGAGCGAGTAGTAGTGGGATTGACATGTGTATCGTCACCATGAGGTGATAGTATGGCCACTTCGTTCTCAATTTTTTGTTTGCTTCAAGAGTGGAAGGGTACGGTGGTCACTTAGCTCATGTTTGATAATGGCACTACATGATTAATAAGCATGCATCATGTACGTAGTCATCCTATCAAAATTTAGAAATGAGCTTATTGTAATCGATGGACCACCTCCCTCTAACCAAACATCTCTGTTTTCCGTGAAAGCTTAAAAGGCAACTCGTGAATGTGTTCTTTT

SEQ ID NO: 763 - DNA, 1401 bp, Zea mays
  misc_feature (1)..(1401): Ceres cDNA ID no. 12365249
  misc_feature (1)..(1401): Ceres CLONE  ID no. 257973
  misc_feature (1)..(1401): Also known as  Ceres CDNA ID no. 23756672
agttcgtttctccgctggcgctgagacgttctcgatcgtacgtgtacgtacgtccaggttcgtggccgtcggcaacgagccgttcctcagggcgtacaacggctcgttcgaccacgtgacggtgccggcgctcaggaacatccagcgcgcgctggacgaggccgggcacggcgcggcggtcaaggcaacggtccccgtcaacgcggacgtgtacgattcgccggcgagcaacccggtgccgtcggcagggaggttccgcagcgacgtggcgcgggtcatggcggacatggtccgcgtcctcaaccgcagcggcgcgccgctcaccgtcaacatctacccgttcctcagcctgtacgggaacgacgacttcccgctggactacgccttcttcgatggcggcgccggtgcgccggtggtcgacggccgggccgtctacaccaacgtgttcgacgccaacttcgacacgctggtgtcggcgctcaagagggtcgggctcggccacctgccggtcatcatcggcgaggtcggctggccgacggacggcgacaggcacgccacggcggccctcgcggagcgcttctacgcggggctcctccagcggctcgcggccaggagaggcacgccgctccggcccggcgcgcgcatcgaggcctacctgttcgggctcgtggacgaggacgccaagagcgtggcgccgggcaacttcgagcgccactggggaatcttcaccttcgacgggcggcccaagttcccgctggacctgcgcggcgacgggcggccggcgatgcccgtcccggcccggggcgtggagtacctgccccggcggtggtgcgtcctgaaccccatcagcatggccggggacggacggctcccggacaacgtcgcgtacgcgtgctcccgcgccgactgcacggcgctaggctacgggtgcagctgcggcgcgctggacgcgcgcgggaacgcgtcgtacgccttcaacgcctattaccaggcacagggacaggtggagtcggcgtgcgacttccaggggctcgccgtcgtcgtcgacgaggacgcgtctcagggcgcctgcaacttcagcgtgcagctcgttgggtcaggggctccggtggccaccggggtcaccacgatggcggccgtactggtggctctgtttcttgtgttgatttgagctgacgcaaggtgtggtgcttgcctgcctgactggaatcctgatgactgtactgtacagtgttggtcccctacagtgatgtactaaggcgggctccaacaagaccctctaaagggttctgtaccctaaatttagaggatacccctccagcaacgtcctctaaacggtcctctaaatttagagaacgctgctggatcctctatatgtagagtttctctaaacggttctct

SEQ ID NO: 764 - protein, 1401 aa, Zea mays
  misc_feature: PFam Name: Glyco_hydro_17; PFam Description: Glycosyl
  misc_feature: PFam Name: X8; PFam Description: X8 domain
  misc_feature: PFam Name: Peptidase_S8; PFam Description: Subtilase family
  misc_feature: GI Number: 48374979; NR Description: putative 3-glucanase
  misc_feature: GI Number: 50919115; NR Description: putative beta-1,3 glucanase [Oryza sativa (japonica cultivar-group)] >gi|28269434|gb|AAO37977.1| putative beta-1,3 glucanase [Oryza
  misc_feature: GI Number: 18483232; NR Description: 3-glucanase [Sorghum bicolor]
  misc_feature: GI Number: 46518473; NR Description: At1g64760 [Arabidopsis
  misc_feature: GI Number: 4191774; NR Description: putative beta-1,3-glucanase [Arabidopsis thaliana] >gi|20197008|gb|AAM14870.1| putative beta-1,3-glucanase [Arabidopsis thaliana] >gi|25411906|pir||G84576 probable beta-1,3-glucanase [imported] -
AGTTCGTTTCTCCGCTGGCGCTGAGACGTTCTCGATCGTACGTGTACGTACGTCCAGGTTCGTGGCCGTCGGCAACGAGCCGTTCCTCAGGGCGTACAACGGCTCGTTCGACCACGTGACGGTGCCGGCGCTCAGGAACATCCAGCGCGCGCTGGACGAGGCCGGGCACGGCGCGGCGGTCAAGGCAACGGTCCCCGTCAACGCGGACGTGTACGATTCGCCGGCGAGCAACCCGGTGCCGTCGGCAGGGAGGTTCCGCAGCGACGTGGCGCGGGTCATGGCGGACATGGTCCGCGTCCTCAACCGCAGCGGCGCGCCGCTCACCGTCAACATCTACCCGTTCCTCAGCCTGTACGGGAACGACGACTTCCCGCTGGACTACGCCTTCTTCGATGGCGGCGCCGGTGCGCCGGTGGTCGACGGCCGGGCCGTCTACACCAACGTGTTCGACGCCAACTTCGACACGCTGGTGTCGGCGCTCAAGAGGGTCGGGCTCGGCCACCTGCCGGTCATCATCGGCGAGGTCGGCTGGCCGACGGACGGCGACAGGCACGCCACGGCGGCCCTCGCGGAGCGCTTCTACGCGGGGCTCCTCCAGCGGCTCGCGGCCAGGAGAGGCACGCCGCTCCGGCCCGGCGCGCGCATCGAGGCCTACCTGTTCGGGCTCGTGGACGAGGACGCCAAGAGCGTGGCGCCGGGCAACTTCGAGCGCCACTGGGGAATCTTCACCTTCGACGGGCGGCCCAAGTTCCCGCTGGACCTGCGCGGCGACGGGCGGCCGGCGATGCCCGTCCCGGCCCGGGGCGTGGAGTACCTGCCCCGGCGGTGGTGCGTCCTGAACCCCATCAGCATGGCCGGGGACGGACGGCTCCCGGACAACGTCGCGTACGCGTGCTCCCGCGCCGACTGCACGGCGCTAGGCTACGGGTGCAGCTGCGGCGCGCTGGACGCGCGCGGGAACGCGTCGTACGCCTTCAACGCCTATTACCAGGCACAGGGACAGGTGGAGTCGGCGTGCGACTTCCAGGGGCTCGCCGTCGTCGTCGACGAGGACGCGTCTCAGGGCGCCTGCAACTTCAGCGTGCAGCTCGTTGGGTCAGGGGCTCCGGTGGCCACCGGGGTCACCACGATGGCGGCCGTACTGGTGGCTCTGTTTCTTGTGTTGATTTGAGCTGACGCAAGGTGTGGTGCTTGCCTGCCTGACTGGAATCCTGATGACTGTACTGTACAGTGTTGGTCCCCTACAGTGATGTACTAAGGCGGGCTCCAACAAGACCCTCTAAAGGGTTCTGTACCCTAAATTTAGAGGATACCCCTCCAGCAACGTCCTCTAAACGGTCCTCTAAATTTAGAGAACGCTGCTGGATCCTCTATATGTAGAGTTTCTCTAAACGGTTCTCT

SEQ ID NO: 765 - DNA, 1523 bp, Zea mays
  misc_feature (1)..(1523): Ceres cDNA ID no. 12365642
  misc_feature (1)..(1523): Ceres CLONE  ID no. 294135
  misc_feature (1)..(1523): Also known as  Ceres CDNA ID no. 23761503
atgagaaaaatagaaaattcctccaaaccctaagcccctctctgctcacctctgtactccgaatctgctcccaagtctgctagggtttaacgctcgcgtcctcctcacgcattcggtctggtcgctgatcttcgcttgttcgattccgctcggctctaggacccaggctctcgaggcggctggagtggcggcgcgacgagagggtgaagcggatgcagacggaggcgagggtggggatggccgccgccacgatggacggcaccggcgccgcggcgtccgccgcccggaggtacacgacgcagcagcagcagcagcagctgcagcaccaccagccgcagctcgggaccgtgccccatctcctcgccggcggcgtcgctggcgcagtcagcaagacctgcaccgccccgctcgcacgcctcaccatcctctttcaggtacaaggaatgcactcagatgtggctacaatgcgcaatactagcatatggcgtgaagcatcccgcattgtctatggagaaggttttcgagctttctggaaagggaaccttgttaccattgctcaccggttgccttactcttcaattagtttctatgcctatgagagatacaagaatttgcttcagatgctaccgggtcttgagaagaatggtggatttggtgcagatgttggtgttagattgctaggtggtggtttatcaggaatcactgcagcttctgtgacgtatccactggacttggtgcggacacgtcttgctgcccagacaaatactgcctactacaggggcatatctcatgctctttatgcgatctgcagagatgagggtgtccgtggattgtacaagggtcttggtgccactttactgggagtgggccccagcattgcagtaagcttctctgtgtatgaaactttacgttcccattggcaaatagagaggccatgtgattcccctgttctgatcagtttggcttgtggaagtctttcaggaattgcatcatctacttttacattcccgttggatcttgtgagacgtcgcatgcaattggaaggagcagccgggagggctcgcgtctaccagacaggactttttggaaccttcggacatattgtccgtacggagggttttagaggcatgtatagaggaatcttgcctgagtactgcaaagtggttcctggtgtcggcatcgtatttatgacatatgagatgcttaaggccatcctcacaggactggaatctgatgattagatatctgcgaggtcatgctacacaattttgatacatggtgtcagaacaacatttgaggctgattagactgggagaaatatgagcatgtagcatacgttagggtttaggatgtgctaaggtttgcagtttgtgttatatggttacagatgtttatgtagtgcaccgtgaaagatgccacaggtcttccaaaatgaatatttttttggcatcaccaccattttgtgtatcttcaataacattgtaatggtacatgaagctgttgtctttagcctgatgatcttt

SEQ ID NO: 766 - protein, 1523 aa, Zea mays
  misc_feature: PFam Name: Mito_carr; PFam Description: Mitochondrial
  misc_feature: GI Number: 34902034; NR Description: putative peroxisomal Ca-dependent solute carrier protein [Oryza sativa (japonica cultivar-group)] >gi|29893633|gb|AAP06887.1| putative peroxisomal
  misc_feature: GI Number: 34895726; NR Description: putative peroxisomal Ca-dependent solute carrier protein [Oryza sativa (japonica cultivar-group)] >gi|10798831|dbj|BAB16462.1| putative peroxisomal Ca-dependent solute carrier protein [Oryza sativa
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
  misc_feature: GI Number: 51970652; NR Description: mitochondrial carrier
ATGAGAAAAATAGAAAATTCCTCCAAACCCTAAGCCCCTCTCTGCTCACCTCTGTACTCCGAATCTGCTCCCAAGTCTGCTAGGGTTTAACGCTCGCGTCCTCCTCACGCATTCGGTCTGGTCGCTGATCTTCGCTTGTTCGATTCCGCTCGGCTCTAGGACCCAGGCTCTCGAGGCGGCTGGAGTGGCGGCGCGACGAGAGGGTGAAGCGGATGCAGACGGAGGCGAGGGTGGGGATGGCCGCCGCCACGATGGACGGCACCGGCGCCGCGGCGTCCGCCGCCCGGAGGTACACGACGCAGCAGCAGCAGCAGCAGCTGCAGCACCACCAGCCGCAGCTCGGGACCGTGCCCCATCTCCTCGCCGGCGGCGTCGCTGGCGCAGTCAGCAAGACCTGCACCGCCCCGCTCGCACGCCTCACCATCCTCTTTCAGGTACAAGGAATGCACTCAGATGTGGCTACAATGCGCAATACTAGCATATGGCGTGAAGCATCCCGCATTGTCTATGGAGAAGGTTTTCGAGCTTTCTGGAAAGGGAACCTTGTTACCATTGCTCACCGGTTGCCTTACTCTTCAATTAGTTTCTATGCCTATGAGAGATACAAGAATTTGCTTCAGATGCTACCGGGTCTTGAGAAGAATGGTGGATTTGGTGCAGATGTTGGTGTTAGATTGCTAGGTGGTGGTTTATCAGGAATCACTGCAGCTTCTGTGACGTATCCACTGGACTTGGTGCGGACACGTCTTGCTGCCCAGACAAATACTGCCTACTACAGGGGCATATCTCATGCTCTTTATGCGATCTGCAGAGATGAGGGTGTCCGTGGATTGTACAAGGGTCTTGGTGCCACTTTACTGGGAGTGGGCCCCAGCATTGCAGTAAGCTTCTCTGTGTATGAAACTTTACGTTCCCATTGGCAAATAGAGAGGCCATGTGATTCCCCTGTTCTGATCAGTTTGGCTTGTGGAAGTCTTTCAGGAATTGCATCATCTACTTTTACATTCCCGTTGGATCTTGTGAGACGTCGCATGCAATTGGAAGGAGCAGCCGGGAGGGCTCGCGTCTACCAGACAGGACTTTTTGGAACCTTCGGACATATTGTCCGTACGGAGGGTTTTAGAGGCATGTATAGAGGAATCTTGCCTGAGTACTGCAAAGTGGTTCCTGGTGTCGGCATCGTATTTATGACATATGAGATGCTTAAGGCCATCCTCACAGGACTGGAATCTGATGATTAGATATCTGCGAGGTCATGCTACACAATTTTGATACATGGTGTCAGAACAACATTTGAGGCTGATTAGACTGGGAGAAATATGAGCATGTAGCATACGTTAGGGTTTAGGATGTGCTAAGGTTTGCAGTTTGTGTTATATGGTTACAGATGTTTATGTAGTGCACCGTGAAAGATGCCACAGGTCTTCCAAAATGAATATTTTTTTGGCATCACCACCATTTTGTGTATCTTCAATAACATTGTAATGGTACATGAAGCTGTTGTCTTTAGCCTGATGATCTTT

SEQ ID NO: 767 - DNA, 1276 bp, Zea mays
  misc_feature (1)..(1276): Ceres cDNA ID no. 12365996
  misc_feature (1)..(1276): Ceres CLONE  ID no. 327761
  misc_feature (1)..(1276): Also known as  Ceres CDNA ID no. 23767332
gtaggattgtgggactcccagctggtggagtggagcttccgagtgtccactccaattctccaacgccagggtgttgcagacttgcaggcagtggaacatggacaaggaaggcgacggccaccaccaccacgccatccgagtcccatccccagataacatagcaatggtggaggagacatcgcagccaaatggcgcaccgtcgctgagacggaaagcaggcgagatgatcgccacctccctggagacgtaccggagcaagcccttctccttctggctactcctgttcctgagcagcggcgccatgctcaccgcgttcccggcgtcgagcctcctgtcgcggctctactacaacgagggcgggcagagcaagtggatcctgtcgtgggcggccgtcgccggctggcccctgcccgcgctgctcctgctgccgctgtatctcctcggcagggcgtcgccgacgccgctgtcgctgtcgctgtgctcctggtacgtgctccttgggctcctcagcgccgccgacaacctcatgtacgcgtgggcctacgcgtacctcccggcgtccacggcctcgctcgtcgccgcgtcgtcgctcgccttctccgcgctcttcggccgcgccatcgccaagaaccggctcaacatgtcctcgctcaacgccgtcgtcgtgatcacggcgggcgtggtgatcgtcgcgctggactccgggtcggacaggccccccggcgtcacgccccgccagtacgcgctcggcttcgtcctggacgtgctcgggtcggcgctccacggcctcatcttcgcgctctccgagctcgtcttcgccagggccctcggtaggcgctcgttccacgtggtgctggagcagcaggcggcggtgtcgctctgcgccttcgccttcacctccgcgggcctcgccgtcgcggagggcttcccggccatgcggcgcgagtcggcacggtttgcgcacggtggccagccggcgtacgcgaacttgatggtgtggacggcactcacgttccagctgggcgtcctcggaggcaccggcgtgctgttcctggcgtccactgtcctcgccggcgtgctgaacgctgtcagggtgcccctgacgagcatcgccgcggtgatctggttccatgaccccatgagtggcttcaagatcttggctctggtcatcacggtgtgggggttcgcgtcctatattcttggacactcctcttttagaaaaacgtaacaaattagatatcatctcattgcaaaaaatgatgaaagattttaattc

SEQ ID NO: 768 - protein, 1276 aa, Zea mays
  misc_feature: GI Number: 50900308; NR Description: putative purine permease [Oryza sativa (japonica cultivar-group)] >gi|47497669|dbj|BAD19736.1| putative purine permease [Oryza sativa
  misc_feature: GI Number: 50900310; NR Description: putative purine permease [Oryza sativa (japonica cultivar-group)] >gi|47497670|dbj|BAD19737.1| putative purine permease [Oryza sativa
  misc_feature: GI Number: 42571763; NR Description: purine permease family
  misc_feature: GI Number: 38605752; NR Description: OSJNBb0016D16.5 [Oryza
  misc_feature: GI Number: 50911631; NR Description: putative purine permease [Oryza sativa (japonica cultivar-group)] >gi|41052802|dbj|BAD07670.1| putative purine permease [Oryza sativa
GTAGGATTGTGGGACTCCCAGCTGGTGGAGTGGAGCTTCCGAGTGTCCACTCCAATTCTCCAACGCCAGGGTGTTGCAGACTTGCAGGCAGTGGAACATGGACAAGGAAGGCGACGGCCACCACCACCACGCCATCCGAGTCCCATCCCCAGATAACATAGCAATGGTGGAGGAGACATCGCAGCCAAATGGCGCACCGTCGCTGAGACGGAAAGCAGGCGAGATGATCGCCACCTCCCTGGAGACGTACCGGAGCAAGCCCTTCTCCTTCTGGCTACTCCTGTTCCTGAGCAGCGGCGCCATGCTCACCGCGTTCCCGGCGTCGAGCCTCCTGTCGCGGCTCTACTACAACGAGGGCGGGCAGAGCAAGTGGATCCTGTCGTGGGCGGCCGTCGCCGGCTGGCCCCTGCCCGCGCTGCTCCTGCTGCCGCTGTATCTCCTCGGCAGGGCGTCGCCGACGCCGCTGTCGCTGTCGCTGTGCTCCTGGTACGTGCTCCTTGGGCTCCTCAGCGCCGCCGACAACCTCATGTACGCGTGGGCCTACGCGTACCTCCCGGCGTCCACGGCCTCGCTCGTCGCCGCGTCGTCGCTCGCCTTCTCCGCGCTCTTCGGCCGCGCCATCGCCAAGAACCGGCTCAACATGTCCTCGCTCAACGCCGTCGTCGTGATCACGGCGGGCGTGGTGATCGTCGCGCTGGACTCCGGGTCGGACAGGCCCCCCGGCGTCACGCCCCGCCAGTACGCGCTCGGCTTCGTCCTGGACGTGCTCGGGTCGGCGCTCCACGGCCTCATCTTCGCGCTCTCCGAGCTCGTCTTCGCCAGGGCCCTCGGTAGGCGCTCGTTCCACGTGGTGCTGGAGCAGCAGGCGGCGGTGTCGCTCTGCGCCTTCGCCTTCACCTCCGCGGGCCTCGCCGTCGCGGAGGGCTTCCCGGCCATGCGGCGCGAGTCGGCACGGTTTGCGCACGGTGGCCAGCCGGCGTACGCGAACTTGATGGTGTGGACGGCACTCACGTTCCAGCTGGGCGTCCTCGGAGGCACCGGCGTGCTGTTCCTGGCGTCCACTGTCCTCGCCGGCGTGCTGAACGCTGTCAGGGTGCCCCTGACGAGCATCGCCGCGGTGATCTGGTTCCATGACCCCATGAGTGGCTTCAAGATCTTGGCTCTGGTCATCACGGTGTGGGGGTTCGCGTCCTATATTCTTGGACACTCCTCTTTTAGAAAAACGTAACAAATTAGATATCATCTCATTGCAAAAAATGATGAAAGATTTTAATTC

SEQ ID NO: 769 - DNA, 1573 bp, Zea mays
  misc_feature (1)..(1573): Ceres cDNA ID no. 12366004
  misc_feature (1)..(1573): Ceres CLONE  ID no. 328411
  misc_feature (1)..(1573): Also known as  Ceres CDNA ID no. 23773773
acacgaggctccagggcctccatcgccacaccggtgcgtgcgagcgcgattaccagaggcgggcggcagggacgatgctgctgcaaaggcgcggcggcctcctctgctgcgggtgcggcgccagcgccgtggccgtggccgtcagtggccgcgttccggaagacgacggcggtgccgtcgtcgatggccagccgcctgacgccaagagcgtgtctggtaccagtgtctccgctgccgtgacgaccgcaaacgcgaggcagctctcgtgggcgcaggtggaggccatgacgggaggcttcacgtcagccatcgtcggcgagggcggcttcagcaccgtttacctcgcccgcctcgctggctccctcgccgccgtgaaggtccatcgtagtagcgagcgtcttcatcgcgcgttccgccaggagctcgacgcgctcctccgcgttcgccatccccacatcgtccgcctcctcgccttctgcgaccagcgagacgaaggcgtgctggtgctagagttcgcgccgaacggcagcctgcacgagcagctccacggcggcggcgcgggcgcggcgccgatgccgtgggcgcggcgggtgccggtggcgctgcaggtggcccgcgccctggagtacctccacgagcggtgcgagccgcaggtggtgcacggcgacgtgaaggcgtcgaacgtgctgctggacgcgggcatgggcgccaggctgtgcgacttcgggtcggcgcgcgcggggttctcggcggccgtggccgttgccgctgcaggcccgcgcccgcgcgccgtgttcgggtccccgggctacgtcgacccgcactacctccgctccggcgtggtcaccaagaagagcgacgtgtacagcttcggcgtgctcctgctggagctgctcaccggcgtgcaggcgttccgcgacggccggctcctgacggcgtccgtggcgccgaggctcgccgccgccgcagccggcgacctcgtggaccggaggctggggtgccgatacgacgcccgcgaggcggcggccgtgctggcgctagcggccgcgtgcgtccgggacaaaccgggcctccggccgtcgatggccgacgtggtgcgggccctggagcagctgcagccgcagcacggccggagcttgttgggcgccggagggaagctgtagctgctgtcgtagacacgtggcgcgcattgttgtttgtggtggtcgtggggatgcgactgctcaactgaccacaccctccctctattggaattgggttggtgaggaacaggaggcgttgggatttgcgctttgggggtattggggtggggggtgatttgcttatcatctttagctgggatgatgggtcatcatgtcattagccaccaaatcaaaagtagagcaactgctgagataaaacgaacagcaggaggatggaagtatccgtcattatcaagtgtgtatacagtagtaactaaaatgtaaacagagttgcttctttttcgtctgtgttgcatgtatgatgtacctgtgtgtggtatgcacacatgtttagccaaaagaaaagaactgtgcatatacattatcattct

SEQ ID NO: 770 - protein, 1573 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 37536060; NR Description: putative receptor protein kinase [Oryza sativa (japonica cultivar-group)] >gi|13786470|gb|AAK39595.1| putative receptor protein kinase [Oryza
  misc_feature: GI Number: 50911268; NR Description: putative serine/threonine-specific protein kinase [Oryza sativa (japonica cultivar-group)] >gi|49388396|dbj|BAD25532.1| putative serine/threonine-specific protein kinase [Oryza sativa (japonica
  misc_feature: GI Number: 50252107; NR Description: serine/threonine-specific receptor protein kinase-like protein [Oryza sativa (japonica cultivar-group)] >gi|50251992|dbj|BAD27925.1| serine/threonine-specific receptor protein kinase-like protein
  misc_feature: GI Number: 42571731; NR Description: protein kinase family
  misc_feature: GI Number: 42562481; NR Description: protein kinase family
ACACGAGGCTCCAGGGCCTCCATCGCCACACCGGTGCGTGCGAGCGCGATTACCAGAGGCGGGCGGCAGGGACGATGCTGCTGCAAAGGCGCGGCGGCCTCCTCTGCTGCGGGTGCGGCGCCAGCGCCGTGGCCGTGGCCGTCAGTGGCCGCGTTCCGGAAGACGACGGCGGTGCCGTCGTCGATGGCCAGCCGCCTGACGCCAAGAGCGTGTCTGGTACCAGTGTCTCCGCTGCCGTGACGACCGCAAACGCGAGGCAGCTCTCGTGGGCGCAGGTGGAGGCCATGACGGGAGGCTTCACGTCAGCCATCGTCGGCGAGGGCGGCTTCAGCACCGTTTACCTCGCCCGCCTCGCTGGCTCCCTCGCCGCCGTGAAGGTCCATCGTAGTAGCGAGCGTCTTCATCGCGCGTTCCGCCAGGAGCTCGACGCGCTCCTCCGCGTTCGCCATCCCCACATCGTCCGCCTCCTCGCCTTCTGCGACCAGCGAGACGAAGGCGTGCTGGTGCTAGAGTTCGCGCCGAACGGCAGCCTGCACGAGCAGCTCCACGGCGGCGGCGCGGGCGCGGCGCCGATGCCGTGGGCGCGGCGGGTGCCGGTGGCGCTGCAGGTGGCCCGCGCCCTGGAGTACCTCCACGAGCGGTGCGAGCCGCAGGTGGTGCACGGCGACGTGAAGGCGTCGAACGTGCTGCTGGACGCGGGCATGGGCGCCAGGCTGTGCGACTTCGGGTCGGCGCGCGCGGGGTTCTCGGCGGCCGTGGCCGTTGCCGCTGCAGGCCCGCGCCCGCGCGCCGTGTTCGGGTCCCCGGGCTACGTCGACCCGCACTACCTCCGCTCCGGCGTGGTCACCAAGAAGAGCGACGTGTACAGCTTCGGCGTGCTCCTGCTGGAGCTGCTCACCGGCGTGCAGGCGTTCCGCGACGGCCGGCTCCTGACGGCGTCCGTGGCGCCGAGGCTCGCCGCCGCCGCAGCCGGCGACCTCGTGGACCGGAGGCTGGGGTGCCGATACGACGCCCGCGAGGCGGCGGCCGTGCTGGCGCTAGCGGCCGCGTGCGTCCGGGACAAACCGGGCCTCCGGCCGTCGATGGCCGACGTGGTGCGGGCCCTGGAGCAGCTGCAGCCGCAGCACGGCCGGAGCTTGTTGGGCGCCGGAGGGAAGCTGTAGCTGCTGTCGTAGACACGTGGCGCGCATTGTTGTTTGTGGTGGTCGTGGGGATGCGACTGCTCAACTGACCACACCCTCCCTCTATTGGAATTGGGTTGGTGAGGAACAGGAGGCGTTGGGATTTGCGCTTTGGGGGTATTGGGGTGGGGGGTGATTTGCTTATCATCTTTAGCTGGGATGATGGGTCATCATGTCATTAGCCACCAAATCAAAAGTAGAGCAACTGCTGAGATAAAACGAACAGCAGGAGGATGGAAGTATCCGTCATTATCAAGTGTGTATACAGTAGTAACTAAAATGTAAACAGAGTTGCTTCTTTTTCGTCTGTGTTGCATGTATGATGTACCTGTGTGTGGTATGCACACATGTTTAGCCAAAAGAAAAGAACTGTGCATATACATTATCATTCT

SEQ ID NO: 771 - DNA, 1486 bp, Zea mays
  misc_feature (1)..(1486): Ceres cDNA ID no. 12366543
  misc_feature (1)..(1486): Ceres CLONE  ID no. 357798
  misc_feature (1)..(1486): Also known as  Ceres CDNA ID no. 23853196
aataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcggggaaggaggaggtgagggagtatgagagcgacatgaggaagctggaggagctgctttctaagctgaacccctcggcggaggagttcgtgccgcagtcccgccgccgcgtggacggcggcgctccccgcctttcggccgacgcgcccgtgttcgtgtcgccggcgatcgactactacgcgcgccaccaccagctcccgccgccgccgcttctgcagcagcagcagccgatgcacgtgctgcagtttgtgggtggcgtcggcggggttggcatgggtggcggcggggggatggactccagcagcgacggatccgccaatggtcagccgaatcgacggagaaggaacggtttcatccaggggaggagaaggatgatgggtgcccggcctcgtcgagctgacagggaggatagtgtcggcggacagtctatgtctctgacgttgatcagcatgtaactgaacagaaacttgctgaagttttttcaacctgtggacaggtggtagattgccgtatctgtggtgatcctaactcagtgcttcgttttgcttttatcgagtttgctgatgacgttgctgcacaagcagcactagcacttggtggaaccgtgcttggcttttatcctgtcaaggttctgccatcaaagacagcaattttacctgtgaaccctaaatttcttcctcacactgatgatgagaaagaaatggtatccaggactgtgtattgtactaacattgacaagaagatcgcagaagatgaagtgaagcaattctttgagggaacatgtggtgaagtttctcgtctgaggctacttggtgattatgtgcactccacatgcatcgcttttgttgagtttgtccaagcagatagtgctattctcgctctgaactgcagtggcattgttcttggaacgcttcctgttagggtgagcccatcaaagacaccagtccgctcgcgatcgccccgtgtgacgtcatactgaattcggctcatctgaagccgtcgtccagggcagcaaatttctgggcaacaaagccctagtcgtgtggccttagagactgccgcatcgcggataagtaattgtcgttgagcagagttctcgttggttaaagtccagtctagtaggaggcgcagagacccgtctgtatggtcgctgggagatctatcttgacctcctttttctgttctttttggtcttagttatcgtggttggattctatagcagccttgacaggcattcgaacaacaatgtttatggttatcctatccgctttggact

SEQ ID NO: 772 - protein, 1486 aa, Zea mays
  misc_feature: PFam Name: RRM_1; PFam Description: RNA recognition motif.
  misc_feature: GI Number: 50252270; NR Description: putative RNA-binding
  misc_feature: GI Number: 53793076; NR Description: putative RNA-binding protein [Oryza sativa (japonica cultivar-group)] >gi|53793069|dbj|BAD54280.1| putative RNA-binding protein [Oryza
  misc_feature: GI Number: 6714278; NR Description: F6N18.17 [Arabidopsis thaliana] gi|25403416|pir||F86452 protein F6N18.17 [imported] - Arabidopsis thaliana gi|15223304|ref|NP_174556.1| RNA-binding
  misc_feature: GI Number: 48427656; NR Description: At1g53650 [Arabidopsis thaliana] >gi|25405657|pir||F96576 probable RNA-binding protein, 40942-42923 [imported] - Arabidopsis thaliana
  misc_feature: GI Number: 21592407; NR Description: RNA-binding protein [Arabidopsis thaliana] >gi|4539439|emb|CAB40027.1| RNA-binding protein [Arabidopsis thaliana] >gi|7267758|emb|CAB78184.1| RNA-binding protein [Arabidopsis thaliana]
AATAATAAAAAGATTCTCGATTCGATTTACTCGCCAATTTTCAGTGAGCGGCGGCGATCGGCTTCGGATCGGCGCAGCGCGGCGGAGCGGAGATGGTTGCCGTGGCGGTGGATGGCCTGATCCGCGGTGCGGACGCCGTGCCGGCGGCGGAGAGGGAAGCGGTGAGGGCGGCAGCTGCGGAGGCGGCGGCCAAGGGCGGTGAGGGGGAATCGGGGAAGGAGGAGGTGAGGGAGTATGAGAGCGACATGAGGAAGCTGGAGGAGCTGCTTTCTAAGCTGAACCCCTCGGCGGAGGAGTTCGTGCCGCAGTCCCGCCGCCGCGTGGACGGCGGCGCTCCCCGCCTTTCGGCCGACGCGCCCGTGTTCGTGTCGCCGGCGATCGACTACTACGCGCGCCACCACCAGCTCCCGCCGCCGCCGCTTCTGCAGCAGCAGCAGCCGATGCACGTGCTGCAGTTTGTGGGTGGCGTCGGCGGGGTTGGCATGGGTGGCGGCGGGGGGATGGACTCCAGCAGCGACGGATCCGCCAATGGTCAGCCGAATCGACGGAGAAGGAACGGTTTCATCCAGGGGAGGAGAAGGATGATGGGTGCCCGGCCTCGTCGAGCTGACAGGGAGGATAGTGTCGGCGGACAGTCTATGTCTCTGACGTTGATCAGCATGTAACTGAACAGAAACTTGCTGAAGTTTTTTCAACCTGTGGACAGGTGGTAGATTGCCGTATCTGTGGTGATCCTAACTCAGTGCTTCGTTTTGCTTTTATCGAGTTTGCTGATGACGTTGCTGCACAAGCAGCACTAGCACTTGGTGGAACCGTGCTTGGCTTTTATCCTGTCAAGGTTCTGCCATCAAAGACAGCAATTTTACCTGTGAACCCTAAATTTCTTCCTCACACTGATGATGAGAAAGAAATGGTATCCAGGACTGTGTATTGTACTAACATTGACAAGAAGATCGCAGAAGATGAAGTGAAGCAATTCTTTGAGGGAACATGTGGTGAAGTTTCTCGTCTGAGGCTACTTGGTGATTATGTGCACTCCACATGCATCGCTTTTGTTGAGTTTGTCCAAGCAGATAGTGCTATTCTCGCTCTGAACTGCAGTGGCATTGTTCTTGGAACGCTTCCTGTTAGGGTGAGCCCATCAAAGACACCAGTCCGCTCGCGATCGCCCCGTGTGACGTCATACTGAATTCGGCTCATCTGAAGCCGTCGTCCAGGGCAGCAAATTTCTGGGCAACAAAGCCCTAGTCGTGTGGCCTTAGAGACTGCCGCATCGCGGATAAGTAATTGTCGTTGAGCAGAGTTCTCGTTGGTTAAAGTCCAGTCTAGTAGGAGGCGCAGAGACCCGTCTGTATGGTCGCTGGGAGATCTATCTTGACCTCCTTTTTCTGTTCTTTTTGGTCTTAGTTATCGTGGTTGGATTCTATAGCAGCCTTGACAGGCATTCGAACAACAATGTTTATGGTTATCCTATCCGCTTTGGACT

SEQ ID NO: 773 - DNA, 1319 bp, Zea mays
  misc_feature (1)..(1319): Ceres cDNA ID no. 12366624
  misc_feature (1)..(1319): Ceres CLONE  ID no. 321008
  misc_feature (1)..(1319): Also known as  Ceres CDNA ID no. 23768624
ctcaaagctagctcagaccaataatcagctcttctcctcctagcttgatctctccaatcaagctctctctctctctctctctctcaacacataccaaacttccactcctcctagatagctagctactagctagacagaaatcccccatgtaattggagagagaacttatgtgttctatgatagattagatatgatgcttctctagctcatcagatcaaattagtactcgaccgataccaagttaattaagaagaagttctctcagcgaagaggcgcgtcaagctggcgaaccggtggtggagcgtgcccggtcacttgggcctgccggagcagccgtccggcggccccaaccccaagacggagcccccggccatgaaggatccggagcccagcagcccggcagtcggcgcgccgggcgaccacggagccgatgagaccaacgagtccggtggcgccgtggtggcggcgcccagccggcggcctcgcggacgcccgccggggtccaagaacaagcccaagccgcccatcttcgtcacgcgcgacagccccaacgcgctgcgcagccacgtcatggaggtggcgggcggcgccgatgtggcggacgccatcgcgcagttctcgcgccgccgccagcgcggtgtctgcgtgctcagcggcgccgggaccgtcgccaacgtggcgctgcggcaaccgtccgcgcccacggccgtggtcgcgctccgcggccgcttcgagatcctctcgcttaccggcaccttcctgcccggccccgcgccgccggggtccacggggctcaccgtgtacctggccgggggccaggggcaggtggttggcggcagcgttgtaggcaccctcatcgccgccggcccggtcatggtgatcgcgtccacgttcgccaacgcaacctacgagcgccttccgctcgaagaggaggatgaagggccagctccaccgatggcgtccggcggcggcgccgatccgctcatgggtggaggcctcggcatcgccgacccgtcagcgctgcccatgttcaacttgccgccgagcaacgggcagcttggaggcggcgacggcttcccgtcatgggcgcacccgcggccaccgtactgatgatcctgatgcgcccaaggtcgagcacagttgctagaatgcaatggcgaatgctgtgcgtgcactgcatggtcgttactgttccattggagacgacgacggccggatcggagtggcgcgccattagtaggttagtacatatgatgaagtgtggccgtcgtccctagtgctactttgttgccgtgcaataatcagatgtcgttggtctc

SEQ ID NO: 774 - protein, 1319 aa, Zea mays
  misc_feature: GI Number: 50915952; NR Description: DNA-binding protein-like [Oryza sativa (japonica cultivar-group)] >gi|48716263|dbj|BAD22878.1| DNA-binding protein-like [Oryza sativa (japonica cultivar-group)] >gi|48716505|dbj|BAD23110.1|
  misc_feature: GI Number: 50948561; NR Description: putative SAP1 protein [Oryza sativa (japonica cultivar-group)] >gi|42408442|dbj|BAD09624.1| putative SAP1 protein [Oryza sativa
  misc_feature: GI Number: 21593180; NR Description: putative DNA-binding
  misc_feature: GI Number: 50912085; NR Description: DNA-binding protein-like [Oryza sativa (japonica cultivar-group)] >gi|41052877|dbj|BAD07790.1| DNA-binding protein-like [Oryza sativa
  misc_feature: GI Number: 50252749; NR Description: putative DNA-binding
CTCAAAGCTAGCTCAGACCAATAATCAGCTCTTCTCCTCCTAGCTTGATCTCTCCAATCAAGCTCTCTCTCTCTCTCTCTCTCTCAACACATACCAAACTTCCACTCCTCCTAGATAGCTAGCTACTAGCTAGACAGAAATCCCCCATGTAATTGGAGAGAGAACTTATGTGTTCTATGATAGATTAGATATGATGCTTCTCTAGCTCATCAGATCAAATTAGTACTCGACCGATACCAAGTTAATTAAGAAGAAGTTCTCTCAGCGAAGAGGCGCGTCAAGCTGGCGAACCGGTGGTGGAGCGTGCCCGGTCACTTGGGCCTGCCGGAGCAGCCGTCCGGCGGCCCCAACCCCAAGACGGAGCCCCCGGCCATGAAGGATCCGGAGCCCAGCAGCCCGGCAGTCGGCGCGCCGGGCGACCACGGAGCCGATGAGACCAACGAGTCCGGTGGCGCCGTGGTGGCGGCGCCCAGCCGGCGGCCTCGCGGACGCCCGCCGGGGTCCAAGAACAAGCCCAAGCCGCCCATCTTCGTCACGCGCGACAGCCCCAACGCGCTGCGCAGCCACGTCATGGAGGTGGCGGGCGGCGCCGATGTGGCGGACGCCATCGCGCAGTTCTCGCGCCGCCGCCAGCGCGGTGTCTGCGTGCTCAGCGGCGCCGGGACCGTCGCCAACGTGGCGCTGCGGCAACCGTCCGCGCCCACGGCCGTGGTCGCGCTCCGCGGCCGCTTCGAGATCCTCTCGCTTACCGGCACCTTCCTGCCCGGCCCCGCGCCGCCGGGGTCCACGGGGCTCACCGTGTACCTGGCCGGGGGCCAGGGGCAGGTGGTTGGCGGCAGCGTTGTAGGCACCCTCATCGCCGCCGGCCCGGTCATGGTGATCGCGTCCACGTTCGCCAACGCAACCTACGAGCGCCTTCCGCTCGAAGAGGAGGATGAAGGGCCAGCTCCACCGATGGCGTCCGGCGGCGGCGCCGATCCGCTCATGGGTGGAGGCCTCGGCATCGCCGACCCGTCAGCGCTGCCCATGTTCAACTTGCCGCCGAGCAACGGGCAGCTTGGAGGCGGCGACGGCTTCCCGTCATGGGCGCACCCGCGGCCACCGTACTGATGATCCTGATGCGCCCAAGGTCGAGCACAGTTGCTAGAATGCAATGGCGAATGCTGTGCGTGCACTGCATGGTCGTTACTGTTCCATTGGAGACGACGACGGCCGGATCGGAGTGGCGCGCCATTAGTAGGTTAGTACATATGATGAAGTGTGGCCGTCGTCCCTAGTGCTACTTTGTTGCCGTGCAATAATCAGATGTCGTTGGTCTC

SEQ ID NO: 775 - DNA, 1495 bp, Zea mays
  misc_feature (1)..(1495): Ceres cDNA ID no. 12366927
  misc_feature (1)..(1495): Ceres CLONE  ID no. 290066
  misc_feature (1)..(1495): Also known as  Ceres CDNA ID no. 23780379
acaacacctcatcacaaacacaaagacagccagccagagccagccagagccagccatcactgatcatagcatcagcagcttagtataccgtaccgctccacatccgagctagaagaagaagcccgcgcggccagtacctgcctagcggcgcgagcgaagcagagatggcgagagcgctgccgctggtgctcgcggcgtccgtcctgctggcggccgccgcgctgctgctggccgcggcgccggcgccggcggccgcggtcgacttcggcgcggaggacctggcgtcggaggaggcgctgtgggcgctgtacgagcgctggcgcggccgccacgcggtggcgcgggacctgggcgacaaggcgcgccgcttcaacgtcttcaaggccaacgtgcgcctcatccacgagttcaaccgccgggacgagccctacaagctccgcctcaaccgcttcggcgacatgaccgccgacgagttccgacgccactacgcgggctccagggtcgcgcaccaccgcatgttccgcggcgacaggcagggctcctcggcgtcggcgtcgttcatgtacgccgacgcgcgcgacgtcccggcctccgtcgactggaggcagaagggcgccgtcaccgacgtcaaggaccagggccagtgcggtagctgctgggcgttctcgacgatcgccgccgtggagggcatcaacgcgatcaagaccaagaacctgacgtcgctgtcggagcagcagctggtggactgcgacaccaaggccaacgccggctgcaacgggggcctcatggactacgcgttccagtacatcgccaagcacggcggggtggcggcggaggacgcgtacccgtacagagcgcgccaggcgtcctgcaagaagtcgccggccccggtcgtcaccatcgacggctacgaggacgtgccggccaacgacgagtcggcgctcaagaaggcggtggcgcaccagcccgtgtccgtcgccatcgaggccagtggctcgcacttccagttctactccgagggggtcttctccggcaggtgcgggacggagctggaccacggcgtcgcggcggtcggctacggggtcaccgcggacggcaccaagtactggctggtcaagaactcgtggggccccgagtggggcgagaaggggtacatccgcatggcgcgcgacgtggccgccaaggagggacactgcggcatcgccatggaggcatcctaccccgtcaagacctcgcccaaccccaaggtccacgccgtcgtcgacgaggacggctccagccacgacgagctctgaattgcgcactacactactacgtactagctatagcctatatagctatactatgattgatccatgtatgctcggacaggaacatcgccgactgtgaatgtctgaatggcatacgcacatcttacacctgcattcatgtaataccagtcgagagttgatcttccagcaactttcatttcattcggttattattatattatttg

SEQ ID NO: 776 - protein, 1495 aa, Zea mays
  misc_feature: PFam Name: Peptidase_C1; PFam Description: Papain family
  misc_feature: GI Number: 51965090; NR Description: PREDICTED OJ1150_A11.17 gene product [Oryza sativa (japonica cultivar-group)] >gi|50948427|ref|XP_483741.1| putative cysteine proteinase [Oryza sativa (japonica cultivar-group)] >gi|42407937|dbj|BAD09076.1|
  misc_feature: GI Number: 58531896; NR Description: cysteine protease
  misc_feature: GI Number: 4731374; NR Description: papain-like cysteine
  misc_feature: GI Number: 20258850; NR Description: putative cysteine proteinase [Arabidopsis thaliana] >gi|9759028|dbj|BAB09397.1| cysteine endopeptidase [Arabidopsis thaliana] >gi|18423124|ref|NP_568722.1| cysteine proteinase, putative
  misc_feature: GI Number: 537437; NR Description: cysteine proteinase
ACAACACCTCATCACAAACACAAAGACAGCCAGCCAGAGCCAGCCAGAGCCAGCCATCACTGATCATAGCATCAGCAGCTTAGTATACCGTACCGCTCCACATCCGAGCTAGAAGAAGAAGCCCGCGCGGCCAGTACCTGCCTAGCGGCGCGAGCGAAGCAGAGATGGCGAGAGCGCTGCCGCTGGTGCTCGCGGCGTCCGTCCTGCTGGCGGCCGCCGCGCTGCTGCTGGCCGCGGCGCCGGCGCCGGCGGCCGCGGTCGACTTCGGCGCGGAGGACCTGGCGTCGGAGGAGGCGCTGTGGGCGCTGTACGAGCGCTGGCGCGGCCGCCACGCGGTGGCGCGGGACCTGGGCGACAAGGCGCGCCGCTTCAACGTCTTCAAGGCCAACGTGCGCCTCATCCACGAGTTCAACCGCCGGGACGAGCCCTACAAGCTCCGCCTCAACCGCTTCGGCGACATGACCGCCGACGAGTTCCGACGCCACTACGCGGGCTCCAGGGTCGCGCACCACCGCATGTTCCGCGGCGACAGGCAGGGCTCCTCGGCGTCGGCGTCGTTCATGTACGCCGACGCGCGCGACGTCCCGGCCTCCGTCGACTGGAGGCAGAAGGGCGCCGTCACCGACGTCAAGGACCAGGGCCAGTGCGGTAGCTGCTGGGCGTTCTCGACGATCGCCGCCGTGGAGGGCATCAACGCGATCAAGACCAAGAACCTGACGTCGCTGTCGGAGCAGCAGCTGGTGGACTGCGACACCAAGGCCAACGCCGGCTGCAACGGGGGCCTCATGGACTACGCGTTCCAGTACATCGCCAAGCACGGCGGGGTGGCGGCGGAGGACGCGTACCCGTACAGAGCGCGCCAGGCGTCCTGCAAGAAGTCGCCGGCCCCGGTCGTCACCATCGACGGCTACGAGGACGTGCCGGCCAACGACGAGTCGGCGCTCAAGAAGGCGGTGGCGCACCAGCCCGTGTCCGTCGCCATCGAGGCCAGTGGCTCGCACTTCCAGTTCTACTCCGAGGGGGTCTTCTCCGGCAGGTGCGGGACGGAGCTGGACCACGGCGTCGCGGCGGTCGGCTACGGGGTCACCGCGGACGGCACCAAGTACTGGCTGGTCAAGAACTCGTGGGGCCCCGAGTGGGGCGAGAAGGGGTACATCCGCATGGCGCGCGACGTGGCCGCCAAGGAGGGACACTGCGGCATCGCCATGGAGGCATCCTACCCCGTCAAGACCTCGCCCAACCCCAAGGTCCACGCCGTCGTCGACGAGGACGGCTCCAGCCACGACGAGCTCTGAATTGCGCACTACACTACTACGTACTAGCTATAGCCTATATAGCTATACTATGATTGATCCATGTATGCTCGGACAGGAACATCGCCGACTGTGAATGTCTGAATGGCATACGCACATCTTACACCTGCATTCATGTAATACCAGTCGAGAGTTGATCTTCCAGCAACTTTCATTTCATTCGGTTATTATTATATTATTTG

SEQ ID NO: 777 - DNA, 2101 bp, Zea mays
  misc_feature (1)..(2101): Ceres cDNA ID no. 12366931
  misc_feature (1)..(2101): Ceres CLONE  ID no. 328378
  misc_feature (1)..(2101): Also known as  Ceres CDNA ID no. 23765793
agctggattggatatttggactagtgttcttcttggcttggccacccgcctactccgtcttcttcatacgagacaagccgtgcgcttcttcttggcctagcccttcgagcagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacaccatcagcgtcatcgtctgggtcccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgaggacgacatcgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactgatgggcgagatggcggaaatggagtgatttctatgtgtggttagctgtctgtcgacttgttttgccacagtttgggtgcttaaacgttaacgtacgtactagttcaatatagtgtctcgggggcgaattggttgtttacatgtcatgtgtttatatatgcgcaatgttcgatctcagtgg

SEQ ID NO: 778 - protein, 2101 aa, Zea mays
  misc_feature: PFam Name: PTR2; PFam Description: POT family
  misc_feature: PFam Name: MFS_1; PFam Description: Major Facilitator Superfamily
  misc_feature: PFam Name: Transferase; PFam Description: Transferase family
  misc_feature: GI Number: 23506067; NR Description: At2g02040/F14H20.11 [Arabidopsis thaliana] >gi|4406786|gb|AAD20096.1| histidine transport protein (PTR2-B) [Arabidopsis thaliana] >gi|1172704|sp|P46032|PT2B_ARATH Peptide transporter PTR2-B
  misc_feature: GI Number: 4102839; NR Description: LeOPT1 [Lycopersicon
  misc_feature: GI Number: 6409176; NR Description: nitrate transporter
  misc_feature: GI Number: 6759441; NR Description: oligopeptide transporter-like protein [Arabidopsis thaliana] >gi|11358593|pir||T45958 oligopeptide transporter-like protein -
  misc_feature: GI Number: 31088360; NR Description: peptide transporter 1
  misc_feature: Utility: Useful for making plants tolerant to low nitrogen
  misc_feature: Utility: Useful for making plants with enhanced tolerance to
AGCTGGATTGGATATTTGGACTAGTGTTCTTCTTGGCTTGGCCACCCGCCTACTCCGTCTTCTTCATACGAGACAAGCCGTGCGCTTCTTCTTGGCCTAGCCCTTCGAGCAGGGCAGGAGAGGAGGCCACTCTGACTGTCACTCTGAGCTTCGCGTCACCTGAGTACTGACGGACGACATGGGAGAAGTTGAGGACATGTACACCCAAGACGGGACCGTGGACATGAAAGGGAATCCCGCCGTGAAGAAGGGCACCGGCAACTGGCGCGCCTGCCCCTACATCCTCGCGAACGAGTGCTGCGAGAGGCTGGCTTACTATGGCATGAGCACCAACCTGGTGAACTACATGAAGACCCGACTTGGCCAGGTGAACTCCGTTGCCTCCAACAACGTCACCAACTGGCAAGGGACGTGCTACATCACGCCGCTCATCGGCGCCTTCTTCGCCGACGCGTACATGGGGAGGTTCTGGACCATCGCCATCTTCATGATCATCTACATTTTCGGCCTGGCGCTGCTGACGATGGCTTCGTCGGTGAAGGGGCTGGTGCCTACGTCGTGCGGCGACAAGGATGTGTGCCACCCGACGGACGCGCAGGCGGCGGTGGTGTTCGTGGCGCTGTACCTCATCGCGCTGGGCACGGGCGGGATCAAGCCGTGCGTGTCCTCCTTCGGCGCCGACCAGTTCGACGAGAACGACGAGCGGGAGAAGAAGAGCAAGAGCTCCTTCTTCAACTGGTTCTACTTCTCCATCAACATCGGCGCGCTGGTGGCGTCCACAGTGCTGGTGTACGTGCAGACGCACGTGGGCTGGGGCTGGGGCTTCGGCATCCCCGCCGTGGTCATGGCCATCGCCGTCGGCAGCTTCTTCGTGGGCACGCCGCTGTACAGGCACCAGAAGCCCGGGGGCAGCCCGCTGACGCGCATCGCGCAGGTGCTCGTCGCGTGCGCGCGCAAGTGGAACGTGGCCGTGCCCGCGGACAAGTCGCGGCTGCACGAGACGGTGGACGGGGAGTCCGGCATCGAGGGGAGCCGCAAGCTGGAGCACTCGGAGCAGCTGGCGTGCCTCGACAGGGCTGCCGTGGTGACGGCCGAGGACGGCGCGGAGGCGAGCCCGTGGCGCCTGTGCTCGGTGACGCAGGTGGAGGAGCTCAAGAGCGTGATCCGGCTGCTGCCCATCTGGGCCAGCGGGATCGTGTTCGCGGCGGTGTACTCGCAGATGAGCACCATGTTCGTGCTGCAGGGTAACACGCTGGACCAGAGCATGGGGCCCCGGTTCAAGATCCCCTCGGCGACGCTGTCCATGGTGGACACCATCAGCGTCATCGTCTGGGTCCCCCGTGTACGACCGCGCCATCGTGCCCCTGGTGCGCTCCTACACCGGGAGGCCGCGCGGGTTCACGCAGCTGCAGCGCATGGGCATCGGCCTCGTCGTCTCCATCTTCTCCATGGTGGCGGCGGGCGTGCTGGACATCGTGCGGCTGCGCGCCATCGCGCGGCACGGCCTGTACGGCGAGGACGACATCGTGCCCATCTCCATCTTCTGGCAGATACCGCAGTACTTCATCATCGGGTGCGCGGAGGTGTTCACCTTCGTGGGGCAGCTGGAGTTCTTCTACGACCAGGCGCCCGACGCCATGAGGAGCATGTGCTCCGCGCTGTCGCTCACCACCGTCGCGCTCGGCAACTACCTCAGCACGGTCCTGGTGACCATCGTCACCCACATCACCACCAGGCACGGCCGCATCGGGTGGATCCCGGAGAACCTCAACCGCGGCCACCTCGACTACTTCTTCTGGCTGCTCGCCGTGCTCAGCCTTCTCAACTTCCTTGCCTACCTCGTCATCGCCAGCTGGTACAAGTACAAGAAGACGGCCGATGATTACCCTGGCGCCAAAGGGGAGCACGGTACAGAGCACTGATGGGCGAGATGGCGGAAATGGAGTGATTTCTATGTGTGGTTAGCTGTCTGTCGACTTGTTTTGCCACAGTTTGGGTGCTTAAACGTTAACGTACGTACTAGTTCAATATAGTGTCTCGGGGGCGAATTGGTTGTTTACATGTCATGTGTTTATATATGCGCAATGTTCGATCTCAGTGG

SEQ ID NO: 779 - DNA, 1782 bp, Zea mays
  misc_feature (1)..(1782): Ceres cDNA ID no. 12367381
  misc_feature (1)..(1782): Ceres CLONE  ID no. 278253
  misc_feature (1)..(1782): Also known as  Ceres CDNA ID no. 23759587
accgttccttttctccaccattgaaacactctctgaccctcactcgctccctgtcacacacactacactcgcaattcatccgcagtcacaagctcggctgctgctcccgcctaacggttgaggcgttgctggtgcacacaggaagggaagggaagggagagctgcacacagctttgctctggctcttggctcccctgtccacctgtcctgtccgtccatcatggaggaaacgcccagcccgcagctctagccgccgtcaatctcgtctcgtatcggagtcgaaggaagtaagaggcgggatggcatgaagcgacctaccaagaatgagaggctgggcaacccccggcacaagtaggaggaagaacccgagcaaccgagccacagggaggaggaggagatgggcaactgcggcacacgggaggagaatgccgtcgtcgctgcgcacgcgcaagttcagcaactccacttgttacaacagccttccaagaacgccaatgcagataggaagcacacctgcatgtcatcagatataagtgacccttccacacctaggaaagttgaagatgccaagaacatttccatatacaacgatgtgattgccttcacattgtttgagctagagacaatcacaaagagcttccgtgttgattatgttcttggcgaaggaggatttgggaccgtttacaagggttacatagatgaaaatgtcagggttgggctgaagtcactgcctgttgcagtcaaggtgctcaacaaagatggacatcaagggcacagagaatggcttaccgaggttaactgcctggggcagttgaggcatccaaatttggtgaagttgatcggatattgctgcgaagatgaccatcggctgcttgtctacgagttcatgtttcgaggaagtctagaaaaccacttattccgaaagacagctacgccattgccctggggtactaggatgtcaatcgcgctgggagccgctaaagggctcgcttgcctccacaacgctcaaaggcccgtcatctacagagatttcaagacatcaaacattctgctggactccgattatactgccaaactgtctgactttggcctcgcaaaagatggccctgaaggtgatcagacgcatgtgtcgacacgggtgatgggaacctacggttatgctgcccctgaatatgtgatgaccggtcacttgactgctcggagtgacgtgtacagcttcggcgtggtcctgctggagctcctgacggggcgcaagtcgatcgacaagtcgcggcccagcagggagcagagcctggtggactgggcgctcccgaagctcaacgacaagaggaggctcctccagatcatcgacccgaggctggaggggcagtactcggccagagccgctcacaagtcctgcagcctcgcgttctactgcctgagccagaaccccaaggccaggccgctcatgagcgacgtcgtcgagaccctcgcgccgttgcagcagggcggcggcggcggcagcgacgcgtcctccggccttcctgactgcagaggccgccgcaggctgaccggcaacagcgtcgtccacttcagggccatccccaaccccaagtgcacgcctgttgtcccggcttgcagagtgcggtgatgttgctgcgcttcggttgaagctgctgggataggttcaggtgtgtactgtgaccatgggtggtggtgcgttttgatgatctgcatgttggattaatgtgggcttggcccaaattaatattcaataatagtcaatgctaatggcccactttt

SEQ ID NO: 780 - protein, 1782 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 9542860; NR Description: protein kinase-like
  misc_feature: GI Number: 30725688; NR Description: At5g56460 [Arabidopsis thaliana] >gi|10177845|dbj|BAB11274.1| protein kinase-like protein [Arabidopsis thaliana] >gi|22135984|gb|AAM91574.1| protein kinase-like protein [Arabidopsis thaliana]
  misc_feature: GI Number: 15238553; NR Description: protein kinase, putative
  misc_feature: GI Number: 10176804; NR Description: serine/threonine protein
  misc_feature: GI Number: 28804505; NR Description: serine/threonine protein
ACCGTTCCTTTTCTCCACCATTGAAACACTCTCTGACCCTCACTCGCTCCCTGTCACACACACTACACTCGCAATTCATCCGCAGTCACAAGCTCGGCTGCTGCTCCCGCCTAACGGTTGAGGCGTTGCTGGTGCACACAGGAAGGGAAGGGAAGGGAGAGCTGCACACAGCTTTGCTCTGGCTCTTGGCTCCCCTGTCCACCTGTCCTGTCCGTCCATCATGGAGGAAACGCCCAGCCCGCAGCTCTAGCCGCCGTCAATCTCGTCTCGTATCGGAGTCGAAGGAAGTAAGAGGCGGGATGGCATGAAGCGACCTACCAAGAATGAGAGGCTGGGCAACCCCCGGCACAAGTAGGAGGAAGAACCCGAGCAACCGAGCCACAGGGAGGAGGAGGAGATGGGCAACTGCGGCACACGGGAGGAGAATGCCGTCGTCGCTGCGCACGCGCAAGTTCAGCAACTCCACTTGTTACAACAGCCTTCCAAGAACGCCAATGCAGATAGGAAGCACACCTGCATGTCATCAGATATAAGTGACCCTTCCACACCTAGGAAAGTTGAAGATGCCAAGAACATTTCCATATACAACGATGTGATTGCCTTCACATTGTTTGAGCTAGAGACAATCACAAAGAGCTTCCGTGTTGATTATGTTCTTGGCGAAGGAGGATTTGGGACCGTTTACAAGGGTTACATAGATGAAAATGTCAGGGTTGGGCTGAAGTCACTGCCTGTTGCAGTCAAGGTGCTCAACAAAGATGGACATCAAGGGCACAGAGAATGGCTTACCGAGGTTAACTGCCTGGGGCAGTTGAGGCATCCAAATTTGGTGAAGTTGATCGGATATTGCTGCGAAGATGACCATCGGCTGCTTGTCTACGAGTTCATGTTTCGAGGAAGTCTAGAAAACCACTTATTCCGAAAGACAGCTACGCCATTGCCCTGGGGTACTAGGATGTCAATCGCGCTGGGAGCCGCTAAAGGGCTCGCTTGCCTCCACAACGCTCAAAGGCCCGTCATCTACAGAGATTTCAAGACATCAAACATTCTGCTGGACTCCGATTATACTGCCAAACTGTCTGACTTTGGCCTCGCAAAAGATGGCCCTGAAGGTGATCAGACGCATGTGTCGACACGGGTGATGGGAACCTACGGTTATGCTGCCCCTGAATATGTGATGACCGGTCACTTGACTGCTCGGAGTGACGTGTACAGCTTCGGCGTGGTCCTGCTGGAGCTCCTGACGGGGCGCAAGTCGATCGACAAGTCGCGGCCCAGCAGGGAGCAGAGCCTGGTGGACTGGGCGCTCCCGAAGCTCAACGACAAGAGGAGGCTCCTCCAGATCATCGACCCGAGGCTGGAGGGGCAGTACTCGGCCAGAGCCGCTCACAAGTCCTGCAGCCTCGCGTTCTACTGCCTGAGCCAGAACCCCAAGGCCAGGCCGCTCATGAGCGACGTCGTCGAGACCCTCGCGCCGTTGCAGCAGGGCGGCGGCGGCGGCAGCGACGCGTCCTCCGGCCTTCCTGACTGCAGAGGCCGCCGCAGGCTGACCGGCAACAGCGTCGTCCACTTCAGGGCCATCCCCAACCCCAAGTGCACGCCTGTTGTCCCGGCTTGCAGAGTGCGGTGATGTTGCTGCGCTTCGGTTGAAGCTGCTGGGATAGGTTCAGGTGTGTACTGTGACCATGGGTGGTGGTGCGTTTTGATGATCTGCATGTTGGATTAATGTGGGCTTGGCCCAAATTAATATTCAATAATAGTCAATGCTAATGGCCCACTTTT

SEQ ID NO: 781 - DNA, 945 bp, Zea mays
  misc_feature (1)..(945): Ceres cDNA ID no. 12367407
  misc_feature (1)..(945): Ceres CLONE  ID no. 288184
  misc_feature (1)..(945): Also known as  Ceres CDNA ID no. 23751107
ctcgcacaaaaaagtctgcaagcagggttaaggcgcgcaccaacctttccctcctacctctactcctgttcctcgggttcatcctcacctcgagcgctgctgcggccatggtgaccagaaggttggctctgagctccctcttccacggcaaggcaagggacacttcgtccttaccaccgccgcctcctcctcctcccgcaccagcctgggcatggccgtccagcaagaacccaagaacgacgcagccgcaggcagcagcagcagcagcagcagcaggcgccaggaccgtcgcctccatcgtcctcgactccgccgactcgtccttcacggcctcctccgcgctgcaggaggactgctgctgctccgacagcctctccacggcgtccgaggcgtcggcgtcggcgtcggcggcgtgcgacgacgcggcggcggacgacgccgtcgtcgtgcgcggggtccgctccgaccggctcctcttcgacccaggcgcgtcggccaccaactccatcctcgaggagaagtctgccaccaaacgggagcaggcgttcggcggcgccgtggccgtcgcgttcgagtccgccgacccgtacgtggacttccgggcgtccatggaggagatggtggccgcgcacgggatcgggcgccactggggctggctggaggagatgctgggctggtacctgcgagccaacgacggcgacacgcactgcgccatcgtggcggccttcatcgacgtcgtcgtcgtcgccgccgtagccgccgacccggctcactcttcgcagcaggcctcgtctcgcacgtttgcgacgggggagttggatgtggcagacaagggcaaaccagctgatggagcgggagcgctcaccgtgtcatgtttggattaagctgagctaaatcttcacagtttatttgcattaccttattatatatgtagtactccgtgtt

SEQ ID NO: 782 - protein, 945 aa, Zea mays
  misc_feature: PFam Name: Extensin_2; PFam Description: Extensin-like region
  misc_feature: PFam Name: Pyr_redox_2; PFam Description: Pyridine
  misc_feature: PFam Name: FH2; PFam Description: Formin Homology 2 Domain
  misc_feature: PFam Name: Cupin_1; PFam Description: Cupin
  misc_feature: GI Number: 34908538; NR Description: P0423B08.18 [Oryza sativa (japonica cultivar-group)] >gi|15290117|dbj|BAB63809.1|
  misc_feature: GI Number: 21618162; NR Description: unknown [Arabidopsis thaliana]
  misc_feature: GI Number: 66776896; NR Description: LigA [Anaeromyxobacter dehalogenans 2CP-C] >gi|66857361|ref|ZP_00401413.1| LigA
  misc_feature: GI Number: 34872074; NR Description: similar to Ser/Arg-related nuclear matrix protein; plenty-of-prolines-101;
  misc_feature: GI Number: 7949115; NR Description: Ser/Arg-related nuclear matrix protein; plenty-of-prolines-101; serine/arginine repetitive matrix protein 1 [Mus musculus] >gi|3153821|gb|AAC17422.1|
CTCGCACAAAAAAGTCTGCAAGCAGGGTTAAGGCGCGCACCAACCTTTCCCTCCTACCTCTACTCCTGTTCCTCGGGTTCATCCTCACCTCGAGCGCTGCTGCGGCCATGGTGACCAGAAGGTTGGCTCTGAGCTCCCTCTTCCACGGCAAGGCAAGGGACACTTCGTCCTTACCACCGCCGCCTCCTCCTCCTCCCGCACCAGCCTGGGCATGGCCGTCCAGCAAGAACCCAAGAACGACGCAGCCGCAGGCAGCAGCAGCAGCAGCAGCAGCAGGCGCCAGGACCGTCGCCTCCATCGTCCTCGACTCCGCCGACTCGTCCTTCACGGCCTCCTCCGCGCTGCAGGAGGACTGCTGCTGCTCCGACAGCCTCTCCACGGCGTCCGAGGCGTCGGCGTCGGCGTCGGCGGCGTGCGACGACGCGGCGGCGGACGACGCCGTCGTCGTGCGCGGGGTCCGCTCCGACCGGCTCCTCTTCGACCCAGGCGCGTCGGCCACCAACTCCATCCTCGAGGAGAAGTCTGCCACCAAACGGGAGCAGGCGTTCGGCGGCGCCGTGGCCGTCGCGTTCGAGTCCGCCGACCCGTACGTGGACTTCCGGGCGTCCATGGAGGAGATGGTGGCCGCGCACGGGATCGGGCGCCACTGGGGCTGGCTGGAGGAGATGCTGGGCTGGTACCTGCGAGCCAACGACGGCGACACGCACTGCGCCATCGTGGCGGCCTTCATCGACGTCGTCGTCGTCGCCGCCGTAGCCGCCGACCCGGCTCACTCTTCGCAGCAGGCCTCGTCTCGCACGTTTGCGACGGGGGAGTTGGATGTGGCAGACAAGGGCAAACCAGCTGATGGAGCGGGAGCGCTCACCGTGTCATGTTTGGATTAAGCTGAGCTAAATCTTCACAGTTTATTTGCATTACCTTATTATATATGTAGTACTCCGTGTT

SEQ ID NO: 783 - DNA, 1233 bp, Zea mays
  misc_feature (1)..(1233): Ceres cDNA ID no. 12367623
  misc_feature (1)..(1233): Ceres CLONE  ID no. 292135
  misc_feature (1)..(1233): Also known as  Ceres CDNA ID no. 23776573
aacatcatcaccacacgctaaatttacagctagctagctgaattcgatcgatatccgggaactaataatccaccgaccccctcatggcggcttcgtcgcgaatgggcgtatctgtctacctcgccatcatggcggcggtgctcgcctcggcgctcggagcggagctcaccgcggactactatagcgagacgtgcccgcaagcgctgaccaccatcaagctcctcgtcggcgccgccatcctgagggagcccaggatgggggcgtcgctggtccgcctccactttcacgattgcttcgtcaatggctgcgacggctccatcctgctggacgacaccgacgacatggtcggagagaagacggcgaagcccaacaacaactccgtgagaggctacgacgtcatcgacaccatcaagtcggcggtgaacacgatatgcttgggcaacgtcgtctcctgcgccgatatcttggccgtggccgctcgcgattccattgtcgctctgggaggaacctcgtacgacgtgctcctggggcggcgcgacgcgacgacggcgagcatggacgacgcgaacaacgacatcccgacgccgttcatggacctgccggcgctacaggacagcttcgagtcccacggcctgtccctgcacgacctggtggtgctctccggcggccacacgctgggctactcccgctgcctcttcttccgcggccgcctgtacaacgagaccggcacgctggacccggcgtacgccgggtcgctggacgagcgctgcccgctggcgggcgacgacgacgcgctgtcggcgctggacgacacccccaccaccgtcgacgctgactactaccagggcctcatgcagggacgcgcgctgctgcactcggatcagcagctttaccaggcaggcggcgccgctggcgacctggtggagtactacgccgacaacccgaccaagttctgggaggacttcggcgcggcaatggtcaagctgggcagcctgagcccgctcaccggcgacgaaggggatgtcagggagaactgccgggtcgtcaaccaggtgtgagtgtgacttcgccgccatcgtcgaatcaacgaggcatcagcttcgttccgtacgtacactctggctgctagctgcaccggcaagctatgcaccaagattctgtagcgtgtgtctgatcattatttgtattcgcgtgcctacttaattttgtgagaaattggtcttatgtttggtt

SEQ ID NO: 784 - protein, 1233 aa, Zea mays
  misc_feature: PFam Name: peroxidase; PFam Description: Peroxidase
  misc_feature: GI Number: 50939979; NR Description: putative peroxidase precursor [Oryza sativa (japonica cultivar-group)] >gi|33146424|dbj|BAC79532.1| putative peroxidase precursor [Oryza sativa (japonica cultivar-group)] >gi|50508359|dbj|BAD30312.1|
  misc_feature: GI Number: 55700947; NR Description: TPA: class III
  misc_feature: GI Number: 66840760; NR Description: peroxidase [Picea abies]
  misc_feature: GI Number: 55701129; NR Description: TPA: class III
  misc_feature: GI Number: 55701139; NR Description: TPA: class III
AACATCATCACCACACGCTAAATTTACAGCTAGCTAGCTGAATTCGATCGATATCCGGGAACTAATAATCCACCGACCCCCTCATGGCGGCTTCGTCGCGAATGGGCGTATCTGTCTACCTCGCCATCATGGCGGCGGTGCTCGCCTCGGCGCTCGGAGCGGAGCTCACCGCGGACTACTATAGCGAGACGTGCCCGCAAGCGCTGACCACCATCAAGCTCCTCGTCGGCGCCGCCATCCTGAGGGAGCCCAGGATGGGGGCGTCGCTGGTCCGCCTCCACTTTCACGATTGCTTCGTCAATGGCTGCGACGGCTCCATCCTGCTGGACGACACCGACGACATGGTCGGAGAGAAGACGGCGAAGCCCAACAACAACTCCGTGAGAGGCTACGACGTCATCGACACCATCAAGTCGGCGGTGAACACGATATGCTTGGGCAACGTCGTCTCCTGCGCCGATATCTTGGCCGTGGCCGCTCGCGATTCCATTGTCGCTCTGGGAGGAACCTCGTACGACGTGCTCCTGGGGCGGCGCGACGCGACGACGGCGAGCATGGACGACGCGAACAACGACATCCCGACGCCGTTCATGGACCTGCCGGCGCTACAGGACAGCTTCGAGTCCCACGGCCTGTCCCTGCACGACCTGGTGGTGCTCTCCGGCGGCCACACGCTGGGCTACTCCCGCTGCCTCTTCTTCCGCGGCCGCCTGTACAACGAGACCGGCACGCTGGACCCGGCGTACGCCGGGTCGCTGGACGAGCGCTGCCCGCTGGCGGGCGACGACGACGCGCTGTCGGCGCTGGACGACACCCCCACCACCGTCGACGCTGACTACTACCAGGGCCTCATGCAGGGACGCGCGCTGCTGCACTCGGATCAGCAGCTTTACCAGGCAGGCGGCGCCGCTGGCGACCTGGTGGAGTACTACGCCGACAACCCGACCAAGTTCTGGGAGGACTTCGGCGCGGCAATGGTCAAGCTGGGCAGCCTGAGCCCGCTCACCGGCGACGAAGGGGATGTCAGGGAGAACTGCCGGGTCGTCAACCAGGTGTGAGTGTGACTTCGCCGCCATCGTCGAATCAACGAGGCATCAGCTTCGTTCCGTACGTACACTCTGGCTGCTAGCTGCACCGGCAAGCTATGCACCAAGATTCTGTAGCGTGTGTCTGATCATTATTTGTATTCGCGTGCCTACTTAATTTTGTGAGAAATTGGTCTTATGTTTGGTT

SEQ ID NO: 785 - DNA, 1523 bp, Zea mays
  misc_feature (1)..(1523): Ceres cDNA ID no. 12367639
  misc_feature (1)..(1523): Ceres CLONE  ID no. 322465
  misc_feature (1)..(1523): Also known as  Ceres CDNA ID no. 23771335
gatctgccatggcctcgctccagtcctttctcgccgtcaaaccggccgccggctgggccgctccgtcccgccgcgcgcgcgtcgcggccttcctcgctccgccgcccccgaccaccgcggccgccgtgggggcggcgcggcgggagctgtcggccgcgagcctggccgtcgtggacggcgaggcgcggtacctcgtcggcacctacaagcggtcccgcgtcgtcttcgagcacggccgcgggtgcaagctctacgataccgacggccgcgagtacctcgacatggccgccggcatcgccgtcacggcgctcgggccacgcggacccagacgtgtgcgccaccatcgcggagcaggccggtaaggtcgtccacgtcagcaacgtcttctacaccaaaccccaggtggagctagccaagcggctcgttgaggtgtcgttcgcggaccgcgccttcttcgccagcactggcacggaggccaacgaggcggccatcaaattctcccgcaagttccagcgggccgcacacccggagagcggcgacccgcccacggagttcctggcgttcagcagcagcttccacggccggaccatgggcgccgtcgcgctcaccagcaagtcgcagtaccgggagcccttcgcgcccgtcatgcctggggtgaccttcgtggattacggcgatctggaggcggccaagaagttcgtacggtccggcagggtcgctgctgtcttcgtcgagcccgtgcagggtgagggtggcattcacagtgccaccagggagttcttgcaggggctgcgggacgcctgtgacgaggcgggagccctcttggtctttgatgaggtgcagtgtggtttcgggcgcacaggccacctctgggcgcatgaggcgtacggagtggaaccagacataatgaccttagcgaagccactggccaacggcattcccatcggcgttgtcctggtgaaggagaagatcgccgcagccataaactacggcgaccacggcacgacgtttggcggcgggcctctcgcctgccagaccgcgataacggtgttcgacaagatcacgagacccggtttcctggccgaggtgtcgaggaaaggggagagcttcaagcagctgctccgcgccaagctgagcgggaacccgcacgtgagggaggtccgcggggtcggccttctcgtcggcgtcgagctggacgtgccagctggtcctctggtcgacgcgtgcttggacgccggcgtcgtcgtgctgactgccggtaagggcaatgtggtgaggctggtgccgccgctcatcgtctcggagaaggagctggagcatgccgcggatgtcataagggactgtctaccggcgctcgatgtcgttgctgctgccctatgtatatggtggtgcaataggtccggatatgaaacctgattccaaattttggaatcgaataaatttcatgtcgggccaatgttgttgtgttcattgaaacaaactcttttttttttggaatcgaataattattacatgtcagaccg

SEQ ID NO: 786 - protein, 1523 aa, Zea mays
  misc_feature: PFam Name: Aminotran_3; PFam Description: Aminotransferase
  misc_feature: GI Number: 1944511; NR Description: acetylornithine aminotransferase [Alnus glutinosa] >gi|2811029|sp|O04866|ARGD_ALNGL Acetylornithine aminotransferase, mitochondrial precursor (ACOAT)
  misc_feature: GI Number: 51854368; NR Description: putative acetylornithine
  misc_feature: GI Number: 21554043; NR Description: putative acetylornithine
  misc_feature: GI Number: 50936909; NR Description: putative acetylornithine aminotransferase [Oryza sativa (japonica cultivar-group)] >gi|34394063|dbj|BAC84165.1| putative acetylornithine
  misc_feature: GI Number: 53794956; NR Description: COG4992: Ornithine/acetylornithine aminotransferase [Chloroflexus
GATCTGCCATGGCCTCGCTCCAGTCCTTTCTCGCCGTCAAACCGGCCGCCGGCTGGGCCGCTCCGTCCCGCCGCGCGCGCGTCGCGGCCTTCCTCGCTCCGCCGCCCCCGACCACCGCGGCCGCCGTGGGGGCGGCGCGGCGGGAGCTGTCGGCCGCGAGCCTGGCCGTCGTGGACGGCGAGGCGCGGTACCTCGTCGGCACCTACAAGCGGTCCCGCGTCGTCTTCGAGCACGGCCGCGGGTGCAAGCTCTACGATACCGACGGCCGCGAGTACCTCGACATGGCCGCCGGCATCGCCGTCACGGCGCTCGGGCCACGCGGACCCAGACGTGTGCGCCACCATCGCGGAGCAGGCCGGTAAGGTCGTCCACGTCAGCAACGTCTTCTACACCAAACCCCAGGTGGAGCTAGCCAAGCGGCTCGTTGAGGTGTCGTTCGCGGACCGCGCCTTCTTCGCCAGCACTGGCACGGAGGCCAACGAGGCGGCCATCAAATTCTCCCGCAAGTTCCAGCGGGCCGCACACCCGGAGAGCGGCGACCCGCCCACGGAGTTCCTGGCGTTCAGCAGCAGCTTCCACGGCCGGACCATGGGCGCCGTCGCGCTCACCAGCAAGTCGCAGTACCGGGAGCCCTTCGCGCCCGTCATGCCTGGGGTGACCTTCGTGGATTACGGCGATCTGGAGGCGGCCAAGAAGTTCGTACGGTCCGGCAGGGTCGCTGCTGTCTTCGTCGAGCCCGTGCAGGGTGAGGGTGGCATTCACAGTGCCACCAGGGAGTTCTTGCAGGGGCTGCGGGACGCCTGTGACGAGGCGGGAGCCCTCTTGGTCTTTGATGAGGTGCAGTGTGGTTTCGGGCGCACAGGCCACCTCTGGGCGCATGAGGCGTACGGAGTGGAACCAGACATAATGACCTTAGCGAAGCCACTGGCCAACGGCATTCCCATCGGCGTTGTCCTGGTGAAGGAGAAGATCGCCGCAGCCATAAACTACGGCGACCACGGCACGACGTTTGGCGGCGGGCCTCTCGCCTGCCAGACCGCGATAACGGTGTTCGACAAGATCACGAGACCCGGTTTCCTGGCCGAGGTGTCGAGGAAAGGGGAGAGCTTCAAGCAGCTGCTCCGCGCCAAGCTGAGCGGGAACCCGCACGTGAGGGAGGTCCGCGGGGTCGGCCTTCTCGTCGGCGTCGAGCTGGACGTGCCAGCTGGTCCTCTGGTCGACGCGTGCTTGGACGCCGGCGTCGTCGTGCTGACTGCCGGTAAGGGCAATGTGGTGAGGCTGGTGCCGCCGCTCATCGTCTCGGAGAAGGAGCTGGAGCATGCCGCGGATGTCATAAGGGACTGTCTACCGGCGCTCGATGTCGTTGCTGCTGCCCTATGTATATGGTGGTGCAATAGGTCCGGATATGAAACCTGATTCCAAATTTTGGAATCGAATAAATTTCATGTCGGGCCAATGTTGTTGTGTTCATTGAAACAAACTCTTTTTTTTTTGGAATCGAATAATTATTACATGTCAGACCG

SEQ ID NO: 787 - DNA, 1225 bp, Zea mays
  misc_feature (1)..(1225): Ceres cDNA ID no. 12367684
  misc_feature (1)..(1225): Ceres CLONE  ID no. 324480
  misc_feature (1)..(1225): Also known as  Ceres CDNA ID no. 23792216
accgagatgctctcttcctccgttagttcagctaccgccgcgctgtctcgcgggtcgccgccgctccaagaagcatgccccgcctattgcttccatctccatcgcctcgcccctgtctgaacgactcggtgcgccgtccaccactctccaaatatcgattcttcctgcccaggactcggaggcggccaagtccgcggcttggcgtgcgaatggcggagatgaccaaggttgggagcgccggggaaccggccgaggttggggtttccatggagagtgacccgattgtgggaggggaggcgccgtcccgcccggggtgggaagcgagccggtgggcgcccgtggaggctgcgctgaatcggatgagtaaatggctggtggctggttctcttgcttttgcagctatttggaagcgtgatgctgaaattatgtggtttttgctgggtgcggttggcaactctctgctttcgatggttcttaaaaagatgctaaaccatgaaagacccgcaccagctttgcggtctggccctgggatgccgtcgtcccacgcacagtccatattctatgctgcgaccatcctggctctttcattgtactactggcttgggacaaattatctgaccatgattcttgggcctgcaactatgtcagtggctgcctatctgtcttggctacgggtgtctcggcgccttcatacactaaaccaggtcatggcggagctgttgtaggatctgtcgtcggtgctctatggtttgtgctctggcattcgcttgtgcaggaggcttttgcttcttctctgctggtcaggattgcagtcgttcttggatcatcagcattttgtgttggctttgtcatctacatgattcgtcactggctcaaggatgagtaatgtacttcttagccgcaatgggagatcgactgataggcacggtgcgtttggatgagtgaatccgttccaattgttatcagaatcgcttgaaatggtgtcaaatgggttgtgagtggagcgattcacgagtgaaaccatttttaattaaaattcaatctagtagttaaatgatttcacgaagtgattctagttcgtgatcagaaacatttcaagaatttagatccaaaatgtttctatacccatcatggtgcaaagacctctaaacgcacatttgatttctgttgtgaattagacctttttatttaacactgaaggaaagttaaagcatggattcttgtg

SEQ ID NO: 788 - protein, 1225 aa, Zea mays
  misc_feature: PFam Name: PAP2; PFam Description: PAP2 superfamily
  misc_feature: GI Number: 51964288; NR Description: PREDICTED P0724B10.35
  misc_feature: GI Number: 50911907; NR Description: phosphatidic acid phosphatase-like [Oryza sativa (japonica cultivar-group)] >gi|41053139|dbj|BAD08082.1| phosphatidic acid phosphatase-like
  misc_feature: GI Number: 42565815; NR Description: phosphatidic acid
ACCGAGATGCTCTCTTCCTCCGTTAGTTCAGCTACCGCCGCGCTGTCTCGCGGGTCGCCGCCGCTCCAAGAAGCATGCCCCGCCTATTGCTTCCATCTCCATCGCCTCGCCCCTGTCTGAACGACTCGGTGCGCCGTCCACCACTCTCCAAATATCGATTCTTCCTGCCCAGGACTCGGAGGCGGCCAAGTCCGCGGCTTGGCGTGCGAATGGCGGAGATGACCAAGGTTGGGAGCGCCGGGGAACCGGCCGAGGTTGGGGTTTCCATGGAGAGTGACCCGATTGTGGGAGGGGAGGCGCCGTCCCGCCCGGGGTGGGAAGCGAGCCGGTGGGCGCCCGTGGAGGCTGCGCTGAATCGGATGAGTAAATGGCTGGTGGCTGGTTCTCTTGCTTTTGCAGCTATTTGGAAGCGTGATGCTGAAATTATGTGGTTTTTGCTGGGTGCGGTTGGCAACTCTCTGCTTTCGATGGTTCTTAAAAAGATGCTAAACCATGAAAGACCCGCACCAGCTTTGCGGTCTGGCCCTGGGATGCCGTCGTCCCACGCACAGTCCATATTCTATGCTGCGACCATCCTGGCTCTTTCATTGTACTACTGGCTTGGGACAAATTATCTGACCATGATTCTTGGGCCTGCAACTATGTCAGTGGCTGCCTATCTGTCTTGGCTACGGGTGTCTCGGCGCCTTCATACACTAAACCAGGTCATGGCGGAGCTGTTGTAGGATCTGTCGTCGGTGCTCTATGGTTTGTGCTCTGGCATTCGCTTGTGCAGGAGGCTTTTGCTTCTTCTCTGCTGGTCAGGATTGCAGTCGTTCTTGGATCATCAGCATTTTGTGTTGGCTTTGTCATCTACATGATTCGTCACTGGCTCAAGGATGAGTAATGTACTTCTTAGCCGCAATGGGAGATCGACTGATAGGCACGGTGCGTTTGGATGAGTGAATCCGTTCCAATTGTTATCAGAATCGCTTGAAATGGTGTCAAATGGGTTGTGAGTGGAGCGATTCACGAGTGAAACCATTTTTAATTAAAATTCAATCTAGTAGTTAAATGATTTCACGAAGTGATTCTAGTTCGTGATCAGAAACATTTCAAGAATTTAGATCCAAAATGTTTCTATACCCATCATGGTGCAAAGACCTCTAAACGCACATTTGATTTCTGTTGTGAATTAGACCTTTTTATTTAACACTGAAGGAAAGTTAAAGCATGGATTCTTGTG

SEQ ID NO: 789 - DNA, 1449 bp, Zea mays
  misc_feature (1)..(1449): Ceres cDNA ID no. 12367750
  misc_feature (1)..(1449): Ceres CLONE  ID no. 333240
  misc_feature (1)..(1449): Also known as  Ceres CDNA ID no. 23763110
gcacgagaccattacctagaacatcctaatcgaaaactccacgccgcgcccgcggagctcgacgcccaccggcgctgcccgtcggagccggggggacgcgccggcgccggagctggcgggagcggagctggcggccatcttccgggtgatggcggacctcctcagcgacccagcgtggccgcagctccatccgcggccctgcaccgacacgccgtggccgggcctgcaatgcgagctcgtgcccgacgacgcgcgcgtgctccgcatcacccgcctccacctgggtctcgacgtcgccaccccgccctgcaggcccgaggccagactagaccccgcctcgctgcgcggactaccgcacctccggacgctctccatcttcagctgctttggcgccgcccaagcctccgttgagctgccgcccgcgctgttcacgtcgtcgtcctcgctcgagcagatcgtgctcaagtccaaccccggcctcaccggcctcataccggcgacgttgggcagcctgcggagcctgcgcgtgctcagcctctcgcagaacggcttccgcggcgggatccccagggagctcggcggcctcgccgcgctgcagcagctcgacctcagctacaacaacatcaccggcgagatccccgaggagattggtgcgatgtcgagtctgacgatccttgacctgagctggaacagcatcggcggcggcgtgccggcgacgctgggcaagctccagaggatgcagaaggcggacctgagctacaaccgcctcgccggccgcgtgccgccggaggcggggtcgctgcgggagctggtgttcctggacctgagccacaacagcctcgcgggcccgctgccgagctcgctggccggcctgtccaggctgcagtacctgctgctgcaggacaaccccctcggcacggcggtgccggcggtggtcgggtcgctgcggcggctgcaggtgctgggcctgtccgggtgcaacctgacggggcccatcccgcgcggcgcgttcgcggcgctggccagcctcacggcgctgtcgctggaccggaaccggctggacgggccgatcccggcgagcctggccgcgctgccccaactgggccagctcaacctcagccagaaccggctggccggggagatcgcgctgccgggggagtttgtcgcgcggctcggcaggcgcctcgacgtccggggcaacgacgagctgtgcatcggcaggggcctacagggtagcggctatctgggagcgcccccgtgcgtggacagccacaacggcgacggatcgccggaaatatcaggtgctgctgcggcggccgtcggcctattcgacgggtcggcgtgtcatctttttgtgtcgtgtctggcgttcgtgttccagttgtgatgtgacatgtaactccggtcgctttctccgcccgactgctgcgacgcgagttttttcctgcc

SEQ ID NO: 790 - protein, 1449 aa, Zea mays
  misc_feature: PFam Name: DivIVA; PFam Description: DivIVA protein
  misc_feature: PFam Name: Pkinase; PFam Description: Protein kinase domain
  misc_feature: PFam Name: Prog_receptor; PFam Description: Progesterone receptor
  misc_feature: PFam Name: Peptidase_S8; PFam Description: Subtilase family
  misc_feature: PFam Name: Aldedh; PFam Description: Aldehyde dehydrogenase family
  misc_feature: GI Number: 34910824; NR Description: putative Hcr2-0B [Oryza sativa (japonica cultivar-group)] >gi|12328502|dbj|BAB21161.1| putative Hcr2-0B [Oryza sativa (japonica cultivar-group)] >gi|15289814|dbj|BAB63512.1| putative Hcr2-0B [Oryza sativa
  misc_feature: GI Number: 48843812; NR Description: putative leucine-rich
  misc_feature: GI Number: 34912808; NR Description: P0501G01.13 [Oryza sativa (japonica cultivar-group)] >gi|12313679|dbj|BAB21084.1|
  misc_feature: GI Number: 34894182; NR Description: P0439B06.12 [Oryza
  misc_feature: GI Number: 15236148; NR Description: leucine rich repeat
GCACGAGACCATTACCTAGAACATCCTAATCGAAAACTCCACGCCGCGCCCGCGGAGCTCGACGCCCACCGGCGCTGCCCGTCGGAGCCGGGGGGACGCGCCGGCGCCGGAGCTGGCGGGAGCGGAGCTGGCGGCCATCTTCCGGGTGATGGCGGACCTCCTCAGCGACCCAGCGTGGCCGCAGCTCCATCCGCGGCCCTGCACCGACACGCCGTGGCCGGGCCTGCAATGCGAGCTCGTGCCCGACGACGCGCGCGTGCTCCGCATCACCCGCCTCCACCTGGGTCTCGACGTCGCCACCCCGCCCTGCAGGCCCGAGGCCAGACTAGACCCCGCCTCGCTGCGCGGACTACCGCACCTCCGGACGCTCTCCATCTTCAGCTGCTTTGGCGCCGCCCAAGCCTCCGTTGAGCTGCCGCCCGCGCTGTTCACGTCGTCGTCCTCGCTCGAGCAGATCGTGCTCAAGTCCAACCCCGGCCTCACCGGCCTCATACCGGCGACGTTGGGCAGCCTGCGGAGCCTGCGCGTGCTCAGCCTCTCGCAGAACGGCTTCCGCGGCGGGATCCCCAGGGAGCTCGGCGGCCTCGCCGCGCTGCAGCAGCTCGACCTCAGCTACAACAACATCACCGGCGAGATCCCCGAGGAGATTGGTGCGATGTCGAGTCTGACGATCCTTGACCTGAGCTGGAACAGCATCGGCGGCGGCGTGCCGGCGACGCTGGGCAAGCTCCAGAGGATGCAGAAGGCGGACCTGAGCTACAACCGCCTCGCCGGCCGCGTGCCGCCGGAGGCGGGGTCGCTGCGGGAGCTGGTGTTCCTGGACCTGAGCCACAACAGCCTCGCGGGCCCGCTGCCGAGCTCGCTGGCCGGCCTGTCCAGGCTGCAGTACCTGCTGCTGCAGGACAACCCCCTCGGCACGGCGGTGCCGGCGGTGGTCGGGTCGCTGCGGCGGCTGCAGGTGCTGGGCCTGTCCGGGTGCAACCTGACGGGGCCCATCCCGCGCGGCGCGTTCGCGGCGCTGGCCAGCCTCACGGCGCTGTCGCTGGACCGGAACCGGCTGGACGGGCCGATCCCGGCGAGCCTGGCCGCGCTGCCCCAACTGGGCCAGCTCAACCTCAGCCAGAACCGGCTGGCCGGGGAGATCGCGCTGCCGGGGGAGTTTGTCGCGCGGCTCGGCAGGCGCCTCGACGTCCGGGGCAACGACGAGCTGTGCATCGGCAGGGGCCTACAGGGTAGCGGCTATCTGGGAGCGCCCCCGTGCGTGGACAGCCACAACGGCGACGGATCGCCGGAAATATCAGGTGCTGCTGCGGCGGCCGTCGGCCTATTCGACGGGTCGGCGTGTCATCTTTTTGTGTCGTGTCTGGCGTTCGTGTTCCAGTTGTGATGTGACATGTAACTCCGGTCGCTTTCTCCGCCCGACTGCTGCGACGCGAGTTTTTTCCTGCC

SEQ ID NO: 791 - DNA, 1596 bp, Zea mays
  misc_feature (1)..(1596): Ceres cDNA ID no. 12367758
  misc_feature (1)..(1596): Ceres CLONE  ID no. 335214
  misc_feature (1)..(1596): Also known as  Ceres CDNA ID no. 23772145
agttttcgcggatctcagttccccttgcacctttttctgggtttctcccccatcacggaaagcgcaaagccgcggccacaccgcaacaaagccaacgagcccaacccggacgggtgagcgagcggctcgtgcggaggtacacagagacgcggaccgggtcgccggacgacgagacgcaccatggcaccgtcgcagctgcttggcagcaccgatctctggcggcccgttgccgccgcgcgcgggggcggctgggccacggccgccgtgctcctcctcctccttgcctctcacctcgcagtcctcctcgtccgcctccgccgccgcctccgcggcggaggccgaaacgcccatccggaggccgccgtggcacccgcgcctgcctccacgccccctggttccgcttccgcctcaggaatagagggattagtgacggagggcgatctgaggcagctggtaggcagtctgggcttgggcgcgcacgaaccagagagggagggctgggagcacgtcatctccaagagcagcgacgacgtctcctacaaggcctggtgcgacaagcccacggctggccctcctaaatatctgagtattacaacatacgagagatgctcggcagagcagctgagggacttctacatggataatgagtacagaatggagtgggataacactgtcaaaaaacatgagcagctgcagtatgacgagaacagtggggtggaggtagggcgaacaattaagaagtttccacttctaacaccaagagagtacatattggcatggcgagtctgggaagcaaacgacaagtctttctattgctttatcaaggaatgtgaacaccctcttgcggcacgacagagaaagtttgttagagtgcaacttctaagatcaggatggtgtattaggaaaatcccaggcagggatgcatgccaaatcacggtgctgcatcatgaggacaatggaatgaatatagagatggcaaagctagctttttccaagggcatctggagctacatatgtaaaatgaacaatgctctacgtcggtatcctcagcatggcagtccatcagtgtcaattctgaccatgcagaaacttatgaagaagtttccccaggatttggagactgccgacgcaagcctttctgcttctcagaacactgcagcatcggtcgttccttccacaccgacttccaggacttcaccatgcaagcttgaggggagaaagtctcgccaaatgatcgcgagcgggattctgctggttggaagcatcgtttgtctatctcgaggccgatccaacctcggggcgcagctcgcgatggccttcttcctgaaaaaggccttcaagcaagagaggcaatcaagctcctcatcgacatgaatggtgaaaacaaacgtgactagatgcaggcggtagccgtactggtttgagccgtgcagactccagacaacgtattattagcatttttaacctttctctgattacagaatacgtgactagataacctttgaccctgagccgtgcagacaagttgtaaagagttttttccggaactagttttgtaaataatcgttttcaaatctggaaacatagaattacttc

SEQ ID NO: 792 - protein, 1596 aa, Zea mays
  misc_feature: PFam Name: START; PFam Description: START domain
  misc_feature: GI Number: 50908121; NR Description: putative membrane related protein [Oryza sativa (japonica cultivar-group)] >gi|47497322|dbj|BAD19363.1| putative membrane related protein
  misc_feature: GI Number: 8778323; NR Description: F14J16.24 [Arabidopsis thaliana] >gi|25406013|pir||G96600 protein F14J16.24 [imported] -
  misc_feature: GI Number: 46798907; NR Description: membrane related protein
  misc_feature: GI Number: 23197608; NR Description: membrane related protein CP5, putative [Arabidopsis thaliana] >gi|22135902|gb|AAM91533.1|
  misc_feature: GI Number: 21593272; NR Description: membrane related
AGTTTTCGCGGATCTCAGTTCCCCTTGCACCTTTTTCTGGGTTTCTCCCCCATCACGGAAAGCGCAAAGCCGCGGCCACACCGCAACAAAGCCAACGAGCCCAACCCGGACGGGTGAGCGAGCGGCTCGTGCGGAGGTACACAGAGACGCGGACCGGGTCGCCGGACGACGAGACGCACCATGGCACCGTCGCAGCTGCTTGGCAGCACCGATCTCTGGCGGCCCGTTGCCGCCGCGCGCGGGGGCGGCTGGGCCACGGCCGCCGTGCTCCTCCTCCTCCTTGCCTCTCACCTCGCAGTCCTCCTCGTCCGCCTCCGCCGCCGCCTCCGCGGCGGAGGCCGAAACGCCCATCCGGAGGCCGCCGTGGCACCCGCGCCTGCCTCCACGCCCCCTGGTTCCGCTTCCGCCTCAGGAATAGAGGGATTAGTGACGGAGGGCGATCTGAGGCAGCTGGTAGGCAGTCTGGGCTTGGGCGCGCACGAACCAGAGAGGGAGGGCTGGGAGCACGTCATCTCCAAGAGCAGCGACGACGTCTCCTACAAGGCCTGGTGCGACAAGCCCACGGCTGGCCCTCCTAAATATCTGAGTATTACAACATACGAGAGATGCTCGGCAGAGCAGCTGAGGGACTTCTACATGGATAATGAGTACAGAATGGAGTGGGATAACACTGTCAAAAAACATGAGCAGCTGCAGTATGACGAGAACAGTGGGGTGGAGGTAGGGCGAACAATTAAGAAGTTTCCACTTCTAACACCAAGAGAGTACATATTGGCATGGCGAGTCTGGGAAGCAAACGACAAGTCTTTCTATTGCTTTATCAAGGAATGTGAACACCCTCTTGCGGCACGACAGAGAAAGTTTGTTAGAGTGCAACTTCTAAGATCAGGATGGTGTATTAGGAAAATCCCAGGCAGGGATGCATGCCAAATCACGGTGCTGCATCATGAGGACAATGGAATGAATATAGAGATGGCAAAGCTAGCTTTTTCCAAGGGCATCTGGAGCTACATATGTAAAATGAACAATGCTCTACGTCGGTATCCTCAGCATGGCAGTCCATCAGTGTCAATTCTGACCATGCAGAAACTTATGAAGAAGTTTCCCCAGGATTTGGAGACTGCCGACGCAAGCCTTTCTGCTTCTCAGAACACTGCAGCATCGGTCGTTCCTTCCACACCGACTTCCAGGACTTCACCATGCAAGCTTGAGGGGAGAAAGTCTCGCCAAATGATCGCGAGCGGGATTCTGCTGGTTGGAAGCATCGTTTGTCTATCTCGAGGCCGATCCAACCTCGGGGCGCAGCTCGCGATGGCCTTCTTCCTGAAAAAGGCCTTCAAGCAAGAGAGGCAATCAAGCTCCTCATCGACATGAATGGTGAAAACAAACGTGACTAGATGCAGGCGGTAGCCGTACTGGTTTGAGCCGTGCAGACTCCAGACAACGTATTATTAGCATTTTTAACCTTTCTCTGATTACAGAATACGTGACTAGATAACCTTTGACCCTGAGCCGTGCAGACAAGTTGTAAAGAGTTTTTTCCGGAACTAGTTTTGTAAATAATCGTTTTCAAATCTGGAAACATAGAATTACTTC

SEQ ID NO: 793 - DNA, 1864 bp, Zea mays
  misc_feature (1)..(1864): Ceres cDNA ID no. 12367773
  misc_feature (1)..(1864): Ceres CLONE  ID no. 336522
  misc_feature (1)..(1864): Also known as  Ceres CDNA ID no. 23762276
gacttctcccccgtttccgcccacatccgccgacctgcctcgccattccgccgcgccttcgcatcgtccgcgcgcccggcccttttcgttctaccccggtacgactcgacggtggtcgtgggcgccgaaggtgcggctccgaggcgccaggtggttcgtttgctgtttgcgcgatcgccggaggagtctgtgcaagctgtgctggctaagggtttgggggttcggattcagtggaggggctgcggcaggagggagctagagatgtacggaccgccgtcccgaggcggcgggggagctggcactgccggagagcagcctagggtttaccaagtttggcgaggaagcaacgagtttttcttgcaaggccggttcatatttggacctgatgtgagatcattgtttctcaccatattcctcattcttgcgccaatggtggtcttctgtatatttgtggccagacatcttatcaatgactttcctgatcattggggagtttcagttatggtcatagtgattgtcttcactgtatacgatttaacattgctgcttcttacctctggtagagatcctggtatagtgcctcgtaacacccatcctcctgaaactgacgctattgaaatgaacaatgatgctggaaatggtcagacaccacaacaattgcggttgccacggacaaaggatgttattgtaaatggggtcattgtgaaggtcaagtactgtgacacctgcatgctgtacagaccacctcgatgctcacactgctctatctgtaataactgtgtggagcgctttgaccaccactgcccttgggttggccaatgcataggattgcgcaattatcggttcttctatatgtttgtattctctacaacattactgtgcctttatgtatttggtttctgctgggtgtacattatcaagattagagacgcagaacagtcgtcgatctggaaagcaatgttgaagactccagcatcaattgttctgatcatatactgcttcatctgtgtgtggtttgtgggtggtctgtctgttttccatttctatctcatgagcaccaaccagacaacctatgagaacttcagatatcgctatgatcggcgggccaacccgtacaacatagggatcttgaacaacttcatggagatattctgcaccgcagtccctccttccaagaacaacttccgagccagggtcccagtagagcaaggtttacagcaatcgcgtgcgccagcaaggggtttcatgagtctaaacatggataaacctgttggggacttcgaattgagtaggaagccagtatcatgggatgaacctcggtcagcagctgatatcagggacttggaggttggtctagggggtctactggacgagaaagaaggcaggatagcccatgcgtccccggatctgagcagagatgcccttcctgagcttgtggaagggagggctggtatgcattcgaggcgatcaagttggggtcacagaagcggggacctcggagtccgtggacagcattgctgtgcagatggggaccggagattctcactggggctccattagcagtgcccatggcacaaccagtggagctcactagcaagctacgccacgtctttgacgcatcttcttgtgaaacctgcctgataccaccaacgaagaagcgacctttgggcgctctctgtgcacatgtgctttcactccactccacctaggatatacgtctgcagtgctttcttactcagttgtcctgagagcgcatcagttctgatggtttgcttcccgtttggtgttttaagcaaaaataacagaagagccccttaactccccctgttgtttggattatccactgtatatatgtatctttgcc

SEQ ID NO: 794 - protein, 1864 aa, Zea mays
  misc_feature: PFam Name: zf-DHHC; PFam Description: DHHC zinc finger domain
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 57900122; NR Description: putative zisp [Oryza sativa (japonica cultivar-group)] gi|57899394|dbj|BAD88041.1|
  misc_feature: GI Number: 30688566; NR Description: zinc finger (DHHC type)
  misc_feature: GI Number: 30693084; NR Description: zinc finger (DHHC type)
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
GACTTCTCCCCCGTTTCCGCCCACATCCGCCGACCTGCCTCGCCATTCCGCCGCGCCTTCGCATCGTCCGCGCGCCCGGCCCTTTTCGTTCTACCCCGGTACGACTCGACGGTGGTCGTGGGCGCCGAAGGTGCGGCTCCGAGGCGCCAGGTGGTTCGTTTGCTGTTTGCGCGATCGCCGGAGGAGTCTGTGCAAGCTGTGCTGGCTAAGGGTTTGGGGGTTCGGATTCAGTGGAGGGGCTGCGGCAGGAGGGAGCTAGAGATGTACGGACCGCCGTCCCGAGGCGGCGGGGGAGCTGGCACTGCCGGAGAGCAGCCTAGGGTTTACCAAGTTTGGCGAGGAAGCAACGAGTTTTTCTTGCAAGGCCGGTTCATATTTGGACCTGATGTGAGATCATTGTTTCTCACCATATTCCTCATTCTTGCGCCAATGGTGGTCTTCTGTATATTTGTGGCCAGACATCTTATCAATGACTTTCCTGATCATTGGGGAGTTTCAGTTATGGTCATAGTGATTGTCTTCACTGTATACGATTTAACATTGCTGCTTCTTACCTCTGGTAGAGATCCTGGTATAGTGCCTCGTAACACCCATCCTCCTGAAACTGACGCTATTGAAATGAACAATGATGCTGGAAATGGTCAGACACCACAACAATTGCGGTTGCCACGGACAAAGGATGTTATTGTAAATGGGGTCATTGTGAAGGTCAAGTACTGTGACACCTGCATGCTGTACAGACCACCTCGATGCTCACACTGCTCTATCTGTAATAACTGTGTGGAGCGCTTTGACCACCACTGCCCTTGGGTTGGCCAATGCATAGGATTGCGCAATTATCGGTTCTTCTATATGTTTGTATTCTCTACAACATTACTGTGCCTTTATGTATTTGGTTTCTGCTGGGTGTACATTATCAAGATTAGAGACGCAGAACAGTCGTCGATCTGGAAAGCAATGTTGAAGACTCCAGCATCAATTGTTCTGATCATATACTGCTTCATCTGTGTGTGGTTTGTGGGTGGTCTGTCTGTTTTCCATTTCTATCTCATGAGCACCAACCAGACAACCTATGAGAACTTCAGATATCGCTATGATCGGCGGGCCAACCCGTACAACATAGGGATCTTGAACAACTTCATGGAGATATTCTGCACCGCAGTCCCTCCTTCCAAGAACAACTTCCGAGCCAGGGTCCCAGTAGAGCAAGGTTTACAGCAATCGCGTGCGCCAGCAAGGGGTTTCATGAGTCTAAACATGGATAAACCTGTTGGGGACTTCGAATTGAGTAGGAAGCCAGTATCATGGGATGAACCTCGGTCAGCAGCTGATATCAGGGACTTGGAGGTTGGTCTAGGGGGTCTACTGGACGAGAAAGAAGGCAGGATAGCCCATGCGTCCCCGGATCTGAGCAGAGATGCCCTTCCTGAGCTTGTGGAAGGGAGGGCTGGTATGCATTCGAGGCGATCAAGTTGGGGTCACAGAAGCGGGGACCTCGGAGTCCGTGGACAGCATTGCTGTGCAGATGGGGACCGGAGATTCTCACTGGGGCTCCATTAGCAGTGCCCATGGCACAACCAGTGGAGCTCACTAGCAAGCTACGCCACGTCTTTGACGCATCTTCTTGTGAAACCTGCCTGATACCACCAACGAAGAAGCGACCTTTGGGCGCTCTCTGTGCACATGTGCTTTCACTCCACTCCACCTAGGATATACGTCTGCAGTGCTTTCTTACTCAGTTGTCCTGAGAGCGCATCAGTTCTGATGGTTTGCTTCCCGTTTGGTGTTTTAAGCAAAAATAACAGAAGAGCCCCTTAACTCCCCCTGTTGTTTGGATTATCCACTGTATATATGTATCTTTGCC

SEQ ID NO: 795 - DNA, 938 bp, Zea mays
  misc_feature (1)..(938): Ceres cDNA ID no. 12367866
  misc_feature (1)..(938): Ceres CLONE  ID no. 389572
  misc_feature (1)..(938): Also known as  Ceres CDNA ID no. 23814099
tcctgtatcaacatattcgctcatttgcgctagtcagctggccttcaatgctgtcttctcatatgtcctaaatgctcaaaagttcaccccattcattttcaactcagtaatcctccttacgttttccgctgcgcttcttggagtcgacgaagattctcagggtaccaatggtttatcgcgtgggaagtacatattgggtttcgcattgaccctaggagcctcggccacatactcactaattctctctctaatcaagtcgcattcgagaaggttattaagaaggaaactttctcagtcgtgttgaatatgcagatatatacagcactagtggcaacagtagcttctcttatcggtttatttgcaagcggcgagtggaagactttagagggagagatgcatgccttcagctcagggagagtgtcctatgtgatgacacttctatggactgctgtatcttggcagatagcttccgtaggagtggtgggtttgatctttgttgtgtcatcactcttttcaaatgtgataagcacactggctctacccatcattccgatttttgctgtgattttcttccacgacaagatggatggagtgaagattattgctatgttgatggccatctggggattcgtttcatatggatatcaattatatgtcagtgacaagaaggctaggaagacttcagtcagtgtggaggagaattcctaagcgcttgttggcctgttacattggtctttgtggctcctataccactttaagttgctggtattgaggaggtactagttattgacttattgtatccaaaaggagctcagttgagaatctcaggtttacacaattcataggtatatacttctgttagtattgtcatatcatcatatgtaccgatgtatggttgtgttgtcctttaaaataaaaagattagcatttccagaggc

SEQ ID NO: 796 - protein, 938 aa, Zea mays
  misc_feature: GI Number: 38605752; NR Description: OSJNBb0016D16.5 [Oryza
  misc_feature: GI Number: 42571763; NR Description: purine permease family
  misc_feature: GI Number: 30684325; NR Description: purine permease family
  misc_feature: GI Number: 50911631; NR Description: putative purine permease [Oryza sativa (japonica cultivar-group)] >gi|41052802|dbj|BAD07670.1| putative purine permease [Oryza sativa
  misc_feature: GI Number: 50911633; NR Description: putative purine permease [Oryza sativa (japonica cultivar-group)] >gi|41052803|dbj|BAD07671.1| putative purine permease [Oryza sativa
TCCTGTATCAACATATTCGCTCATTTGCGCTAGTCAGCTGGCCTTCAATGCTGTCTTCTCATATGTCCTAAATGCTCAAAAGTTCACCCCATTCATTTTCAACTCAGTAATCCTCCTTACGTTTTCCGCTGCGCTTCTTGGAGTCGACGAAGATTCTCAGGGTACCAATGGTTTATCGCGTGGGAAGTACATATTGGGTTTCGCATTGACCCTAGGAGCCTCGGCCACATACTCACTAATTCTCTCTCTAATCAAGTCGCATTCGAGAAGGTTATTAAGAAGGAAACTTTCTCAGTCGTGTTGAATATGCAGATATATACAGCACTAGTGGCAACAGTAGCTTCTCTTATCGGTTTATTTGCAAGCGGCGAGTGGAAGACTTTAGAGGGAGAGATGCATGCCTTCAGCTCAGGGAGAGTGTCCTATGTGATGACACTTCTATGGACTGCTGTATCTTGGCAGATAGCTTCCGTAGGAGTGGTGGGTTTGATCTTTGTTGTGTCATCACTCTTTTCAAATGTGATAAGCACACTGGCTCTACCCATCATTCCGATTTTTGCTGTGATTTTCTTCCACGACAAGATGGATGGAGTGAAGATTATTGCTATGTTGATGGCCATCTGGGGATTCGTTTCATATGGATATCAATTATATGTCAGTGACAAGAAGGCTAGGAAGACTTCAGTCAGTGTGGAGGAGAATTCCTAAGCGCTTGTTGGCCTGTTACATTGGTCTTTGTGGCTCCTATACCACTTTAAGTTGCTGGTATTGAGGAGGTACTAGTTATTGACTTATTGTATCCAAAAGGAGCTCAGTTGAGAATCTCAGGTTTACACAATTCATAGGTATATACTTCTGTTAGTATTGTCATATCATCATATGTACCGATGTATGGTTGTGTTGTCCTTTAAAATAAAAAGATTAGCATTTCCAGAGGC

SEQ ID NO: 797 - DNA, 1564 bp, Zea mays
  misc_feature (1)..(1564): Ceres cDNA ID no. 12367922
  misc_feature (1)..(1564): Ceres CLONE  ID no. 304531
  misc_feature (1)..(1564): Also known as  Ceres CDNA ID no. 23762196
actgtattattgtgtggctcagctcaacaagctcgccgcaccgtcgccatggacgccgccaccggcaactgttcctcctctccgctgcgcatcgtgatctgcccgtggctcgcgttcggccacatgctcccgtgcctggagctcgcggagcgtctggcttcgcggggccaccgcgtgtccttcgtctccacgccgcgcaacctggcgcgcctcccgccgcggcgccacgacgtgcacctcgtgcccctgcccctcccacgcgtggagggcctccccgacggcgtcgagtccaccaacgacgtgccccccgacaagagagacctccactggaaggccttcgacggcctcgccgtccccttcgctgagttcctggccgccgcgtgcgccgacgaggctaccaggccggactgggtcctcgccgacacattctcccattgggcggccgccgtcgccctcgagcacaaggtgccaagcgcgatgcttctcccgagcgccgccatgatcgcctcgtgctggcaccggccgccgtcgcacgccgagcagccgagaagcgcagtgtttgaggagccggcggaacggccggcgggtgtgctcccttacgagtgggataaaagagcgcacttctttgggccccaaagagcgtcgggcatgtccaccgcgcagcgctgcttcctgacactgcagaggtgcaggctgctggccatgcggagctgccccgagtgggagccggagaatttcacggtggcggcggcactcctcggcaagccgctcgtgccgctcggcctcctaccgccgtcgcccaacggtggacgacgacgagaggaggacggcggcagtacggcgcgctgctggctggacgcgcagccgccgagctcggtcgtgtacgtggcgttgggcagcgaagtcccgctgacggtggcgctggtgcacgagctcgcccttgggctggagctcgccggcgcacgcttcctttgggctctccggaagcccagcggcgtcgcggacgacgccgacgtgctcccgccgggattccgggagcgcacctgcggccgcgggctcgtcgccatgggctgggtccctcagatgagcatactggcgcacggcgccgtgggcgggttcctgacgcactgcggccggaactcgctcgtcgaagggctcctgttcggccaccctctcgtcatgctgcccgtcgtcggggaccagggccccaacgcgcgcgccatggagcggaccaaggttgggctgcaggtggcgaggaacggcaaggacgggtcgttcgaccgccacggcgtcgccgccgccgtccgggaagtcatgctggtggaagaagccaggaaggtcttcgtggcgaatgccctggaaatgcagcgtgttgtggccgacaaggaacgccatgagagatacatcgacgagttcatacgccagctgagatcttactccactccgccggcagcgagttaaaaaggcgtacttggtggcttggtgcctcgcactgtatgtctgtatggggtctaggatgtcaacggttacgtacccgtccagtaatattattccatacttacct

SEQ ID NO: 798 - protein, 1564 aa, Zea mays
  misc_feature: PFam Name: UDPGT; PFam Description: UDP-glucoronosyl and
  misc_feature: PFam Name: Glyco_transf_28; PFam Description:
  misc_feature: PFam Name: Peptidase_S8; PFam Description: Subtilase family
  misc_feature: GI Number: 50918067; NR Description: putative UDP-glucoronosyl and UDP-glucosyl transferase [Oryza sativa (japonica cultivar-group)] >gi|41469442|gb|AAS07243.1| putative UDP-glucoronosyl and UDP-glucosyl transferase [Oryza protein
  misc_feature: GI Number: 50918061; NR Description: putative UDP-glucoronosyl and UDP-glucosyl transferase [Oryza sativa (japonica cultivar-group)] >gi|41469452|gb|AAS07253.1| putative UDP-glucoronosyl and UDP-glucosyl transferase [Oryza protein
  misc_feature: GI Number: 51091136; NR Description: putative UDP-glucosyltransferase [Oryza sativa (japonica cultivar-group)] >gi|51090402|dbj|BAD35324.1| putative UDP-glucosyltransferase
  misc_feature: GI Number: 50909939; NR Description: putative UDP-glucosyltransferase [Oryza sativa (japonica cultivar-group)] >gi|46806235|dbj|BAD17459.1| putative UDP-glucosyltransferase
  misc_feature: GI Number: 50919219; NR Description: putative UDP-glucoronosyl and UDP-glucosyl transferase [Oryza sativa (japonica cultivar-group)] >gi|41469414|gb|AAS07237.1| putative UDP-glucoronosyl and UDP-glucosyl transferase [Oryza sativa
ACTGTATTATTGTGTGGCTCAGCTCAACAAGCTCGCCGCACCGTCGCCATGGACGCCGCCACCGGCAACTGTTCCTCCTCTCCGCTGCGCATCGTGATCTGCCCGTGGCTCGCGTTCGGCCACATGCTCCCGTGCCTGGAGCTCGCGGAGCGTCTGGCTTCGCGGGGCCACCGCGTGTCCTTCGTCTCCACGCCGCGCAACCTGGCGCGCCTCCCGCCGCGGCGCCACGACGTGCACCTCGTGCCCCTGCCCCTCCCACGCGTGGAGGGCCTCCCCGACGGCGTCGAGTCCACCAACGACGTGCCCCCCGACAAGAGAGACCTCCACTGGAAGGCCTTCGACGGCCTCGCCGTCCCCTTCGCTGAGTTCCTGGCCGCCGCGTGCGCCGACGAGGCTACCAGGCCGGACTGGGTCCTCGCCGACACATTCTCCCATTGGGCGGCCGCCGTCGCCCTCGAGCACAAGGTGCCAAGCGCGATGCTTCTCCCGAGCGCCGCCATGATCGCCTCGTGCTGGCACCGGCCGCCGTCGCACGCCGAGCAGCCGAGAAGCGCAGTGTTTGAGGAGCCGGCGGAACGGCCGGCGGGTGTGCTCCCTTACGAGTGGGATAAAAGAGCGCACTTCTTTGGGCCCCAAAGAGCGTCGGGCATGTCCACCGCGCAGCGCTGCTTCCTGACACTGCAGAGGTGCAGGCTGCTGGCCATGCGGAGCTGCCCCGAGTGGGAGCCGGAGAATTTCACGGTGGCGGCGGCACTCCTCGGCAAGCCGCTCGTGCCGCTCGGCCTCCTACCGCCGTCGCCCAACGGTGGACGACGACGAGAGGAGGACGGCGGCAGTACGGCGCGCTGCTGGCTGGACGCGCAGCCGCCGAGCTCGGTCGTGTACGTGGCGTTGGGCAGCGAAGTCCCGCTGACGGTGGCGCTGGTGCACGAGCTCGCCCTTGGGCTGGAGCTCGCCGGCGCACGCTTCCTTTGGGCTCTCCGGAAGCCCAGCGGCGTCGCGGACGACGCCGACGTGCTCCCGCCGGGATTCCGGGAGCGCACCTGCGGCCGCGGGCTCGTCGCCATGGGCTGGGTCCCTCAGATGAGCATACTGGCGCACGGCGCCGTGGGCGGGTTCCTGACGCACTGCGGCCGGAACTCGCTCGTCGAAGGGCTCCTGTTCGGCCACCCTCTCGTCATGCTGCCCGTCGTCGGGGACCAGGGCCCCAACGCGCGCGCCATGGAGCGGACCAAGGTTGGGCTGCAGGTGGCGAGGAACGGCAAGGACGGGTCGTTCGACCGCCACGGCGTCGCCGCCGCCGTCCGGGAAGTCATGCTGGTGGAAGAAGCCAGGAAGGTCTTCGTGGCGAATGCCCTGGAAATGCAGCGTGTTGTGGCCGACAAGGAACGCCATGAGAGATACATCGACGAGTTCATACGCCAGCTGAGATCTTACTCCACTCCGCCGGCAGCGAGTTAAAAAGGCGTACTTGGTGGCTTGGTGCCTCGCACTGTATGTCTGTATGGGGTCTAGGATGTCAACGGTTACGTACCCGTCCAGTAATATTATTCCATACTTACCT

SEQ ID NO: 799 - DNA, 1260 bp, Zea mays
  misc_feature (1)..(1260): Ceres cDNA ID no. 12368126
  misc_feature (1)..(1260): Ceres CLONE  ID no. 382385
  misc_feature (1)..(1260): Also known as  Ceres CDNA ID no. 23803174
agtcaaacaaattgtttactagcctaagtgtaagagcagcacgatggtgcatcaggctcagggacagatggtgcaggaggtggccgccgccggcctccccgcgctgccgagccggtacgtgctgagggaggaggaccgcccaactggtgacgtcgcggcacccgagttggccttccccaccgtggacgtcaatgtcttgccgaccccggtgacgtggaggaggccagcaagctccggtcggcgctcgaatcctggggcctcttcaaggtgaccggccacggcatgccggtatccctgctggacggcatccgggacgccgggctggagttcttccacctgccagcggcggagaagctgaagcacgccaaccgggacgacgccggcgagttccagcccgagggttacggcatcgaccgcgtggacaccgacggtcaggtgctggactggtgcgaccggctgtacctgacggtgcagccggaggaggagcggcggatgcagttctggcccgcgcggccggcgtcgctcgtggggctcctgcacgagtacgccctgggcagcgagcaggtggccaggcgcgtgctccgggccatggcgcgggtgctggggttcggcgaggggttcttcctcgggcacgtgggcgagaagggcggcacgtacgcgcggttcacctactaccctccctgcccgcgcccggacctcgtgtacgggctgaagccccacacggacaactccgtcgtcaccgtgctcctcctcgaccgcgacgtcggcggcctccaggtgctgctcagggggcctggccccggcccggtgggtggacgtgcccgtgctcgcccgcgacgagctgctcgtcgtcgtcggcgaggagatggagatcatgagcaacgcggtgttcagggcgcccacgcaccgcgtggtcaccagcggcagggagaggatgtcgctcgtgctcttctaccagccggagccgcacaaggacctgcagcccgcggaggagctggtgagcgaggaccggcccgcgatttacaggaggctcaaggccaagaccttcggcgacgggttctgggatgcgttcgcgctcggcgagcgcaccatcgacttcctcaacatcaaggtcgacgacaaggagcatggaggcggattagtaacctcagcgccagcttgacgccatgcatgtgaacgaactactgtacacgatgtatcactggtagtgtaatgtaataagagacatggagcggttttccatgcaatataatctagttt

SEQ ID NO: 800 - protein, 1260 aa, Zea mays
  misc_feature: PFam Name: 2OG-FeII_Oxy; PFam Description: 2OG-Fe(II)
  misc_feature: GI Number: 55771347; NR Description: putative iron/ascorbate-dependent oxidoreductase [Oryza sativa (japonica cultivar-group)] gi|52075655|dbj|BAD44825.1| putative iron/ascorbate-dependent oxidoreductase [Oryza sativa (japonica
  misc_feature: GI Number: 34898484; NR Description: Similar to Prunus armeniaca ethylene-forming-enzyme-like dioxygenase. (U97530) [Oryza sativa (japonica cultivar-group)] >gi|34898464|ref|NP_910578.1| Similar to Prunus armeniaca ethylene-forming-enzyme-like
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AGTCAAACAAATTGTTTACTAGCCTAAGTGTAAGAGCAGCACGATGGTGCATCAGGCTCAGGGACAGATGGTGCAGGAGGTGGCCGCCGCCGGCCTCCCCGCGCTGCCGAGCCGGTACGTGCTGAGGGAGGAGGACCGCCCAACTGGTGACGTCGCGGCACCCGAGTTGGCCTTCCCCACCGTGGACGTCAATGTCTTGCCGACCCCGGTGACGTGGAGGAGGCCAGCAAGCTCCGGTCGGCGCTCGAATCCTGGGGCCTCTTCAAGGTGACCGGCCACGGCATGCCGGTATCCCTGCTGGACGGCATCCGGGACGCCGGGCTGGAGTTCTTCCACCTGCCAGCGGCGGAGAAGCTGAAGCACGCCAACCGGGACGACGCCGGCGAGTTCCAGCCCGAGGGTTACGGCATCGACCGCGTGGACACCGACGGTCAGGTGCTGGACTGGTGCGACCGGCTGTACCTGACGGTGCAGCCGGAGGAGGAGCGGCGGATGCAGTTCTGGCCCGCGCGGCCGGCGTCGCTCGTGGGGCTCCTGCACGAGTACGCCCTGGGCAGCGAGCAGGTGGCCAGGCGCGTGCTCCGGGCCATGGCGCGGGTGCTGGGGTTCGGCGAGGGGTTCTTCCTCGGGCACGTGGGCGAGAAGGGCGGCACGTACGCGCGGTTCACCTACTACCCTCCCTGCCCGCGCCCGGACCTCGTGTACGGGCTGAAGCCCCACACGGACAACTCCGTCGTCACCGTGCTCCTCCTCGACCGCGACGTCGGCGGCCTCCAGGTGCTGCTCAGGGGGCCTGGCCCCGGCCCGGTGGGTGGACGTGCCCGTGCTCGCCCGCGACGAGCTGCTCGTCGTCGTCGGCGAGGAGATGGAGATCATGAGCAACGCGGTGTTCAGGGCGCCCACGCACCGCGTGGTCACCAGCGGCAGGGAGAGGATGTCGCTCGTGCTCTTCTACCAGCCGGAGCCGCACAAGGACCTGCAGCCCGCGGAGGAGCTGGTGAGCGAGGACCGGCCCGCGATTTACAGGAGGCTCAAGGCCAAGACCTTCGGCGACGGGTTCTGGGATGCGTTCGCGCTCGGCGAGCGCACCATCGACTTCCTCAACATCAAGGTCGACGACAAGGAGCATGGAGGCGGATTAGTAACCTCAGCGCCAGCTTGACGCCATGCATGTGAACGAACTACTGTACACGATGTATCACTGGTAGTGTAATGTAATAAGAGACATGGAGCGGTTTTCCATGCAATATAATCTAGTTT

SEQ ID NO: 801 - DNA, 1753 bp, Zea mays
  misc_feature (1)..(1753): Ceres cDNA ID no. 12368205
  misc_feature (1)..(1753): Ceres CLONE  ID no. 342672
  misc_feature (1)..(1753): Also known as  Ceres CDNA ID no. 23787857
gacaacctaaaagcagaaagtataactgtataagtaatgccatcagctccgtacttgacgtagaattccaatggaaatggaactagaccctttcctgggcgtcgtgctcgccaccgccgtcctcctcgtcgccgtcctccgccggaagcgcggctccagccgcaagtacaagatgccatccgggcctaggccgtggccggtgatcggcaacctcaacctgatcggcgcgctcccgcaccgctccatccacgcgctctccgcgcggcacggcgcgttcatgtcgctccgcttcggctccgtccccgtcgtcgtcggctcctccgtggaagcggccaggttcttcctcaggaccagcgacacgtcgttcatcgaccgccccaggatggcggccgggaagtacaccgcctacgactactccgacatcgtctggtcgccctgcggggcgtactggcgccaggcgcgcaagctctggaaggcccatctgttcagcgacaggcagctcaggtcgcaggagcacgtccgcagcgaggagctgcgcgtcctgctgcgcgccctgtcgtcgtcgtcctccgcgggcgcggccgggcgcggccggcgggccgtcgcgctcaaggagcacctgctcatgtacagcctcaacgtgatctcgcgcatggcgctgggcgggaagtacgtcggcgagggcggcaccgcgggctcgccgatctcgccggccgagttcagctggatggtcgacgagctcttcctcctcaacggcgtgttctgcgtcggggacttcatcccgtggctcggctggctggacctccagggctacgtcgggaggatgaagaggctgggcaagatgttcgatcgcttcctggagcacgtggtggacgagcacgaccagcggcggcggcgggagggcggcgggttcgtccccgcggacatggtggacctgctgctggagctcgccgacgaccccaaactcgaggtccccatcgaacgggatggcgtcaagggattcgcgctggacctgatcgctggcggcacggactccacggcggtgaccatcgagtgggccatgtcggagctcctgcggaagcccgaggtcctcgccaaggtcaccgaggagctggacggcgtcatcggccacggccgcctggtcaccgagcaggacatcccggacctgccgtacctggaggccgtcgtgaaggagaccctccgcctgcacccggtgacgccgctgctggcgccgcggctgtgccgcgaggacgcgtccacgggcagctacgacatcccgcggggcacgctcgtgttcgtcaacgtctgggccatcggccgcgaccccgccgtgtggggccacgacgcggaggagttccgcccggagaggttcgtcggcagcgccgtggacgtgaagggccacgacctggagctgctcccgttcgggtccggccgccggatgtgcccgggctacgtcctcgggctcaagatggtgcaggtcaccctggccaacctgctgcacgccttctcgtggaggctgcctgatagcgtggcgccggagaagctgaacatgcaggagaagttcgggctcgccgtgccgcgcttggtcccgctcgaggccgtcgccgtgcccaggctgccaccacacctgtatgccgggccatgatgcatgtctatgtttgtttttgtaggcgcatacaactgtctcgtaataaaagatacatatcttttctctgtacatatacacctaataaagagacaaacaatatcgtcg

SEQ ID NO: 802 - protein, 1753 aa, Zea mays
  misc_feature: PFam Name: p450; PFam Description: Cytochrome P450
  misc_feature: GI Number: 1237250; NR Description: cytochrome P450 [Nicotiana tabacum] >gi|7430637|pir||T03634 cytochrome P450 -
  misc_feature: GI Number: 18377404; NR Description: cytochrome P450
  misc_feature: GI Number: 14423327; NR Description: elicitor-inducible
  misc_feature: GI Number: 51091414; NR Description: putative cytochrome P450
  misc_feature: GI Number: 50908727; NR Description: putative cytochrome P450 monooxygenase [Oryza sativa (japonica cultivar-group)] >gi|48716169|dbj|BAD23209.1| putative cytochrome P450 monooxygenase [Oryza sativa (japonica cultivar-group)] [Oryza
GACAACCTAAAAGCAGAAAGTATAACTGTATAAGTAATGCCATCAGCTCCGTACTTGACGTAGAATTCCAATGGAAATGGAACTAGACCCTTTCCTGGGCGTCGTGCTCGCCACCGCCGTCCTCCTCGTCGCCGTCCTCCGCCGGAAGCGCGGCTCCAGCCGCAAGTACAAGATGCCATCCGGGCCTAGGCCGTGGCCGGTGATCGGCAACCTCAACCTGATCGGCGCGCTCCCGCACCGCTCCATCCACGCGCTCTCCGCGCGGCACGGCGCGTTCATGTCGCTCCGCTTCGGCTCCGTCCCCGTCGTCGTCGGCTCCTCCGTGGAAGCGGCCAGGTTCTTCCTCAGGACCAGCGACACGTCGTTCATCGACCGCCCCAGGATGGCGGCCGGGAAGTACACCGCCTACGACTACTCCGACATCGTCTGGTCGCCCTGCGGGGCGTACTGGCGCCAGGCGCGCAAGCTCTGGAAGGCCCATCTGTTCAGCGACAGGCAGCTCAGGTCGCAGGAGCACGTCCGCAGCGAGGAGCTGCGCGTCCTGCTGCGCGCCCTGTCGTCGTCGTCCTCCGCGGGCGCGGCCGGGCGCGGCCGGCGGGCCGTCGCGCTCAAGGAGCACCTGCTCATGTACAGCCTCAACGTGATCTCGCGCATGGCGCTGGGCGGGAAGTACGTCGGCGAGGGCGGCACCGCGGGCTCGCCGATCTCGCCGGCCGAGTTCAGCTGGATGGTCGACGAGCTCTTCCTCCTCAACGGCGTGTTCTGCGTCGGGGACTTCATCCCGTGGCTCGGCTGGCTGGACCTCCAGGGCTACGTCGGGAGGATGAAGAGGCTGGGCAAGATGTTCGATCGCTTCCTGGAGCACGTGGTGGACGAGCACGACCAGCGGCGGCGGCGGGAGGGCGGCGGGTTCGTCCCCGCGGACATGGTGGACCTGCTGCTGGAGCTCGCCGACGACCCCAAACTCGAGGTCCCCATCGAACGGGATGGCGTCAAGGGATTCGCGCTGGACCTGATCGCTGGCGGCACGGACTCCACGGCGGTGACCATCGAGTGGGCCATGTCGGAGCTCCTGCGGAAGCCCGAGGTCCTCGCCAAGGTCACCGAGGAGCTGGACGGCGTCATCGGCCACGGCCGCCTGGTCACCGAGCAGGACATCCCGGACCTGCCGTACCTGGAGGCCGTCGTGAAGGAGACCCTCCGCCTGCACCCGGTGACGCCGCTGCTGGCGCCGCGGCTGTGCCGCGAGGACGCGTCCACGGGCAGCTACGACATCCCGCGGGGCACGCTCGTGTTCGTCAACGTCTGGGCCATCGGCCGCGACCCCGCCGTGTGGGGCCACGACGCGGAGGAGTTCCGCCCGGAGAGGTTCGTCGGCAGCGCCGTGGACGTGAAGGGCCACGACCTGGAGCTGCTCCCGTTCGGGTCCGGCCGCCGGATGTGCCCGGGCTACGTCCTCGGGCTCAAGATGGTGCAGGTCACCCTGGCCAACCTGCTGCACGCCTTCTCGTGGAGGCTGCCTGATAGCGTGGCGCCGGAGAAGCTGAACATGCAGGAGAAGTTCGGGCTCGCCGTGCCGCGCTTGGTCCCGCTCGAGGCCGTCGCCGTGCCCAGGCTGCCACCACACCTGTATGCCGGGCCATGATGCATGTCTATGTTTGTTTTTGTAGGCGCATACAACTGTCTCGTAATAAAAGATACATATCTTTTCTCTGTACATATACACCTAATAAAGAGACAAACAATATCGTCG

SEQ ID NO: 803 - DNA, 2366 bp, Zea mays
  misc_feature (1)..(2366): Ceres cDNA ID no. 12368336
  misc_feature (1)..(2366): Ceres CLONE  ID no. 392598
  misc_feature (1)..(2366): Also known as  Ceres CDNA ID no. 23800293
gcacgagaccattacctagaacatcctaatcgaaaaagagatttgccggctgctggcccctgcctgctgtgcgcccgtgcgccgcgcctccctgcctgttctaagcaactgcaagcagcaatctgcttaacgcacgtcggcgcctcgccggcgcgacgggcacaacagcccgcctggcatttggcccgtgaccgtgagccacccaccctacgcctttggcaccgcgacatgccttgccggcacaccccatcgaggcgtcgaccatccccgccgccgatcacccaaacttcgcacggcaccccgcccaccttcgccgatggagccccacctgcccgctcacctcacgcgcctcctcaagacccaaccgctgcacgccctcctgtccgacgcgtccacctaccgcgccgcacgccacctgttcgacgcggtgccccgcccgacagccgccctgtgctgcgctttcgtctccgttctctcaaagctctcgctgcaccaggagctcatcgaggccgtctcctcgctacaccgcaggggtggcgccattccgtcgggctgcatcccgcttgtcctaaagtcctgtgcgctgtcggcagcgtcctgccagggcacccagacgcattgtcatgcccttgtgcgtgggatgctaggagatgtgttcgtgcagactgctctggtcgatttctacgccaagaatggcaacatggactcagctgtgatggccttcgaggaaatgccgatcaaggatccgataccgatgaactgcttgatcattgggtattccagatcaggggatgtggaggaggcaaggaggcttttcgacagtatgccgagaaagacgtctgcttcatggaattcgatgattgcttgctatgcacatggcggagagttccaggaagcattgacattgtttgatcagatgttgcgcgagggtgcaagtccgaatgctatcactatcacgacggtgttctccatctgcgccaaaaccggtgatcttgagactggaaggcgggcaaaggcgtgggttagcgaggaagacttgcagaacgtgatagtccacaccgctctgatggagatgtacgtcaagtgccgtgctatcgacgaggcacgtcgcgagttcgatcggatgccacgaagggatgttgtagcatggagcaccatgattgctggttattcacacaatgggagaccacatgaatctcttgagctgttcgagaggatgaaggcgaccaattgcaagccaaatgaggttactctcgttggtgtgttgtctgcatgtgcacagctgggttctgatgaacttggggaacagatcgggagctacatcgagagtcagacactgccacttaccagctaccttggatctgctctgattgatatgtacaccaagtgcgggcatgttgccagagctcgcgatgtcttccaccggatggaacagaaggtggttattgcttggaactccatgatcagaggccttgcactgaacggctttgcagaagatgcaatcgccttgtacggggaaatggtaggagatggggttcagcccaacgagatcacctttctcgcgctgttgacagcgtgtacccatgctggcttggtagacaaaggcatggcattcttccaagagatgaagaagaacaagcagcatgcctctcctcaagttgagcactgcgcttgcatagtggacctcctctgcaagtctggcaggctgtgggaagcctacaagttcatctgcgacatggaagtcgagccaaacgcggtgatctggaccacgctgctcagcgcctgcagagcccacgcggacgtcgagcttgccaagctcgccgcgggcaagcttgtagtactggagcccaatagctcgtcgatctacgttctcctctccaacatctacgctgacgcagggctctggggcgatgtgagggagatcagagacctgatgaggagcaagaacttgcagaagctgtccgcctacagctggatcgagctagacggtgaggtgcacaggttcctggtacaggatacgtatcacccgaggtcagctgagatttacaacgtcgtcgatggcctgggcttgcagctggagaggactagtcctgatcatgagttaatttcagaggtttgctgattaaaattactgtcatgtcagttacaatactttctcgccaaatgtcatgcaatttgtgctctgtaggagtacagttgtagaagcataaaaggtgaaatgcgtcggatattcatgttttttttgtttcagcagctgctgcgttgcgcgcgtgcgtgagatttggtttggtttcgttcccctgcaatgtaatcatgtcgtgactctcaagggattattccgctctgctcttatggtctctgttttc

SEQ ID NO: 804 - protein, 2366 aa, Zea mays
  misc_feature: PFam Name: PPR; PFam Description: PPR repeat
  misc_feature: GI Number: 34910598; NR Description: P0683B11.6 [Oryza sativa (japonica cultivar-group)] >gi|20160882|dbj|BAB89820.1| P0683B11.6
  misc_feature: GI Number: 8778839; NR Description: T6D22.15 [Arabidopsis thaliana] >gi|15223099|ref|NP_172286.1| pentatricopeptide (PPR)
  misc_feature: GI Number: 37536800; NR Description: putative PPR-repeat protein [Oryza sativa (japonica cultivar-group)] >gi|14165320|gb|AAK55452.1| putative PPR repeat protein [Oryza sativa (japonica cultivar-group)] >gi|31433484|gb|AAP54989.1|
  misc_feature: GI Number: 50905853; NR Description: putative pentatricopeptide (PPR) repeat-containing protein [Oryza sativa (japonica cultivar-group)] >gi|46390971|dbj|BAD16484.1| putative pentatricopeptide (PPR) repeat-containing protein [Oryza sativa
  misc_feature: GI Number: 34900958; NR Description: selenium-binding protein-like protein [Oryza sativa (japonica cultivar-group)] >gi|22293716|dbj|BAC10060.1| selenium-binding protein-like protein
GCACGAGACCATTACCTAGAACATCCTAATCGAAAAAGAGATTTGCCGGCTGCTGGCCCCTGCCTGCTGTGCGCCCGTGCGCCGCGCCTCCCTGCCTGTTCTAAGCAACTGCAAGCAGCAATCTGCTTAACGCACGTCGGCGCCTCGCCGGCGCGACGGGCACAACAGCCCGCCTGGCATTTGGCCCGTGACCGTGAGCCACCCACCCTACGCCTTTGGCACCGCGACATGCCTTGCCGGCACACCCCATCGAGGCGTCGACCATCCCCGCCGCCGATCACCCAAACTTCGCACGGCACCCCGCCCACCTTCGCCGATGGAGCCCCACCTGCCCGCTCACCTCACGCGCCTCCTCAAGACCCAACCGCTGCACGCCCTCCTGTCCGACGCGTCCACCTACCGCGCCGCACGCCACCTGTTCGACGCGGTGCCCCGCCCGACAGCCGCCCTGTGCTGCGCTTTCGTCTCCGTTCTCTCAAAGCTCTCGCTGCACCAGGAGCTCATCGAGGCCGTCTCCTCGCTACACCGCAGGGGTGGCGCCATTCCGTCGGGCTGCATCCCGCTTGTCCTAAAGTCCTGTGCGCTGTCGGCAGCGTCCTGCCAGGGCACCCAGACGCATTGTCATGCCCTTGTGCGTGGGATGCTAGGAGATGTGTTCGTGCAGACTGCTCTGGTCGATTTCTACGCCAAGAATGGCAACATGGACTCAGCTGTGATGGCCTTCGAGGAAATGCCGATCAAGGATCCGATACCGATGAACTGCTTGATCATTGGGTATTCCAGATCAGGGGATGTGGAGGAGGCAAGGAGGCTTTTCGACAGTATGCCGAGAAAGACGTCTGCTTCATGGAATTCGATGATTGCTTGCTATGCACATGGCGGAGAGTTCCAGGAAGCATTGACATTGTTTGATCAGATGTTGCGCGAGGGTGCAAGTCCGAATGCTATCACTATCACGACGGTGTTCTCCATCTGCGCCAAAACCGGTGATCTTGAGACTGGAAGGCGGGCAAAGGCGTGGGTTAGCGAGGAAGACTTGCAGAACGTGATAGTCCACACCGCTCTGATGGAGATGTACGTCAAGTGCCGTGCTATCGACGAGGCACGTCGCGAGTTCGATCGGATGCCACGAAGGGATGTTGTAGCATGGAGCACCATGATTGCTGGTTATTCACACAATGGGAGACCACATGAATCTCTTGAGCTGTTCGAGAGGATGAAGGCGACCAATTGCAAGCCAAATGAGGTTACTCTCGTTGGTGTGTTGTCTGCATGTGCACAGCTGGGTTCTGATGAACTTGGGGAACAGATCGGGAGCTACATCGAGAGTCAGACACTGCCACTTACCAGCTACCTTGGATCTGCTCTGATTGATATGTACACCAAGTGCGGGCATGTTGCCAGAGCTCGCGATGTCTTCCACCGGATGGAACAGAAGGTGGTTATTGCTTGGAACTCCATGATCAGAGGCCTTGCACTGAACGGCTTTGCAGAAGATGCAATCGCCTTGTACGGGGAAATGGTAGGAGATGGGGTTCAGCCCAACGAGATCACCTTTCTCGCGCTGTTGACAGCGTGTACCCATGCTGGCTTGGTAGACAAAGGCATGGCATTCTTCCAAGAGATGAAGAAGAACAAGCAGCATGCCTCTCCTCAAGTTGAGCACTGCGCTTGCATAGTGGACCTCCTCTGCAAGTCTGGCAGGCTGTGGGAAGCCTACAAGTTCATCTGCGACATGGAAGTCGAGCCAAACGCGGTGATCTGGACCACGCTGCTCAGCGCCTGCAGAGCCCACGCGGACGTCGAGCTTGCCAAGCTCGCCGCGGGCAAGCTTGTAGTACTGGAGCCCAATAGCTCGTCGATCTACGTTCTCCTCTCCAACATCTACGCTGACGCAGGGCTCTGGGGCGATGTGAGGGAGATCAGAGACCTGATGAGGAGCAAGAACTTGCAGAAGCTGTCCGCCTACAGCTGGATCGAGCTAGACGGTGAGGTGCACAGGTTCCTGGTACAGGATACGTATCACCCGAGGTCAGCTGAGATTTACAACGTCGTCGATGGCCTGGGCTTGCAGCTGGAGAGGACTAGTCCTGATCATGAGTTAATTTCAGAGGTTTGCTGATTAAAATTACTGTCATGTCAGTTACAATACTTTCTCGCCAAATGTCATGCAATTTGTGCTCTGTAGGAGTACAGTTGTAGAAGCATAAAAGGTGAAATGCGTCGGATATTCATGTTTTTTTTGTTTCAGCAGCTGCTGCGTTGCGCGCGTGCGTGAGATTTGGTTTGGTTTCGTTCCCCTGCAATGTAATCATGTCGTGACTCTCAAGGGATTATTCCGCTCTGCTCTTATGGTCTCTGTTTTC

SEQ ID NO: 805 - DNA, 1252 bp, Zea mays
  misc_feature (1)..(1252): Ceres cDNA ID no. 12368639
  misc_feature (1)..(1252): Ceres CLONE  ID no. 343255
  misc_feature (1)..(1252): Also known as  Ceres CDNA ID no. 23785776
acgacggcacccgttcccatctcaattgataacgcatctccaatctccaagcgcagacgccggaggaagaaagcttgaagcagccacggcaatggcgtcccggcagttcttcacctacgacccctacgagttcgcgtacgaccagtactacaacctttacgaaccttactacctgcggcagtccgcgcccacccatcgagctagggacatctttgcgggtgccgagccggcggccgcgaaagcgagatccgcgcccagggcaaaggagtcggagacgcagacgtcgttctcaatcccagtcaacgggcctgactcgccggagagggctccctctccggtggcggaagctcgcgcgggaccgatggcgccggcgatgtcggcagaggacgccgcggcgcggatgcaggcagtggtgcgagggttcctcgcgaggaagtcggtgcgggcggtacgccaggtggatcaggaggcggagcaagtcgcgggaaagatggcgtgcgaggcggaggccctgctagcggaccccagggcacgcgtcgccgtctgggaggcgctcatgaggatgctgctgcgtctcgacgcggtgcgcggagcgcgggactaccggaggagggtcaccaagcgggtcgtcgcgctgcaggacgccgtcgacgcgctcgtcgctaagccggcaccggcaaccgtcgagattgctgaggagatcgccatagcgccggagctgccggacgctgaagatgaaaaggaagacgaagaggcagagacacacgaggcggcggccgtcgagatagcagaggagagcaataccaatgttggtgtcgacgagccctgagggttcggagatattggctgaagaaaacgaacacacctcaccggccctgactgcagttgctggcgccgcctccgacgttgtggacgcgaggaagttgatgcagatggtggcgacgctgtgcgagcagagcgcgcagcagtgcgcgttgatcgaagtgctggccgagcgtgtggacatgctggagcgtaccgtgcggcggatgcaagacgccgacagcgccggcggcggccagccaagaagctgagcacggagggcaactgaaggagcaacagcaagctttacagcggttgacgacgaaatctattaatagagatttaaatagttatgtatttttccattgcttttaatctcgagatttattattatagacactagattatttatattcattattttataataaagttcctcgtatttattgtt

SEQ ID NO: 806 - protein, 1252 aa, Zea mays
  misc_feature: PFam Name: BAG; PFam Description: BAG domain
  misc_feature: PFam Name: Dehydrin; PFam Description: Dehydrin
  misc_feature: PFam Name: GRP; PFam Description: Glycine rich protein family
  misc_feature: GI Number: 4185307; NR Description: unknown [Zea mays]
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 66776103; NR Description: LigA [Anaeromyxobacter dehalogenans 2CP-C] >gi|66858140|ref|ZP_00402169.1| LigA
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 29826490; NR Description: putative ATP/GTP-binding Gly/Ala-rich protein [Streptomyces avermitilis MA-4680] >gi|29611288|dbj|BAC75331.1| putative ATP/GTP-binding Gly/Ala-rich
ACGACGGCACCCGTTCCCATCTCAATTGATAACGCATCTCCAATCTCCAAGCGCAGACGCCGGAGGAAGAAAGCTTGAAGCAGCCACGGCAATGGCGTCCCGGCAGTTCTTCACCTACGACCCCTACGAGTTCGCGTACGACCAGTACTACAACCTTTACGAACCTTACTACCTGCGGCAGTCCGCGCCCACCCATCGAGCTAGGGACATCTTTGCGGGTGCCGAGCCGGCGGCCGCGAAAGCGAGATCCGCGCCCAGGGCAAAGGAGTCGGAGACGCAGACGTCGTTCTCAATCCCAGTCAACGGGCCTGACTCGCCGGAGAGGGCTCCCTCTCCGGTGGCGGAAGCTCGCGCGGGACCGATGGCGCCGGCGATGTCGGCAGAGGACGCCGCGGCGCGGATGCAGGCAGTGGTGCGAGGGTTCCTCGCGAGGAAGTCGGTGCGGGCGGTACGCCAGGTGGATCAGGAGGCGGAGCAAGTCGCGGGAAAGATGGCGTGCGAGGCGGAGGCCCTGCTAGCGGACCCCAGGGCACGCGTCGCCGTCTGGGAGGCGCTCATGAGGATGCTGCTGCGTCTCGACGCGGTGCGCGGAGCGCGGGACTACCGGAGGAGGGTCACCAAGCGGGTCGTCGCGCTGCAGGACGCCGTCGACGCGCTCGTCGCTAAGCCGGCACCGGCAACCGTCGAGATTGCTGAGGAGATCGCCATAGCGCCGGAGCTGCCGGACGCTGAAGATGAAAAGGAAGACGAAGAGGCAGAGACACACGAGGCGGCGGCCGTCGAGATAGCAGAGGAGAGCAATACCAATGTTGGTGTCGACGAGCCCTGAGGGTTCGGAGATATTGGCTGAAGAAAACGAACACACCTCACCGGCCCTGACTGCAGTTGCTGGCGCCGCCTCCGACGTTGTGGACGCGAGGAAGTTGATGCAGATGGTGGCGACGCTGTGCGAGCAGAGCGCGCAGCAGTGCGCGTTGATCGAAGTGCTGGCCGAGCGTGTGGACATGCTGGAGCGTACCGTGCGGCGGATGCAAGACGCCGACAGCGCCGGCGGCGGCCAGCCAAGAAGCTGAGCACGGAGGGCAACTGAAGGAGCAACAGCAAGCTTTACAGCGGTTGACGACGAAATCTATTAATAGAGATTTAAATAGTTATGTATTTTTCCATTGCTTTTAATCTCGAGATTTATTATTATAGACACTAGATTATTTATATTCATTATTTTATAATAAAGTTCCTCGTATTTATTGTT

SEQ ID NO: 807 - DNA, 838 bp, Zea mays
  misc_feature (1)..(838): Ceres cDNA ID no. 12368902
  misc_feature (1)..(838): Ceres CLONE  ID no. 343210
  misc_feature (1)..(838): Also known as  Ceres CDNA ID no. 23789582
acactacaaacgcattaagctcttagctagccctagccacgtacccacacatcgtagacaacgcaattagctaggaatagcatccatggcgtccggggctgctgcttcctcggccctcttgctcctcgtcgcggccttggtggccaccagtgcgagggcggccacattcaccatcaccaacaactgcggctcgacggtgtggccggcggccaccccggtgggcggcggcacgcagcttgaccccgggcagacgtggaccgtggacgtgccggcggggacccagtccggcagggtgtgggggcgcacggggtgctccttcaacggcggcagcgggagctgccagacgggcgactgcggcggcgcactctcctgcacgctctcggggcagcctcccatgacgctggccgagttcaccatcggcggcggcggcagccaggacttctacgacatctcggtgatcgacggctacaacctggccatgctcttctcgtgcagcaccggcgtgaccctcaactgcggcgggcccagctgcccagacgcctacctgtttcccagcgacaacaccaagacccatgcctgcagcggcaacagcaactaccaggtcaccttctgcccgtgagatcgcgcgtgcgaggcaggcggcagtgtggccggacgacgatgcaatatgcaatgcatgctccagccaacttctttgtttgcgaataataagtatgttgtttgtcctagtttgttattagtggagaaataaaaaaaagtagacaatcgaataagacgatgatgttcacccgttagataatgtaacttcgatgagtttgatctatatatatgtgcttgc

SEQ ID NO: 808 - protein, 838 aa, Zea mays
  misc_feature: PFam Name: Thaumatin; PFam Description: Thaumatin family
  misc_feature: GI Number: 444344; NR Description: thaumatin-like protein
  misc_feature: GI Number: 3290006; NR Description: pathogenesis related protein-5 [Zea mays] >gi|7442164|pir||T02055 pathogenesis related
  misc_feature: GI Number: 20376; NR Description: thaumatin-like protein [Oryza sativa] >gi|100715|pir||S25551 thaumatin-like protein - rice
  misc_feature: GI Number: 1321999; NR Description: thaumatin-like protein [Triticum aestivum] >gi|7442166|pir||T06790 thaumatin-like protein
  misc_feature: GI Number: 19083; NR Description: pathogenesis-related protein [Hordeum vulgare] >gi|19081|emb|CAA41444.1| pathogenesis-related protein [Hordeum vulgare] >gi|9501332|emb|CAB99485.1| pathogenesis protein 5 [Hordeum vulgare
ACACTACAAACGCATTAAGCTCTTAGCTAGCCCTAGCCACGTACCCACACATCGTAGACAACGCAATTAGCTAGGAATAGCATCCATGGCGTCCGGGGCTGCTGCTTCCTCGGCCCTCTTGCTCCTCGTCGCGGCCTTGGTGGCCACCAGTGCGAGGGCGGCCACATTCACCATCACCAACAACTGCGGCTCGACGGTGTGGCCGGCGGCCACCCCGGTGGGCGGCGGCACGCAGCTTGACCCCGGGCAGACGTGGACCGTGGACGTGCCGGCGGGGACCCAGTCCGGCAGGGTGTGGGGGCGCACGGGGTGCTCCTTCAACGGCGGCAGCGGGAGCTGCCAGACGGGCGACTGCGGCGGCGCACTCTCCTGCACGCTCTCGGGGCAGCCTCCCATGACGCTGGCCGAGTTCACCATCGGCGGCGGCGGCAGCCAGGACTTCTACGACATCTCGGTGATCGACGGCTACAACCTGGCCATGCTCTTCTCGTGCAGCACCGGCGTGACCCTCAACTGCGGCGGGCCCAGCTGCCCAGACGCCTACCTGTTTCCCAGCGACAACACCAAGACCCATGCCTGCAGCGGCAACAGCAACTACCAGGTCACCTTCTGCCCGTGAGATCGCGCGTGCGAGGCAGGCGGCAGTGTGGCCGGACGACGATGCAATATGCAATGCATGCTCCAGCCAACTTCTTTGTTTGCGAATAATAAGTATGTTGTTTGTCCTAGTTTGTTATTAGTGGAGAAATAAAAAAAAGTAGACAATCGAATAAGACGATGATGTTCACCCGTTAGATAATGTAACTTCGATGAGTTTGATCTATATATATGTGCTTGC

SEQ ID NO: 809 - DNA, 733 bp, Zea mays
  misc_feature (1)..(733): Ceres cDNA ID no. 12368925
  misc_feature (1)..(733): Ceres CLONE  ID no. 238618
  misc_feature (1)..(733): Also known as  Ceres CDNA ID no. 23773116
gtagggatcacttgtcaggacaggcgccttggcgtgagtcgccataggaaggggaggaggtctccaaaagttttggtggagcgacgaggacgaggacgccgtgagaaggcaggaaagagctaaaaggatggaagaaaagaaagtgtatctgcaactgtacgaagcaatggaggcgctggtccacatctgccgggacggatgcaggacgatcgggcctcgagatcaagcgctcaagggcagcctagcagccgcctgcaagtttcgcgcctgcaagggcattgagctgctcgtgcgccacttctcggcctgcggagtccgggtgcccggcggctgtgccaactgcaggcggatgtggcagctcctcgagctgcattcccgcatgtgcttcctcccggacacctgcaaggttcctctctgcgggcattttaaggacaagatgcggaatctggggaggaaggaagagaccaaatggaaccttttggtgtgcaaggtgctggagcgcggaggaaccatgggttttatgcccggaaggagaaaaaatttcatcaatcctaaggccagctgggagttgccacgtggctcctcttgtatttgaaacacccaaaccttgccaggggttttatgttagacgagaaggggaccaggaggagccggaacaaaaaagaaaacgtcagaacagctgttgcgtgaatcgtgatgatactttaaaaaggaaaaaaaacatctaattttg

SEQ ID NO: 810 - protein, 733 aa, Zea mays
  misc_feature: PFam Name: zf-TAZ; PFam Description: TAZ zinc finger
  misc_feature: GI Number: 57899800; NR Description: putative BTB and TAZ
  misc_feature: GI Number: 42573822; NR Description: TAZ zinc finger family
  misc_feature: GI Number: 42561724; NR Description: TAZ zinc finger family
  misc_feature: GI Number: 36955924; NR Description: BTB and TAZ domain protein 5 [Arabidopsis thaliana] >gi|18420081|ref|NP_568031.1| TAZ zinc finger family protein / BTB/POZ domain-containing protein
  misc_feature: GI Number: 21537174; NR Description: unknown [Arabidopsis thaliana]
GTAGGGATCACTTGTCAGGACAGGCGCCTTGGCGTGAGTCGCCATAGGAAGGGGAGGAGGTCTCCAAAAGTTTTGGTGGAGCGACGAGGACGAGGACGCCGTGAGAAGGCAGGAAAGAGCTAAAAGGATGGAAGAAAAGAAAGTGTATCTGCAACTGTACGAAGCAATGGAGGCGCTGGTCCACATCTGCCGGGACGGATGCAGGACGATCGGGCCTCGAGATCAAGCGCTCAAGGGCAGCCTAGCAGCCGCCTGCAAGTTTCGCGCCTGCAAGGGCATTGAGCTGCTCGTGCGCCACTTCTCGGCCTGCGGAGTCCGGGTGCCCGGCGGCTGTGCCAACTGCAGGCGGATGTGGCAGCTCCTCGAGCTGCATTCCCGCATGTGCTTCCTCCCGGACACCTGCAAGGTTCCTCTCTGCGGGCATTTTAAGGACAAGATGCGGAATCTGGGGAGGAAGGAAGAGACCAAATGGAACCTTTTGGTGTGCAAGGTGCTGGAGCGCGGAGGAACCATGGGTTTTATGCCCGGAAGGAGAAAAAATTTCATCAATCCTAAGGCCAGCTGGGAGTTGCCACGTGGCTCCTCTTGTATTTGAAACACCCAAACCTTGCCAGGGGTTTTATGTTAGACGAGAAGGGGACCAGGAGGAGCCGGAACAAAAAAGAAAACGTCAGAACAGCTGTTGCGTGAATCGTGATGATACTTTAAAAAGGAAAAAAAACATCTAATTTTG

SEQ ID NO: 811 - DNA, 1673 bp, Zea mays
  misc_feature (1)..(1673): Ceres cDNA ID no. 12369078
  misc_feature (1)..(1673): Ceres CLONE  ID no. 299461
  misc_feature (1)..(1673): Also known as  Ceres CDNA ID no. 23760960
atagaccccgcgcatggacggcctccatccactccgcccagcacccgcacctcgtcagtcgtcaccgagaagcagaagcagcagctgctgcctgctggtcgttcgttcgcctcgttctctccgcctccccccaccccccgcctcgcttcctcctccgcgcttccttcgccgaggcgtcagcgtcagcgagggcgtataaagcgctccccctccgcgcgcgtccgcacaatcgccaccgcctctccgctcctcgacaagaccaatggcggctgctgcgtcctccgctctgcacgccgttggcgccgtcgcctccgccaagcctagatccgtcgcccccgcggtggcgacgaggaggagcgtgcgcgtggcgcccgcggccaagcgaggaccaggctcgggaggaggcaggctcgtggctcgcagcgccgttgcagccaaggcggatgaggcggccgcggcggcgggatccaagtcaggcggccatgagttgctgatgtttgaggcccttcgtgaagccttgatagaagagatgaatttggatccaacagtgtgcgtcatgggtgaagatgttggtcattatggaggttcatacaaggtgaccaaagggttggctgagatgttcggagatctccgggtccttgatacccctatcgccgagaactccttcactggcatgggagttggagcagcaatgaaggggctgaggcctgttgtggaaggcatgaacatgggtttccttctccttgcctacaaccagatctcgaacaactgcggcatgcttcactacacctcaggcggccagttcaagatcccggtcgtgatccgaggccccggcggtgtcggtcgccagctcggtgccgagcactcgcagcggctagagtcgtacttccagtcgattcctggccttcagatggttgcctgctccactccttacaacgcaaagggcctgatgaaggcggccataaggagcgagaaccccgtggtgctgtttgagcacgtcctcttgtacaacctgaaggagaaaatccccgacgaggagtacatctgctgcctggaggaggcggagatggtgcggccaggtgagcacgtgaccatcctcacgtactcccgcatgaggtaccacgtgatgcaggctgccaagacgctggtgaacaaggggtacgaccccgaggtcatcgacatcaggtcgctgaagccgttcgacctgcacacgatcgggaactcgatcaagaagacccaccgcgtgctgatcgtggaggagtgcatgcggacgggcggcatcggcgccagcctgcggtcggccatcatcgacaacttctgggactacctggacgcccccatcatgtgcctgtcgtcgcaggacgtgccgaccccgtacgccgcgacgctggaggacgccaccgtggtgcagcccgcgcagatcgtggccgccgtcgagcagatctgccaatgatcagtgatatcatggctttgttgagtacctgatctgtggagtcagattaccgtggttttgtttctctgtcgcatcgcgactgtcaccgtgccttagacaagacatgtttttgtattttgcaacgcagaagccatactcgtactggatgccgtttgtgggtggcctatttgttcattgtgcaaagttggatgccatactcgtacactattattatcaggtt

SEQ ID NO: 812 - protein, 1673 aa, Zea mays
  misc_feature: PFam Name: Transket_pyr; PFam Description: Transketolase,
  misc_feature: PFam Name: Transketolase_C; PFam Description: Transketolase,
  misc_feature: GI Number: 20334776; NR Description: At1g30120/T2H7_8 [Arabidopsis thaliana] >gi|13605515|gb|AAK32751.1| At1g30120/T2H7_8 [Arabidopsis thaliana] >gi|12321636|gb|AAG50862.1| pyruvate dehydrogenase E1 beta
  misc_feature: GI Number: 22416925; NR Description: beta subunit of pyruvate dehydrogenase E1 component [Chaetosphaeridium globosum] >gi|22711921|ref|NP_683783.1| pyruvate dehydrogenase E1 component
  misc_feature: GI Number: 21593379; NR Description: putative pyruvate
  misc_feature: GI Number: 3128205; NR Description: putative pyruvate dehydrogenase E1 beta subunit [Arabidopsis thaliana] >gi|5702375|gb|AAD47282.1| putative pyruvate dehydrogenase beta subunit [Arabidopsis thaliana] >gi|15226781|ref|NP_181006.1|
  misc_feature: GI Number: 2454184; NR Description: pyruvate dehydrogenase E1 beta subunit [Arabidopsis thaliana] >gi|21593321|gb|AAM65270.1| pyruvate dehydrogenase E1 beta subunit, putative [Arabidopsis
ATAGACCCCGCGCATGGACGGCCTCCATCCACTCCGCCCAGCACCCGCACCTCGTCAGTCGTCACCGAGAAGCAGAAGCAGCAGCTGCTGCCTGCTGGTCGTTCGTTCGCCTCGTTCTCTCCGCCTCCCCCCACCCCCCGCCTCGCTTCCTCCTCCGCGCTTCCTTCGCCGAGGCGTCAGCGTCAGCGAGGGCGTATAAAGCGCTCCCCCTCCGCGCGCGTCCGCACAATCGCCACCGCCTCTCCGCTCCTCGACAAGACCAATGGCGGCTGCTGCGTCCTCCGCTCTGCACGCCGTTGGCGCCGTCGCCTCCGCCAAGCCTAGATCCGTCGCCCCCGCGGTGGCGACGAGGAGGAGCGTGCGCGTGGCGCCCGCGGCCAAGCGAGGACCAGGCTCGGGAGGAGGCAGGCTCGTGGCTCGCAGCGCCGTTGCAGCCAAGGCGGATGAGGCGGCCGCGGCGGCGGGATCCAAGTCAGGCGGCCATGAGTTGCTGATGTTTGAGGCCCTTCGTGAAGCCTTGATAGAAGAGATGAATTTGGATCCAACAGTGTGCGTCATGGGTGAAGATGTTGGTCATTATGGAGGTTCATACAAGGTGACCAAAGGGTTGGCTGAGATGTTCGGAGATCTCCGGGTCCTTGATACCCCTATCGCCGAGAACTCCTTCACTGGCATGGGAGTTGGAGCAGCAATGAAGGGGCTGAGGCCTGTTGTGGAAGGCATGAACATGGGTTTCCTTCTCCTTGCCTACAACCAGATCTCGAACAACTGCGGCATGCTTCACTACACCTCAGGCGGCCAGTTCAAGATCCCGGTCGTGATCCGAGGCCCCGGCGGTGTCGGTCGCCAGCTCGGTGCCGAGCACTCGCAGCGGCTAGAGTCGTACTTCCAGTCGATTCCTGGCCTTCAGATGGTTGCCTGCTCCACTCCTTACAACGCAAAGGGCCTGATGAAGGCGGCCATAAGGAGCGAGAACCCCGTGGTGCTGTTTGAGCACGTCCTCTTGTACAACCTGAAGGAGAAAATCCCCGACGAGGAGTACATCTGCTGCCTGGAGGAGGCGGAGATGGTGCGGCCAGGTGAGCACGTGACCATCCTCACGTACTCCCGCATGAGGTACCACGTGATGCAGGCTGCCAAGACGCTGGTGAACAAGGGGTACGACCCCGAGGTCATCGACATCAGGTCGCTGAAGCCGTTCGACCTGCACACGATCGGGAACTCGATCAAGAAGACCCACCGCGTGCTGATCGTGGAGGAGTGCATGCGGACGGGCGGCATCGGCGCCAGCCTGCGGTCGGCCATCATCGACAACTTCTGGGACTACCTGGACGCCCCCATCATGTGCCTGTCGTCGCAGGACGTGCCGACCCCGTACGCCGCGACGCTGGAGGACGCCACCGTGGTGCAGCCCGCGCAGATCGTGGCCGCCGTCGAGCAGATCTGCCAATGATCAGTGATATCATGGCTTTGTTGAGTACCTGATCTGTGGAGTCAGATTACCGTGGTTTTGTTTCTCTGTCGCATCGCGACTGTCACCGTGCCTTAGACAAGACATGTTTTTGTATTTTGCAACGCAGAAGCCATACTCGTACTGGATGCCGTTTGTGGGTGGCCTATTTGTTCATTGTGCAAAGTTGGATGCCATACTCGTACACTATTATTATCAGGTT

SEQ ID NO: 813 - DNA, 1733 bp, Zea mays
  misc_feature (1)..(1733): Ceres cDNA ID no. 12369271
  misc_feature (1)..(1733): Ceres CLONE  ID no. 327399
  misc_feature (1)..(1733): Also known as  Ceres CDNA ID no. 23767785
accgagaatctttcaccctcctgacctctctctctcctcttctccctcccgtgagtgagtgagctggagtcaagctagccgagcgagtgatggcatggggagcttgcactgctgcggcagctgctctccttctgctcctcctcctcctcgccgccgccgcagcaggtggtaacggcggcgtgcattgccttgaccttgaccttgaggaggggaggcggcaccacctgagcaggagagccttgcaagggaggcagaggcggcaccacctgaggtcaagggcggtgggtggcgccacggtgctcgagctgaggcaccacagcttcagccctgcaccggccaacagcagggaggaggaggcggacgctctcctgtccgccgacgccgcgcgcgtctcgtcgctgcaagggcgcatagagcactaccggctgacgacgaccagctcgtcggccgaggtggcggtgacggcgtccaaggcgcaggtgcccgtcagctcgggcgcgaggctccggacgctgaactacgtggccaccgtggggctgggcggcggcgaggcgacggtgatcgtggacacggccagcgagctgacgtgggtgcagtgcgcgccgtgcgagtcgtgccacgaccagcagggcccgctgttcgacccgtcctcgtcgccgtcctacgccgcggtgccgtgcgactccccctcctgcgacgcgctgcagcagcagctggccacgggcgcgggcgcgccgccgtgcgacgccgggcggccggcggcctgcagctacgcgctcagctaccgcgacggctcctactcccgcggcgtgctggcgcacgacaggctgagcctggccggggaggtcatcgacggcttcgtgttcgggtgcggcaccagcaaccagggcccgccgttcggcggcacgtcgggcctcatggggctcggccgcagccagctctcgctcgtgtcgcagaccgtggaccagttcggcggcgtgttctcctactgcctcccgctcagcagggagtccgacgcgtcgggctcgctggtgctgggcgacgacccgtcggcgtaccgcaactcgaccccggtcgtgtacacctcgatggtgtccaactccgacccgctgctccaggggcccttctacctggtgaacctgaccgggatcacggtcggcggccaggaggtggagtccacgggcttctcggccagggcgatcgtcgactcgggcaccgtgatcaccagcctcgtgccgtcggtctacaacgccgtcagggccgagttcatgagccagctcgcggagtacccgcaggcgccagggttctccatcctcgacacctgcttcaacatgaccgggctcaaggaagtccaggtgcccagcctgactctcgtgttcgacggcggcgcggaggtggaggtggactccggcggcgtgctctacttcgtcagcagcgactcctcacaggtgtgcctggccgtggcctccctgaaatccgaggacgagacctccatcatcggcaactaccagcagaagaacctgagggtcgtcttcgacacctcggcgtctcaggttggtttcgcgcaggagacgtgtggttatatttgactttgactcggattgggattgggattgggatgcagcgggcggccatgggctctatatatgtgaatacctttatacttacttgcagatttgtttcgagattacccctggtgattggcaaatggtaacaaggtgttcagttgttgg

SEQ ID NO: 814 - protein, 1733 aa, Zea mays
  misc_feature: PFam Name: Asp; PFam Description: Eukaryotic aspartyl protease
  misc_feature: GI Number: 50943229; NR Description: putative 41 kD chloroplast nucleoid DNA binding protein [Oryza sativa (japonica cultivar-group)] >gi|37806402|dbj|BAC99940.1| putative 41 kD chloroplast nucleoid DNA binding protein [Oryza sativa (japonica
  misc_feature: GI Number: 7715602; NR Description: F20B17.14 [Arabidopsis thaliana] >gi|25406599|pir||B96828 probable aspartyl proteinase, 105611-106921 [imported] - Arabidopsis thaliana >gi|12324588|gb|AAG52249.1| putative aspartyl protease;
  misc_feature: GI Number: 21595063; NR Description: putative aspartyl
  misc_feature: GI Number: 7489168; NR Description: nucleoid DNA-binding protein cnd41, chloroplast - common tobacco >gi|2541876|dbj|BAA22813.1| CND41, chloroplast nucleoid DNA binding
  misc_feature: GI Number: 24430421; NR Description: 41 kD chloroplast
ACCGAGAATCTTTCACCCTCCTGACCTCTCTCTCTCCTCTTCTCCCTCCCGTGAGTGAGTGAGCTGGAGTCAAGCTAGCCGAGCGAGTGATGGCATGGGGAGCTTGCACTGCTGCGGCAGCTGCTCTCCTTCTGCTCCTCCTCCTCCTCGCCGCCGCCGCAGCAGGTGGTAACGGCGGCGTGCATTGCCTTGACCTTGACCTTGAGGAGGGGAGGCGGCACCACCTGAGCAGGAGAGCCTTGCAAGGGAGGCAGAGGCGGCACCACCTGAGGTCAAGGGCGGTGGGTGGCGCCACGGTGCTCGAGCTGAGGCACCACAGCTTCAGCCCTGCACCGGCCAACAGCAGGGAGGAGGAGGCGGACGCTCTCCTGTCCGCCGACGCCGCGCGCGTCTCGTCGCTGCAAGGGCGCATAGAGCACTACCGGCTGACGACGACCAGCTCGTCGGCCGAGGTGGCGGTGACGGCGTCCAAGGCGCAGGTGCCCGTCAGCTCGGGCGCGAGGCTCCGGACGCTGAACTACGTGGCCACCGTGGGGCTGGGCGGCGGCGAGGCGACGGTGATCGTGGACACGGCCAGCGAGCTGACGTGGGTGCAGTGCGCGCCGTGCGAGTCGTGCCACGACCAGCAGGGCCCGCTGTTCGACCCGTCCTCGTCGCCGTCCTACGCCGCGGTGCCGTGCGACTCCCCCTCCTGCGACGCGCTGCAGCAGCAGCTGGCCACGGGCGCGGGCGCGCCGCCGTGCGACGCCGGGCGGCCGGCGGCCTGCAGCTACGCGCTCAGCTACCGCGACGGCTCCTACTCCCGCGGCGTGCTGGCGCACGACAGGCTGAGCCTGGCCGGGGAGGTCATCGACGGCTTCGTGTTCGGGTGCGGCACCAGCAACCAGGGCCCGCCGTTCGGCGGCACGTCGGGCCTCATGGGGCTCGGCCGCAGCCAGCTCTCGCTCGTGTCGCAGACCGTGGACCAGTTCGGCGGCGTGTTCTCCTACTGCCTCCCGCTCAGCAGGGAGTCCGACGCGTCGGGCTCGCTGGTGCTGGGCGACGACCCGTCGGCGTACCGCAACTCGACCCCGGTCGTGTACACCTCGATGGTGTCCAACTCCGACCCGCTGCTCCAGGGGCCCTTCTACCTGGTGAACCTGACCGGGATCACGGTCGGCGGCCAGGAGGTGGAGTCCACGGGCTTCTCGGCCAGGGCGATCGTCGACTCGGGCACCGTGATCACCAGCCTCGTGCCGTCGGTCTACAACGCCGTCAGGGCCGAGTTCATGAGCCAGCTCGCGGAGTACCCGCAGGCGCCAGGGTTCTCCATCCTCGACACCTGCTTCAACATGACCGGGCTCAAGGAAGTCCAGGTGCCCAGCCTGACTCTCGTGTTCGACGGCGGCGCGGAGGTGGAGGTGGACTCCGGCGGCGTGCTCTACTTCGTCAGCAGCGACTCCTCACAGGTGTGCCTGGCCGTGGCCTCCCTGAAATCCGAGGACGAGACCTCCATCATCGGCAACTACCAGCAGAAGAACCTGAGGGTCGTCTTCGACACCTCGGCGTCTCAGGTTGGTTTCGCGCAGGAGACGTGTGGTTATATTTGACTTTGACTCGGATTGGGATTGGGATTGGGATGCAGCGGGCGGCCATGGGCTCTATATATGTGAATACCTTTATACTTACTTGCAGATTTGTTTCGAGATTACCCCTGGTGATTGGCAAATGGTAACAAGGTGTTCAGTTGTTGG

SEQ ID NO: 815 - DNA, 738 bp, Zea mays
  misc_feature (1)..(738): Ceres cDNA ID no. 12369342
  misc_feature (1)..(738): Ceres CLONE  ID no. 370380
  misc_feature (1)..(738): Also known as  Ceres CDNA ID no. 23794257
catggaagttgtcgattcctccgtcgccatctggcgctccgacgagtccgggatctggagcgtcctatacgtgctcgatgtcctctggagcctgctgaccggccgcctggtgcgagagaaggtggacccggccgtgcaaagcgccgtcgacagtcagatgaacgccgcggactcgcaggacatggcgccgacactggcggacatgttcgagacgggcgccgccgacgccaagggcatgccggccgccgccgtcgcggcgctccccatcatggccttcaccgagcacaccgtcgccgacggctccggggagcccatcggctgctccgtctgccttcaggacttcgaggcaggcgagacggcgcggagcttgccggagtgcgggcacacgttccacctgccgtgcatcgacgtctggctgctccggccacgcctcgtgcccactgtgtcgtcgcgcggtctaagccggttcgcacacttttcgttaggatgtctttgggcaaccgtgagccgatgcgcgtgcacacgtgtcccagaccaggagcacagtatagtagggtagtaggagtgcaggacacctggttctttcttgcataccttgattatttttttccttcttttttctacgtcttgagcacgcatgtacagatacagtacgtggctcacattgtctcacacacactgtggatgtaaatatgtatagggtaaatgttgtaaacaatgtaatatacttgtacattg

SEQ ID NO: 816 - protein, 738 aa, Zea mays
  misc_feature: PFam Name: zf-C3HC4; PFam Description: Zinc finger, C3HC4
  misc_feature: GI Number: 50948297; NR Description: putative NEP1-interacting protein [Oryza sativa (japonica cultivar-group)] >gi|42407817|dbj|BAD08961.1| putative NEP1-interacting protein
  misc_feature: GI Number: 18855037; NR Description: putative zinc finger
  misc_feature: GI Number: 27524904; NR Description: NEP1-interacting protein 2 [Arabidopsis thaliana] >gi|30680091|ref|NP_179364.2| zinc finger
  misc_feature: GI Number: 27524902; NR Description: NEP1-interacting protein
  misc_feature: GI Number: 38228693; NR Description: zinc finger protein
CATGGAAGTTGTCGATTCCTCCGTCGCCATCTGGCGCTCCGACGAGTCCGGGATCTGGAGCGTCCTATACGTGCTCGATGTCCTCTGGAGCCTGCTGACCGGCCGCCTGGTGCGAGAGAAGGTGGACCCGGCCGTGCAAAGCGCCGTCGACAGTCAGATGAACGCCGCGGACTCGCAGGACATGGCGCCGACACTGGCGGACATGTTCGAGACGGGCGCCGCCGACGCCAAGGGCATGCCGGCCGCCGCCGTCGCGGCGCTCCCCATCATGGCCTTCACCGAGCACACCGTCGCCGACGGCTCCGGGGAGCCCATCGGCTGCTCCGTCTGCCTTCAGGACTTCGAGGCAGGCGAGACGGCGCGGAGCTTGCCGGAGTGCGGGCACACGTTCCACCTGCCGTGCATCGACGTCTGGCTGCTCCGGCCACGCCTCGTGCCCACTGTGTCGTCGCGCGGTCTAAGCCGGTTCGCACACTTTTCGTTAGGATGTCTTTGGGCAACCGTGAGCCGATGCGCGTGCACACGTGTCCCAGACCAGGAGCACAGTATAGTAGGGTAGTAGGAGTGCAGGACACCTGGTTCTTTCTTGCATACCTTGATTATTTTTTTCCTTCTTTTTTCTACGTCTTGAGCACGCATGTACAGATACAGTACGTGGCTCACATTGTCTCACACACACTGTGGATGTAAATATGTATAGGGTAAATGTTGTAAACAATGTAATATACTTGTACATTG

SEQ ID NO: 817 - DNA, 789 bp, Arabidopsis thaliana
  misc_feature (1)..(789): Ceres cDNA ID no. 12369935
  misc_feature (1)..(789): Ceres CLONE  ID no. 23377
  misc_feature (1)..(789): Also known as  Ceres CDNA ID no. 23375654
attgcttgcttgttattatgcatccaaaccttaaaaacttgtctcctcagattcaccatcctacaaaacttatcaatctcttcttcatctttcttctgcatcctccaccctaatctctctgcaaattccttcatcttctccttttgttcttcattgatctttgtcctcactctcttcttcttcctcatcatcatcatcatcaaacttttcccatcaacgttttggttacgatgactcagaatcttcttcatatcctcgcttgaagatgaagtcctccgtccaatctcacccgttggatgcattacacgtggcttgtacgagctgttactgctgtaaaacgccggagttatcatcagctgataatcttgtttactgttcatgtgtccgtacacttctttccggtggaagctccggtgacagttacaggcggcgcattttaaagcaccgagtgtaccttcttctccgccggccatgaactcgcagcatccgtccaccacgtgtcctccggttgaggccgcgtggttcttctgacattcccggtacttagctccttggtcgacacgtgtctttggtttttggttttctttcttgatcgggaataaagccatggatggatctgattcgggtttggcttctggttccggatccgtatgtggctttacttctgttgagattattgttgtggttgtaattgcattgcattttcctccaagctccattgtgaatctgacccaaaacaacaaaactttgttaaatattaatacgtataaatcattcaataatgcatgc

SEQ ID NO: 818 - protein, 789 aa, Arabidopsis thaliana
ATTGCTTGCTTGTTATTATGCATCCAAACCTTAAAAACTTGTCTCCTCAGATTCACCATCCTACAAAACTTATCAATCTCTTCTTCATCTTTCTTCTGCATCCTCCACCCTAATCTCTCTGCAAATTCCTTCATCTTCTCCTTTTGTTCTTCATTGATCTTTGTCCTCACTCTCTTCTTCTTCCTCATCATCATCATCATCAAACTTTTCCCATCAACGTTTTGGTTACGATGACTCAGAATCTTCTTCATATCCTCGCTTGAAGATGAAGTCCTCCGTCCAATCTCACCCGTTGGATGCATTACACGTGGCTTGTACGAGCTGTTACTGCTGTAAAACGCCGGAGTTATCATCAGCTGATAATCTTGTTTACTGTTCATGTGTCCGTACACTTCTTTCCGGTGGAAGCTCCGGTGACAGTTACAGGCGGCGCATTTTAAAGCACCGAGTGTACCTTCTTCTCCGCCGGCCATGAACTCGCAGCATCCGTCCACCACGTGTCCTCCGGTTGAGGCCGCGTGGTTCTTCTGACATTCCCGGTACTTAGCTCCTTGGTCGACACGTGTCTTTGGTTTTTGGTTTTCTTTCTTGATCGGGAATAAAGCCATGGATGGATCTGATTCGGGTTTGGCTTCTGGTTCCGGATCCGTATGTGGCTTTACTTCTGTTGAGATTATTGTTGTGGTTGTAATTGCATTGCATTTTCCTCCAAGCTCCATTGTGAATCTGACCCAAAACAACAAAACTTTGTTAAATATTAATACGTATAAATCATTCAATAATGCATGC

SEQ ID NO: 819 - DNA, 1494 bp, Arabidopsis thaliana
  misc_feature (1)..(1494): Ceres cDNA ID no. 12370144
  misc_feature (1)..(1494): Ceres CLONE  ID no. 4620
  misc_feature (1)..(1494): Also known as  Ceres CDNA ID no. 23375842
ataagactcctctccaaatgctaccacacaattcctctatcaaagccgcccaatcctccacccaaaaatggcttatctccggcgagcagccaccgcattggttctcattttccagctccatctctttctctctctctcaaatgcacataacataacccgaatcttggccaaagaccctgatttctccactttcaaccactatctctcagcgactcatctcgccgacgagatcaaccgccggcaaacaatcaccgtcttggccgtcgataactcagcaatgtcctccatcctctctaacggatactcactctaccaaatccgcaacattctctctctccacgtcctggtcgattacttcggcaccaagaaacttcaccagatcaccgacggctccacctccactgcctccatgtttcaatccaccggatccgccaccggaacttctggatacatcaacatcaccgatataaaaggcggtaaagtcgcttttggtgtccaagacgacgatagcaagctcacagctcactacgtcaaatccgtctttgaaaagccttacaacatctctgttcttcacatcagccaagtcttaacctcgccggaagcagaagctcccacggcgagtcccagcgacctcatcctcaccacaatcctcgaaaaacaagggtgcaaagctttctccgacatcttgaagtcaaccggcgccgacaaaacgttccaagataccgtagacggaggcttaacggtgttctgtccctccgacagcgctgtcggtaagttcatgccgaaattcaaatccctttctccggcgaacaagactgcgttagtgctttaccacggcatgccggtttaccagtcgttacaaatgcttagatcaggtaacggcgccgttaacacgttagcgacggaaggtaacaacaagtttgatttcaccgttcaaaatgacggagaagacgtgacgctggagacggacgttgtgacggcgaaggtaatggggacgttaaaggatcaagagccattgatagtttacaagatcgataaagtgttgttgcctagagaaatctacaaggccgttaagacgtccgctccagctcctaagtcgagtaagaaaaagcctaagaacgcggaggctgacgccgacggacctagcgccgatgctccgtcagatgatgatgttgaggtggctgacgataaaaacggcgccgtatcagcgatgattactcgaacaagtaatgtcgtaacggccattgtcgggctctgtttcggagtttggcttatgtgaagtgacgtggcatttacctcgctttgggaatcttgttttcctttttctttgtgatctgtcggtttaatttattttacatattcttttttttgttcacgttgatacttggtgtggagatttggaataattaattgttccacttgtgttggatctgatatgttttattctaaaaaaatgtgatgatcattcaaaagagtgattggtacgttggaatc

SEQ ID NO: 820 - protein, 1494 aa, Arabidopsis thaliana
  misc_feature: PFam Name: Fasciclin; PFam Description: Fasciclin domain
  misc_feature: GI Number: 22655474; NR Description: At4g12730/T20K18_80 [Arabidopsis thaliana] >gi|4586249|emb|CAB40990.1| putative pollen surface protein [Arabidopsis thaliana] >gi|7267974|emb|CAB78315.1| putative pollen surface protein
  misc_feature: GI Number: 13377778; NR Description: fasciclin-like
  misc_feature: GI Number: 21593810; NR Description: putative pollen surface
  misc_feature: GI Number: 21595125; NR Description: endosperm-specific
  misc_feature: GI Number: 14190409; NR Description: AT3g60900/T4C21_310
ATAAGACTCCTCTCCAAATGCTACCACACAATTCCTCTATCAAAGCCGCCCAATCCTCCACCCAAAAATGGCTTATCTCCGGCGAGCAGCCACCGCATTGGTTCTCATTTTCCAGCTCCATCTCTTTCTCTCTCTCTCAAATGCACATAACATAACCCGAATCTTGGCCAAAGACCCTGATTTCTCCACTTTCAACCACTATCTCTCAGCGACTCATCTCGCCGACGAGATCAACCGCCGGCAAACAATCACCGTCTTGGCCGTCGATAACTCAGCAATGTCCTCCATCCTCTCTAACGGATACTCACTCTACCAAATCCGCAACATTCTCTCTCTCCACGTCCTGGTCGATTACTTCGGCACCAAGAAACTTCACCAGATCACCGACGGCTCCACCTCCACTGCCTCCATGTTTCAATCCACCGGATCCGCCACCGGAACTTCTGGATACATCAACATCACCGATATAAAAGGCGGTAAAGTCGCTTTTGGTGTCCAAGACGACGATAGCAAGCTCACAGCTCACTACGTCAAATCCGTCTTTGAAAAGCCTTACAACATCTCTGTTCTTCACATCAGCCAAGTCTTAACCTCGCCGGAAGCAGAAGCTCCCACGGCGAGTCCCAGCGACCTCATCCTCACCACAATCCTCGAAAAACAAGGGTGCAAAGCTTTCTCCGACATCTTGAAGTCAACCGGCGCCGACAAAACGTTCCAAGATACCGTAGACGGAGGCTTAACGGTGTTCTGTCCCTCCGACAGCGCTGTCGGTAAGTTCATGCCGAAATTCAAATCCCTTTCTCCGGCGAACAAGACTGCGTTAGTGCTTTACCACGGCATGCCGGTTTACCAGTCGTTACAAATGCTTAGATCAGGTAACGGCGCCGTTAACACGTTAGCGACGGAAGGTAACAACAAGTTTGATTTCACCGTTCAAAATGACGGAGAAGACGTGACGCTGGAGACGGACGTTGTGACGGCGAAGGTAATGGGGACGTTAAAGGATCAAGAGCCATTGATAGTTTACAAGATCGATAAAGTGTTGTTGCCTAGAGAAATCTACAAGGCCGTTAAGACGTCCGCTCCAGCTCCTAAGTCGAGTAAGAAAAAGCCTAAGAACGCGGAGGCTGACGCCGACGGACCTAGCGCCGATGCTCCGTCAGATGATGATGTTGAGGTGGCTGACGATAAAAACGGCGCCGTATCAGCGATGATTACTCGAACAAGTAATGTCGTAACGGCCATTGTCGGGCTCTGTTTCGGAGTTTGGCTTATGTGAAGTGACGTGGCATTTACCTCGCTTTGGGAATCTTGTTTTCCTTTTTCTTTGTGATCTGTCGGTTTAATTTATTTTACATATTCTTTTTTTTGTTCACGTTGATACTTGGTGTGGAGATTTGGAATAATTAATTGTTCCACTTGTGTTGGATCTGATATGTTTTATTCTAAAAAAATGTGATGATCATTCAAAAGAGTGATTGGTACGTTGGAATC

SEQ ID NO: 821 - DNA, 1819 bp, Arabidopsis thaliana
  misc_feature (1)..(1819): Ceres cDNA ID no. 12370303
  misc_feature (1)..(1819): Ceres CLONE  ID no. 158882
  misc_feature (1)..(1819): Also known as  Ceres CDNA ID no. 23375992
gtcttttggtgggtcttcgtcaaagctctctcctttacggtccttttctccagcgcatgaaataataaaggacacctgtatttattaaaatcactacattttccgtaacaaaaaaaatcaaactttgttttctcaatggacggtgcgggagaatcacgactcggtggtgatggtggtggtgatggttctgttggagttcagatccgacaaacacggatgctaccggattttctccagagcgtgaatctcaagtatgtgaaattaggttacaattacttaatctcaaatctcttgactctctgtttattccctctcgccgttgttatctccgtcgaagcctctcagatgaacccagatgatctcaaacagctctggatccatctacaatacaatctggttagtatcatcatctgttcagcgattctagtcttcgggttaacggtttatgttacgacccgacctagacccgtttacttggttgatttctcttgttatctcccacctgatcatctcaaagctccttacgctcggttcatggaacattctagactcaccggagatttcgatgactctgctctcgagtttcaacgcaagatccttgagcgttctggtttaggggaagacacttgtccctgaagctatgcattatgttccaccgagaatttcaatggctgctgctagagaagaagctgaacaagtcatgtttggtgctttagataaccttttcgctaacactaatgtgaaaccaaaggatattggaatccttgttgtgaattgtagtctctttaatccaactccttcgttatctgcaatgattgtgaacaagtataagcttagaggtaacattagaagctacaatctaggcggtatgggttgcagcgcgggagttatcgctgtggatcttgctaaagacatgttgttggtacataggaacacttatgcggttgttgtttctactgagaacattactcagaattggtattttggtaacaagaaatcgatgttgataccgaactgcttgtttcgagttggtggctctgcggttttgctatcgaacaagtcgagggacaagagacggtctaagtacaggcttgtacatgtagtcaggactcaccgtggagcagatgataaagctttccgttgtgtttatcaagagcaggatgatacagggagaaccggggtttcgttgtcgaaagatctaatggcgattgcaggggaaactctcaaaaccaatatcactacattgggtcctcttgttctaccgataagtgagcagattctcttctttatgactctagttgtgaagaagctctttaacggtaaagtgaaaccgtatatcccggatttcaaacttgctttcgagcatttctgtatccatgctggtggaagagctgtgatcgatgagttagagaagaatctgcagctttcaccagttcatgtcgaggcttcgaggatgactcttcatcgatttggtaacacatcttcgagctccatttggtatgaattggcttacattgaagcgaagggaaggatgcgaagaggtaatcgtgtttggcaaatcgcgttcggaagtggatttaaatgtaatagcgcgatttgggaagcattaaggcatgtgaaaccttcgaacaacagtccttgtgaagattgtattgacaagtatccggtaactttaagttattagcttcgtttgaggaactgttattgtgtaacttcgagactaatccatggttgttttttttcttagagaagaaacccttagatttgatctctgacaatgtcaatgtgtttgttgtttatgtgttttggagagtttgtg

SEQ ID NO: 822 - protein, 1819 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 32172502; NR Description: FAE1 [Marchantia polymorpha]
  misc_feature: GI Number: 32172500; NR Description: FAE3 [Marchantia polymorpha]
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 12963438; NR Description: beta-ketoacyl-CoA
GTCTTTTGGTGGGTCTTCGTCAAAGCTCTCTCCTTTACGGTCCTTTTCTCCAGCGCATGAAATAATAAAGGACACCTGTATTTATTAAAATCACTACATTTTCCGTAACAAAAAAAATCAAACTTTGTTTTCTCAATGGACGGTGCGGGAGAATCACGACTCGGTGGTGATGGTGGTGGTGATGGTTCTGTTGGAGTTCAGATCCGACAAACACGGATGCTACCGGATTTTCTCCAGAGCGTGAATCTCAAGTATGTGAAATTAGGTTACAATTACTTAATCTCAAATCTCTTGACTCTCTGTTTATTCCCTCTCGCCGTTGTTATCTCCGTCGAAGCCTCTCAGATGAACCCAGATGATCTCAAACAGCTCTGGATCCATCTACAATACAATCTGGTTAGTATCATCATCTGTTCAGCGATTCTAGTCTTCGGGTTAACGGTTTATGTTACGACCCGACCTAGACCCGTTTACTTGGTTGATTTCTCTTGTTATCTCCCACCTGATCATCTCAAAGCTCCTTACGCTCGGTTCATGGAACATTCTAGACTCACCGGAGATTTCGATGACTCTGCTCTCGAGTTTCAACGCAAGATCCTTGAGCGTTCTGGTTTAGGGGAAGACACTTGTCCCTGAAGCTATGCATTATGTTCCACCGAGAATTTCAATGGCTGCTGCTAGAGAAGAAGCTGAACAAGTCATGTTTGGTGCTTTAGATAACCTTTTCGCTAACACTAATGTGAAACCAAAGGATATTGGAATCCTTGTTGTGAATTGTAGTCTCTTTAATCCAACTCCTTCGTTATCTGCAATGATTGTGAACAAGTATAAGCTTAGAGGTAACATTAGAAGCTACAATCTAGGCGGTATGGGTTGCAGCGCGGGAGTTATCGCTGTGGATCTTGCTAAAGACATGTTGTTGGTACATAGGAACACTTATGCGGTTGTTGTTTCTACTGAGAACATTACTCAGAATTGGTATTTTGGTAACAAGAAATCGATGTTGATACCGAACTGCTTGTTTCGAGTTGGTGGCTCTGCGGTTTTGCTATCGAACAAGTCGAGGGACAAGAGACGGTCTAAGTACAGGCTTGTACATGTAGTCAGGACTCACCGTGGAGCAGATGATAAAGCTTTCCGTTGTGTTTATCAAGAGCAGGATGATACAGGGAGAACCGGGGTTTCGTTGTCGAAAGATCTAATGGCGATTGCAGGGGAAACTCTCAAAACCAATATCACTACATTGGGTCCTCTTGTTCTACCGATAAGTGAGCAGATTCTCTTCTTTATGACTCTAGTTGTGAAGAAGCTCTTTAACGGTAAAGTGAAACCGTATATCCCGGATTTCAAACTTGCTTTCGAGCATTTCTGTATCCATGCTGGTGGAAGAGCTGTGATCGATGAGTTAGAGAAGAATCTGCAGCTTTCACCAGTTCATGTCGAGGCTTCGAGGATGACTCTTCATCGATTTGGTAACACATCTTCGAGCTCCATTTGGTATGAATTGGCTTACATTGAAGCGAAGGGAAGGATGCGAAGAGGTAATCGTGTTTGGCAAATCGCGTTCGGAAGTGGATTTAAATGTAATAGCGCGATTTGGGAAGCATTAAGGCATGTGAAACCTTCGAACAACAGTCCTTGTGAAGATTGTATTGACAAGTATCCGGTAACTTTAAGTTATTAGCTTCGTTTGAGGAACTGTTATTGTGTAACTTCGAGACTAATCCATGGTTGTTTTTTTTCTTAGAGAAGAAACCCTTAGATTTGATCTCTGACAATGTCAATGTGTTTGTTGTTTATGTGTTTTGGAGAGTTTGTG

SEQ ID NO: 823 - DNA, 1293 bp, Arabidopsis thaliana
  misc_feature (1)..(1293): Ceres cDNA ID no. 12370578
  misc_feature (1)..(1293): Ceres CLONE  ID no. 31570
  misc_feature (1)..(1293): Also known as  Ceres CDNA ID no. 23376242
aatctgaaagttcttaagtggttccacgatgtttccattttgttctgacttccgaggccaacgagatgagtccaataaacaaagggcacggaaacattctttttaaattaggtttgttttttatttttggtttttggtttttcccggaaattgtatgaagtcttcgttacagtttctctctctcacattctctgtataaagtcttcttgagatcgaaggataacttcaattcgattcttttccaagctacacacagctgattttattataagaagattgattgtgatgggtactagagctctgcagattcctttacttgaaggtgagactgataattacgatggtgttactgtaaccatggtggaacctatggattctgaggtttttactgaaagtcttagggcttcgctttcgcattggagagaagaggggaagaagggaatttggataaagctgcctcttggattggctaatcttgtggaggctgcagttagtgaaggatttagatatcaccacgcggagcctgagtacttgatgcttgtatcttggatctctgaaactcctgatacaatcccagccaatgcttctcatgttgtaggtgctggtgctttggtcatcaacaaaaatactaaagaggtcctcgttgtccaggagaggagtgggtttttcaaagataaaaatgtgtggaagctgcctactggtgttatcaacgagggcgaggatatatggactggagtagctagggaagtggaagaagaaactggaattattgcagattttgtcgaagtactggctttcaggcaaagccacaaagccatcttaaaaaagaaaacagatatgtttttcctgtgtgtcttaagtccgcgctcttacgatattactgaacaaaaatctgagatcttgcaagctaagtggatgccgatccaagagtatgtagaccaaccatggaacaagaagaacgagatgttcaagttcatggctaacatttgccaaaagaagtgtgaggaagaatacttgggattcgccattgtgccaactaccacatcatctggtaaagagagctttatctactgcaatgcggatcatgccaagcgccttaaagtatcgcgtgaccaagcctctgcttctctctgaaaacattctcatctgattctgtttgatctcggcatgtgtgtgtccagtgtgtacaaaacaggatactttcttctatattattccgattctacaaaattgcgtctaaatatttaagtttataccatctctatgagccactgtaaaacttgccatcgactt

SEQ ID NO: 824 - protein, 1293 aa, Arabidopsis thaliana
  misc_feature: PFam Name: NUDIX; PFam Description: NUDIX domain
  misc_feature: GI Number: 21553511; NR Description: growth factor like
  misc_feature: GI Number: 15810611; NR Description: putative growth factor [Arabidopsis thaliana] >gi|13877893|gb|AAK44024.1| putative growth factor [Arabidopsis thaliana] >gi|4586248|emb|CAB40989.1| growth factor like protein [Arabidopsis thaliana]
  misc_feature: GI Number: 4587605; NR Description: putative mutT domain protein [Arabidopsis thaliana] >gi|25387471|pir||G84457 probable mutT domain protein [imported] - Arabidopsis thaliana >gi|15228147|ref|NP_178526.1| MutT/nudix family protein
  misc_feature: GI Number: 38564302; NR Description: At2g04430 [Arabidopsis thaliana] >gi|40824275|gb|AAR92362.1| At2g04430 [Arabidopsis
  misc_feature: GI Number: 4587607; NR Description: putative mutT domain protein [Arabidopsis thaliana] >gi|25387501|pir||E84457 probable mutT domain protein [imported] - Arabidopsis thaliana >gi|15228145|ref|NP_178524.1| MutT/nudix family protein
AATCTGAAAGTTCTTAAGTGGTTCCACGATGTTTCCATTTTGTTCTGACTTCCGAGGCCAACGAGATGAGTCCAATAAACAAAGGGCACGGAAACATTCTTTTTAAATTAGGTTTGTTTTTTATTTTTGGTTTTTGGTTTTTCCCGGAAATTGTATGAAGTCTTCGTTACAGTTTCTCTCTCTCACATTCTCTGTATAAAGTCTTCTTGAGATCGAAGGATAACTTCAATTCGATTCTTTTCCAAGCTACACACAGCTGATTTTATTATAAGAAGATTGATTGTGATGGGTACTAGAGCTCTGCAGATTCCTTTACTTGAAGGTGAGACTGATAATTACGATGGTGTTACTGTAACCATGGTGGAACCTATGGATTCTGAGGTTTTTACTGAAAGTCTTAGGGCTTCGCTTTCGCATTGGAGAGAAGAGGGGAAGAAGGGAATTTGGATAAAGCTGCCTCTTGGATTGGCTAATCTTGTGGAGGCTGCAGTTAGTGAAGGATTTAGATATCACCACGCGGAGCCTGAGTACTTGATGCTTGTATCTTGGATCTCTGAAACTCCTGATACAATCCCAGCCAATGCTTCTCATGTTGTAGGTGCTGGTGCTTTGGTCATCAACAAAAATACTAAAGAGGTCCTCGTTGTCCAGGAGAGGAGTGGGTTTTTCAAAGATAAAAATGTGTGGAAGCTGCCTACTGGTGTTATCAACGAGGGCGAGGATATATGGACTGGAGTAGCTAGGGAAGTGGAAGAAGAAACTGGAATTATTGCAGATTTTGTCGAAGTACTGGCTTTCAGGCAAAGCCACAAAGCCATCTTAAAAAAGAAAACAGATATGTTTTTCCTGTGTGTCTTAAGTCCGCGCTCTTACGATATTACTGAACAAAAATCTGAGATCTTGCAAGCTAAGTGGATGCCGATCCAAGAGTATGTAGACCAACCATGGAACAAGAAGAACGAGATGTTCAAGTTCATGGCTAACATTTGCCAAAAGAAGTGTGAGGAAGAATACTTGGGATTCGCCATTGTGCCAACTACCACATCATCTGGTAAAGAGAGCTTTATCTACTGCAATGCGGATCATGCCAAGCGCCTTAAAGTATCGCGTGACCAAGCCTCTGCTTCTCTCTGAAAACATTCTCATCTGATTCTGTTTGATCTCGGCATGTGTGTGTCCAGTGTGTACAAAACAGGATACTTTCTTCTATATTATTCCGATTCTACAAAATTGCGTCTAAATATTTAAGTTTATACCATCTCTATGAGCCACTGTAAAACTTGCCATCGACTT

SEQ ID NO: 825 - DNA, 1298 bp, Arabidopsis thaliana
  misc_feature (1)..(1298): Ceres cDNA ID no. 12370642
  misc_feature (1)..(1298): Ceres CLONE  ID no. 19079
  misc_feature (1)..(1298): Also known as  Ceres CDNA ID no. 23376302
ctctctctctctctctctctttcaatacagctccaaaactcgtcctcaagacgctatttatccatttaagtctcttctcttttcgtcctcataatactcttatacacagaaacgtttttcattcataacaaaaaatgggttttataactcgatttttagttttcatgtcactcttcaccagtttggtttctggatttgctctacaaaagcttcctcttatacagttcgacgaaggttacacacagctctttggtgaccagaatcttattgttcacagagatggaaaatctgtccggttaacgcttgatgaaagaaccggttctggatttgtctcaaatgatatttacttgcatggcttcttcagttcctctatcaaattgccagcagattactctgcaggagttgttatcgccttttatttatcaaatggggacttatatgagaagaatcatgacgagattgattttgagtttttggggaatattagaggcagagaatggaggattcagaccaatatatacggtaatggaagcacacacttgggcagagaagaaagatacaatctttggtttgatccaacagaggatttccatcaatacagtatcctttggtctctatctcacatcatattttatgtagacaatgttccgatcagagaagtcaaacgtacggcgtcgatgggcggtgacttcccggcgaagccaatgtctttatattcaaccatatgggatggttccaaatgggcgactgatggaggcaagtacggtgtaaattacaaatatgccccttacgtctctcaattcactgatctgatcctccacggctgcgccgttgaccccaccgagaagtttccgagctgcaaagatgaagcggttcagaatctccggctagcatcggagataacggagtctcagaggaacaagatggagattttccgacagaaacacatgacttattcgtattgttacgatcatatgaggtacaaggtggttttgtcggagtgtgttgtgaatccggctgaggctaagcgtctcagggtctatgatccggtcacgttcggtgggattcctcacggccaccgtcgtgggaagcatcggagcaggagccgattagctcgaactgagtcgatatgaatcggtgtatattgttcggctagagggcatttttggcattttctgtcttgtataggaatactatgaattatggactgaataatggaatgacaccgctatattttgatttcctccattttatgaacattatcgttttaacataataataaaatttcatttttctat

SEQ ID NO: 826 - protein, 1298 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 31711806; NR Description: At2g01850 [Arabidopsis thaliana] >gi|2154609|dbj|BAA20289.1| endoxyloglucan transferase related protein [Arabidopsis thaliana] >gi|4522010|gb|AAD21783.1| xyloglucan endotransglycosylase >gi|38605340|sp|Q8LDS2|XT27_ARATH
  misc_feature: GI Number: 5533313; NR Description: endoxyloglucan
  misc_feature: GI Number: 21553969; NR Description: putative
  misc_feature: GI Number: 21553987; NR Description: xyloglucan endo-transglycosylase, putative [Arabidopsis thaliana] >gi|2154611|dbj|BAA20290.1| endoxyloglucan transferase related protein [Arabidopsis thaliana] >gi|8778237|gb|AAF79246.1|
  misc_feature: GI Number: 6681351; NR Description: ETAG-A3 [Lycopersicon
CTCTCTCTCTCTCTCTCTCTTTCAATACAGCTCCAAAACTCGTCCTCAAGACGCTATTTATCCATTTAAGTCTCTTCTCTTTTCGTCCTCATAATACTCTTATACACAGAAACGTTTTTCATTCATAACAAAAAATGGGTTTTATAACTCGATTTTTAGTTTTCATGTCACTCTTCACCAGTTTGGTTTCTGGATTTGCTCTACAAAAGCTTCCTCTTATACAGTTCGACGAAGGTTACACACAGCTCTTTGGTGACCAGAATCTTATTGTTCACAGAGATGGAAAATCTGTCCGGTTAACGCTTGATGAAAGAACCGGTTCTGGATTTGTCTCAAATGATATTTACTTGCATGGCTTCTTCAGTTCCTCTATCAAATTGCCAGCAGATTACTCTGCAGGAGTTGTTATCGCCTTTTATTTATCAAATGGGGACTTATATGAGAAGAATCATGACGAGATTGATTTTGAGTTTTTGGGGAATATTAGAGGCAGAGAATGGAGGATTCAGACCAATATATACGGTAATGGAAGCACACACTTGGGCAGAGAAGAAAGATACAATCTTTGGTTTGATCCAACAGAGGATTTCCATCAATACAGTATCCTTTGGTCTCTATCTCACATCATATTTTATGTAGACAATGTTCCGATCAGAGAAGTCAAACGTACGGCGTCGATGGGCGGTGACTTCCCGGCGAAGCCAATGTCTTTATATTCAACCATATGGGATGGTTCCAAATGGGCGACTGATGGAGGCAAGTACGGTGTAAATTACAAATATGCCCCTTACGTCTCTCAATTCACTGATCTGATCCTCCACGGCTGCGCCGTTGACCCCACCGAGAAGTTTCCGAGCTGCAAAGATGAAGCGGTTCAGAATCTCCGGCTAGCATCGGAGATAACGGAGTCTCAGAGGAACAAGATGGAGATTTTCCGACAGAAACACATGACTTATTCGTATTGTTACGATCATATGAGGTACAAGGTGGTTTTGTCGGAGTGTGTTGTGAATCCGGCTGAGGCTAAGCGTCTCAGGGTCTATGATCCGGTCACGTTCGGTGGGATTCCTCACGGCCACCGTCGTGGGAAGCATCGGAGCAGGAGCCGATTAGCTCGAACTGAGTCGATATGAATCGGTGTATATTGTTCGGCTAGAGGGCATTTTTGGCATTTTCTGTCTTGTATAGGAATACTATGAATTATGGACTGAATAATGGAATGACACCGCTATATTTTGATTTCCTCCATTTTATGAACATTATCGTTTTAACATAATAATAAAATTTCATTTTTCTAT

SEQ ID NO: 827 - DNA, 1382 bp, Arabidopsis thaliana
  misc_feature (1)..(1382): Ceres cDNA ID no. 12371106
  misc_feature (1)..(1382): Ceres CLONE  ID no. 126098
  misc_feature (1)..(1382): Also known as  Ceres CDNA ID no. 23376733
aaacctctctcctcgaccctttaatttctaatcaccgaccaaaattgatcggaaacctagagctcttcgtattgctccgccaccatgcatatccggcgccagatcttcgttaaatctcctgactgtcaaaaagtcgtcgctctgcaattggatcctgcgcaatctctattaactctttcgggtatcacttccttactcgaatcgtcgcagcgtatatcgttttcggcttgctcgattactctagatgggaagcttttgaatggctctacacggatccaagtatcgaagcttccttctgtatccatgctcactcttttccctcgcctccgtggaggtggaggagatggtggggcaacgggagccgagtctcgcgattgctatctcaatatgtacgcggagaagaaacctgacaaggttgatcctaatgagcagaggctctccaaatggttgaattgtgctttgtctaacgagcctttggctgagccgtgcgtgattgatctccttgggaatttgttcaataaagaagttttggtgcacgctttgttgtctaagaggttgcctaaacaattctcgtacattaagggtttgaaagatatggtgaatattaagcttacgcctgttgctggttctgatggttcatcgcaagatacgactagtgcacagtttcagtgtccggtctcagggcttgaattcaatggaaagtacaagtttttcgctttgaggggatgtggacatgtgatgagcgcaaaggcgttgaaggaagtgaagtcttcttcttgtttggtgtgtcatgcggatgtcaaagattctgataagattgtgatcaatggtactgaggaggaagtagatttgttgagggagaagatggaggaggagaaagctaagctgagagagaagaaaggtgtctcaaagaagagtaagaacggtgctgctgtggtggctgatacaggtgcgaaggtcgcaaagagacagatagaggatgggaatgtcaatggcaatggtataactgtgaagaaattcaaggcggcggataaagtgccggttaatgctactaaggaagtctatgcttctctctttacttcctctaagaagaagtctgatttcagggagacttactcttgcaggtcacttcctctcggcaggaattgatttgttggatcaatgttgtttacctgcttgcttcatttgctctgtaatctgttttgattatattgatatatcaacttgcttttgtaatttcgcctactggataatataatgtttttcttttccttttgcaattggtaaaaacagtaaacatgtttgcatccactatgctaaaactagtaaaagtgttgtatcataagctgcaattgtaacaagaggatatgtatgttgtttac

SEQ ID NO: 828 - protein, 1382 aa, Arabidopsis thaliana
  misc_feature: GI Number: 32484231; NR Description: MGC64388 protein
  misc_feature: GI Number: 27735473; NR Description: Similar to chromosome 20
  misc_feature: GI Number: 6563236; NR Description: protein x 0001 [Homo sapiens]
  misc_feature: GI Number: 13097180; NR Description: Chromosome 20 open reading frame 43 [Homo sapiens] >gi|23813888|sp|Q9BY42|CT43_HUMAN Protein C20orf43 (HSPC164/HSPC169) (AD-007) (CDA05)
  misc_feature: GI Number: 7705483; NR Description: chromosome 20 open reading frame 43 [Homo sapiens] >gi|6841550|gb|AAF29128.1| HSPC164
AAACCTCTCTCCTCGACCCTTTAATTTCTAATCACCGACCAAAATTGATCGGAAACCTAGAGCTCTTCGTATTGCTCCGCCACCATGCATATCCGGCGCCAGATCTTCGTTAAATCTCCTGACTGTCAAAAAGTCGTCGCTCTGCAATTGGATCCTGCGCAATCTCTATTAACTCTTTCGGGTATCACTTCCTTACTCGAATCGTCGCAGCGTATATCGTTTTCGGCTTGCTCGATTACTCTAGATGGGAAGCTTTTGAATGGCTCTACACGGATCCAAGTATCGAAGCTTCCTTCTGTATCCATGCTCACTCTTTTCCCTCGCCTCCGTGGAGGTGGAGGAGATGGTGGGGCAACGGGAGCCGAGTCTCGCGATTGCTATCTCAATATGTACGCGGAGAAGAAACCTGACAAGGTTGATCCTAATGAGCAGAGGCTCTCCAAATGGTTGAATTGTGCTTTGTCTAACGAGCCTTTGGCTGAGCCGTGCGTGATTGATCTCCTTGGGAATTTGTTCAATAAAGAAGTTTTGGTGCACGCTTTGTTGTCTAAGAGGTTGCCTAAACAATTCTCGTACATTAAGGGTTTGAAAGATATGGTGAATATTAAGCTTACGCCTGTTGCTGGTTCTGATGGTTCATCGCAAGATACGACTAGTGCACAGTTTCAGTGTCCGGTCTCAGGGCTTGAATTCAATGGAAAGTACAAGTTTTTCGCTTTGAGGGGATGTGGACATGTGATGAGCGCAAAGGCGTTGAAGGAAGTGAAGTCTTCTTCTTGTTTGGTGTGTCATGCGGATGTCAAAGATTCTGATAAGATTGTGATCAATGGTACTGAGGAGGAAGTAGATTTGTTGAGGGAGAAGATGGAGGAGGAGAAAGCTAAGCTGAGAGAGAAGAAAGGTGTCTCAAAGAAGAGTAAGAACGGTGCTGCTGTGGTGGCTGATACAGGTGCGAAGGTCGCAAAGAGACAGATAGAGGATGGGAATGTCAATGGCAATGGTATAACTGTGAAGAAATTCAAGGCGGCGGATAAAGTGCCGGTTAATGCTACTAAGGAAGTCTATGCTTCTCTCTTTACTTCCTCTAAGAAGAAGTCTGATTTCAGGGAGACTTACTCTTGCAGGTCACTTCCTCTCGGCAGGAATTGATTTGTTGGATCAATGTTGTTTACCTGCTTGCTTCATTTGCTCTGTAATCTGTTTTGATTATATTGATATATCAACTTGCTTTTGTAATTTCGCCTACTGGATAATATAATGTTTTTCTTTTCCTTTTGCAATTGGTAAAAACAGTAAACATGTTTGCATCCACTATGCTAAAACTAGTAAAAGTGTTGTATCATAAGCTGCAATTGTAACAAGAGGATATGTATGTTGTTTAC

SEQ ID NO: 829 - DNA, 1075 bp, Arabidopsis thaliana
  misc_feature (1)..(1075): Ceres cDNA ID no. 12371334
  misc_feature (1)..(1075): Ceres CLONE  ID no. 39883
  misc_feature (1)..(1075): Also known as  Ceres CDNA ID no. 23376945
aaggagcttcgtgcttgtcaacaaattttccaagcgcccgctgaactaaaaaagatgagttctgatctgaagagaaagccgaagaagaagataactcctaaacctgttcaattaaaccctaattggtcactcctccaacaaaaactgaaatctgattctcatggcaacactcgaaaatcttcaaacccagaaaatcccagctccatattagggaagcgaaaggagagacccgattcggaggttgatgttcctaagattaatcccttagctccggttaacgacgattccagtttgacagatgaagtggctatggactgtgaaatggttggtgtcagtcaaggaaccaaaagtgcccttggacgagttaccttggtaaataaatggggaaatgttctatatgatgagtttgtccgtccagtggaacatgttgttgactttcgtacttctattagcgggattcgacctcgagatttgagaaaggccaaagatttccgcgttgctcaaaccaaagtagcagagttgataaagggaaagattctcgtgggacacgccttgcataatgatctcaaggctttgctgctaactcacccgaaaaaggacataagggacacaggagaatatcagccctttctcaagggcaaaacaagaaagtctctgaaacatctcgcatctgaaattctaggggctgacattcaaaatggagagcactgccctattgatgatgcaagagctgcgatgatgctttaccaaaagaacagaaaagagtgggagaaaactgtgaaagaccagacacggatgtggctgaaacaaaagaagcgtaagcctaagaagaaagctaaatatgggaacaacgcttccaccaatgacaatccaattgtttgaatcaatcagcgagagcaaacctgactaaacagaaaaccaagaatcgctgaaaagttttggtcgtttttcctttctttttgattgttctcagcatcaggcgctgcatccaaatgtactatcgtctattacaatgttataccagattagatcatgtattattgttaaacaaaaaatatacatttttggaggttcc

SEQ ID NO: 830 - protein, 1075 aa, Arabidopsis thaliana
  misc_feature: PFam Name: Exonuc_X-T; PFam Description: Exonuclease
  misc_feature: GI Number: 21593535; NR Description: exonuclease, putative [Arabidopsis thaliana] >gi|18400624|ref|NP_566499.1| exonuclease
  misc_feature: GI Number: 8777491; NR Description: exonuclease-like protein
  misc_feature: GI Number: 1079321; NR Description: XPMC2 protein - African
  misc_feature: GI Number: 27696424; NR Description: Xpmc2 protein [Xenopus laevis]
  misc_feature: GI Number: 50757227; NR Description: PREDICTED: similar to XPMC2 prevents mitotic catastrophe 2 homolog; Xenopus prevents
AAGGAGCTTCGTGCTTGTCAACAAATTTTCCAAGCGCCCGCTGAACTAAAAAAGATGAGTTCTGATCTGAAGAGAAAGCCGAAGAAGAAGATAACTCCTAAACCTGTTCAATTAAACCCTAATTGGTCACTCCTCCAACAAAAACTGAAATCTGATTCTCATGGCAACACTCGAAAATCTTCAAACCCAGAAAATCCCAGCTCCATATTAGGGAAGCGAAAGGAGAGACCCGATTCGGAGGTTGATGTTCCTAAGATTAATCCCTTAGCTCCGGTTAACGACGATTCCAGTTTGACAGATGAAGTGGCTATGGACTGTGAAATGGTTGGTGTCAGTCAAGGAACCAAAAGTGCCCTTGGACGAGTTACCTTGGTAAATAAATGGGGAAATGTTCTATATGATGAGTTTGTCCGTCCAGTGGAACATGTTGTTGACTTTCGTACTTCTATTAGCGGGATTCGACCTCGAGATTTGAGAAAGGCCAAAGATTTCCGCGTTGCTCAAACCAAAGTAGCAGAGTTGATAAAGGGAAAGATTCTCGTGGGACACGCCTTGCATAATGATCTCAAGGCTTTGCTGCTAACTCACCCGAAAAAGGACATAAGGGACACAGGAGAATATCAGCCCTTTCTCAAGGGCAAAACAAGAAAGTCTCTGAAACATCTCGCATCTGAAATTCTAGGGGCTGACATTCAAAATGGAGAGCACTGCCCTATTGATGATGCAAGAGCTGCGATGATGCTTTACCAAAAGAACAGAAAAGAGTGGGAGAAAACTGTGAAAGACCAGACACGGATGTGGCTGAAACAAAAGAAGCGTAAGCCTAAGAAGAAAGCTAAATATGGGAACAACGCTTCCACCAATGACAATCCAATTGTTTGAATCAATCAGCGAGAGCAAACCTGACTAAACAGAAAACCAAGAATCGCTGAAAAGTTTTGGTCGTTTTTCCTTTCTTTTTGATTGTTCTCAGCATCAGGCGCTGCATCCAAATGTACTATCGTCTATTACAATGTTATACCAGATTAGATCATGTATTATTGTTAAACAAAAAATATACATTTTTGGAGGTTCC

SEQ ID NO: 831 - DNA, 1290 bp, Arabidopsis thaliana
  misc_feature (1)..(1290): Ceres cDNA ID no. 12371516
  misc_feature (1)..(1290): Ceres CLONE  ID no. 1959
  misc_feature (1)..(1290): Also known as  Ceres CDNA ID no. 23377122
atcctttctctctcattttagatccaaaactcttctctgtctctctcaagatttatgttttcgtaactgtaactcatagcaaaaacgagtctaagatctgttcataatgatgatgttcaagagcggtgacatggattacacccagaaaatgaagagatgtcacgaatatgtagaagctctagaagaagaacaaaaaaagattcaagtctttcaacgtgagctccctttatgtttagaacttgtaacccaagctatcgagtcatgtcggaaggagttatcggaatcttcagaacatgttggcggccagtcagaatgttctgagcggacaactagtgaatgcggcggtgccgtgtttgaagagtttatgccaatcaagtggagttctgcttcatctgatgaaaccgataaagatgaagaagctgagaaaactgagatgatgaccaatgaaaataacgatggtgataagaagaaatcggattggcttagatctgttcaattgtggaaccaatcaccagatccacaacctaataataagaaaccgatggtaattgaagtcaaacgcagcgctggtgcgtttcaaccgtttcaaaaggagaaacctaaggctgcagattctcaaccacttattaaagcaattactccgacgtcgacgacgacaactagttccacggcggaaaccgtcgggggtggaaaagagtttgaggagcagaaacaatctcattcgaataggaagcaaagacgttgctggtcaccggagttacaccgcagattcttgcacgcgcttcaacaacttggtggatcacatgttgctacgcctaagcagattagagatcttatgaaggtcgatggtttaactaatgacgaagttaaaagtcatttacagaaatatagattgcatacaagaagaccagctactccggtagtaaggaccggtggtgaaaatccacaacaacggcagtttatggtgatggaaggcatttgggtaccttcacacgatacaactaataatagagtttacgctcctgtggcgacacaaccgccgcaatcttcaacgtcgggagagagaagcaatcggggttgcaaatctcccgcaacatcttctactactacacacacaccacaccttcttcctctttcataaatatatagttaccgatttgtatgaaaatttgttttcttctttatatatttgttttgtaaccaagaatgttcgttctaggtttaagagttttgaataaattgtaacaatagatatacattgcacacaattgaataaaagaaaaagttttg

SEQ ID NO: 832 - protein, 1290 aa, Arabidopsis thaliana
  misc_feature: PFam Name: Myb_DNA-binding; PFam Description: Myb-like
  misc_feature: GI Number: 21554044; NR Description: unknown [Arabidopsis thaliana]
  misc_feature: GI Number: 5734711; NR Description: F24J5.9 [Arabidopsis thaliana] >gi|25404762|pir||C96711 F24J5.9 [imported] - Arabidopsis
  misc_feature: GI Number: 21593572; NR Description: unknown [Arabidopsis thaliana]
  misc_feature: GI Number: 21700901; NR Description: At1g13300/T6J4_6 [Arabidopsis thaliana] >gi|13605875|gb|AAK32923.1| At1g13300/T6J4_6 [Arabidopsis thaliana] >gi|25511627|pir||F86267 T6J4.6 protein - Arabidopsis thaliana
  misc_feature: GI Number: 21553699; NR Description: unknown [Arabidopsis thaliana]
ATCCTTTCTCTCTCATTTTAGATCCAAAACTCTTCTCTGTCTCTCTCAAGATTTATGTTTTCGTAACTGTAACTCATAGCAAAAACGAGTCTAAGATCTGTTCATAATGATGATGTTCAAGAGCGGTGACATGGATTACACCCAGAAAATGAAGAGATGTCACGAATATGTAGAAGCTCTAGAAGAAGAACAAAAAAAGATTCAAGTCTTTCAACGTGAGCTCCCTTTATGTTTAGAACTTGTAACCCAAGCTATCGAGTCATGTCGGAAGGAGTTATCGGAATCTTCAGAACATGTTGGCGGCCAGTCAGAATGTTCTGAGCGGACAACTAGTGAATGCGGCGGTGCCGTGTTTGAAGAGTTTATGCCAATCAAGTGGAGTTCTGCTTCATCTGATGAAACCGATAAAGATGAAGAAGCTGAGAAAACTGAGATGATGACCAATGAAAATAACGATGGTGATAAGAAGAAATCGGATTGGCTTAGATCTGTTCAATTGTGGAACCAATCACCAGATCCACAACCTAATAATAAGAAACCGATGGTAATTGAAGTCAAACGCAGCGCTGGTGCGTTTCAACCGTTTCAAAAGGAGAAACCTAAGGCTGCAGATTCTCAACCACTTATTAAAGCAATTACTCCGACGTCGACGACGACAACTAGTTCCACGGCGGAAACCGTCGGGGGTGGAAAAGAGTTTGAGGAGCAGAAACAATCTCATTCGAATAGGAAGCAAAGACGTTGCTGGTCACCGGAGTTACACCGCAGATTCTTGCACGCGCTTCAACAACTTGGTGGATCACATGTTGCTACGCCTAAGCAGATTAGAGATCTTATGAAGGTCGATGGTTTAACTAATGACGAAGTTAAAAGTCATTTACAGAAATATAGATTGCATACAAGAAGACCAGCTACTCCGGTAGTAAGGACCGGTGGTGAAAATCCACAACAACGGCAGTTTATGGTGATGGAAGGCATTTGGGTACCTTCACACGATACAACTAATAATAGAGTTTACGCTCCTGTGGCGACACAACCGCCGCAATCTTCAACGTCGGGAGAGAGAAGCAATCGGGGTTGCAAATCTCCCGCAACATCTTCTACTACTACACACACACCACACCTTCTTCCTCTTTCATAAATATATAGTTACCGATTTGTATGAAAATTTGTTTTCTTCTTTATATATTTGTTTTGTAACCAAGAATGTTCGTTCTAGGTTTAAGAGTTTTGAATAAATTGTAACAATAGATATACATTGCACACAATTGAATAAAAGAAAAAGTTTTG

SEQ ID NO: 833 - DNA, 1231 bp, Arabidopsis thaliana
  misc_feature (1)..(1231): Ceres cDNA ID no. 12371520
  misc_feature (1)..(1231): Ceres CLONE  ID no. 36212
  misc_feature (1)..(1231): Also known as  Ceres CDNA ID no. 23377126
actactagctcagggtttttacttttctagggtttatctatctcattccgcaatcatggagtctctggggaagctacagctacatcaccagccatttcacctttccttcactcacacctcttcttcaacattccccaaaaacctcttcaaatcctcaattcaaccaatttcatctctcaaatccgcttcaattaaagcttcgtcctccaaatttcaaaactctatcacccctctcccaaagtccacacctttccgtctcttcaaatccacatgcatcactctaacaaccgccgcggctctgcttttggcgaatctccatctcaaatcgccggcgattgcagctcccatcgcgcctccgccgtcagttgaaagcaaagaaaacgttaccttggaagaagaagagagagcgcttgatgagcatttgattactcacccttctgatgtcgacgctcttcgttcattgatggaggtaaagatcaaatctcgaaagcttacagaagcagtagaagtgatcgatcgtttgataaaattggaacctgaagaaaaagaatggccagttttgaaagctaacatctttacctacagtggagatctagacttggctaaaactggatttgaagagattctggctaaagatccgcttcgtgttgaagcttatcacggcttgcttatggcttattcagatgcaggtcttgatttgaaagaggtggagagtagaattgaggaagcaatgttgaagtgcaaaaaggagaataatcaaaacgattttcgggattttaagctactcgtggcgcagattcgggtcattgaaggaaaacatagtgaagcattgaagctttatcaagagcttgtaaaggaggaaccaagagattttaggccgtatctttgtcagggaattatatacacattgctgaagaagaaagacaaggcagaagaacagtttgataactttcggaaacttgttccaaagaatcatccttatagagagtattttatggataatatgatagcaacaaagcttttttccgagaaggcgcagcgtgagatggctgaggagatggctggatcaactagttgatgagaatatgtgtaatgaggtgaaaaatcatgcttagaagacttggaaaatgtggttttgaggattttctgttgcaggtttttcttgatcgtctcaagatgtatctttagttggtttacataaagttcataagtcgaatacttggtttaattt

SEQ ID NO: 834 - protein, 1231 aa, Arabidopsis thaliana
  misc_feature: PFam Name: TPR_1; PFam Description: Tetratricopeptide repeat
  misc_feature: GI Number: 21617936; NR Description: unknown [Arabidopsis thaliana]
  misc_feature: GI Number: 21553360; NR Description: unknown [Arabidopsis thaliana] >gi|18413971|ref|NP_568104.1| chloroplast lumen common
  misc_feature: GI Number: 28416459; NR Description: At4g39470/F23K16_100 [Arabidopsis thaliana] >gi|15215656|gb|AAK91373.1| AT4g39470/F23K16_100 [Arabidopsis thaliana] >gi|18420460|ref|NP_568061.1| chloroplast lumen common family
  misc_feature: GI Number: 57900694; NR Description: unknow protein [Oryza
  misc_feature: GI Number: 48892733; NR Description: COG0457: FOG: TPR repeat
ACTACTAGCTCAGGGTTTTTACTTTTCTAGGGTTTATCTATCTCATTCCGCAATCATGGAGTCTCTGGGGAAGCTACAGCTACATCACCAGCCATTTCACCTTTCCTTCACTCACACCTCTTCTTCAACATTCCCCAAAAACCTCTTCAAATCCTCAATTCAACCAATTTCATCTCTCAAATCCGCTTCAATTAAAGCTTCGTCCTCCAAATTTCAAAACTCTATCACCCCTCTCCCAAAGTCCACACCTTTCCGTCTCTTCAAATCCACATGCATCACTCTAACAACCGCCGCGGCTCTGCTTTTGGCGAATCTCCATCTCAAATCGCCGGCGATTGCAGCTCCCATCGCGCCTCCGCCGTCAGTTGAAAGCAAAGAAAACGTTACCTTGGAAGAAGAAGAGAGAGCGCTTGATGAGCATTTGATTACTCACCCTTCTGATGTCGACGCTCTTCGTTCATTGATGGAGGTAAAGATCAAATCTCGAAAGCTTACAGAAGCAGTAGAAGTGATCGATCGTTTGATAAAATTGGAACCTGAAGAAAAAGAATGGCCAGTTTTGAAAGCTAACATCTTTACCTACAGTGGAGATCTAGACTTGGCTAAAACTGGATTTGAAGAGATTCTGGCTAAAGATCCGCTTCGTGTTGAAGCTTATCACGGCTTGCTTATGGCTTATTCAGATGCAGGTCTTGATTTGAAAGAGGTGGAGAGTAGAATTGAGGAAGCAATGTTGAAGTGCAAAAAGGAGAATAATCAAAACGATTTTCGGGATTTTAAGCTACTCGTGGCGCAGATTCGGGTCATTGAAGGAAAACATAGTGAAGCATTGAAGCTTTATCAAGAGCTTGTAAAGGAGGAACCAAGAGATTTTAGGCCGTATCTTTGTCAGGGAATTATATACACATTGCTGAAGAAGAAAGACAAGGCAGAAGAACAGTTTGATAACTTTCGGAAACTTGTTCCAAAGAATCATCCTTATAGAGAGTATTTTATGGATAATATGATAGCAACAAAGCTTTTTTCCGAGAAGGCGCAGCGTGAGATGGCTGAGGAGATGGCTGGATCAACTAGTTGATGAGAATATGTGTAATGAGGTGAAAAATCATGCTTAGAAGACTTGGAAAATGTGGTTTTGAGGATTTTCTGTTGCAGGTTTTTCTTGATCGTCTCAAGATGTATCTTTAGTTGGTTTACATAAAGTTCATAAGTCGAATACTTGGTTTAATTT

SEQ ID NO: 835 - DNA, 1376 bp, Arabidopsis thaliana
  misc_feature (1)..(1376): Ceres cDNA ID no. 12371724
  misc_feature (1)..(1376): Ceres CLONE  ID no. 21406
  misc_feature (1)..(1376): Also known as  Ceres CDNA ID no. 23377330
aatcttttatttttcttttagaaaccaaacttttcagatttctctctctccatttggcgatagaagaagtcatgtaccaatcatcatcctccacgtcatcatcatcgcagagatcatcgcttcccggcggcggaggactgatccgttacggctcagctccgggatcgtttctaaactctgtggttgacgaagtcatcggaggaggctcatcaaacgctcgtgacttcaccggctatcaaccgtcgtcggataacttcatcggtaactttttcaccggagctgctgactcatcctcgctgagatccgattcgacgacttgtggagtcaacaactcatccgacggacagaaacagctaggcaataacaataataataatagtaataaagatatcttcctcgacagatcctacggtggattcaacgagatctcgcaacaacacaagagcaacgacatcggaggaggaaacagctcaggatcttactctctcgctagacaacgtagctctcccgccgatttcttcacctacctcgcctcagataaaaacaatttctcgttgaaccaaccaaccagtgattatagtccgcaaggagggtctaatgggggacgaggacattccagattgaagtctcagctaagcttcacgaatcacgactctctggctcggatcaacgaggtcaatgagaccccagtccacgacggttcaggccattcgttttctgcggctagctttggtgcagccactactgattcttgggatgacggttccggttcgatagggtttaccgtgactaggcccagtaaacgatccaaggacatggactctggtctcttttcgcagtatagtcttccttcagacacttcaatgaactacatggataacttcatgcagcttccagaagattctgtaccctgcaaaatccgggccaaacgcggctgcgccacccatcctagaagcatcgctgagcgggagaggagaacgagaataagtgggaagctaaagaagctacaagatcttgtccccaacatggataagcaaacaagctattcagacatgctggatttagctgtacaacacatcaaaggccttcagcatcaacttcagaatttgaaaaaagatcaagagaattgcacgtgtgggtgcagtgagaaaccaagctagctcaaacccaaaggtagggtcatcctaattttatttgcattgttccgattttatcatatgagagaattagagaagatgtaaataaaatagattatattaaatgtctaatcctcttataattaagctcctcattcgttatcattataagatagaacagtgacaattgtccattatgtttttgtttcaagtttatgttttgagtgtcgcctattttgt

SEQ ID NO: 836 - protein, 1376 aa, Arabidopsis thaliana
  misc_feature: PFam Name: HLH; PFam Description: Helix-loop-helix
  misc_feature: GI Number: 21554238; NR Description: Contains similarity to bHLH transcription factor GBOF-1 from Tulipa gesneriana gb|AF185269
  misc_feature: GI Number: 52421281; NR Description: At2g42280 [Arabidopsis thaliana] >gi|51536448|gb|AAU05462.1| At2g42280 [Arabidopsis thaliana] >gi|42569863|ref|NP_181757.2| basic helix-loop-helix
  misc_feature: GI Number: 34907702; NR Description: P0035F12.11 [Oryza sativa (japonica cultivar-group)] >gi|20161021|dbj|BAB89954.1| P0035F12.11 [Oryza sativa (japonica cultivar-group)] >gi|20161601|dbj|BAB90521.1| B1065G12.3 [Oryza sativa (japonica
  misc_feature: GI Number: 56784863; NR Description: putative helix-loop-helix protein 1A [Oryza sativa (japonica
  misc_feature: GI Number: 20127088; NR Description: putative bHLH transcription factor [Arabidopsis thaliana] >gi|20147401|gb|AAM10410.1| At1g35460/F12A4_2 [Arabidopsis thaliana] >gi|15724178|gb|AAL06481.1| At1g35460/F12A4_2
AATCTTTTATTTTTCTTTTAGAAACCAAACTTTTCAGATTTCTCTCTCTCCATTTGGCGATAGAAGAAGTCATGTACCAATCATCATCCTCCACGTCATCATCATCGCAGAGATCATCGCTTCCCGGCGGCGGAGGACTGATCCGTTACGGCTCAGCTCCGGGATCGTTTCTAAACTCTGTGGTTGACGAAGTCATCGGAGGAGGCTCATCAAACGCTCGTGACTTCACCGGCTATCAACCGTCGTCGGATAACTTCATCGGTAACTTTTTCACCGGAGCTGCTGACTCATCCTCGCTGAGATCCGATTCGACGACTTGTGGAGTCAACAACTCATCCGACGGACAGAAACAGCTAGGCAATAACAATAATAATAATAGTAATAAAGATATCTTCCTCGACAGATCCTACGGTGGATTCAACGAGATCTCGCAACAACACAAGAGCAACGACATCGGAGGAGGAAACAGCTCAGGATCTTACTCTCTCGCTAGACAACGTAGCTCTCCCGCCGATTTCTTCACCTACCTCGCCTCAGATAAAAACAATTTCTCGTTGAACCAACCAACCAGTGATTATAGTCCGCAAGGAGGGTCTAATGGGGGACGAGGACATTCCAGATTGAAGTCTCAGCTAAGCTTCACGAATCACGACTCTCTGGCTCGGATCAACGAGGTCAATGAGACCCCAGTCCACGACGGTTCAGGCCATTCGTTTTCTGCGGCTAGCTTTGGTGCAGCCACTACTGATTCTTGGGATGACGGTTCCGGTTCGATAGGGTTTACCGTGACTAGGCCCAGTAAACGATCCAAGGACATGGACTCTGGTCTCTTTTCGCAGTATAGTCTTCCTTCAGACACTTCAATGAACTACATGGATAACTTCATGCAGCTTCCAGAAGATTCTGTACCCTGCAAAATCCGGGCCAAACGCGGCTGCGCCACCCATCCTAGAAGCATCGCTGAGCGGGAGAGGAGAACGAGAATAAGTGGGAAGCTAAAGAAGCTACAAGATCTTGTCCCCAACATGGATAAGCAAACAAGCTATTCAGACATGCTGGATTTAGCTGTACAACACATCAAAGGCCTTCAGCATCAACTTCAGAATTTGAAAAAAGATCAAGAGAATTGCACGTGTGGGTGCAGTGAGAAACCAAGCTAGCTCAAACCCAAAGGTAGGGTCATCCTAATTTTATTTGCATTGTTCCGATTTTATCATATGAGAGAATTAGAGAAGATGTAAATAAAATAGATTATATTAAATGTCTAATCCTCTTATAATTAAGCTCCTCATTCGTTATCATTATAAGATAGAACAGTGACAATTGTCCATTATGTTTTTGTTTCAAGTTTATGTTTTGAGTGTCGCCTATTTTGT

SEQ ID NO: 837 - DNA, 1510 bp, Arabidopsis thaliana
  misc_feature (1)..(1510): Ceres cDNA ID no. 12371757
  misc_feature (1)..(1510): Ceres CLONE  ID no. 2944
  misc_feature (1)..(1510): Also known as  Ceres CDNA ID no. 23377357
aattatttttcccattctcttcactatctctctccctagaaaattgccagaagaagaaggttctccaattcaaaaaaatagaaactcgctaccattcatttcaaaaaatttcttgttaagttacgtttttttctttttttttgcttctttcgttcttattgtcttagaagacaaaagagactagagaggatagaaaaatggaagcttcaagcacaagaagcgagaagaagaagaagaagaagacgatacagagagaaaacaccgatactcaaaagaaaaaaaagctacccagtgtttggttttcacttaagaaatctctcccctgcaaatctgatgtctccgatgtccacattccgagatccaaaaaagagctagctcccatatccactaagagaacaacaacctcctccggcggcggggtcggcggcaggtccggttgttcaagatccatagccaatcttaaagacgtaatccatggaaaccaacggcatttagagaagccgctttgctctagccctcgttctataggaagcagcgagtttctcaatcccattactcacgatgtaatctttagcaactccacctgcgagctcaagatcaccgccgccggagcaacagaattcgtcgggaatcttagaccagggacgccggtcaattactcttcttcacgccgtagccaaacttcgagaaaggcttcttctttagatagagaaggattagggtttcaccagagcagaagagagaatgatagagaagccgccattaacggagacaattcctctgtttcttgccataaatgcggcgagaaatttagcaaactcgaagctgcagaagctcatcatctaaccaaacacgccgtgactgagctaatggaaggagactcgtcgaggagaatagtggagataatctgcagaacaagctggttaaagacagagaatcaaggagggagaatcgatcggattttgaaagtacacaacatgcaaaaaaccttagcgagattcgaagaatacagagatacagtgaagatcagagcaagcaagttacaaaagaaacatccgagatgtatcgccgacggaaacgagcttctcaggtttcacggcaccactgtggcttgcgctttggggataaacgggtcgacgagtctgtgttcgtcggaaaagtgttgcgtttgtcggattatacgaaatgggttctcggcgaaacgggagatgaataacggaattggggtttttactgcgtcgacgagtgagagggcgtttgagtctattgtgattggagatggtggtggtggtgatcggaaggcgttgattgtgtgtcgagtgattgccgggagggttcatcggccggtggagaatgtagaggagatgggtgggttgttgagtgggtttgattcattggctggtaaagttgggttgtacacaaatgttgaggagctctatttgctcaattctcgagctttgcttcctgttttgtgctaatctgcaaaccttaaatcaaacttttgaggtcg

SEQ ID NO: 838 - protein, 1510 aa, Arabidopsis thaliana
  misc_feature: PFam Name: zf-C2H2; PFam Description: Zinc finger, C2H2 type
  misc_feature: GI Number: 52076893; NR Description: zinc finger (C2H2 type) protein-like [Oryza sativa (japonica cultivar-group)] >gi|52076647|dbj|BAD45547.1| zinc finger (C2H2 type) protein-like
  misc_feature: GI Number: 15222333; NR Description: zinc finger (C2H2 type) family protein [Arabidopsis thaliana] >gi|9369383|gb|AAF87132.1|
  misc_feature: GI Number: 15220394; NR Description: zinc finger (C2H2 type)
  misc_feature: GI Number: 9802582; NR Description: T2E6.3 [Arabidopsis thaliana]
  misc_feature: GI Number: 5777616; NR Description: CAA30374.1 protein [Oryza
AATTATTTTTCCCATTCTCTTCACTATCTCTCTCCCTAGAAAATTGCCAGAAGAAGAAGGTTCTCCAATTCAAAAAAATAGAAACTCGCTACCATTCATTTCAAAAAATTTCTTGTTAAGTTACGTTTTTTTCTTTTTTTTTGCTTCTTTCGTTCTTATTGTCTTAGAAGACAAAAGAGACTAGAGAGGATAGAAAAATGGAAGCTTCAAGCACAAGAAGCGAGAAGAAGAAGAAGAAGAAGACGATACAGAGAGAAAACACCGATACTCAAAAGAAAAAAAAGCTACCCAGTGTTTGGTTTTCACTTAAGAAATCTCTCCCCTGCAAATCTGATGTCTCCGATGTCCACATTCCGAGATCCAAAAAAGAGCTAGCTCCCATATCCACTAAGAGAACAACAACCTCCTCCGGCGGCGGGGTCGGCGGCAGGTCCGGTTGTTCAAGATCCATAGCCAATCTTAAAGACGTAATCCATGGAAACCAACGGCATTTAGAGAAGCCGCTTTGCTCTAGCCCTCGTTCTATAGGAAGCAGCGAGTTTCTCAATCCCATTACTCACGATGTAATCTTTAGCAACTCCACCTGCGAGCTCAAGATCACCGCCGCCGGAGCAACAGAATTCGTCGGGAATCTTAGACCAGGGACGCCGGTCAATTACTCTTCTTCACGCCGTAGCCAAACTTCGAGAAAGGCTTCTTCTTTAGATAGAGAAGGATTAGGGTTTCACCAGAGCAGAAGAGAGAATGATAGAGAAGCCGCCATTAACGGAGACAATTCCTCTGTTTCTTGCCATAAATGCGGCGAGAAATTTAGCAAACTCGAAGCTGCAGAAGCTCATCATCTAACCAAACACGCCGTGACTGAGCTAATGGAAGGAGACTCGTCGAGGAGAATAGTGGAGATAATCTGCAGAACAAGCTGGTTAAAGACAGAGAATCAAGGAGGGAGAATCGATCGGATTTTGAAAGTACACAACATGCAAAAAACCTTAGCGAGATTCGAAGAATACAGAGATACAGTGAAGATCAGAGCAAGCAAGTTACAAAAGAAACATCCGAGATGTATCGCCGACGGAAACGAGCTTCTCAGGTTTCACGGCACCACTGTGGCTTGCGCTTTGGGGATAAACGGGTCGACGAGTCTGTGTTCGTCGGAAAAGTGTTGCGTTTGTCGGATTATACGAAATGGGTTCTCGGCGAAACGGGAGATGAATAACGGAATTGGGGTTTTTACTGCGTCGACGAGTGAGAGGGCGTTTGAGTCTATTGTGATTGGAGATGGTGGTGGTGGTGATCGGAAGGCGTTGATTGTGTGTCGAGTGATTGCCGGGAGGGTTCATCGGCCGGTGGAGAATGTAGAGGAGATGGGTGGGTTGTTGAGTGGGTTTGATTCATTGGCTGGTAAAGTTGGGTTGTACACAAATGTTGAGGAGCTCTATTTGCTCAATTCTCGAGCTTTGCTTCCTGTTTTGTGCTAATCTGCAAACCTTAAATCAAACTTTTGAGGTCG

SEQ ID NO: 839 - DNA, 1254 bp, Arabidopsis thaliana
  misc_feature (1)..(1254): Ceres cDNA ID no. 12371795
  misc_feature (1)..(1254): Ceres CLONE  ID no. 36719
  misc_feature (1)..(1254): Also known as  Ceres CDNA ID no. 23377392
ggatttgcattcttttcccaaactttaacattttatatctaaaaccatttcatcttatgaatatcaacaacaatggcagaacaagaaactacgtcaaacataaacaccattaatgatcaagcagaagaagaaacaagaacaaaatctcagccattgatttcaggtctaccaaatgatatagctgagctttgtcttcttcgtcttccttacccataccatgctctatatcgctctgtttcatcttcatggaacaaaaccatcacaaaccctagattcctcttctccaagcaatctctttctatctcttctccttacctatttgtcttcgctttcaacaaatcaacggctaggattcaatggcaatcccttgaccttgcatctggccgttggtttgttttacctcccatgccaaactctttcaccaaaatctcgtctcctcacgcactctcatgcgcgtcgatgccacgtcaggggaagctttttgtactcggcggcggagatgtaaaccgctccgccgtcgtttacactgctctaacgaatcgttggtcgtgtatatctccgatgatgagcccgagaacgtacttcgtctccgggaatgttaacggtaaaatcatggccgttggtgggagtgtgggcggaaacggagaagcaactacggaagttgaatcgtatgatccagataatgacacgtggacggttgtgaagaagttgccgatggtgttggcgaagtatgactcagccgtgatcgggaaagagatgtgtgtaacagaaggatgggcgtggccgttcatgtttccaccgatgggacaagtgtacgactccgacgaaggcacgtggcgagagatgagcggtgggatgaaagaagggtggacgggtgtgagcgtcgtgatccgcgacaggctgtttgtgatctcggagcacggtgattttccgatgaaggtttattgttcagatgatgacacgtggaggtacgtgagtggtgagaagctacagggggagaagatgcggcgtcctttcgccgtgacgggagctgatgatcgtgtgtttgtggtggccagtgggattaacgtagcggaagggagagtgagtgaagggcaaaatggggattttagtgttgagtggaggatggtttcgtctcctaaaagttctattcagttttcacctgctagttgtcatgtgctatatgtttgatgtgtaattgttgttagttttgaatttgtaaactcttttcactaaaacccttttcactggctg

SEQ ID NO: 840 - protein, 1254 aa, Arabidopsis thaliana
  misc_feature: PFam Name: Kelch_1; PFam Description: Kelch motif
  misc_feature: PFam Name: F-box; PFam Description: F-box domain
  misc_feature: GI Number: 21593163; NR Description: unknown [Arabidopsis thaliana]
  misc_feature: GI Number: 51536380; NR Description: kelch repeat containing F-box protein-like [Oryza sativa (japonica cultivar-group)] >gi|51535613|dbj|BAD37556.1| kelch repeat containing F-box
  misc_feature: GI Number: 50508810; NR Description: kelch repeat containing
  misc_feature: GI Number: 51963796; NR Description: PREDICTED OJ1399_H05.37
  misc_feature: GI Number: 50904747; NR Description: putative SKP1 interacting partner [Oryza sativa (japonica cultivar-group)] >gi|41052587|dbj|BAD07929.1| putative SKP1 interacting partner [Oryza sativa (japonica cultivar-group)]
GGATTTGCATTCTTTTCCCAAACTTTAACATTTTATATCTAAAACCATTTCATCTTATGAATATCAACAACAATGGCAGAACAAGAAACTACGTCAAACATAAACACCATTAATGATCAAGCAGAAGAAGAAACAAGAACAAAATCTCAGCCATTGATTTCAGGTCTACCAAATGATATAGCTGAGCTTTGTCTTCTTCGTCTTCCTTACCCATACCATGCTCTATATCGCTCTGTTTCATCTTCATGGAACAAAACCATCACAAACCCTAGATTCCTCTTCTCCAAGCAATCTCTTTCTATCTCTTCTCCTTACCTATTTGTCTTCGCTTTCAACAAATCAACGGCTAGGATTCAATGGCAATCCCTTGACCTTGCATCTGGCCGTTGGTTTGTTTTACCTCCCATGCCAAACTCTTTCACCAAAATCTCGTCTCCTCACGCACTCTCATGCGCGTCGATGCCACGTCAGGGGAAGCTTTTTGTACTCGGCGGCGGAGATGTAAACCGCTCCGCCGTCGTTTACACTGCTCTAACGAATCGTTGGTCGTGTATATCTCCGATGATGAGCCCGAGAACGTACTTCGTCTCCGGGAATGTTAACGGTAAAATCATGGCCGTTGGTGGGAGTGTGGGCGGAAACGGAGAAGCAACTACGGAAGTTGAATCGTATGATCCAGATAATGACACGTGGACGGTTGTGAAGAAGTTGCCGATGGTGTTGGCGAAGTATGACTCAGCCGTGATCGGGAAAGAGATGTGTGTAACAGAAGGATGGGCGTGGCCGTTCATGTTTCCACCGATGGGACAAGTGTACGACTCCGACGAAGGCACGTGGCGAGAGATGAGCGGTGGGATGAAAGAAGGGTGGACGGGTGTGAGCGTCGTGATCCGCGACAGGCTGTTTGTGATCTCGGAGCACGGTGATTTTCCGATGAAGGTTTATTGTTCAGATGATGACACGTGGAGGTACGTGAGTGGTGAGAAGCTACAGGGGGAGAAGATGCGGCGTCCTTTCGCCGTGACGGGAGCTGATGATCGTGTGTTTGTGGTGGCCAGTGGGATTAACGTAGCGGAAGGGAGAGTGAGTGAAGGGCAAAATGGGGATTTTAGTGTTGAGTGGAGGATGGTTTCGTCTCCTAAAAGTTCTATTCAGTTTTCACCTGCTAGTTGTCATGTGCTATATGTTTGATGTGTAATTGTTGTTAGTTTTGAATTTGTAAACTCTTTTCACTAAAACCCTTTTCACTGGCTG

SEQ ID NO: 841 - DNA, 1437 bp, Arabidopsis thaliana
  misc_feature (1)..(1437): Ceres cDNA ID no. 12371961
  misc_feature (1)..(1437): Ceres CLONE  ID no. 111694
  misc_feature (1)..(1437): Also known as  Ceres CDNA ID no. 23377549
atcaaattaaaaccctccagcctccaacaacaaaatttaccaacactctctctttctctttctctctgaaaacttaaaacgatggctataaccgccactcaaaacgacggcgtttcactaaacgccaataagatttcgtatgatcttgtggaaactgatgttgagatcatcacctccggtcgtcgtagtattccggcacactccggcatcctcgcttcggtctcaccggtactgacgaacatcatcgagaagccgaggaagattcacggcggatcatcgaagaaagttattaagattctcggtgttccatgcgacgccgtttcagtcttcgtcagattcctctattctccgagtgtcacggagaatgagatggaaaaatacggaatccatctactggctttatcacacgtgtatatggtgactcagttaaagcaacggtgcactaaaggcgtcggtgagagagtaaccgccgaaaacgttgtcgatattctccagctggctcgtctctgcgacgcacctgacctctgtctcaagtgtatgcgattcattcactacaagttcaagaccgttgaacagacagaaggatggaagtttcttcaagaacacgatccttttcttgaacttgacattctccaattcatcgacgatgcagaatcgaggaagaaaagaagaaggagacacagacgagaacagaatctgtatttgcagctgagtgaagccatggaatgtatagaacacatatgcaccgaaggttgcacactggtcggaccatcgtctaacttagacaacaagtcaacatgtcaagcaaaacccggtccatgcagtgcgttttcgacttgttaaggacttcaacttcttatacgtcactttgcagtatgcaagaaaagagtcgatggcaaaggttgtgtccgatgcaagagaatgattcaactccttagactccattcttcgatttgtgaccaatctgaatcttgccgtgtccctctttgcaggcaatataagaatagaggtgaaaaggacaagaaaatggttgaggacacgaagtggaaggttctggtgagaagagtagcgtctgctaaagccatgtcttcgttgtctcaatcaaagaagaaaaaaagtgaagtgttatttaaagaagaagcagaagatttgatcagaatccggaacaagttaatgtgaatatacaatatatgtgtttttattagattatatagtgagcgattgttagaagccattaattacttgagtcggaaggtttatttgtttgttatttgtctctcggactggttgattgggttaaacttgtcaatgagtaaccctttgaatctgtcgttttgtttggtcggtcgaattatatagaaatgtattattggttataaaatggtattagggtttttggagactttgtggcaaaaagtatacagattgatccggttt

SEQ ID NO: 842 - protein, 1437 aa, Arabidopsis thaliana
  misc_feature: PFam Name: BTB; PFam Description: BTB/POZ domain
  misc_feature: PFam Name: zf-TAZ; PFam Description: TAZ zinc finger
  misc_feature: GI Number: 50902306; NR Description: P0497A05.15 [Oryza sativa (japonica cultivar-group)] >gi|20804890|dbj|BAB92571.1| P0497A05.15 [Oryza sativa (japonica cultivar-group)] >gi|20804925|dbj|BAB92604.1| P0456E05.3 [Oryza sativa (japonica
  misc_feature: GI Number: 57899800; NR Description: putative BTB and TAZ
  misc_feature: GI Number: 42561724; NR Description: TAZ zinc finger family
  misc_feature: GI Number: 42573822; NR Description: TAZ zinc finger family
  misc_feature: GI Number: 34907566; NR Description: B1078G07.24 [Oryza sativa (japonica cultivar-group)] >gi|20161276|dbj|BAB90202.1| B1078G07.24 [Oryza sativa (japonica cultivar-group)] >gi|21952829|dbj|BAC06244.1| P0696G06.1 [Oryza sativa (japonica
ATCAAATTAAAACCCTCCAGCCTCCAACAACAAAATTTACCAACACTCTCTCTTTCTCTTTCTCTCTGAAAACTTAAAACGATGGCTATAACCGCCACTCAAAACGACGGCGTTTCACTAAACGCCAATAAGATTTCGTATGATCTTGTGGAAACTGATGTTGAGATCATCACCTCCGGTCGTCGTAGTATTCCGGCACACTCCGGCATCCTCGCTTCGGTCTCACCGGTACTGACGAACATCATCGAGAAGCCGAGGAAGATTCACGGCGGATCATCGAAGAAAGTTATTAAGATTCTCGGTGTTCCATGCGACGCCGTTTCAGTCTTCGTCAGATTCCTCTATTCTCCGAGTGTCACGGAGAATGAGATGGAAAAATACGGAATCCATCTACTGGCTTTATCACACGTGTATATGGTGACTCAGTTAAAGCAACGGTGCACTAAAGGCGTCGGTGAGAGAGTAACCGCCGAAAACGTTGTCGATATTCTCCAGCTGGCTCGTCTCTGCGACGCACCTGACCTCTGTCTCAAGTGTATGCGATTCATTCACTACAAGTTCAAGACCGTTGAACAGACAGAAGGATGGAAGTTTCTTCAAGAACACGATCCTTTTCTTGAACTTGACATTCTCCAATTCATCGACGATGCAGAATCGAGGAAGAAAAGAAGAAGGAGACACAGACGAGAACAGAATCTGTATTTGCAGCTGAGTGAAGCCATGGAATGTATAGAACACATATGCACCGAAGGTTGCACACTGGTCGGACCATCGTCTAACTTAGACAACAAGTCAACATGTCAAGCAAAACCCGGTCCATGCAGTGCGTTTTCGACTTGTTAAGGACTTCAACTTCTTATACGTCACTTTGCAGTATGCAAGAAAAGAGTCGATGGCAAAGGTTGTGTCCGATGCAAGAGAATGATTCAACTCCTTAGACTCCATTCTTCGATTTGTGACCAATCTGAATCTTGCCGTGTCCCTCTTTGCAGGCAATATAAGAATAGAGGTGAAAAGGACAAGAAAATGGTTGAGGACACGAAGTGGAAGGTTCTGGTGAGAAGAGTAGCGTCTGCTAAAGCCATGTCTTCGTTGTCTCAATCAAAGAAGAAAAAAAGTGAAGTGTTATTTAAAGAAGAAGCAGAAGATTTGATCAGAATCCGGAACAAGTTAATGTGAATATACAATATATGTGTTTTTATTAGATTATATAGTGAGCGATTGTTAGAAGCCATTAATTACTTGAGTCGGAAGGTTTATTTGTTTGTTATTTGTCTCTCGGACTGGTTGATTGGGTTAAACTTGTCAATGAGTAACCCTTTGAATCTGTCGTTTTGTTTGGTCGGTCGAATTATATAGAAATGTATTATTGGTTATAAAATGGTATTAGGGTTTTTGGAGACTTTGTGGCAAAAAGTATACAGATTGATCCGGTTT

SEQ ID NO: 843 - DNA, 1347 bp, Arabidopsis thaliana
  misc_feature (1)..(1347): Ceres cDNA ID no. 12371997
  misc_feature (1)..(1347): Ceres CLONE  ID no. 15213
  misc_feature (1)..(1347): Also known as  Ceres CDNA ID no. 23377585
accatgtcttcagatcaactaagcaaattccttgatagaaacaaaatggaagacaataaaagaaaagtattagatgaagaagcgaaagcttctctagacatatggaagtatgtctttgggtttgcagatatagcagctgcaaagtgtgccattgatcttaaaataccagaagccattgaaaaccatccttcttcacagcccgtaacactagccgaactctcctccgccgtctccgcctctccctcgcatctccgccgtataatgaggtttcttgtacaccaaggaatctttaaagaaatccccacaaaagatggtttagctacaggctacgttaatacgccactctctcgccgtttgatgatcacaagacgtgatggaaaatcgctggctccttttgttctcttcgaaacaactcccgagatgctcgctccatggttgagacttagctcagtcgtttcttcgccggtcaacggttcaactccaccaccgtttgatgcagtgcacggtaaggacgtgtggtcgttcgcgcaggataatcccttcctcagcgatatgatcaatgaggccatggcttgtgatgcaaggcgcgtggtgccacgtgtagccggagcttgtcacggcttgtttgatggcgtgactacgatggttgacgtaggaggtggtacgggagagacgatggggatgcttgtgaaggagtttccttggatcaaaggatttaactttgatcttcctcatgtcattgaagttgctgaagtcttggacggtgttgagaatgttgagggcgatatgtttgattctattccggcttgcgacgccattttcatcaagtgggtgttacacgattggggagacaaagattgcataaagatattgaagaattgcaaagaagcggtccctccaaatatcggaaaagtgttgatagtggaatcggtgatcggagagaataaaaagacgatgatagtggacgaacgagatgaaaagttagagcacgtgagattgatgcttgatatggtgatgatggctcacacaagcacaggcaaagaacggactttgaaagaatgggactttgttcttaaagaagctggctttgctcgatatgaggttagggacattgatgatgttcagagtcttataatcgcgtatcggtcttaagaggaggacatgaaagatatatctttcctttgaggaaaactcaataaattagtgattgttgatttggtgtttttatacagaacgacgtgtgggtgaataattgtgttgtgtgataataagtaaggcttgtttcagtatcagcagagttgttttttatttgtatttttcacatttttttatcattaatttccttgt

SEQ ID NO: 844 - protein, 1347 aa, Arabidopsis thaliana
  misc_feature: PFam Name: Methyltransf_2; PFam Description: O-methyltransferase
  misc_feature: PFam Name: Dimerisation; PFam Description: Dimerisation domain
  misc_feature: GI Number: 7270466; NR Description: O-methyltransferase-like protein [Arabidopsis thaliana] >gi|4455341|emb|CAB36722.1| O-methyltransferase-like protein [Arabidopsis thaliana] >gi|15236280|ref|NP_195241.1| O-methyltransferase family 2
  misc_feature: GI Number: 23198188; NR Description: O-methyltransferase-like protein [Arabidopsis thaliana] >gi|7270467|emb|CAB80233.1| O-methyltransferase-like protein [Arabidopsis thaliana] >gi|4455342|emb|CAB36723.1| O-methyltransferase-like protein
  misc_feature: GI Number: 33285922; NR Description: O-methyltransferase-like
  misc_feature: GI Number: 32440935; NR Description: caffeic acid
  misc_feature: GI Number: 1777386; NR Description: caffeic acid
ACCATGTCTTCAGATCAACTAAGCAAATTCCTTGATAGAAACAAAATGGAAGACAATAAAAGAAAAGTATTAGATGAAGAAGCGAAAGCTTCTCTAGACATATGGAAGTATGTCTTTGGGTTTGCAGATATAGCAGCTGCAAAGTGTGCCATTGATCTTAAAATACCAGAAGCCATTGAAAACCATCCTTCTTCACAGCCCGTAACACTAGCCGAACTCTCCTCCGCCGTCTCCGCCTCTCCCTCGCATCTCCGCCGTATAATGAGGTTTCTTGTACACCAAGGAATCTTTAAAGAAATCCCCACAAAAGATGGTTTAGCTACAGGCTACGTTAATACGCCACTCTCTCGCCGTTTGATGATCACAAGACGTGATGGAAAATCGCTGGCTCCTTTTGTTCTCTTCGAAACAACTCCCGAGATGCTCGCTCCATGGTTGAGACTTAGCTCAGTCGTTTCTTCGCCGGTCAACGGTTCAACTCCACCACCGTTTGATGCAGTGCACGGTAAGGACGTGTGGTCGTTCGCGCAGGATAATCCCTTCCTCAGCGATATGATCAATGAGGCCATGGCTTGTGATGCAAGGCGCGTGGTGCCACGTGTAGCCGGAGCTTGTCACGGCTTGTTTGATGGCGTGACTACGATGGTTGACGTAGGAGGTGGTACGGGAGAGACGATGGGGATGCTTGTGAAGGAGTTTCCTTGGATCAAAGGATTTAACTTTGATCTTCCTCATGTCATTGAAGTTGCTGAAGTCTTGGACGGTGTTGAGAATGTTGAGGGCGATATGTTTGATTCTATTCCGGCTTGCGACGCCATTTTCATCAAGTGGGTGTTACACGATTGGGGAGACAAAGATTGCATAAAGATATTGAAGAATTGCAAAGAAGCGGTCCCTCCAAATATCGGAAAAGTGTTGATAGTGGAATCGGTGATCGGAGAGAATAAAAAGACGATGATAGTGGACGAACGAGATGAAAAGTTAGAGCACGTGAGATTGATGCTTGATATGGTGATGATGGCTCACACAAGCACAGGCAAAGAACGGACTTTGAAAGAATGGGACTTTGTTCTTAAAGAAGCTGGCTTTGCTCGATATGAGGTTAGGGACATTGATGATGTTCAGAGTCTTATAATCGCGTATCGGTCTTAAGAGGAGGACATGAAAGATATATCTTTCCTTTGAGGAAAACTCAATAAATTAGTGATTGTTGATTTGGTGTTTTTATACAGAACGACGTGTGGGTGAATAATTGTGTTGTGTGATAATAAGTAAGGCTTGTTTCAGTATCAGCAGAGTTGTTTTTTATTTGTATTTTTCACATTTTTTTATCATTAATTTCCTTGT

SEQ ID NO: 845 - DNA, 1873 bp, Arabidopsis thaliana
  misc_feature (1)..(1873): Ceres cDNA ID no. 12372096
  misc_feature (1)..(1873): Ceres CLONE  ID no. 40049
  misc_feature (1)..(1873): Also known as  Ceres CDNA ID no. 23377680
ttcaatctcattaaagagaaaagaaacgattagagaaagagaagagggtagagacttcttttctttgtttctgtggaggctcttcttcttcttcttctctgtctctgtctctgtctctctgtaatcttctgtgctctccacaaatttgtctctcctctctctcgccgactccacaaattttgagcttctttttttgaagttcttgagaacaagtgaaagagcttaatatccacaagactcttgtttctttcttaaatggctaaagtttattggccttatttcgatcctgaatatgagaacttgagctccagaatcaatcctccaagtgtttctatagataacactagctgcaaagaatgcactcttgtcaaggtggacagtatgaacaaacctggaatactacttgaagttgtgcaagtcctaaccgatctcgatctcactatcactaaagcttatatctcttctgatggtggatggttcatggacgtattccatgtcaccgatcaacaaggaaacaaggttactgatagcaaaaccatcgattacatcgagaaggtgttaggaccaaagggtcatgcttcggcttcacaaaacacttggcctggtaaaagagtcggtgtccattcattaggcgaccacacatcgatagagattattgctcgtgatcgtcctggtctcttgtcggaggtttcagccgtactagcagacctcaacattaatgtggtggcagctgaagcatggactcacaaccgtaggattgcgtgtgtcctctatgtgaatgacaatgcaacttctagagccgttgatgatccagaaagattgtcttccatggaagaacagcttaacaatgtgctgcgtgggtgcgaagaacaagatgagaaatttgctcggacgagtctctccattgggtcgactcacgttgatcgaaggcttcatcagatgtttttcgctgatagagactacgaagcagtgactaagcttgatgattctgcttcttgcggattcgagcccaaaatcacggttgagcattgtgaagagaaaggttactccgtgataaacgtgagctgcgaggatcgaccaaagctcatgtttgacattgtatgcacgcttacggatatgcaatacattgtgtttcacgccacgatttcatcaagcggctctcatgcttctcaggagtatttcatcagacacaaagacggttgcactcttgacacagaaggagagaaagagagagttgtcaaatgtctggaagctgcaatccatagacgagtcagcgagggttggagtttggagctctgcgcaaaggacagagttggattactgtcggaagtgacaaggattctgagagagcacgggctatcagtgtcgagagctggtgtgacaacagtaggagaacaagccgtcaacgttttctatgtgaaagatgcttcagggaatccagtggatgtgaagacgattgaggcgttacgcggagagattggacacagtatgatgattgacttcaagaataaagttccgagcagaaaatggaaagaagaaggtcaagccggaacaggaggaggatgggccaaaaccagtttcttctttgggaatttgctggagaagttactgccttgagagaaaaggtaactatgtgtggataaaacgtactgtaaaatgtgtattatgtatgatctagagggccttagtgtgatgtatgacttggtcagggattttggtggtttgcccgaagtcaaaccgaaccaaaactggttttcggttactttagactttagtcatagtaaaatgaacatgtctataaatgaataatatgcaactcttccaattggtaggcttgcttttgtctatgtaatatcaatccttcttgttatgt

SEQ ID NO: 846 - protein, 1873 aa, Arabidopsis thaliana
  misc_feature: PFam Name: ACT; PFam Description: ACT domain
  misc_feature: GI Number: 21593552; NR Description: unknown [Arabidopsis thaliana]
  misc_feature: GI Number: 22138098; NR Description: ACR4 [Arabidopsis thaliana] >gi|15221589|ref|NP_177067.1| ACT domain containing
  misc_feature: GI Number: 42572033; NR Description: ACT domain containing
  misc_feature: GI Number: 25370627; NR Description: protein F4N2.2 [imported] - Arabidopsis thaliana >gi|6730631|gb|AAF27052.1| F4N2.2
  misc_feature: GI Number: 50916533; NR Description: putative ACT domain containing protein, ACR4, with alternative splicing forms [Oryza sativa (japonica cultivar-group)] >gi|41469089|gb|AAS07063.1|
TTCAATCTCATTAAAGAGAAAAGAAACGATTAGAGAAAGAGAAGAGGGTAGAGACTTCTTTTCTTTGTTTCTGTGGAGGCTCTTCTTCTTCTTCTTCTCTGTCTCTGTCTCTGTCTCTCTGTAATCTTCTGTGCTCTCCACAAATTTGTCTCTCCTCTCTCTCGCCGACTCCACAAATTTTGAGCTTCTTTTTTTGAAGTTCTTGAGAACAAGTGAAAGAGCTTAATATCCACAAGACTCTTGTTTCTTTCTTAAATGGCTAAAGTTTATTGGCCTTATTTCGATCCTGAATATGAGAACTTGAGCTCCAGAATCAATCCTCCAAGTGTTTCTATAGATAACACTAGCTGCAAAGAATGCACTCTTGTCAAGGTGGACAGTATGAACAAACCTGGAATACTACTTGAAGTTGTGCAAGTCCTAACCGATCTCGATCTCACTATCACTAAAGCTTATATCTCTTCTGATGGTGGATGGTTCATGGACGTATTCCATGTCACCGATCAACAAGGAAACAAGGTTACTGATAGCAAAACCATCGATTACATCGAGAAGGTGTTAGGACCAAAGGGTCATGCTTCGGCTTCACAAAACACTTGGCCTGGTAAAAGAGTCGGTGTCCATTCATTAGGCGACCACACATCGATAGAGATTATTGCTCGTGATCGTCCTGGTCTCTTGTCGGAGGTTTCAGCCGTACTAGCAGACCTCAACATTAATGTGGTGGCAGCTGAAGCATGGACTCACAACCGTAGGATTGCGTGTGTCCTCTATGTGAATGACAATGCAACTTCTAGAGCCGTTGATGATCCAGAAAGATTGTCTTCCATGGAAGAACAGCTTAACAATGTGCTGCGTGGGTGCGAAGAACAAGATGAGAAATTTGCTCGGACGAGTCTCTCCATTGGGTCGACTCACGTTGATCGAAGGCTTCATCAGATGTTTTTCGCTGATAGAGACTACGAAGCAGTGACTAAGCTTGATGATTCTGCTTCTTGCGGATTCGAGCCCAAAATCACGGTTGAGCATTGTGAAGAGAAAGGTTACTCCGTGATAAACGTGAGCTGCGAGGATCGACCAAAGCTCATGTTTGACATTGTATGCACGCTTACGGATATGCAATACATTGTGTTTCACGCCACGATTTCATCAAGCGGCTCTCATGCTTCTCAGGAGTATTTCATCAGACACAAAGACGGTTGCACTCTTGACACAGAAGGAGAGAAAGAGAGAGTTGTCAAATGTCTGGAAGCTGCAATCCATAGACGAGTCAGCGAGGGTTGGAGTTTGGAGCTCTGCGCAAAGGACAGAGTTGGATTACTGTCGGAAGTGACAAGGATTCTGAGAGAGCACGGGCTATCAGTGTCGAGAGCTGGTGTGACAACAGTAGGAGAACAAGCCGTCAACGTTTTCTATGTGAAAGATGCTTCAGGGAATCCAGTGGATGTGAAGACGATTGAGGCGTTACGCGGAGAGATTGGACACAGTATGATGATTGACTTCAAGAATAAAGTTCCGAGCAGAAAATGGAAAGAAGAAGGTCAAGCCGGAACAGGAGGAGGATGGGCCAAAACCAGTTTCTTCTTTGGGAATTTGCTGGAGAAGTTACTGCCTTGAGAGAAAAGGTAACTATGTGTGGATAAAACGTACTGTAAAATGTGTATTATGTATGATCTAGAGGGCCTTAGTGTGATGTATGACTTGGTCAGGGATTTTGGTGGTTTGCCCGAAGTCAAACCGAACCAAAACTGGTTTTCGGTTACTTTAGACTTTAGTCATAGTAAAATGAACATGTCTATAAATGAATAATATGCAACTCTTCCAATTGGTAGGCTTGCTTTTGTCTATGTAATATCAATCCTTCTTGTTATGT

SEQ ID NO: 847 - DNA, 1078 bp, Arabidopsis thaliana
  misc_feature (1)..(1078): Ceres cDNA ID no. 12372181
  misc_feature (1)..(1078): Ceres CLONE  ID no. 33335
  misc_feature (1)..(1078): Also known as  Ceres CDNA ID no. 23377753
tcaaaaaatatctctcccccttcttctctcttcctcacattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttctagcttgtctattatgtccgagaatttctttttctgtttttgattcttttcgttgtatatctttgtccaataaaggaaatgatgtgtctttactcc

SEQ ID NO: 848 - protein, 1078 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 17104625; NR Description: putative xyloglucan endo-1,4-beta-D-glucanase precursor [Arabidopsis thaliana] >gi|14334966|gb|AAK59660.1| putative xyloglucan endo-1,4-beta-D-glucanase precursor [Arabidopsis thaliana]
  misc_feature: GI Number: 21553999; NR Description: xyloglucan
  misc_feature: GI Number: 9758317; NR Description: TCH4 protein [Arabidopsis thaliana] >gi|17386136|gb|AAL38614.1| AT5g57560/MUA2_13 [Arabidopsis thaliana] >gi|15777883|gb|AAL05902.1| AT5g57560/MUA2_13 [Arabidopsis thaliana]
  misc_feature: GI Number: 29500899; NR Description: putative xyloglucan endotransglycosylase [Cucumis sativus] >gi|29500891|emb|CAD87535.1|
  misc_feature: GI Number: 29500901; NR Description: putative xyloglucan endotransglycosylase [Cucumis sativus] >gi|29500893|emb|CAD87536.1|
TCAAAAAATATCTCTCCCCCTTCTTCTCTCTTCCTCACATTCCTCACCAAACCCTCTCCAAAACACACCCACACGTACGCACACACACAAAGACAATGTCTCCTTTCAAAATATTCTTCTTCACGACTCTTCTCGTGGCGGCGTTTTCAGTGTCGGCTGCTGATTTCAACACTGACGTCAACGTAGCTTGGGGAAATGGCCGTGGGAAGATACTCAACAACGGCCAGCTTCTTACTCTCTCCTTAGACAAATCCTCTGGTTCCGGTTTTCAATCCAAAACAGAGTATTTGTTTGGAAAGATTGATATGCAGATTAAGCTTGTTCCTGGTAACTCTGCAGGAACAGTCACAACTTTTTACCTAAAATCCGAAGGATCCACTTGGGATGAGATTGATTTTGAGTTCTTGGGTAATATGAGTGGAGATCCTTATACTTTACACACTAATGTTTACACTCAAGGTAAAGGTGACAAAGAGCAACAATTCCATCTCTGGTTCGACCCAACCGCCAATTTCCACACTTACTCAATCCTCTGGAACCCTCAAAGAATCATATTGACCGTCGATGACACACCCATTAGAGAGTTTAAAAACTATGAGTCTCTCGGTGTCTTGTTTCCAAAGAACAAGCCGATGAGGATGTACGCGAGTTTATGGAACGCAGACGATTGGGCAACAAGAGGCGGTCTTGTTAAAACTGATTGGTCTAAAGCTCCATTCATGGCTTCTTACAGAAACATTAAGATTGACTCGAAACCAAACTCCAATTGGTACACTCAAGAAATGGATTCAACAAGCCAAGCTAGACTCAAATGGGTTCAGAAGAATTACATGATCTACAATTATTGTACTGACCATAGGAGGTTTCCACAGGGAGCTCCTAAGGAATGCACAACAAGCTCATAGAATCTCAAATTATATTCTATTTATTTATCTACACTTCCTCTCTTTCTTTTATGTGAAAATTGTGAATGCTCTGTTTCTAGCTTGTCTATTATGTCCGAGAATTTCTTTTTCTGTTTTTGATTCTTTTCGTTGTATATCTTTGTCCAATAAAGGAAATGATGTGTCTTTACTCC

SEQ ID NO: 849 - DNA, 1245 bp, Zea mays
  misc_feature (1)..(1245): Ceres cDNA ID no. 12372214
  misc_feature (1)..(1245): Ceres CLONE  ID no. 217231
  misc_feature (1)..(1245): Also known as  Ceres CDNA ID no. 23741454
attgattccagcgatttggccggggtcagtagctaacgttccatcccagaaaaccccatcttatcataggaagtctaccagttttgccaccaaggtcacaccatccaccacggccatggagtccggcgcagacgaggtggcgttcgagtccccggcacatttccgcatctacaagagcgggaggatcgagcgcctgaaccggcccccggtccttcccgccggcctcgacgaggccaccggtgtcacctcaaaggacgtcgtcctggacgccggcaccggcctttccgtacgcatctacctccccaagctccaggaaccatccaagaagctcccggtcctcgtctacttccacggcggcgcgttcctcctcgagtcggccggctctgccacgtaccacacctacgtcaacccactcgcagccgccgcgggcgtcctggtggtgtccgtggactaccgcctggcaccggagcacccggtcccggcggcctacgaggactcgtgggccgcgctccagtgggtgacgtcggcgcaggacgagtggatcgtcgagcacggcgacacggcgcggctcttcctcgccggcgacagcgccggcgcaaacatcgtgcacgacatgctgatgcgggcgtccggcgccggcgggccgcgcgtcgagggcgccatcctgctccacccgtggttcggcgggaacgcgcccatcgagggcgagccggagggtgccgcagcggccaccgctgggctctggacctacgcgtgcccgggcgcggtcggcggcgccgacgacccgaggatgaaccctctcgcgccgggcgcgccgccgctggagaggctcgggtgcgcgaggatgctggtgtgcgccgggaagaaggacgcgctctacgtgagggaccgcgcgtactatgaagccgtggcggccagcgcgtggcccggggacgtggcgtggctcgagtccgaaggagaggagcacgtcttcttcctcccgaagcccgagtgcgagaacgccaagctgctcatggaccgcgtcgtggccttcattgccggggcctgacttgctctcttgtggccttgttggcgcggcaccgcgcgacgcagcatcaggtcgccattgaagatttaagttgtggacttgtgggcaagtttctctcgctgaatattggtcttgtctaaatttttttctggtacaagtgtggtactgaagtcttgaaactgattttttaataagcaaactataagtccacattattc

SEQ ID NO: 850 - protein, 1245 aa, Zea mays
  misc_feature: PFam Name: Abhydrolase_3; PFam Description: alpha/beta
  misc_feature: PFam Name: COesterase; PFam Description: Carboxylesterase
  misc_feature: PFam Name: AF-4; PFam Description: AF-4 proto-oncoprotein
  misc_feature: PFam Name: Peptidase_S8; PFam Description: Subtilase family
  misc_feature: PFam Name: HlyD; PFam Description: HlyD family secretion protein
  misc_feature: GI Number: 51535268; NR Description: putative PrMC3 [Oryza
  misc_feature: GI Number: 51535269; NR Description: putative PrMC3 [Oryza
  misc_feature: GI Number: 51535273; NR Description: putative PrMC3 [Oryza
  misc_feature: GI Number: 51535271; NR Description: putative PrMC3 [Oryza
  misc_feature: GI Number: 51535274; NR Description: putative PrMC3 [Oryza
ATTGATTCCAGCGATTTGGCCGGGGTCAGTAGCTAACGTTCCATCCCAGAAAACCCCATCTTATCATAGGAAGTCTACCAGTTTTGCCACCAAGGTCACACCATCCACCACGGCCATGGAGTCCGGCGCAGACGAGGTGGCGTTCGAGTCCCCGGCACATTTCCGCATCTACAAGAGCGGGAGGATCGAGCGCCTGAACCGGCCCCCGGTCCTTCCCGCCGGCCTCGACGAGGCCACCGGTGTCACCTCAAAGGACGTCGTCCTGGACGCCGGCACCGGCCTTTCCGTACGCATCTACCTCCCCAAGCTCCAGGAACCATCCAAGAAGCTCCCGGTCCTCGTCTACTTCCACGGCGGCGCGTTCCTCCTCGAGTCGGCCGGCTCTGCCACGTACCACACCTACGTCAACCCACTCGCAGCCGCCGCGGGCGTCCTGGTGGTGTCCGTGGACTACCGCCTGGCACCGGAGCACCCGGTCCCGGCGGCCTACGAGGACTCGTGGGCCGCGCTCCAGTGGGTGACGTCGGCGCAGGACGAGTGGATCGTCGAGCACGGCGACACGGCGCGGCTCTTCCTCGCCGGCGACAGCGCCGGCGCAAACATCGTGCACGACATGCTGATGCGGGCGTCCGGCGCCGGCGGGCCGCGCGTCGAGGGCGCCATCCTGCTCCACCCGTGGTTCGGCGGGAACGCGCCCATCGAGGGCGAGCCGGAGGGTGCCGCAGCGGCCACCGCTGGGCTCTGGACCTACGCGTGCCCGGGCGCGGTCGGCGGCGCCGACGACCCGAGGATGAACCCTCTCGCGCCGGGCGCGCCGCCGCTGGAGAGGCTCGGGTGCGCGAGGATGCTGGTGTGCGCCGGGAAGAAGGACGCGCTCTACGTGAGGGACCGCGCGTACTATGAAGCCGTGGCGGCCAGCGCGTGGCCCGGGGACGTGGCGTGGCTCGAGTCCGAAGGAGAGGAGCACGTCTTCTTCCTCCCGAAGCCCGAGTGCGAGAACGCCAAGCTGCTCATGGACCGCGTCGTGGCCTTCATTGCCGGGGCCTGACTTGCTCTCTTGTGGCCTTGTTGGCGCGGCACCGCGCGACGCAGCATCAGGTCGCCATTGAAGATTTAAGTTGTGGACTTGTGGGCAAGTTTCTCTCGCTGAATATTGGTCTTGTCTAAATTTTTTTCTGGTACAAGTGTGGTACTGAAGTCTTGAAACTGATTTTTTAATAAGCAAACTATAAGTCCACATTATTC

SEQ ID NO: 851 - DNA, 888 bp, Zea mays
  misc_feature (1)..(888): Ceres cDNA ID no. 12372263
  misc_feature (1)..(888): Ceres CLONE  ID no. 340296
  misc_feature (1)..(888): Also known as  Ceres CDNA ID no. 24192972
ctcattcgcgcgaccatggacacggacacggacacgacgacgtccaccggctcccgcctccatcccgcggccggacatgtacgctcattggccgcccggggcgccgagagcctcgtcacctgcgtcttcgcgacggtgggcacggtcctcggcgcgatcaccggtggcctcatcggcctggccacggagacgggcgtgctgcgcggcacgggcgtcggcggcatcacgggcgcgctggtgtccatggaggtcgtcgagtcgctgtggcgctccgacgagccggcaatctggagcgtcgtctacgtgctcgatgtcatctggagcttgctcaccggccgccttgtgcgcgagaaggtggaccccgccgtgctcagcgccgtcgagagccagatgagcgcagcggacacaccggccttgcatgcagaccacgccgacatcttcgacacgggcggcaccaacggcatggcgagggtcgccatggacgcgctccccgtcgttaggttcaccgagcgcagcaacgtcgacgccagcggcgagctcatcgcctgttcggtttgcctccaggaattccaagccggcgacagcgcgaggagcctgccggtgtgccgccacacgttccacctgccgtgcatcgacggctggctgctccggcacgcctcctgccccttgtgccgccgcgctgtctaggccgcgcccgttcctctaccctcaaggatagccgccaccagagcttctctgacaagcgacacccgttccttcaggctgtagccgtacgcacactggcagcgtgatttttctgtagctcatcagatgattcagatgggcgttatgtaaacattggttaatttttaacaaatgcaagtggtgcacatggcgatggccccatcc

SEQ ID NO: 852 - protein, 888 aa, Zea mays
  misc_feature: PFam Name: zf-C3HC4; PFam Description: Zinc finger, C3HC4
  misc_feature: GI Number: 50948297; NR Description: putative NEP1-interacting protein [Oryza sativa (japonica cultivar-group)] >gi|42407817|dbj|BAD08961.1| putative NEP1-interacting protein
  misc_feature: GI Number: 18855037; NR Description: putative zinc finger
  misc_feature: GI Number: 27524904; NR Description: NEP1-interacting protein 2 [Arabidopsis thaliana] >gi|30680091|ref|NP_179364.2| zinc finger
  misc_feature: GI Number: 27524902; NR Description: NEP1-interacting protein
  misc_feature: GI Number: 50912679; NR Description: putative NEP1-interacting protein [Oryza sativa (japonica cultivar-group)] >gi|46390630|dbj|BAD16113.1| putative NEP1-interacting protein
CTCATTCGCGCGACCATGGACACGGACACGGACACGACGACGTCCACCGGCTCCCGCCTCCATCCCGCGGCCGGACATGTACGCTCATTGGCCGCCCGGGGCGCCGAGAGCCTCGTCACCTGCGTCTTCGCGACGGTGGGCACGGTCCTCGGCGCGATCACCGGTGGCCTCATCGGCCTGGCCACGGAGACGGGCGTGCTGCGCGGCACGGGCGTCGGCGGCATCACGGGCGCGCTGGTGTCCATGGAGGTCGTCGAGTCGCTGTGGCGCTCCGACGAGCCGGCAATCTGGAGCGTCGTCTACGTGCTCGATGTCATCTGGAGCTTGCTCACCGGCCGCCTTGTGCGCGAGAAGGTGGACCCCGCCGTGCTCAGCGCCGTCGAGAGCCAGATGAGCGCAGCGGACACACCGGCCTTGCATGCAGACCACGCCGACATCTTCGACACGGGCGGCACCAACGGCATGGCGAGGGTCGCCATGGACGCGCTCCCCGTCGTTAGGTTCACCGAGCGCAGCAACGTCGACGCCAGCGGCGAGCTCATCGCCTGTTCGGTTTGCCTCCAGGAATTCCAAGCCGGCGACAGCGCGAGGAGCCTGCCGGTGTGCCGCCACACGTTCCACCTGCCGTGCATCGACGGCTGGCTGCTCCGGCACGCCTCCTGCCCCTTGTGCCGCCGCGCTGTCTAGGCCGCGCCCGTTCCTCTACCCTCAAGGATAGCCGCCACCAGAGCTTCTCTGACAAGCGACACCCGTTCCTTCAGGCTGTAGCCGTACGCACACTGGCAGCGTGATTTTTCTGTAGCTCATCAGATGATTCAGATGGGCGTTATGTAAACATTGGTTAATTTTTAACAAATGCAAGTGGTGCACATGGCGATGGCCCCATCC

SEQ ID NO: 853 - DNA, 1530 bp, Zea mays
  misc_feature (1)..(1530): Ceres cDNA ID no. 12372712
  misc_feature (1)..(1530): Ceres CLONE  ID no. 298819
  misc_feature (1)..(1530): Also known as  Ceres CDNA ID no. 23781501
  misc_feature (417)..(417): n is a, c, t, g, unknown, or other
  misc_feature (418)..(418): n is a, c, t, g, unknown, or other
  misc_feature (702)..(702): n is a, c, t, g, unknown, or other
gcacgagaccattacctagaacatcctaatcgaaaagtggatgttcggaagcaagctttgtcgacagacagatggggaaggcggggcggttgctcaagagcatcttggcggggaggaagagcggcgtcagagacaaggcgctgcggcatcagcagcagcaaggcgacgccactccgctgccggccgcgagcagcccccgggagaagaggcgctggagcttcaggcggcccgcgacggcgcccacgaagcaggaggggaaggccaataacgcggcgccgtccccgttgtcgtcgctggagccgtcggcgcgggagctcgaccagagcgagcacgccgtggcagcggcggcggctgccaccgaggtggctcgtctgacggctgctgacgagagccatctgtcagtcagctgctgccccnncgaggaggcggccgccgtcaggatccaggccaccttcagaggctatctggctcggaaggcgctgtgcgcgctgcgcggactagtgaagctgcaggcgctggtcaggggccagctggtgaggaggcaggccaacgccacagctccgccgcatgcaggccctcgtcgacgcgcagtcccgcctgcgcgcccagcgcgcgcgcatgctggacgcggaccacgccacgccgccagcggcctaccagcgccgctcaccgcaccatcccattccgatgcgccgcagctcntacgaggcgatggaccggtcgggggaggagcacgtgaaggtcgtggagatggacgccggcgacccggcgcgacgcgggcggagcagctgctcggcggcggccaccgagtccagggagcgccgcctcgccgagtactaccaccacggcggcggcgggcagtgctcgcccgcgccgttcctcttcgcccccgacctcagcccgcagcgcggcgacagcggccacctggaggacgtgttcgcgttcgaccccgcggcgacggcgcgcagcagcccgtacgtggccccctacgacgacgccgccgacgcctacggcgtcgtcccgagctacatggccaacaccgagtcgtcccgcgccaaggtccggtcccagagcgcgccgcgccagcgcaccgacgcggcgctggagcgccagcccagcaggcgccgcgcccagcagggcgcgcccaggaagatgcagcgctcgtcgtcgcacgtcggcgtgccggcggcggccgcgtacgggtacccggcgcagccgtgggcgggcgtcaggctggaccggtccagcgcgtcgctggtgggcagcgagtgcggctcgaccagctccgtgctcaccgcggccaccgtcggctactgccgctcgctcgtcggattcgaggtccaccggggccactactgaacagcaagttgatcaccattgcaatgttgtacttgtaccgatccatctattgcctgatgatggttcttgtgaaatattagctgtgtgctgttgttgttgttgttctcgtcaatatgtaaattccaaatgtcaactgcatgtgtcgtccttaatccaaatgcataatgattc

SEQ ID NO: 854 - protein, 1530 aa, Zea mays
  misc_feature: PFam Name: Peptidase_S8; PFam Description: Subtilase family
  misc_feature: GI Number: 30682982; NR Description: calmodulin-binding
  misc_feature: GI Number: 50940489; NR Description: calmodulin-binding protein family-like [Oryza sativa (japonica cultivar-group)] >gi|42409298|dbj|BAD10560.1| calmodulin-binding protein family-like
  misc_feature: GI Number: 34906398; NR Description: P0710E05.11 [Oryza sativa (japonica cultivar-group)] >gi|9049461|dbj|BAA99426.1|
  misc_feature: GI Number: 6715635; NR Description: T25K16.10 [Arabidopsis
  misc_feature: GI Number: 66780099; NR Description: PE-PGRS family protein [Anaeromyxobacter dehalogenans 2CP-C] >gi|66854329|ref|ZP_00398411.1| PE-PGRS family protein
GCACGAGACCATTACCTAGAACATCCTAATCGAAAAGTGGATGTTCGGAAGCAAGCTTTGTCGACAGACAGATGGGGAAGGCGGGGCGGTTGCTCAAGAGCATCTTGGCGGGGAGGAAGAGCGGCGTCAGAGACAAGGCGCTGCGGCATCAGCAGCAGCAAGGCGACGCCACTCCGCTGCCGGCCGCGAGCAGCCCCCGGGAGAAGAGGCGCTGGAGCTTCAGGCGGCCCGCGACGGCGCCCACGAAGCAGGAGGGGAAGGCCAATAACGCGGCGCCGTCCCCGTTGTCGTCGCTGGAGCCGTCGGCGCGGGAGCTCGACCAGAGCGAGCACGCCGTGGCAGCGGCGGCGGCTGCCACCGAGGTGGCTCGTCTGACGGCTGCTGACGAGAGCCATCTGTCAGTCAGCTGCTGCCCCNNCGAGGAGGCGGCCGCCGTCAGGATCCAGGCCACCTTCAGAGGCTATCTGGCTCGGAAGGCGCTGTGCGCGCTGCGCGGACTAGTGAAGCTGCAGGCGCTGGTCAGGGGCCAGCTGGTGAGGAGGCAGGCCAACGCCACAGCTCCGCCGCATGCAGGCCCTCGTCGACGCGCAGTCCCGCCTGCGCGCCCAGCGCGCGCGCATGCTGGACGCGGACCACGCCACGCCGCCAGCGGCCTACCAGCGCCGCTCACCGCACCATCCCATTCCGATGCGCCGCAGCTCNTACGAGGCGATGGACCGGTCGGGGGAGGAGCACGTGAAGGTCGTGGAGATGGACGCCGGCGACCCGGCGCGACGCGGGCGGAGCAGCTGCTCGGCGGCGGCCACCGAGTCCAGGGAGCGCCGCCTCGCCGAGTACTACCACCACGGCGGCGGCGGGCAGTGCTCGCCCGCGCCGTTCCTCTTCGCCCCCGACCTCAGCCCGCAGCGCGGCGACAGCGGCCACCTGGAGGACGTGTTCGCGTTCGACCCCGCGGCGACGGCGCGCAGCAGCCCGTACGTGGCCCCCTACGACGACGCCGCCGACGCCTACGGCGTCGTCCCGAGCTACATGGCCAACACCGAGTCGTCCCGCGCCAAGGTCCGGTCCCAGAGCGCGCCGCGCCAGCGCACCGACGCGGCGCTGGAGCGCCAGCCCAGCAGGCGCCGCGCCCAGCAGGGCGCGCCCAGGAAGATGCAGCGCTCGTCGTCGCACGTCGGCGTGCCGGCGGCGGCCGCGTACGGGTACCCGGCGCAGCCGTGGGCGGGCGTCAGGCTGGACCGGTCCAGCGCGTCGCTGGTGGGCAGCGAGTGCGGCTCGACCAGCTCCGTGCTCACCGCGGCCACCGTCGGCTACTGCCGCTCGCTCGTCGGATTCGAGGTCCACCGGGGCCACTACTGAACAGCAAGTTGATCACCATTGCAATGTTGTACTTGTACCGATCCATCTATTGCCTGATGATGGTTCTTGTGAAATATTAGCTGTGTGCTGTTGTTGTTGTTGTTCTCGTCAATATGTAAATTCCAAATGTCAACTGCATGTGTCGTCCTTAATCCAAATGCATAATGATTC

SEQ ID NO: 855 - DNA, 1558 bp, Zea mays
  misc_feature (1)..(1558): Ceres cDNA ID no. 12372754
  misc_feature (1)..(1558): Ceres CLONE  ID no. 275074
  misc_feature (1)..(1558): Also known as  Ceres CDNA ID no. 23758137
ccggttcagttcagtggcgccgtcgtgcctcgacgacggcgggagacgccgcaagcaggtgagagtgagacgggcggtgactagcgggcgcttaggccgacatcggccccgcagcggcggggtagggtgcgtcgacacgcgggactgcgacttgggggggattgattcccttcgctgttctctcttctccggcgcgtgcgcgcgggatcgaaggtagggtttgggccccaaagttcgtgtctttggggacagcggcggcgatggactacaccaacgccatccacatcatcccggacgccgcgggccccgacgcctgggccaacgcggcgtcggccgcgggcgccgacgccagcatctgggccaccgaggacgactaccgccagtggagcgccgaaccaggctacggcgaccggaacccctcgtcgcgggcggggagcgagcagccgccgccgggcaagaaggctcgcggcgggggcggcggcagcgatagcggcggcggtggcagcacgagcaagtcgcgcgccattggcaagatgttcttcaagaccaagctctgctgcaagttccgggccgggacctgtccctacgtcaccaactgcaacttcgcgcatggcatggaggagctccggaagccaccgcccaactggcaggagatcgtggccgcccacgaggaggccacggagcagcgggaggagcaccagatccccatcatgacatctggaagtgttgtagctggagacggcggcggtggcagtggtggcggctcgcaggggggcagggcattcaagggccgtcactgcaagaagttctacactgaagagggctgcccctatggtgacacatgcaccttcctgcatgatgagcagtctaaggcacgggagagcgtggccatcagtctctcgcccaccgttggtggtgggggatacaatgctgcctccgccaacggagtgatggtgcagaagccgtccaactggaagacaaggatctgtaacaagtgggagatgactggatactgcccatttgggagcaaatgccactttgctcatggttctaccgaacttcacaagtacggagggggcctcgtggacatcgacggcagggacatcttgtccactcctgattcgaagcaagccggtggctctgctaaagctcctctagagtctgctgctgcgtccactgcgttgccccctcatgcagacgtgtaccatctcggcatccagtcgcagcgctcggccatcgccagccagaggtctggacagctgcaaaggcccatccagaaatggaagggccctgacaagatcagcaggatctatggagactggatagatgagaacgaatagaagaaggatcttctacggtgggccgaagggaagctgttacttggtatccgtccgactccacatcagctggtggaagctttacctggcttagaagatctcgttagcgctgcaaaaccagagtcaagatcatctttgcaagacctgtattggggagataaactgctggaacatagtgccgctttcttccgttgaactcagtagcattgctatgcttgtgt

SEQ ID NO: 856 - protein, 1558 aa, Zea mays
  misc_feature: PFam Name: zf-CCCH; PFam Description: Zinc finger
  misc_feature: GI Number: 50941347; NR Description: putative zinc finger protein [Oryza sativa (japonica cultivar-group)] >gi|29467558|dbj|BAC66728.1| putative zinc finger protein [Oryza sativa (japonica cultivar-group)] >gi|37806157|dbj|BAC99662.1|
  misc_feature: GI Number: 19547999; NR Description: At1g32359/F27G20.10 [Arabidopsis thaliana] >gi|15912259|gb|AAL08263.1|
  misc_feature: GI Number: 14018368; NR Description: zinc finger protein
  misc_feature: GI Number: 56121890; NR Description: At2g35430 [Arabidopsis thaliana] gi|42569638|ref|NP_181086.2| zinc finger (CCCH-type) family protein [Arabidopsis thaliana] gi|58331803|gb|AAW70399.1|
  misc_feature: GI Number: 29250754; NR Description: GLP_49_64409_65443
CCGGTTCAGTTCAGTGGCGCCGTCGTGCCTCGACGACGGCGGGAGACGCCGCAAGCAGGTGAGAGTGAGACGGGCGGTGACTAGCGGGCGCTTAGGCCGACATCGGCCCCGCAGCGGCGGGGTAGGGTGCGTCGACACGCGGGACTGCGACTTGGGGGGGATTGATTCCCTTCGCTGTTCTCTCTTCTCCGGCGCGTGCGCGCGGGATCGAAGGTAGGGTTTGGGCCCCAAAGTTCGTGTCTTTGGGGACAGCGGCGGCGATGGACTACACCAACGCCATCCACATCATCCCGGACGCCGCGGGCCCCGACGCCTGGGCCAACGCGGCGTCGGCCGCGGGCGCCGACGCCAGCATCTGGGCCACCGAGGACGACTACCGCCAGTGGAGCGCCGAACCAGGCTACGGCGACCGGAACCCCTCGTCGCGGGCGGGGAGCGAGCAGCCGCCGCCGGGCAAGAAGGCTCGCGGCGGGGGCGGCGGCAGCGATAGCGGCGGCGGTGGCAGCACGAGCAAGTCGCGCGCCATTGGCAAGATGTTCTTCAAGACCAAGCTCTGCTGCAAGTTCCGGGCCGGGACCTGTCCCTACGTCACCAACTGCAACTTCGCGCATGGCATGGAGGAGCTCCGGAAGCCACCGCCCAACTGGCAGGAGATCGTGGCCGCCCACGAGGAGGCCACGGAGCAGCGGGAGGAGCACCAGATCCCCATCATGACATCTGGAAGTGTTGTAGCTGGAGACGGCGGCGGTGGCAGTGGTGGCGGCTCGCAGGGGGGCAGGGCATTCAAGGGCCGTCACTGCAAGAAGTTCTACACTGAAGAGGGCTGCCCCTATGGTGACACATGCACCTTCCTGCATGATGAGCAGTCTAAGGCACGGGAGAGCGTGGCCATCAGTCTCTCGCCCACCGTTGGTGGTGGGGGATACAATGCTGCCTCCGCCAACGGAGTGATGGTGCAGAAGCCGTCCAACTGGAAGACAAGGATCTGTAACAAGTGGGAGATGACTGGATACTGCCCATTTGGGAGCAAATGCCACTTTGCTCATGGTTCTACCGAACTTCACAAGTACGGAGGGGGCCTCGTGGACATCGACGGCAGGGACATCTTGTCCACTCCTGATTCGAAGCAAGCCGGTGGCTCTGCTAAAGCTCCTCTAGAGTCTGCTGCTGCGTCCACTGCGTTGCCCCCTCATGCAGACGTGTACCATCTCGGCATCCAGTCGCAGCGCTCGGCCATCGCCAGCCAGAGGTCTGGACAGCTGCAAAGGCCCATCCAGAAATGGAAGGGCCCTGACAAGATCAGCAGGATCTATGGAGACTGGATAGATGAGAACGAATAGAAGAAGGATCTTCTACGGTGGGCCGAAGGGAAGCTGTTACTTGGTATCCGTCCGACTCCACATCAGCTGGTGGAAGCTTTACCTGGCTTAGAAGATCTCGTTAGCGCTGCAAAACCAGAGTCAAGATCATCTTTGCAAGACCTGTATTGGGGAGATAAACTGCTGGAACATAGTGCCGCTTTCTTCCGTTGAACTCAGTAGCATTGCTATGCTTGTGT

SEQ ID NO: 857 - DNA, 1370 bp, Zea mays
  misc_feature (1)..(1370): Ceres cDNA ID no. 12372818
  misc_feature (1)..(1370): Ceres CLONE  ID no. 333231
  misc_feature (1)..(1370): Also known as  Ceres CDNA ID no. 23774274
atattgtaatgaacactcccttacgtgcagtgccgcgagctgacctccacgaggaccgaaacaattatcgccagattggccgcttcacctcgacagccacgccaccaccactgcgggtctgcggcagtcggcacatggagctcctgcgggacagcatctccatggtgtccctggctgtcctggtgaccgcggtgtgcgcgcgcgccgcgtcctcgtggctccgccccggtctccctcgcctggcgtcgttgctcccgatggtcgcctttcttgccgcggctcccctggctttctcctctgcaatcatccggggacttgcaggcttcttcctcgggtggctcggcgtgttcaaggtcgtcctcctggccgtcggccgcggcccgcttgaccccgccctccccgttctcccgttcgtcttcaccacagcgcttcccgttaagctcagatgcagcagcaccggcgctgcagcagcgtgcagggccaaatcggtctccctcgtctcgtgcgcggtcaaggtcgcggtcatagccgccatcctccatgtgtaccagtacacggaccagctgcatctctacactcgcctcgctctgtacagcgtccacatctactgcttcttggacttcctcctcccgtgcatcgcggcggctggcggcgccctcggcatggatatggagccgcagttcgacaagccgtacctggcgtcgtccctacgcgacttctggggccggcggtggaacctcgtggtgtcggacatcctccggccgtctgtctacggccccgtgcgcgcgcgcgccgggaaggcaccggccgtcctggccacgttcctcgtgtccgggctgatgcacgaggtcatgatttactacctcaccctgcgatcacccaccggtgagatgacggccttcttcctgctccatggcgtctgctgtattgccgaggagtcgtgcgcgcggcggtggatgcagtggggttggaggccgccgccgcgacccgtggctacgctgctcgtggtggtgttcgtggccggcaccgcattctggctcttcttcccgcaaatttgcagggaaggaatggaggagttactgctcgaggagtgggcagcggtaggggcgttcttcaacgacgccgcccgaaagctgctccagatgttcacgtgaagacttgaaagtcggcagtcggcaccagcagactcgttccaatcctctagagataattagtagctatggttttagctgtgttcacagagctaacaacaatagcaatagctatttgagaaacatatagtgtgtttggtttgagaaacgaagtggtgtatctctttctcacttttcacttttttatttggtttgtgaattttatttggtttgtgaaat

SEQ ID NO: 858 - protein, 1370 aa, Zea mays
  misc_feature: PFam Name: MBOAT; PFam Description: MBOAT family
  misc_feature: GI Number: 38347115; NR Description: OSJNBa0009K15.12 [Oryza
  misc_feature: GI Number: 58532043; NR Description: OSJNBa0009K15.16 [Oryza
  misc_feature: GI Number: 50907895; NR Description: putative wax synthase [Oryza sativa (japonica cultivar-group)] >gi|47497822|dbj|BAD19919.1| putative wax synthase [Oryza sativa
  misc_feature: GI Number: 50908115; NR Description: putative wax synthase [Oryza sativa (japonica cultivar-group)] >gi|47497319|dbj|BAD19360.1| putative wax synthase [Oryza sativa
  misc_feature: GI Number: 50938097; NR Description: putative wax synthase isoform protein [Oryza sativa (japonica cultivar-group)] >gi|28812087|dbj|BAC65039.1| putative wax synthase isoform protein [Oryza sativa (japonica cultivar-group)] [Oryza sativa
ATATTGTAATGAACACTCCCTTACGTGCAGTGCCGCGAGCTGACCTCCACGAGGACCGAAACAATTATCGCCAGATTGGCCGCTTCACCTCGACAGCCACGCCACCACCACTGCGGGTCTGCGGCAGTCGGCACATGGAGCTCCTGCGGGACAGCATCTCCATGGTGTCCCTGGCTGTCCTGGTGACCGCGGTGTGCGCGCGCGCCGCGTCCTCGTGGCTCCGCCCCGGTCTCCCTCGCCTGGCGTCGTTGCTCCCGATGGTCGCCTTTCTTGCCGCGGCTCCCCTGGCTTTCTCCTCTGCAATCATCCGGGGACTTGCAGGCTTCTTCCTCGGGTGGCTCGGCGTGTTCAAGGTCGTCCTCCTGGCCGTCGGCCGCGGCCCGCTTGACCCCGCCCTCCCCGTTCTCCCGTTCGTCTTCACCACAGCGCTTCCCGTTAAGCTCAGATGCAGCAGCACCGGCGCTGCAGCAGCGTGCAGGGCCAAATCGGTCTCCCTCGTCTCGTGCGCGGTCAAGGTCGCGGTCATAGCCGCCATCCTCCATGTGTACCAGTACACGGACCAGCTGCATCTCTACACTCGCCTCGCTCTGTACAGCGTCCACATCTACTGCTTCTTGGACTTCCTCCTCCCGTGCATCGCGGCGGCTGGCGGCGCCCTCGGCATGGATATGGAGCCGCAGTTCGACAAGCCGTACCTGGCGTCGTCCCTACGCGACTTCTGGGGCCGGCGGTGGAACCTCGTGGTGTCGGACATCCTCCGGCCGTCTGTCTACGGCCCCGTGCGCGCGCGCGCCGGGAAGGCACCGGCCGTCCTGGCCACGTTCCTCGTGTCCGGGCTGATGCACGAGGTCATGATTTACTACCTCACCCTGCGATCACCCACCGGTGAGATGACGGCCTTCTTCCTGCTCCATGGCGTCTGCTGTATTGCCGAGGAGTCGTGCGCGCGGCGGTGGATGCAGTGGGGTTGGAGGCCGCCGCCGCGACCCGTGGCTACGCTGCTCGTGGTGGTGTTCGTGGCCGGCACCGCATTCTGGCTCTTCTTCCCGCAAATTTGCAGGGAAGGAATGGAGGAGTTACTGCTCGAGGAGTGGGCAGCGGTAGGGGCGTTCTTCAACGACGCCGCCCGAAAGCTGCTCCAGATGTTCACGTGAAGACTTGAAAGTCGGCAGTCGGCACCAGCAGACTCGTTCCAATCCTCTAGAGATAATTAGTAGCTATGGTTTTAGCTGTGTTCACAGAGCTAACAACAATAGCAATAGCTATTTGAGAAACATATAGTGTGTTTGGTTTGAGAAACGAAGTGGTGTATCTCTTTCTCACTTTTCACTTTTTTATTTGGTTTGTGAATTTTATTTGGTTTGTGAAAT

SEQ ID NO: 859 - DNA, 1649 bp, Zea mays
  misc_feature (1)..(1649): Ceres cDNA ID no. 12372859
  misc_feature (1)..(1649): Ceres CLONE  ID no. 312264
  misc_feature (1)..(1649): Also known as  Ceres CDNA ID no. 23778164
tagttcatttatgatttcctgcgagcacaaagctagcgaagataccaaacaatggggagcacgagcgccacaggcaccacgtcgtcttcctcatcggctgcccacgggggcggtgccgcacacgtactgctcctgccgtacccgggcgcgcagggccatacaaacccgctgctccagttcggccgctgcctcgcctaccacggcctccgccccacgctcgtcacctcgcggtacgtgctctccaccaccccgcctcccggggagcccttcagggtggccgccatttccgatggcttcgacgacggcggggcggccgcgtgccccgacctcgacgtgtactggcgccagctcgaggccgtcggctcggagacgctggcggagctgatccgctccgaggccgccgatgggcggcctgtgcgcgtgctggtttacgacccgcacctgccgtgggcgcgacgggtggcacaggcggccgggctggcggcagcggcgttcctatcgcagccatgcgccgtcgacgtcgtctacggggaggtgtgtgcaggacggctgccactgccggtggtggacgggaaagagctgtttgcacgcgggctgctgggtgtcgagctcggtcccgacgacgttccgccgttcgcagcaaagccagactggtgccctgtgttccttcgggcatcactgcggcaatttgaggggctggaggacgccgacgacgtgctcgtcaactcattccacgagatcgaacccaaggaggcagattatatggccctaacatggcatgcaaagacaataggcccaactttgccatcattttatcttgatgatgaccgtttgcccttgaacaagacttacggtttcaacctcttcaacagcagcgagtcatgtctggcttggcttgacaaacagcttccgtgttctgttgttcttgtatcctatggtactgtctctgattatgatgaagcacagttagaggagcttggcaatggattgtacaattctggcaaaccattcatttgggttgtgaggtcaaacgaagaacacaagttgtccaatgaacttcgtgacaagtgcaaggaacgtggccttattgtttcttggtgcccccagctggaagttctagcacataaagctacaggttgtttcttcacacattgcggatggaactcgacattggaagcaattgttaatggtgtgccaatggtggcaataccacactgggcagaccagccgaccatatcaaaatatatggagagcatgtggggcttgggtgtccgagtgcgcaaggatgagaaaggcttggtaacgagggacgaggtggaaaggtgcatcaaggatgtcatggatggtgatagtaaggataagtataggaagagtgccactatgtggatgcaaaaggccaaggcagctatgcagaatggagggagctcggccaagaatattacagaattcgccgcgaagtattctttaagttaatttttcaaatatttcgtaaaaaaagttaattttcaaagatataatgatagtgttataattacttcctataccttcatggattgtatgccttcctgcatgttatatttttgtctcgggattgtgcgtattacgttttgacttgatgatgtacatgctacagcagcaacctccacgtc

SEQ ID NO: 860 - protein, 1649 aa, Zea mays
  misc_feature: PFam Name: UDPGT; PFam Description: UDP-glucoronosyl and
  misc_feature: GI Number: 50726639; NR Description: putative UDP-glucose:salicylic acid glucosyltransferase [Oryza sativa (japonica cultivar-group)] >gi|50725328|dbj|BAD34401.1| putative UDP-glucose:salicylic acid glucosyltransferase [Oryza sativa
  misc_feature: GI Number: 50726641; NR Description: putative UDP-glucose:salicylic acid glucosyltransferase [Oryza sativa (japonica cultivar-group)] >gi|50725330|dbj|BAD34403.1| putative UDP-glucose:salicylic acid glucosyltransferase [Oryza sativa
  misc_feature: GI Number: 60649935; NR Description: UDP-xylose phenolic
  misc_feature: GI Number: 42571217; NR Description: UDP-glucoronosyl/UDP-glucosyl transferase family protein
  misc_feature: GI Number: 62320526; NR Description: putative
TAGTTCATTTATGATTTCCTGCGAGCACAAAGCTAGCGAAGATACCAAACAATGGGGAGCACGAGCGCCACAGGCACCACGTCGTCTTCCTCATCGGCTGCCCACGGGGGCGGTGCCGCACACGTACTGCTCCTGCCGTACCCGGGCGCGCAGGGCCATACAAACCCGCTGCTCCAGTTCGGCCGCTGCCTCGCCTACCACGGCCTCCGCCCCACGCTCGTCACCTCGCGGTACGTGCTCTCCACCACCCCGCCTCCCGGGGAGCCCTTCAGGGTGGCCGCCATTTCCGATGGCTTCGACGACGGCGGGGCGGCCGCGTGCCCCGACCTCGACGTGTACTGGCGCCAGCTCGAGGCCGTCGGCTCGGAGACGCTGGCGGAGCTGATCCGCTCCGAGGCCGCCGATGGGCGGCCTGTGCGCGTGCTGGTTTACGACCCGCACCTGCCGTGGGCGCGACGGGTGGCACAGGCGGCCGGGCTGGCGGCAGCGGCGTTCCTATCGCAGCCATGCGCCGTCGACGTCGTCTACGGGGAGGTGTGTGCAGGACGGCTGCCACTGCCGGTGGTGGACGGGAAAGAGCTGTTTGCACGCGGGCTGCTGGGTGTCGAGCTCGGTCCCGACGACGTTCCGCCGTTCGCAGCAAAGCCAGACTGGTGCCCTGTGTTCCTTCGGGCATCACTGCGGCAATTTGAGGGGCTGGAGGACGCCGACGACGTGCTCGTCAACTCATTCCACGAGATCGAACCCAAGGAGGCAGATTATATGGCCCTAACATGGCATGCAAAGACAATAGGCCCAACTTTGCCATCATTTTATCTTGATGATGACCGTTTGCCCTTGAACAAGACTTACGGTTTCAACCTCTTCAACAGCAGCGAGTCATGTCTGGCTTGGCTTGACAAACAGCTTCCGTGTTCTGTTGTTCTTGTATCCTATGGTACTGTCTCTGATTATGATGAAGCACAGTTAGAGGAGCTTGGCAATGGATTGTACAATTCTGGCAAACCATTCATTTGGGTTGTGAGGTCAAACGAAGAACACAAGTTGTCCAATGAACTTCGTGACAAGTGCAAGGAACGTGGCCTTATTGTTTCTTGGTGCCCCCAGCTGGAAGTTCTAGCACATAAAGCTACAGGTTGTTTCTTCACACATTGCGGATGGAACTCGACATTGGAAGCAATTGTTAATGGTGTGCCAATGGTGGCAATACCACACTGGGCAGACCAGCCGACCATATCAAAATATATGGAGAGCATGTGGGGCTTGGGTGTCCGAGTGCGCAAGGATGAGAAAGGCTTGGTAACGAGGGACGAGGTGGAAAGGTGCATCAAGGATGTCATGGATGGTGATAGTAAGGATAAGTATAGGAAGAGTGCCACTATGTGGATGCAAAAGGCCAAGGCAGCTATGCAGAATGGAGGGAGCTCGGCCAAGAATATTACAGAATTCGCCGCGAAGTATTCTTTAAGTTAATTTTTCAAATATTTCGTAAAAAAAGTTAATTTTCAAAGATATAATGATAGTGTTATAATTACTTCCTATACCTTCATGGATTGTATGCCTTCCTGCATGTTATATTTTTGTCTCGGGATTGTGCGTATTACGTTTTGACTTGATGATGTACATGCTACAGCAGCAACCTCCACGTC

SEQ ID NO: 861 - DNA, 1990 bp, Zea mays
  misc_feature (1)..(1990): Ceres cDNA ID no. 12372870
  misc_feature (1)..(1990): Ceres CLONE  ID no. 302734
  misc_feature (1)..(1990): Also known as  Ceres CDNA ID no. 23769279
gttccaggtcgtggtctttgccaaattcccacgcccctgcccaccctgcccgaatcctctcgccctttacccccgcccgcgaccccattcacactctcgctgctccactccgctccgctcagctcgtcgggacgcgcccccgcctcccatcccatgcccgcccccgcgctcgtcggaggccgctcgcggcggcctcccatcccgccgcgctgacgagagggcctctcggtgggggcgcttcgggtgttcattttgtccgttcggggaaggggagtgcggcgatggggaagcagcaggaggggaagcggcggcgcggggagaaggacgggcagcggaaggggagggggaagacagctgcagcggcggtgccggaggacgcggcgccagtggccgggtgctggatccgcttcccgcgcctccgcggctgcatgccgtcgcgcgccaaggtcgactcctccaccagcgcgcgtggcggcggccgggaaaccaaaccatctactgatgatgcttgccaggaccaatcagtaccaccagcctctggttccgcaacaaccagtaacactggaagtatctcaccttcttccatagttggagaggagctaaaactagctttccaactgcgtagatttacttttagtgaactgaaatgtgccacgagaaacttccgacctgagagtcttcttggcgagggaggttttggctgtgtctttaaaggatggattgaggagaatggaactgctcctgttaagccaggcaccggattaactgttgctgtcaagacactcaaccatgatgggttgcaggggcataaagagtgggtggcagaagttgattttcttggaaaccttcagcatccacatctagtgaaattggttggctactgcattgaagatgaccagaggttgcttgtgtatgaatttatgccccgtggaagtttggagaatcatctttttagaaagtcattgcctctaccatgggccattagaatgaaaattgctcttggtgctgcgaaaagcctcgcttttcttcatgaagaagctgaaagaccagtaatctatcgggacttcaaaacctccaatattcttttagatgcggactataacgcaaaactctctgattttggacttgctaaagatggccctgagggtgataaaacacatgtgtcaactagggtcatgggaacatatggatatgctgcacctgaatatgtaatgacaggtcacctgacatcgaagagtgacgtatatagctttggagttgtactactagagatgatgactggtagaaggtcaatggacaagaacaggccaaacggagaacacaacctggttgaatgggcacgcccttatctgggagaaagacgcagattctataagcttgtagaccctcgtttggatgggaacttctccataaaaggcgcccagaagacggctcagctggcccatgcctgcctcagccgtgaccccaaggctaggcctctgatgagccaggtggtggaggtgctgaagcctctccagaacctcaaggacatggccagctcttcctactacttccagtccatgcaacatgagcggcgcacagcacttgccaacccatatggcagtcaaagcatgaaagcgcagagcacctttgcgcggaacgggcagcagcccatgaggagcctctcgtatggccctcatgcttccccgtatcgccagtcgccaaggcttgacagcaagcggcaatgagtcatggtgcttgtctgtcgaccataacatattttcaagactgaagttgtaaccagaactggtgtatgaactcagccatccaacaagcatctgagctatctattattgtggatgaagcagcaacattgattcgaatttgcatatcatctgcgagtgaatttttttctctcttgttatcgcttacattttagctgtactgtctttacggctctagataccttgacttgaaaggtggaactaaacagggttttgatcggtctttg

SEQ ID NO: 862 - protein, 1990 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 34898434; NR Description: ESTs C98382(C2985),D22444(C11129) correspond to a region of the predicted gene.~Similar to Arabidopsis thaliana APK1 gene for protein tyrosine-serine-threonine kinase.(D12522) [Oryza sativa
  misc_feature: GI Number: 9294282; NR Description: protein kinase
  misc_feature: GI Number: 42565268; NR Description: protein kinase, putative
  misc_feature: GI Number: 50899626; NR Description: putative serine/threonine protein kinase [Oryza sativa (japonica cultivar-group)] >gi|48716659|dbj|BAD23327.1| putative serine/threonine protein kinase [Oryza sativa (japonica
  misc_feature: GI Number: 28804505; NR Description: serine/threonine protein
GTTCCAGGTCGTGGTCTTTGCCAAATTCCCACGCCCCTGCCCACCCTGCCCGAATCCTCTCGCCCTTTACCCCCGCCCGCGACCCCATTCACACTCTCGCTGCTCCACTCCGCTCCGCTCAGCTCGTCGGGACGCGCCCCCGCCTCCCATCCCATGCCCGCCCCCGCGCTCGTCGGAGGCCGCTCGCGGCGGCCTCCCATCCCGCCGCGCTGACGAGAGGGCCTCTCGGTGGGGGCGCTTCGGGTGTTCATTTTGTCCGTTCGGGGAAGGGGAGTGCGGCGATGGGGAAGCAGCAGGAGGGGAAGCGGCGGCGCGGGGAGAAGGACGGGCAGCGGAAGGGGAGGGGGAAGACAGCTGCAGCGGCGGTGCCGGAGGACGCGGCGCCAGTGGCCGGGTGCTGGATCCGCTTCCCGCGCCTCCGCGGCTGCATGCCGTCGCGCGCCAAGGTCGACTCCTCCACCAGCGCGCGTGGCGGCGGCCGGGAAACCAAACCATCTACTGATGATGCTTGCCAGGACCAATCAGTACCACCAGCCTCTGGTTCCGCAACAACCAGTAACACTGGAAGTATCTCACCTTCTTCCATAGTTGGAGAGGAGCTAAAACTAGCTTTCCAACTGCGTAGATTTACTTTTAGTGAACTGAAATGTGCCACGAGAAACTTCCGACCTGAGAGTCTTCTTGGCGAGGGAGGTTTTGGCTGTGTCTTTAAAGGATGGATTGAGGAGAATGGAACTGCTCCTGTTAAGCCAGGCACCGGATTAACTGTTGCTGTCAAGACACTCAACCATGATGGGTTGCAGGGGCATAAAGAGTGGGTGGCAGAAGTTGATTTTCTTGGAAACCTTCAGCATCCACATCTAGTGAAATTGGTTGGCTACTGCATTGAAGATGACCAGAGGTTGCTTGTGTATGAATTTATGCCCCGTGGAAGTTTGGAGAATCATCTTTTTAGAAAGTCATTGCCTCTACCATGGGCCATTAGAATGAAAATTGCTCTTGGTGCTGCGAAAAGCCTCGCTTTTCTTCATGAAGAAGCTGAAAGACCAGTAATCTATCGGGACTTCAAAACCTCCAATATTCTTTTAGATGCGGACTATAACGCAAAACTCTCTGATTTTGGACTTGCTAAAGATGGCCCTGAGGGTGATAAAACACATGTGTCAACTAGGGTCATGGGAACATATGGATATGCTGCACCTGAATATGTAATGACAGGTCACCTGACATCGAAGAGTGACGTATATAGCTTTGGAGTTGTACTACTAGAGATGATGACTGGTAGAAGGTCAATGGACAAGAACAGGCCAAACGGAGAACACAACCTGGTTGAATGGGCACGCCCTTATCTGGGAGAAAGACGCAGATTCTATAAGCTTGTAGACCCTCGTTTGGATGGGAACTTCTCCATAAAAGGCGCCCAGAAGACGGCTCAGCTGGCCCATGCCTGCCTCAGCCGTGACCCCAAGGCTAGGCCTCTGATGAGCCAGGTGGTGGAGGTGCTGAAGCCTCTCCAGAACCTCAAGGACATGGCCAGCTCTTCCTACTACTTCCAGTCCATGCAACATGAGCGGCGCACAGCACTTGCCAACCCATATGGCAGTCAAAGCATGAAAGCGCAGAGCACCTTTGCGCGGAACGGGCAGCAGCCCATGAGGAGCCTCTCGTATGGCCCTCATGCTTCCCCGTATCGCCAGTCGCCAAGGCTTGACAGCAAGCGGCAATGAGTCATGGTGCTTGTCTGTCGACCATAACATATTTTCAAGACTGAAGTTGTAACCAGAACTGGTGTATGAACTCAGCCATCCAACAAGCATCTGAGCTATCTATTATTGTGGATGAAGCAGCAACATTGATTCGAATTTGCATATCATCTGCGAGTGAATTTTTTTCTCTCTTGTTATCGCTTACATTTTAGCTGTACTGTCTTTACGGCTCTAGATACCTTGACTTGAAAGGTGGAACTAAACAGGGTTTTGATCGGTCTTTG

SEQ ID NO: 863 - DNA, 1738 bp, Zea mays
  misc_feature (1)..(1738): Ceres cDNA ID no. 12372961
  misc_feature (1)..(1738): Ceres CLONE  ID no. 242729
  misc_feature (1)..(1738): Also known as  Ceres CDNA ID no. 23757175
atccatcaaagtcacagagacgaccagctgaagcgaacacagagctgctcgccgtgtaacgcagcaggcagcagcacccagaggcggcaggacacacacacagcacacgcagatcttcgatcaccaccatgggttctctcggcagcgccgcgcagcagcagccgcagcaaccgcacgccgtgtgcctgccgtacccagcgcagggccacatcaccccgatgctcaacgtggcgaagctgctgcacgcccggggcttccacgtcaccttcgtcaacaccgagtacaaccaggcgcgcctcgtccggacccgcggggcggcggccgtggccggcctcccgggcttccgcttcgccaccatccccgacggcctgccgccgtcggaggacgacgacgtcacgcaggacatcccctcgctgtgcaagtccaccacggagacctgcctcggtcccttccgccgcctgctcgcggacctcagcgacccgcccgtcacctgcgtcgtctccgacgtcgtcatgggcttctccatcgacgccaccaaggagctcggccttccctacgtccagctctggactgccagcaccatcagcttcctcggctaccgccactaccacctcctcaagagccgtggcctcgctccgctcaaaagtgtggagcagctgacgaacggattccttgacacggcggtggaggacgtgccggggctgcggaacatgaggttccgggacttcccgagcttcatccgctccacggacccggacgagtacatggtgggctacgtcctccaggagacggggcgcacggcgggcgcgtcggccgtgatcctcaacaccttcgacgagctggagggcgaggcggtggcggccatgcgctcgctcggcctggcgcgcaaggtgtacacgctgggcccgctcccgctgctggcgcgcgaggacccgcccaccccgcgctccgccatcagcctcagcctgtggaaggaggaggaggagtgcctgcggtggctcgacggcagggaccccggctccgtcgtctacgtcaacttcggcagcatcaccgtgatgaccagcgaccagctggtggagttcgcgtgggggctggccaacagcggcaggccgttcctgtggatcatccggcgcgacctcgtcaggggcgacactgccgtgctgccgccggagttcctgtccgagacggccggccgcgggctcatggccacctggtgcccgcagcaggcggtgctggaccacccggccgtggccgcgttcctcacgcacagcggatggaactccacgctggaggccatgtgcggcggcgtcccggtcatcagctggcccttcttcgccgaccagcagaccaactgccgctaccagtgcaacgagtggggcgtcgggatggagatcgacagcaacgtccggcgcgacgccgtggcgagcctcatcgctgagctcatggagggggagcaggggaaggagatgaggagaagggcactggaatggagggacaaggccatcgaggtggccaagcccggaggcacgtcttaccggaatttcgatgaactggttcgcaatgtgctcctgccaaagaactaggcaacttagctctatatttgcagtttgcacggtgcttctgccagtgccgtgtgattttgttcctttgttttggagggagatggacaggtcagtgtcgttgtgtaaacaataaaaatacatgcatacgagcgtccaattgaggatgggcaagtctg

SEQ ID NO: 864 - protein, 1738 aa, Zea mays
  misc_feature: PFam Name: UDPGT; PFam Description: UDP-glucoronosyl and
  misc_feature: PFam Name: Cation_efflux; PFam Description: Cation efflux family
  misc_feature: PFam Name: Mucin; PFam Description: Mucin-like glycoprotein
  misc_feature: GI Number: 51964394; NR Description: PREDICTED P0627E03.33 gene product [Oryza sativa (japonica cultivar-group)] >gi|50912923|ref|XP_467869.1| putative UDP-glucose glucosyltransferase1 [Oryza sativa (japonica cultivar-group)]
  misc_feature: GI Number: 19911203; NR Description: glucosyltransferase-10
  misc_feature: GI Number: 62241065; NR Description: glycosyltransferase
  misc_feature: GI Number: 62241067; NR Description: glycosyltransferase
  misc_feature: GI Number: 50909849; NR Description: putative UDP-glycosyltransferase 85A8 [Oryza sativa (japonica cultivar-group)] >gi|50253292|dbj|BAD29561.1| putative UDP-glycosyltransferase 85A8 [Oryza sativa (japonica
ATCCATCAAAGTCACAGAGACGACCAGCTGAAGCGAACACAGAGCTGCTCGCCGTGTAACGCAGCAGGCAGCAGCACCCAGAGGCGGCAGGACACACACACAGCACACGCAGATCTTCGATCACCACCATGGGTTCTCTCGGCAGCGCCGCGCAGCAGCAGCCGCAGCAACCGCACGCCGTGTGCCTGCCGTACCCAGCGCAGGGCCACATCACCCCGATGCTCAACGTGGCGAAGCTGCTGCACGCCCGGGGCTTCCACGTCACCTTCGTCAACACCGAGTACAACCAGGCGCGCCTCGTCCGGACCCGCGGGGCGGCGGCCGTGGCCGGCCTCCCGGGCTTCCGCTTCGCCACCATCCCCGACGGCCTGCCGCCGTCGGAGGACGACGACGTCACGCAGGACATCCCCTCGCTGTGCAAGTCCACCACGGAGACCTGCCTCGGTCCCTTCCGCCGCCTGCTCGCGGACCTCAGCGACCCGCCCGTCACCTGCGTCGTCTCCGACGTCGTCATGGGCTTCTCCATCGACGCCACCAAGGAGCTCGGCCTTCCCTACGTCCAGCTCTGGACTGCCAGCACCATCAGCTTCCTCGGCTACCGCCACTACCACCTCCTCAAGAGCCGTGGCCTCGCTCCGCTCAAAAGTGTGGAGCAGCTGACGAACGGATTCCTTGACACGGCGGTGGAGGACGTGCCGGGGCTGCGGAACATGAGGTTCCGGGACTTCCCGAGCTTCATCCGCTCCACGGACCCGGACGAGTACATGGTGGGCTACGTCCTCCAGGAGACGGGGCGCACGGCGGGCGCGTCGGCCGTGATCCTCAACACCTTCGACGAGCTGGAGGGCGAGGCGGTGGCGGCCATGCGCTCGCTCGGCCTGGCGCGCAAGGTGTACACGCTGGGCCCGCTCCCGCTGCTGGCGCGCGAGGACCCGCCCACCCCGCGCTCCGCCATCAGCCTCAGCCTGTGGAAGGAGGAGGAGGAGTGCCTGCGGTGGCTCGACGGCAGGGACCCCGGCTCCGTCGTCTACGTCAACTTCGGCAGCATCACCGTGATGACCAGCGACCAGCTGGTGGAGTTCGCGTGGGGGCTGGCCAACAGCGGCAGGCCGTTCCTGTGGATCATCCGGCGCGACCTCGTCAGGGGCGACACTGCCGTGCTGCCGCCGGAGTTCCTGTCCGAGACGGCCGGCCGCGGGCTCATGGCCACCTGGTGCCCGCAGCAGGCGGTGCTGGACCACCCGGCCGTGGCCGCGTTCCTCACGCACAGCGGATGGAACTCCACGCTGGAGGCCATGTGCGGCGGCGTCCCGGTCATCAGCTGGCCCTTCTTCGCCGACCAGCAGACCAACTGCCGCTACCAGTGCAACGAGTGGGGCGTCGGGATGGAGATCGACAGCAACGTCCGGCGCGACGCCGTGGCGAGCCTCATCGCTGAGCTCATGGAGGGGGAGCAGGGGAAGGAGATGAGGAGAAGGGCACTGGAATGGAGGGACAAGGCCATCGAGGTGGCCAAGCCCGGAGGCACGTCTTACCGGAATTTCGATGAACTGGTTCGCAATGTGCTCCTGCCAAAGAACTAGGCAACTTAGCTCTATATTTGCAGTTTGCACGGTGCTTCTGCCAGTGCCGTGTGATTTTGTTCCTTTGTTTTGGAGGGAGATGGACAGGTCAGTGTCGTTGTGTAAACAATAAAAATACATGCATACGAGCGTCCAATTGAGGATGGGCAAGTCTG

SEQ ID NO: 865 - DNA, 1686 bp, Zea mays
  misc_feature (1)..(1686): Ceres cDNA ID no. 12372981
  misc_feature (1)..(1686): Ceres CLONE  ID no. 339803
  misc_feature (1)..(1686): Also known as  Ceres CDNA ID no. 23762620
gttttgctgttcttttcttcctcgtaatccgctcggcttccattgttgccgccgctaccgacggcgacggcagacatcaagtgtcagtcctccttccgccgaagtcttcttttggttggactccgagtctccgactgtccgacaggagttgcgctcctcctccccctctagtctactggatttcactagcgtggagatccatctctatttgtttttggtctcttctttgcttcaactataactagtaaattggcgcgcgccagcgcgcgtactcagagagaactaaacaatccggcaagctctacaaaaatcagggggcaaggtcaatctcagttgataagataccacttgtactctaatctgtcagtctccacgtgcggctgcatatatactgtttcaaaatttcggagtaaggtctgaagtctgaatcctcatgctgcttcagagggattgaagctggttgttggtcgctcttgcacatggcgcagccacagcagcgggtgtaccaagcttggaagggggataacaggttcttctttggtgggcggttgatatttggaccaaatgttaattctctaggtgtttctgttgccctcattgttatcccagttgctgtcttttgtgtgtttgtcgcacaccatctccgtcatcagtttcatgcatatgatgcaggatatgcaattcttgtcatagcaatagtgctcacaatctatgtgcttctgttactcttaaccactgccgctcgggatccaggaattgtacctcgtgcttcacatccacctgaggatattcactatgataatttgtctcttactgacacacctggaatactacagttcccccgtgtaaaagaagttatagtaaatgggatgcctgtgaaagtaaaatattgtgaaacttgtatggtttttcgtcctcctcggtgttcacactgttccatttgcaacaattgtgtggaacgctttgatcaccactgtccatgggtaggacagtgcattggaaagcgcaattaccgttattttttcctatttgttgtcgcttcaagtctcctctccatttatgtgtttattataacggccttgtacatcaagtttctcatggatggagactatcctacagtttggaaggcattgaaacattcccctgcttctctagcactaatgatatactgttttatctctctctggtttgttggtgggctcacaggatttcatacatatctcatcagcactaatcagaccacatacgaaaattttcagtacaggtcggatggcaggcttaatgtctatgatcaagggtgtctgagtaactttcaagaagtagtgtgtgccaagatagagccttctaaacataagttccgggcgcacatacaagaggaagtgcgagctccaccagctaaccgtgctggagagagtgaagaagaacaagttggtggtcctcgagcaaaagtgggggatggcctcgatattgatggtgatctgatgaagatttcacataggcataaccatgaggacgtcgatattgaaataggatgtggggatgctaatgaggtggaatgctcagtttcagattccaaagttaaagacaatacggatgcacatatgtgatatgtagagttagaaataaggtaaatggagaacagtcgagttgggttccagcggtttaatgaatgtgtttgtttagttc

SEQ ID NO: 866 - protein, 1686 aa, Zea mays
  misc_feature: PFam Name: zf-DHHC; PFam Description: DHHC zinc finger domain
  misc_feature: GI Number: 56784777; NR Description: putative NEW1 domain
  misc_feature: GI Number: 34908626; NR Description: P0677H08.13 [Oryza sativa (japonica cultivar-group)] >gi|29365512|dbj|BAB89798.2|
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 30688566; NR Description: zinc finger (DHHC type)
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
GTTTTGCTGTTCTTTTCTTCCTCGTAATCCGCTCGGCTTCCATTGTTGCCGCCGCTACCGACGGCGACGGCAGACATCAAGTGTCAGTCCTCCTTCCGCCGAAGTCTTCTTTTGGTTGGACTCCGAGTCTCCGACTGTCCGACAGGAGTTGCGCTCCTCCTCCCCCTCTAGTCTACTGGATTTCACTAGCGTGGAGATCCATCTCTATTTGTTTTTGGTCTCTTCTTTGCTTCAACTATAACTAGTAAATTGGCGCGCGCCAGCGCGCGTACTCAGAGAGAACTAAACAATCCGGCAAGCTCTACAAAAATCAGGGGGCAAGGTCAATCTCAGTTGATAAGATACCACTTGTACTCTAATCTGTCAGTCTCCACGTGCGGCTGCATATATACTGTTTCAAAATTTCGGAGTAAGGTCTGAAGTCTGAATCCTCATGCTGCTTCAGAGGGATTGAAGCTGGTTGTTGGTCGCTCTTGCACATGGCGCAGCCACAGCAGCGGGTGTACCAAGCTTGGAAGGGGGATAACAGGTTCTTCTTTGGTGGGCGGTTGATATTTGGACCAAATGTTAATTCTCTAGGTGTTTCTGTTGCCCTCATTGTTATCCCAGTTGCTGTCTTTTGTGTGTTTGTCGCACACCATCTCCGTCATCAGTTTCATGCATATGATGCAGGATATGCAATTCTTGTCATAGCAATAGTGCTCACAATCTATGTGCTTCTGTTACTCTTAACCACTGCCGCTCGGGATCCAGGAATTGTACCTCGTGCTTCACATCCACCTGAGGATATTCACTATGATAATTTGTCTCTTACTGACACACCTGGAATACTACAGTTCCCCCGTGTAAAAGAAGTTATAGTAAATGGGATGCCTGTGAAAGTAAAATATTGTGAAACTTGTATGGTTTTTCGTCCTCCTCGGTGTTCACACTGTTCCATTTGCAACAATTGTGTGGAACGCTTTGATCACCACTGTCCATGGGTAGGACAGTGCATTGGAAAGCGCAATTACCGTTATTTTTTCCTATTTGTTGTCGCTTCAAGTCTCCTCTCCATTTATGTGTTTATTATAACGGCCTTGTACATCAAGTTTCTCATGGATGGAGACTATCCTACAGTTTGGAAGGCATTGAAACATTCCCCTGCTTCTCTAGCACTAATGATATACTGTTTTATCTCTCTCTGGTTTGTTGGTGGGCTCACAGGATTTCATACATATCTCATCAGCACTAATCAGACCACATACGAAAATTTTCAGTACAGGTCGGATGGCAGGCTTAATGTCTATGATCAAGGGTGTCTGAGTAACTTTCAAGAAGTAGTGTGTGCCAAGATAGAGCCTTCTAAACATAAGTTCCGGGCGCACATACAAGAGGAAGTGCGAGCTCCACCAGCTAACCGTGCTGGAGAGAGTGAAGAAGAACAAGTTGGTGGTCCTCGAGCAAAAGTGGGGGATGGCCTCGATATTGATGGTGATCTGATGAAGATTTCACATAGGCATAACCATGAGGACGTCGATATTGAAATAGGATGTGGGGATGCTAATGAGGTGGAATGCTCAGTTTCAGATTCCAAAGTTAAAGACAATACGGATGCACATATGTGATATGTAGAGTTAGAAATAAGGTAAATGGAGAACAGTCGAGTTGGGTTCCAGCGGTTTAATGAATGTGTTTGTTTAGTTC

SEQ ID NO: 867 - DNA, 1267 bp, Zea mays
  misc_feature (1)..(1267): Ceres cDNA ID no. 12373164
  misc_feature (1)..(1267): Ceres CLONE  ID no. 312786
  misc_feature (1)..(1267): Also known as  Ceres CDNA ID no. 23768055
actctccagtctccactagcatcagtcgccgccgcctatcctcgagcaccatttccatcaacagcatccgcctctggcaagctagcgacagcaactcatggcactccgcgcgctcgacaacacgatgcccgccgccgtcgaggagcggcccaagaaggtggctaaggtgggcgtccccgccgccgccgccaaggccgccgcctccccctcccccgggagtggcggcaagaagaagaaggggaacgacgagaactcggcgccaagggccacggccgcggcggcggagcaggcggtggagtacatctcgtcggaggagctggaggcggcggccagccccaaggccaaggccgcggggctggtgcgcggacctggactccaaggactgggtcaggacctgcgaggcgctcaacgacgcgcgccgcctcgcgatccaccaccccgcgctgctgaacccgatcctggagaaggtggtgctggcggtcgtgaagacgatgaagagcccccgcagcgcggtgctcaagacgtccatcatggcctgcgccgacatcttcagttccttcggcaacctcctcgcctccgtctccgacgacaccttcgacaagctgctgctccagctcctgctgaaggcgtcccaggacaagcggttcgtgtgcgaggaggccgagaaggcgacgcgcgcgatggcggcgtcgatggcgccgctgccgctgctgaagaagctcaaggcgtacgtccaccacgccaacctcagggtcagggctaaggccgccgtcgccatctcccactgcgccgcccggatggacatcggcgcgatgaaggagttcgggatgtcggcgctgctgcagctggcggcggagctgctgaacgaccggctgccggaggcgagggaggccgcccgcggcgtggtggcgtcgacgcacgcggccttcgccaaggaggccgccgcgagcggccaggaggacgacgcggccgcgtcctgggagagcctctgcgcgctcagcctcccgcccatctccgcgcaggccgtcgccaagatcgctgccgccgccgcctcctcgcagtagccactgcacgcgtgcggacgtgcgccgctggcgttgattttgggggtcgtctggttcggttcagaagtagcgctcgtgagtcttcagacagagctcgtttgtcgccgccgccgccgagtctgtttgtttgttctttctactccatgctatctcgcatggttagtgttctgtttatggcttcgtcaagtaataacatatcaatt

SEQ ID NO: 868 - protein, 1267 aa, Zea mays
  misc_feature: PFam Name: FH2; PFam Description: Formin Homology 2 Domain
  misc_feature: PFam Name: Extensin_2; PFam Description: Extensin-like region
  misc_feature: PFam Name: Pyr_redox_2; PFam Description: Pyridine
  misc_feature: PFam Name: GRP; PFam Description: Glycine rich protein family
  misc_feature: PFam Name: Drf_FH1; PFam Description: Formin Homology Region 1
  misc_feature: GI Number: 21593517; NR Description: unknown [Arabidopsis thaliana]
  misc_feature: GI Number: 51979208; NR Description: PREDICTED P0543C11.17-3 gene product [Oryza sativa (japonica cultivar-group)] >gi|51979206|ref|XP_507469.1| PREDICTED P0543C11.17-3 gene product [Oryza sativa (japonica cultivar-group)] [Oryza sativa
  misc_feature: GI Number: 51979707; NR Description: PREDICTED P0702C09.23 gene product [Oryza sativa (japonica cultivar-group)] >gi|51979705|ref|XP_507599.1| PREDICTED P0702C09.23 gene product [Oryza sativa (japonica cultivar-group)] [Oryza sativa (japonica
  misc_feature: GI Number: 21537265; NR Description: unknown [Arabidopsis thaliana]
  misc_feature: GI Number: 5821151; NR Description: RNA binding protein [Homo
ACTCTCCAGTCTCCACTAGCATCAGTCGCCGCCGCCTATCCTCGAGCACCATTTCCATCAACAGCATCCGCCTCTGGCAAGCTAGCGACAGCAACTCATGGCACTCCGCGCGCTCGACAACACGATGCCCGCCGCCGTCGAGGAGCGGCCCAAGAAGGTGGCTAAGGTGGGCGTCCCCGCCGCCGCCGCCAAGGCCGCCGCCTCCCCCTCCCCCGGGAGTGGCGGCAAGAAGAAGAAGGGGAACGACGAGAACTCGGCGCCAAGGGCCACGGCCGCGGCGGCGGAGCAGGCGGTGGAGTACATCTCGTCGGAGGAGCTGGAGGCGGCGGCCAGCCCCAAGGCCAAGGCCGCGGGGCTGGTGCGCGGACCTGGACTCCAAGGACTGGGTCAGGACCTGCGAGGCGCTCAACGACGCGCGCCGCCTCGCGATCCACCACCCCGCGCTGCTGAACCCGATCCTGGAGAAGGTGGTGCTGGCGGTCGTGAAGACGATGAAGAGCCCCCGCAGCGCGGTGCTCAAGACGTCCATCATGGCCTGCGCCGACATCTTCAGTTCCTTCGGCAACCTCCTCGCCTCCGTCTCCGACGACACCTTCGACAAGCTGCTGCTCCAGCTCCTGCTGAAGGCGTCCCAGGACAAGCGGTTCGTGTGCGAGGAGGCCGAGAAGGCGACGCGCGCGATGGCGGCGTCGATGGCGCCGCTGCCGCTGCTGAAGAAGCTCAAGGCGTACGTCCACCACGCCAACCTCAGGGTCAGGGCTAAGGCCGCCGTCGCCATCTCCCACTGCGCCGCCCGGATGGACATCGGCGCGATGAAGGAGTTCGGGATGTCGGCGCTGCTGCAGCTGGCGGCGGAGCTGCTGAACGACCGGCTGCCGGAGGCGAGGGAGGCCGCCCGCGGCGTGGTGGCGTCGACGCACGCGGCCTTCGCCAAGGAGGCCGCCGCGAGCGGCCAGGAGGACGACGCGGCCGCGTCCTGGGAGAGCCTCTGCGCGCTCAGCCTCCCGCCCATCTCCGCGCAGGCCGTCGCCAAGATCGCTGCCGCCGCCGCCTCCTCGCAGTAGCCACTGCACGCGTGCGGACGTGCGCCGCTGGCGTTGATTTTGGGGGTCGTCTGGTTCGGTTCAGAAGTAGCGCTCGTGAGTCTTCAGACAGAGCTCGTTTGTCGCCGCCGCCGCCGAGTCTGTTTGTTTGTTCTTTCTACTCCATGCTATCTCGCATGGTTAGTGTTCTGTTTATGGCTTCGTCAAGTAATAACATATCAATT

SEQ ID NO: 869 - DNA, 1443 bp, Zea mays
  misc_feature (1)..(1443): Ceres cDNA ID no. 12373180
  misc_feature (1)..(1443): Ceres CLONE  ID no. 300040
  misc_feature (1)..(1443): Also known as  Ceres CDNA ID no. 23777467
agcattctagttctactgctgatcttctgcatggccatggtgaggaacccaagagaccttgaaacatactaggagtactagcagtagaggatttaaacctatcttggagtttgcaactggtatcttcttgcaagatcccaaggccaccgtaagatttgttgcagcgtgagacaggagctgcggctgcggaggaagtgagcaaaagcatggatctttccggcacgcagggcgagctgccgatggcaacaatgcacgccggcgggtcgccgtacctggggctgcaccacgggcacccacagcagcacaaccatggcgcgaacggccggcacatgtcgccgccggatgtggtggcggaggaggccaagaaccggcagctggcggtggtgcccgtgggcacaggaggcggaggcggggcaggggtgaggtaccgcgagtgcctgaagaaccacgcggctgccatcggcgggagcgcgacggacgggtgcggcgagttcatgcccgcgggcgaggaggggtcgctggacgcgctccggtgctcggcgtgcgggtgccaccgcaacttccaccgcaaggagccgccgggcggcgacgggcggcagctgtacgggcaccaccaccaccacccgctgagcccgctggccgcggtgcacccccaccatcaccgggggctgctggtggcggcgcttcccccggcgccgacgcgcatggtgatgccgctgagcgccgccatgcaccatcaccagcagccgccgcagcagcaccacagctcggcgtcagcggactccgacgacgcacacgtgccaggggtgcgcgggggggaggtgcagcagcagcagcaggcaccggcacggaagcggttccggaccaagttcaccgcggagcagaaggcccggatgctggggttcgcggaggacgccgggtggcggctgcagaagctggacgaggcggcggtgcagcgcttctgccaggaggtcggcgtgaagcggcgcgtgctcaaggtgtggatgcacaacaacaagcacaccctggcgcggcgcggccacgccgggctccccggcgacccggagctgctggggccgcacgacggccagctcggcatgccgctcccggagccggcggcggagcccgcagttgctgctgcggctgcggctggacttggagtgaccgaccaagccatgtctttcgggactggacgacattgatcaagagagtctaatgctgactgaatcagccttgcggcatagggaagctgttttctttgttaatctgctgctgatctcatcaatctagccgtagctttagctgcatttgcattccactgttccatccatcctagctatccatcaaccacaaactgatgatgcggagtctccatggatttctattccttgttgatttctgtagctgctctccccgctcttgactttaattttttagtgctcg

SEQ ID NO: 870 - protein, 1443 aa, Zea mays
  misc_feature: PFam Name: ZF-HD_dimer; PFam Description: ZF-HD protein
  misc_feature: PFam Name: Homeobox; PFam Description: Homeobox domain
  misc_feature: PFam Name: MARCKS; PFam Description: MARCKS family
  misc_feature: PFam Name: Pkinase; PFam Description: Protein kinase domain
  misc_feature: PFam Name: Drf_FH1; PFam Description: Formin Homology Region 1
  misc_feature: GI Number: 13374061; NR Description: ZF-HD homeobox protein
  misc_feature: GI Number: 5091602; NR Description: 10A19I.6 [Oryza sativa
  misc_feature: GI Number: 50251525; NR Description: putative ZF-HD homeobox
  misc_feature: GI Number: 13277218; NR Description: ZF-HD homeobox protein
  misc_feature: GI Number: 53689757; NR Description: ZF-HD homeobox
AGCATTCTAGTTCTACTGCTGATCTTCTGCATGGCCATGGTGAGGAACCCAAGAGACCTTGAAACATACTAGGAGTACTAGCAGTAGAGGATTTAAACCTATCTTGGAGTTTGCAACTGGTATCTTCTTGCAAGATCCCAAGGCCACCGTAAGATTTGTTGCAGCGTGAGACAGGAGCTGCGGCTGCGGAGGAAGTGAGCAAAAGCATGGATCTTTCCGGCACGCAGGGCGAGCTGCCGATGGCAACAATGCACGCCGGCGGGTCGCCGTACCTGGGGCTGCACCACGGGCACCCACAGCAGCACAACCATGGCGCGAACGGCCGGCACATGTCGCCGCCGGATGTGGTGGCGGAGGAGGCCAAGAACCGGCAGCTGGCGGTGGTGCCCGTGGGCACAGGAGGCGGAGGCGGGGCAGGGGTGAGGTACCGCGAGTGCCTGAAGAACCACGCGGCTGCCATCGGCGGGAGCGCGACGGACGGGTGCGGCGAGTTCATGCCCGCGGGCGAGGAGGGGTCGCTGGACGCGCTCCGGTGCTCGGCGTGCGGGTGCCACCGCAACTTCCACCGCAAGGAGCCGCCGGGCGGCGACGGGCGGCAGCTGTACGGGCACCACCACCACCACCCGCTGAGCCCGCTGGCCGCGGTGCACCCCCACCATCACCGGGGGCTGCTGGTGGCGGCGCTTCCCCCGGCGCCGACGCGCATGGTGATGCCGCTGAGCGCCGCCATGCACCATCACCAGCAGCCGCCGCAGCAGCACCACAGCTCGGCGTCAGCGGACTCCGACGACGCACACGTGCCAGGGGTGCGCGGGGGGGAGGTGCAGCAGCAGCAGCAGGCACCGGCACGGAAGCGGTTCCGGACCAAGTTCACCGCGGAGCAGAAGGCCCGGATGCTGGGGTTCGCGGAGGACGCCGGGTGGCGGCTGCAGAAGCTGGACGAGGCGGCGGTGCAGCGCTTCTGCCAGGAGGTCGGCGTGAAGCGGCGCGTGCTCAAGGTGTGGATGCACAACAACAAGCACACCCTGGCGCGGCGCGGCCACGCCGGGCTCCCCGGCGACCCGGAGCTGCTGGGGCCGCACGACGGCCAGCTCGGCATGCCGCTCCCGGAGCCGGCGGCGGAGCCCGCAGTTGCTGCTGCGGCTGCGGCTGGACTTGGAGTGACCGACCAAGCCATGTCTTTCGGGACTGGACGACATTGATCAAGAGAGTCTAATGCTGACTGAATCAGCCTTGCGGCATAGGGAAGCTGTTTTCTTTGTTAATCTGCTGCTGATCTCATCAATCTAGCCGTAGCTTTAGCTGCATTTGCATTCCACTGTTCCATCCATCCTAGCTATCCATCAACCACAAACTGATGATGCGGAGTCTCCATGGATTTCTATTCCTTGTTGATTTCTGTAGCTGCTCTCCCCGCTCTTGACTTTAATTTTTTAGTGCTCG

SEQ ID NO: 871 - DNA, 1806 bp, Zea mays
  misc_feature (1)..(1806): Ceres cDNA ID no. 12373188
  misc_feature (1)..(1806): Ceres CLONE  ID no. 299101
  misc_feature (1)..(1806): Also known as  Ceres CDNA ID no. 23847161
accagtcaaacaacgccaagcgcgcctcccgtgaacccagcggcccgtcaagtcaaagcatggacgtgccgctcccgctgctgctcggctccgtggccgtttccctcgtcgtgtggtgccttctgctccgccgcggcggggccgggaaggggaagcggccgctgccgcccggtccccggggctggccggtgctgggcaacctgccgcaggtcggcgccaagccgcaccacaccatgtgtgctctggcgcgggagtacggcccgctgttccggctccggttcggcagcgccgaggtggtggtggccgcgtcggcgcgggtggcggcccagttcctgcgcgcccacgacgccaacttcagcaaccgcccgcccaactccggggccgagcacgtggcgtacaactaccaggacctggtgttcgccccgtacggctcccggtggcgcgcgctacggaagctgtgcgcgctccacctcttctccgccaaggccctggacgacctgcgcggcgtcagggagggcgaggtggcgctcatggtgagggagctcgcccggcagggagagcgagaacgggccgccgtggcgctgggccaggtggccaacgtctgcgcgaccaacacgctggcccgggcgaccgtgggccggcgcgtgttcgccgtcgacggaggggagggcgccagggagttcaaggagatggtggtggagctgatgcagctcgccggggtcttcaacgtcggggacttcgtgccggcgctcgcgtggctcgacccgcagggcgtggtcggcaggatgaagcggctgcaccgcaggtacgacgacatgatgaacgggatcatcagggagaggaaggccgccgaggaaggcaaggacctgctcagcgtgctgctggccaggatgcgggagcagcagccgctagcggagggcgacgacactaggttcaacgagactgacatcaaggcacttctcctgaacctcttcacggctgggacggacacgacatccagcacggtggagtgggcgctggccgagctgatccggcatccggacgtgctcaggaaggcccagcaggagctcgacgccgtcgtcggccgcgaccgcctcgtctccgagtcggacctcccgcgcctcacgtacctcacggcggtgatcaaggagacgttccgtctgcacccgtccacgccgctgtcgctgccccgcgtcgccgccgaggagtgcgaggtggacgggttccgcatccccgccggcaccacgctgctggtgaacgtgtgggcgatcgcccgagacccggaggcgtggcccgagcctctcgagttccggcccggccgcttcctcccgggcggctcgcacgcgggagtcgatgtcaaagggagcgacttcgagctcatcccgttcggcgccggccggagaatctgcgcgggcctcagctggggtctgcggatggtcacgctcatgacggccacgctggtgcacgccctggactgggacctcgccgacggcatgaccgcggacaagctggacatggaggaggcctacgggctcaccctgcagcgcgccgtgccgttaatggtccgcccagcacccagactgctgccgtctgcttacgcagagtagaaatcgatgctcgccggccggccatatccatgccgtccgtatgcatggatgcatggtcaaataaataagcgttgtacgtgggtatcggtgtcacaaactcacaatgtgtatcatgtattgcttcgtcagtggcgtgtgtaagcgtccgtttttttttgtattttattctttttccagaaaaaatcaccgttgaaatcgc

SEQ ID NO: 872 - protein, 1806 aa, Zea mays
  misc_feature: PFam Name: p450; PFam Description: Cytochrome P450
  misc_feature: GI Number: 44889632; NR Description: flavonoid 3'-hydroxylase
  misc_feature: GI Number: 28603528; NR Description: flavonoid 3'-hydroxylase [Glycine max] >gi|28603526|gb|AAO47846.1| flavonoid 3'-hydroxylase [Glycine max] >gi|18148451|dbj|BAB83261.1| flavonoid 3'-hydroxylase
  misc_feature: GI Number: 38093216; NR Description: flavonoid 3'-hydroxylase [Ipomoea nil] >gi|38093210|dbj|BAD00187.1| flavonoid 3'-hydroxylase
  misc_feature: GI Number: 38093218; NR Description: flavonoid 3'-hydroxylase [Ipomoea purpurea] >gi|38093212|dbj|BAD00188.1| flavonoid 3'-hydroxylase [Ipomoea purpurea] >gi|37694931|gb|AAR00229.1|
  misc_feature: GI Number: 42821962; NR Description: flavonoid 3'-hydroxylase
ACCAGTCAAACAACGCCAAGCGCGCCTCCCGTGAACCCAGCGGCCCGTCAAGTCAAAGCATGGACGTGCCGCTCCCGCTGCTGCTCGGCTCCGTGGCCGTTTCCCTCGTCGTGTGGTGCCTTCTGCTCCGCCGCGGCGGGGCCGGGAAGGGGAAGCGGCCGCTGCCGCCCGGTCCCCGGGGCTGGCCGGTGCTGGGCAACCTGCCGCAGGTCGGCGCCAAGCCGCACCACACCATGTGTGCTCTGGCGCGGGAGTACGGCCCGCTGTTCCGGCTCCGGTTCGGCAGCGCCGAGGTGGTGGTGGCCGCGTCGGCGCGGGTGGCGGCCCAGTTCCTGCGCGCCCACGACGCCAACTTCAGCAACCGCCCGCCCAACTCCGGGGCCGAGCACGTGGCGTACAACTACCAGGACCTGGTGTTCGCCCCGTACGGCTCCCGGTGGCGCGCGCTACGGAAGCTGTGCGCGCTCCACCTCTTCTCCGCCAAGGCCCTGGACGACCTGCGCGGCGTCAGGGAGGGCGAGGTGGCGCTCATGGTGAGGGAGCTCGCCCGGCAGGGAGAGCGAGAACGGGCCGCCGTGGCGCTGGGCCAGGTGGCCAACGTCTGCGCGACCAACACGCTGGCCCGGGCGACCGTGGGCCGGCGCGTGTTCGCCGTCGACGGAGGGGAGGGCGCCAGGGAGTTCAAGGAGATGGTGGTGGAGCTGATGCAGCTCGCCGGGGTCTTCAACGTCGGGGACTTCGTGCCGGCGCTCGCGTGGCTCGACCCGCAGGGCGTGGTCGGCAGGATGAAGCGGCTGCACCGCAGGTACGACGACATGATGAACGGGATCATCAGGGAGAGGAAGGCCGCCGAGGAAGGCAAGGACCTGCTCAGCGTGCTGCTGGCCAGGATGCGGGAGCAGCAGCCGCTAGCGGAGGGCGACGACACTAGGTTCAACGAGACTGACATCAAGGCACTTCTCCTGAACCTCTTCACGGCTGGGACGGACACGACATCCAGCACGGTGGAGTGGGCGCTGGCCGAGCTGATCCGGCATCCGGACGTGCTCAGGAAGGCCCAGCAGGAGCTCGACGCCGTCGTCGGCCGCGACCGCCTCGTCTCCGAGTCGGACCTCCCGCGCCTCACGTACCTCACGGCGGTGATCAAGGAGACGTTCCGTCTGCACCCGTCCACGCCGCTGTCGCTGCCCCGCGTCGCCGCCGAGGAGTGCGAGGTGGACGGGTTCCGCATCCCCGCCGGCACCACGCTGCTGGTGAACGTGTGGGCGATCGCCCGAGACCCGGAGGCGTGGCCCGAGCCTCTCGAGTTCCGGCCCGGCCGCTTCCTCCCGGGCGGCTCGCACGCGGGAGTCGATGTCAAAGGGAGCGACTTCGAGCTCATCCCGTTCGGCGCCGGCCGGAGAATCTGCGCGGGCCTCAGCTGGGGTCTGCGGATGGTCACGCTCATGACGGCCACGCTGGTGCACGCCCTGGACTGGGACCTCGCCGACGGCATGACCGCGGACAAGCTGGACATGGAGGAGGCCTACGGGCTCACCCTGCAGCGCGCCGTGCCGTTAATGGTCCGCCCAGCACCCAGACTGCTGCCGTCTGCTTACGCAGAGTAGAAATCGATGCTCGCCGGCCGGCCATATCCATGCCGTCCGTATGCATGGATGCATGGTCAAATAAATAAGCGTTGTACGTGGGTATCGGTGTCACAAACTCACAATGTGTATCATGTATTGCTTCGTCAGTGGCGTGTGTAAGCGTCCGTTTTTTTTTGTATTTTATTCTTTTTCCAGAAAAAATCACCGTTGAAATCGC

SEQ ID NO: 873 - DNA, 1681 bp, Zea mays
  misc_feature (1)..(1681): Ceres cDNA ID no. 12373285
  misc_feature (1)..(1681): Ceres CLONE  ID no. 280019
  misc_feature (1)..(1681): Also known as  Ceres CDNA ID no. 23759551
atcgcgtgcgctctgtggaccgtggtggcgactactgggtggccgccgccacccccgctcggccgccctacgccaggtgctcaccgtcttcgggaccttcgccggcaacgaacactcaccagggaggatgttgcccttgtttagacactgctgtgcctttggaagtcatcatcctcatcccttaatttggaggaacatcttccaaacatcgcgaagagaacaaaaacaaatcaggagttgggatgcacagtgctcagcaaatcaggatcaagcttctatagagaaatgcaatgctccaaagaatttaccaatacctgataattcacttctcgatgctcgtattctctattgtacctctcctgccctgggtcataacaaagaagcacacccagaatcgaacaaaagagttcctgtgatagttgatactcttgagaaattggagcttagtcccaagcatcgtggttcacaggttcttgaaattcaaaatttcaaccctgcttctctagatgatgttgcacgagttcattcaagatcttacatcactggactagaaaaggctatgggcagagcttcagatgaaggtctgatattgattgaagggacaggaccaacatacgctacagaaactactttccgagaatcacttctatcagctggtgccggaatcacactggttgattcagtggtcgcagcgtcaaagttaggtcctaatccgccccttggctttgcattgataaggccaccaggacatcatgctgttcctcaaggtcccatgggtttttgtgtctttgggaacattgcagtggcagctcggtacgctcagcatcaacatggactaaagcgtgtgatgataatagattttgatgttcaccatggcaatgggacgtcagattcattttatgatgatccagatatcttcttcttgtcaactcaccagcttggaagctaccctggtactggtaagatcaatgaagtcggacagggtgatggtgaaggcacgacactcaaccttcctctgcccggtggcgcaggtgactacgcaatgagatgtgcatttgatgaggtcattgctccatcggcccatcgattcaagcctgatataatccttgtatcagctggatacgacgcacacgcgctggaccctctggctggccttcagttcacaacaggcacgttctacatgctggcatccagcatcaagcaggtgaccaaggaactctgtggtggccgctgtgtcttcttcctggaaggcgggtacaacctgcagtcgctctccagctccgttgccgacacgttccgtgcattccttgatgagcccagcctcgcagcacagtttgatgatccagcgatacttttcgaagagccgactcggaagatcaaggaagcaatcgagaaggccaagagcatccactcactctaggctgtcagctaattttccccccaatccccagaaatcccggaggggtagccctaaattgggaaaaggtgctgtcagcagtgtgcactgcagaactgcaagatcttgtggcaattggcattttgcaggtaggtagtgcatagtttgaacttggaaggcatggtcattttaatttagccaattctcaccagaaaatggaattaccgttctctcaatactagctgtatatattgaccaaaagttatgtgctacattattaatttt

SEQ ID NO: 874 - protein, 1681 aa, Zea mays
  misc_feature: PFam Name: Hist_deacetyl; PFam Description: Histone
  misc_feature: GI Number: 21360523; NR Description: AT4g33470/F17M5_230 [Arabidopsis thaliana] >gi|15529220|gb|AAK97704.1| AT4g33470/F17M5_230 [Arabidopsis thaliana] >gi|18418220|ref|NP_567921.1| histone deacetylase family protein
  misc_feature: GI Number: 52550445; NR Description: acetoin utilization
  misc_feature: GI Number: 52352410; NR Description: acetoin utilization
  misc_feature: GI Number: 52548847; NR Description: acetoin utilization
  misc_feature: GI Number: 52549274; NR Description: acetoin utilization
ATCGCGTGCGCTCTGTGGACCGTGGTGGCGACTACTGGGTGGCCGCCGCCACCCCCGCTCGGCCGCCCTACGCCAGGTGCTCACCGTCTTCGGGACCTTCGCCGGCAACGAACACTCACCAGGGAGGATGTTGCCCTTGTTTAGACACTGCTGTGCCTTTGGAAGTCATCATCCTCATCCCTTAATTTGGAGGAACATCTTCCAAACATCGCGAAGAGAACAAAAACAAATCAGGAGTTGGGATGCACAGTGCTCAGCAAATCAGGATCAAGCTTCTATAGAGAAATGCAATGCTCCAAAGAATTTACCAATACCTGATAATTCACTTCTCGATGCTCGTATTCTCTATTGTACCTCTCCTGCCCTGGGTCATAACAAAGAAGCACACCCAGAATCGAACAAAAGAGTTCCTGTGATAGTTGATACTCTTGAGAAATTGGAGCTTAGTCCCAAGCATCGTGGTTCACAGGTTCTTGAAATTCAAAATTTCAACCCTGCTTCTCTAGATGATGTTGCACGAGTTCATTCAAGATCTTACATCACTGGACTAGAAAAGGCTATGGGCAGAGCTTCAGATGAAGGTCTGATATTGATTGAAGGGACAGGACCAACATACGCTACAGAAACTACTTTCCGAGAATCACTTCTATCAGCTGGTGCCGGAATCACACTGGTTGATTCAGTGGTCGCAGCGTCAAAGTTAGGTCCTAATCCGCCCCTTGGCTTTGCATTGATAAGGCCACCAGGACATCATGCTGTTCCTCAAGGTCCCATGGGTTTTTGTGTCTTTGGGAACATTGCAGTGGCAGCTCGGTACGCTCAGCATCAACATGGACTAAAGCGTGTGATGATAATAGATTTTGATGTTCACCATGGCAATGGGACGTCAGATTCATTTTATGATGATCCAGATATCTTCTTCTTGTCAACTCACCAGCTTGGAAGCTACCCTGGTACTGGTAAGATCAATGAAGTCGGACAGGGTGATGGTGAAGGCACGACACTCAACCTTCCTCTGCCCGGTGGCGCAGGTGACTACGCAATGAGATGTGCATTTGATGAGGTCATTGCTCCATCGGCCCATCGATTCAAGCCTGATATAATCCTTGTATCAGCTGGATACGACGCACACGCGCTGGACCCTCTGGCTGGCCTTCAGTTCACAACAGGCACGTTCTACATGCTGGCATCCAGCATCAAGCAGGTGACCAAGGAACTCTGTGGTGGCCGCTGTGTCTTCTTCCTGGAAGGCGGGTACAACCTGCAGTCGCTCTCCAGCTCCGTTGCCGACACGTTCCGTGCATTCCTTGATGAGCCCAGCCTCGCAGCACAGTTTGATGATCCAGCGATACTTTTCGAAGAGCCGACTCGGAAGATCAAGGAAGCAATCGAGAAGGCCAAGAGCATCCACTCACTCTAGGCTGTCAGCTAATTTTCCCCCCAATCCCCAGAAATCCCGGAGGGGTAGCCCTAAATTGGGAAAAGGTGCTGTCAGCAGTGTGCACTGCAGAACTGCAAGATCTTGTGGCAATTGGCATTTTGCAGGTAGGTAGTGCATAGTTTGAACTTGGAAGGCATGGTCATTTTAATTTAGCCAATTCTCACCAGAAAATGGAATTACCGTTCTCTCAATACTAGCTGTATATATTGACCAAAAGTTATGTGCTACATTATTAATTTT

SEQ ID NO: 875 - DNA, 2062 bp, Zea mays
  misc_feature (1)..(2062): Ceres cDNA ID no. 12373375
  misc_feature (1)..(2062): Ceres CLONE  ID no. 259530
  misc_feature (1)..(2062): Also known as  Ceres CDNA ID no. 24398502
ctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaggacagcctggcgttccagtcgcgtctgctggccaagtccggcatcggcgacgagtcgtacatgccgcgctgcgtgttcgagcccaacgccagctgcgccaccatgaaggagggccgcgccgaggcgtccacggccatgttcgcggcgctggacgagctgttcgacaagtgccgcgtccggcccaaggacgtgggcgtgctggtggtcaactgcagcctcttcaacccgacgccctccctgtccgccatgatcgtcaaccactacaagatgcgcggcaacatcctgagctacaacctgggggggcatgggctgcagcggcgggcgtcatcgccatcgatctggcccgcgacatgctccaggccagcggcgcgggcctggccgtggtggtcagcacggaggccgtctccttcacgtggtaccccgggaagcggcgctccatgctcatcccgaacgccttcttccgggccggctgcgcggcggtgctgctgtccaaccggcgccgcgacttccaccgcgccaagtaccagctggagcacgtggtgcgcacgcacaagggcgcggacgaccgcgccttccgctccgtgtaccaggaggaggacgagcagcggatcaagggcctgtccatcagccgcgacctgctggaggtgggcggccacgcgctcaagaccaacatcaccacgctggggcccctggtgctgcccttctccgagcagctgctcttcttcgcgggcgtgctgttccgccacctgttcccgtccaaggcctccacgccggcgccgccgaccaccccaggggacgcctcggccgccgcgccctacatcccggacttcaagcgcgcgttcgagcacttctgcatgcacgcggccagccgcgacgtgctggagcacctgcagagcaacctgggcctgcgcaacgccgacctggaggcctcccgcgccgcgctgcaccgcttcggcaacacctcaagcagcagcatctggtacgagctggcgtacctggaggccaagggccgcgtccgccgcggcgaccgcgtctggcagctcgccttcgggtcgggcttcaagtgcaacagcgcggtgtggcgcgccgtccgccgcgtgcgccgccccgcgcgcagcccctggctgggactgcgtcgaccagtacccggcgcgcatggacgcctagcacgtacctgcaatgcagtggctgctatctatctatcgctcgcttcgctaccactaccagtgcagtgctgcacttcaccgatggatgatggatcggatatgatatggtataggacgcggtcggtcgatttgcatgcatgcacaagtgttagtataccgttctgaaggtacgtttgaactttgttcgtttgtattgcactattgcttgttgtttaagtagcggttaagggaggcatacgtacgctgtactaccataatggaagtactccggtccggtcctgtcctgtgtgagccttatgtacgtgcaattttaatgtgttttggt

SEQ ID NO: 876 - protein, 2062 aa, Zea mays
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: Pyr_redox_2; PFam Description: Pyridine
  misc_feature: PFam Name: SerH; PFam Description: Cell surface
  misc_feature: PFam Name: Keratin_B2; PFam Description: Keratin, high
  misc_feature: GI Number: 23506207; NR Description: At2g26250/T1D16.11 [Arabidopsis thaliana] >gi|12597467|gb|AAG60062.1| putative beta-ketoacyl-CoA synthase FIDDLEHEAD [Arabidopsis thaliana] >gi|3559809|emb|CAA09311.1| fiddlehead protein [Arabidopsis
  misc_feature: GI Number: 32172502; NR Description: FAE1 [Marchantia polymorpha]
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 8177711; NR Description: fiddlehead protein
  misc_feature: GI Number: 8177719; NR Description: fiddlehead protein
CTCTCACTACCACCACCACTGCCCCGGATCCATACCAGCTGCAGCAGCAGCGCGCGCGAGCTAGCTTCGGTCGGTCGATAGATCGATCGATCGCTCGGCCATCATGGCGCGGGAGGAGCAGGCGCTGCTGTCGACGGAGATCGTGAACCGCGGCGTGGAGCCGTCGGGCCCGGACGCCGGCTCGCCGGCCTTCTCGGTGCGCGTGCGCCGCCGCCTGCCGGACTTCCTGCAGTCGGTGAACCTCAAGTACGTGCGCCTCGGGTACCACTACCTCATCAGCCACGGCGTGTACCTGGCCACCATCCCCGTCATCGTGCTGGTGTGCGGCGCCGAGCTGGGCAGCCTCAGCCGCGACGAGCTGTGGCGCAAGGTGTGGGGGGAGGCCACCTACGACCTCGCCACCGTGCTCGCCTTCCTCGCCGTCCTCGCCTTCACCATCTCCGTCTACATCATGTCCAGGCCCAGGCCCGTGTACCTCATCGACTTCGCATGCTACAAGCCGGCCGACGAGCTCAAGGTGTCCAAGGCGGAGTTCATCGACCTGGCGCGCAAGTCCGGCAAGTTCGACGAGGACAGCCTGGCGTTCCAGTCGCGTCTGCTGGCCAAGTCCGGCATCGGCGACGAGTCGTACATGCCGCGCTGCGTGTTCGAGCCCAACGCCAGCTGCGCCACCATGAAGGAGGGCCGCGCCGAGGCGTCCACGGCCATGTTCGCGGCGCTGGACGAGCTGTTCGACAAGTGCCGCGTCCGGCCCAAGGACGTGGGCGTGCTGGTGGTCAACTGCAGCCTCTTCAACCCGACGCCCTCCCTGTCCGCCATGATCGTCAACCACTACAAGATGCGCGGCAACATCCTGAGCTACAACCTGGGGGGGCATGGGCTGCAGCGGCGGGCGTCATCGCCATCGATCTGGCCCGCGACATGCTCCAGGCCAGCGGCGCGGGCCTGGCCGTGGTGGTCAGCACGGAGGCCGTCTCCTTCACGTGGTACCCCGGGAAGCGGCGCTCCATGCTCATCCCGAACGCCTTCTTCCGGGCCGGCTGCGCGGCGGTGCTGCTGTCCAACCGGCGCCGCGACTTCCACCGCGCCAAGTACCAGCTGGAGCACGTGGTGCGCACGCACAAGGGCGCGGACGACCGCGCCTTCCGCTCCGTGTACCAGGAGGAGGACGAGCAGCGGATCAAGGGCCTGTCCATCAGCCGCGACCTGCTGGAGGTGGGCGGCCACGCGCTCAAGACCAACATCACCACGCTGGGGCCCCTGGTGCTGCCCTTCTCCGAGCAGCTGCTCTTCTTCGCGGGCGTGCTGTTCCGCCACCTGTTCCCGTCCAAGGCCTCCACGCCGGCGCCGCCGACCACCCCAGGGGACGCCTCGGCCGCCGCGCCCTACATCCCGGACTTCAAGCGCGCGTTCGAGCACTTCTGCATGCACGCGGCCAGCCGCGACGTGCTGGAGCACCTGCAGAGCAACCTGGGCCTGCGCAACGCCGACCTGGAGGCCTCCCGCGCCGCGCTGCACCGCTTCGGCAACACCTCAAGCAGCAGCATCTGGTACGAGCTGGCGTACCTGGAGGCCAAGGGCCGCGTCCGCCGCGGCGACCGCGTCTGGCAGCTCGCCTTCGGGTCGGGCTTCAAGTGCAACAGCGCGGTGTGGCGCGCCGTCCGCCGCGTGCGCCGCCCCGCGCGCAGCCCCTGGCTGGGACTGCGTCGACCAGTACCCGGCGCGCATGGACGCCTAGCACGTACCTGCAATGCAGTGGCTGCTATCTATCTATCGCTCGCTTCGCTACCACTACCAGTGCAGTGCTGCACTTCACCGATGGATGATGGATCGGATATGATATGGTATAGGACGCGGTCGGTCGATTTGCATGCATGCACAAGTGTTAGTATACCGTTCTGAAGGTACGTTTGAACTTTGTTCGTTTGTATTGCACTATTGCTTGTTGTTTAAGTAGCGGTTAAGGGAGGCATACGTACGCTGTACTACCATAATGGAAGTACTCCGGTCCGGTCCTGTCCTGTGTGAGCCTTATGTACGTGCAATTTTAATGTGTTTTGGT

SEQ ID NO: 877 - DNA, 1481 bp, Zea mays
  misc_feature (1)..(1481): Ceres cDNA ID no. 12373728
  misc_feature (1)..(1481): Ceres CLONE  ID no. 279323
  misc_feature (1)..(1481): Also known as  Ceres CDNA ID no. 23779330
aaaaagcgtgtgcgacagaggaagtccatgtgcccggctcggccctgccacggccacgcacagcagaggagcccgcaagcccgcgcgctccccgccaagatttgccaccaataccccggtcctccactcctcctctcctccgcgagctccgtctccccccctcgcgcgaacgccgggcgcacgcagccaggccaggtatccccccggccccaaccaaaccatcgcatgggagccgcgactggcccgacgaagcggagccgcgtccccagcaagaggcagcaggaggaggaggccatggcgcgcgctgcgggcgtggaggcgcaggcgcaggcgcggcggcggccacggctggtggggtacgaggagctgccggagtacctcaaggacaacgagtacatccgcgggcactaccgcgccgagtggcccgtccgcgacgcgctcctcagcgccttcgcctggcacaacgagactctcaacgtgtggacgcatctcggcgggttcctgtttttcctggcgctcgcggtcgccggagggtggacggaggccgccgacgaagccgctccggggatcatgaggttcgtggtgacaccaccagctaacgcttcgtgggacgtgctgcattcgggtctgccaagccacgacggcagggcgtcgcagtccggcgtgccgcggtggccgcggacggtgttcctggtgggcgccatgtcgtgcctggccatcagcgcgacggcccacctgctggcgtgccactcgcggcgcgccagcgtggtgttctggcagctcgactacgcgggcatctccgtgatgatcgtcgcctccttcgtgccgccggtgtactacgccttcctctgccacccgccggcgcgggcggccatacctgtccgccatcgcggcgctgggcgcgctcgtggtggccgcgctgctctccccgtcctgctcgtccccgcgctaccgccgcctccgcgcggcgctgttcctggccatgggcctgtcgggcgtcgtcccggcgctgcacgcgctgtggctcaactggggccacgccgcctgctacctggcgctcggcctcgaggtcgccatgggtctcgcctacgccacgggcgcatggttctacgtcagccgcgtgccggagaagtggaggcccggggtgttcgacgtcgtgggccacagccaccagatcttccacgtgctcgtgctcgtcggcgccgtcacgcactacgtcgccgtcgccgtgctcatccactggcgggagaaggtggctgccgcctgtggcgcggcgtcgtaggcgggcttgctgctcctggcttctgcagcaagccagctgaggtgtttgatcatccagagcttcaatgtgccagtgcgatggattcaacaagcgttcgaatcggcgaacgaagtagttgcagttgcagttgcagcatagatcggctctagagttcgacgatttgtaatttaattgatgggatgattgagtatggtggtcc

SEQ ID NO: 878 - protein, 1481 aa, Zea mays
  misc_feature: PFam Name: HlyIII; PFam Description: Haemolysin-III related
  misc_feature: GI Number: 50252081; NR Description: putative adiponectin
  misc_feature: GI Number: 51535032; NR Description: putative adiponectin
  misc_feature: GI Number: 40805092; NR Description: adiponectin receptor 1
  misc_feature: GI Number: 38018665; NR Description: progestin and adipoQ receptor family member I [Mus musculus] >gi|38259186|ref|NP_082596.2| adiponectin receptor 1; progestin and adipoQ receptor family member I [Mus musculus]
  misc_feature: GI Number: 4929559; NR Description: CGI-45 protein [Homo sapiens]
AAAAAGCGTGTGCGACAGAGGAAGTCCATGTGCCCGGCTCGGCCCTGCCACGGCCACGCACAGCAGAGGAGCCCGCAAGCCCGCGCGCTCCCCGCCAAGATTTGCCACCAATACCCCGGTCCTCCACTCCTCCTCTCCTCCGCGAGCTCCGTCTCCCCCCCTCGCGCGAACGCCGGGCGCACGCAGCCAGGCCAGGTATCCCCCCGGCCCCAACCAAACCATCGCATGGGAGCCGCGACTGGCCCGACGAAGCGGAGCCGCGTCCCCAGCAAGAGGCAGCAGGAGGAGGAGGCCATGGCGCGCGCTGCGGGCGTGGAGGCGCAGGCGCAGGCGCGGCGGCGGCCACGGCTGGTGGGGTACGAGGAGCTGCCGGAGTACCTCAAGGACAACGAGTACATCCGCGGGCACTACCGCGCCGAGTGGCCCGTCCGCGACGCGCTCCTCAGCGCCTTCGCCTGGCACAACGAGACTCTCAACGTGTGGACGCATCTCGGCGGGTTCCTGTTTTTCCTGGCGCTCGCGGTCGCCGGAGGGTGGACGGAGGCCGCCGACGAAGCCGCTCCGGGGATCATGAGGTTCGTGGTGACACCACCAGCTAACGCTTCGTGGGACGTGCTGCATTCGGGTCTGCCAAGCCACGACGGCAGGGCGTCGCAGTCCGGCGTGCCGCGGTGGCCGCGGACGGTGTTCCTGGTGGGCGCCATGTCGTGCCTGGCCATCAGCGCGACGGCCCACCTGCTGGCGTGCCACTCGCGGCGCGCCAGCGTGGTGTTCTGGCAGCTCGACTACGCGGGCATCTCCGTGATGATCGTCGCCTCCTTCGTGCCGCCGGTGTACTACGCCTTCCTCTGCCACCCGCCGGCGCGGGCGGCCATACCTGTCCGCCATCGCGGCGCTGGGCGCGCTCGTGGTGGCCGCGCTGCTCTCCCCGTCCTGCTCGTCCCCGCGCTACCGCCGCCTCCGCGCGGCGCTGTTCCTGGCCATGGGCCTGTCGGGCGTCGTCCCGGCGCTGCACGCGCTGTGGCTCAACTGGGGCCACGCCGCCTGCTACCTGGCGCTCGGCCTCGAGGTCGCCATGGGTCTCGCCTACGCCACGGGCGCATGGTTCTACGTCAGCCGCGTGCCGGAGAAGTGGAGGCCCGGGGTGTTCGACGTCGTGGGCCACAGCCACCAGATCTTCCACGTGCTCGTGCTCGTCGGCGCCGTCACGCACTACGTCGCCGTCGCCGTGCTCATCCACTGGCGGGAGAAGGTGGCTGCCGCCTGTGGCGCGGCGTCGTAGGCGGGCTTGCTGCTCCTGGCTTCTGCAGCAAGCCAGCTGAGGTGTTTGATCATCCAGAGCTTCAATGTGCCAGTGCGATGGATTCAACAAGCGTTCGAATCGGCGAACGAAGTAGTTGCAGTTGCAGTTGCAGCATAGATCGGCTCTAGAGTTCGACGATTTGTAATTTAATTGATGGGATGATTGAGTATGGTGGTCC

SEQ ID NO: 879 - DNA, 1482 bp, Zea mays
  misc_feature (1)..(1482): Ceres cDNA ID no. 12373828
  misc_feature (1)..(1482): Ceres CLONE  ID no. 260287
  misc_feature (1)..(1482): Also known as  Ceres CDNA ID no. 23766475
  misc_feature (1200)..(1200): n is a, c, t, g, unknown, or other
gcacgagaccattacctagaacatcctaatcaaaaaacggtctgctctctttctctctcttcccctattacgagtcccagcagctagaacaacacaaaccctctcctgtagctagatgtgtggtagtaagctctcgctgttaacctcggcaaagaacctactggaagtcggaagggaaaaagcaaagtaggagtagctagctagtatagcaaacaagctcccccgtgtgccgacgagccgccgactaggtcagccgccatggacttcgacgagcacgatgacggcgacgaggagatgacgccgatgcccgtgagctcgagctacgatgcgccgatgcagccggggctgggactgggcggaggaggcggcgagaccccgaagcacggggattctgctggagccgggagcttcaggacgccgccagcaggcggcttcgggggaggaggcgcaggcgcaggcgcaggcgcaggcggtggcggggccaccaggtaccgggagtgcctcaagaaccacgcggtcggcatcggcgggcacgcggtggacggctgcggcgaattcatggccgctggcgaggagggctccatcgacgcgctgcgctgcgcggcctgcggctgccaccgcaacttccaccgcaaggagtccgacaactcgccagcgggaggcgggggcgtcgcgccgcccgatcccgccgccgccctgtccccggccgccatcacagcctacggcgccgccgtggcggcgcaccaccaccagttctccccctactaccgcacccctgccgggtacttcctgcaccagcagctggcggccgccgccgggcacatgcagcgcccgctcgcgctgccgtccacctcccactcgctggggcgcgaagagggcgacgacgtgtccgggctgatcggccccatggtggtggcgcccatgatgggcatgtcgctgggcccgggcggcggcccgtcggggggctcgtccggcggctcggggtccggcaagaagcggttccgcaccaagttcacgcaggagcagaaggaccggatgctggcgttcgcggagcggctggggtggcgcatccagaagcacgacgaggccgccgtgcagcagttctgcgaggaggtctgcgtcaagcgccacgtgctcaaggtgtggatgcacaacaacaagcacaccctcggcaagaagccatgaccgaccgccggccanttcttcgcgccggcgcctgcactgtgtgctagctaggtacaccaccactgatcgcattgcatcatagatctcctcctctctttctcagcaccgtattgcttgctagccttttttttttgggggtactcctctccttgccttcctttttttagagttttagctagaaatgtaagctagctacttaggtcagtagcgagcagcagttcttggattttagctacgatggagaagacggccgttgttctcttgtcatcttcattattttattgtacttctttggcc

SEQ ID NO: 880 - protein, 1482 aa, Zea mays
  misc_feature: PFam Name: ZF-HD_dimer; PFam Description: ZF-HD protein
  misc_feature: PFam Name: Homeobox; PFam Description: Homeobox domain
  misc_feature: PFam Name: Amidohydro_1; PFam Description: Amidohydrolase family
  misc_feature: PFam Name: GRP; PFam Description: Glycine rich protein family
  misc_feature: PFam Name: MCPVI; PFam Description: Minor capsid protein VI
  misc_feature: GI Number: 50946893; NR Description: putative ZF-HD homeobox protein [Oryza sativa (japonica cultivar-group)] >gi|42408573|dbj|BAD09750.1| putative ZF-HD homeobox protein [Oryza
  misc_feature: GI Number: 50900288; NR Description: putative ZF-HD homeobox protein [Oryza sativa (japonica cultivar-group)] >gi|46806323|dbj|BAD17515.1| putative ZF-HD homeobox protein [Oryza
  misc_feature: GI Number: 62733875; NR Description: ZF-HD protein dimerisation region, putative [Oryza sativa (japonica
  misc_feature: GI Number: 50251525; NR Description: putative ZF-HD homeobox
  misc_feature: GI Number: 5091602; NR Description: 10A19I.6 [Oryza sativa
GCACGAGACCATTACCTAGAACATCCTAATCAAAAAACGGTCTGCTCTCTTTCTCTCTCTTCCCCTATTACGAGTCCCAGCAGCTAGAACAACACAAACCCTCTCCTGTAGCTAGATGTGTGGTAGTAAGCTCTCGCTGTTAACCTCGGCAAAGAACCTACTGGAAGTCGGAAGGGAAAAAGCAAAGTAGGAGTAGCTAGCTAGTATAGCAAACAAGCTCCCCCGTGTGCCGACGAGCCGCCGACTAGGTCAGCCGCCATGGACTTCGACGAGCACGATGACGGCGACGAGGAGATGACGCCGATGCCCGTGAGCTCGAGCTACGATGCGCCGATGCAGCCGGGGCTGGGACTGGGCGGAGGAGGCGGCGAGACCCCGAAGCACGGGGATTCTGCTGGAGCCGGGAGCTTCAGGACGCCGCCAGCAGGCGGCTTCGGGGGAGGAGGCGCAGGCGCAGGCGCAGGCGCAGGCGGTGGCGGGGCCACCAGGTACCGGGAGTGCCTCAAGAACCACGCGGTCGGCATCGGCGGGCACGCGGTGGACGGCTGCGGCGAATTCATGGCCGCTGGCGAGGAGGGCTCCATCGACGCGCTGCGCTGCGCGGCCTGCGGCTGCCACCGCAACTTCCACCGCAAGGAGTCCGACAACTCGCCAGCGGGAGGCGGGGGCGTCGCGCCGCCCGATCCCGCCGCCGCCCTGTCCCCGGCCGCCATCACAGCCTACGGCGCCGCCGTGGCGGCGCACCACCACCAGTTCTCCCCCTACTACCGCACCCCTGCCGGGTACTTCCTGCACCAGCAGCTGGCGGCCGCCGCCGGGCACATGCAGCGCCCGCTCGCGCTGCCGTCCACCTCCCACTCGCTGGGGCGCGAAGAGGGCGACGACGTGTCCGGGCTGATCGGCCCCATGGTGGTGGCGCCCATGATGGGCATGTCGCTGGGCCCGGGCGGCGGCCCGTCGGGGGGCTCGTCCGGCGGCTCGGGGTCCGGCAAGAAGCGGTTCCGCACCAAGTTCACGCAGGAGCAGAAGGACCGGATGCTGGCGTTCGCGGAGCGGCTGGGGTGGCGCATCCAGAAGCACGACGAGGCCGCCGTGCAGCAGTTCTGCGAGGAGGTCTGCGTCAAGCGCCACGTGCTCAAGGTGTGGATGCACAACAACAAGCACACCCTCGGCAAGAAGCCATGACCGACCGCCGGCCANTTCTTCGCGCCGGCGCCTGCACTGTGTGCTAGCTAGGTACACCACCACTGATCGCATTGCATCATAGATCTCCTCCTCTCTTTCTCAGCACCGTATTGCTTGCTAGCCTTTTTTTTTTGGGGGTACTCCTCTCCTTGCCTTCCTTTTTTTAGAGTTTTAGCTAGAAATGTAAGCTAGCTACTTAGGTCAGTAGCGAGCAGCAGTTCTTGGATTTTAGCTACGATGGAGAAGACGGCCGTTGTTCTCTTGTCATCTTCATTATTTTATTGTACTTCTTTGGCC

SEQ ID NO: 881 - DNA, 1825 bp, Zea mays
  misc_feature (1)..(1825): Ceres cDNA ID no. 12373878
  misc_feature (1)..(1825): Ceres CLONE  ID no. 245569
  misc_feature (1)..(1825): Also known as  Ceres CDNA ID no. 23768308
atcaactctatccagtttcctgtctcgtttcatattgttttcccagaaatggaccggatgtgatttgtattcgtttttatccctaaatctgagtttagggggatttttagggaaataatggaggtgctgtaagtacccttccgtctgtctctccctcactcccttcgcgacgactacgcccggtgctcttcttcggccccaggtagctttcgctgccgtcctacggcaggtgcccaagtcttcttcgggcccttcaacgacgacgagcactaccagtttgttgaagatggaaaataaagagttgttcaagatgggaagtgcagatacagatactgctgcactgcacaaggagtgggatgatgttctctgtccgatatgcatggaccatccgcacaatgctgtccttctgttgtgcagctcccatgacaaaggatgccgatcctatatatgtgatacaagctataggcattcaaattgcctagataggttcaagaaaatgaaagtgaatgatgaggacagtccttcacagtcaagctcgtccatgcctaggggtacaggaaaccaaaatgttgtccagagatctcgttttggtcccactagagagagccccaggctacacatagacatatctgtacccgatgaaacttccgatcatcaagatgccagccacagacctgctgccatagttggagaacaggaagaaaacatctacaatgaaggcccagatttgacattggaaactcacgaggttgggatcaatggttcttcagtgtcaagcgacgtgtcaagcttaaatcaattgttgtgcccactgtgcagaggggtggttagtggctggaagatcatcaaagaagctagacagtatttggatgggaaatccagagcttgctcacgagaagcctgcatgttttctggtaactacagggagatccgtagacatgccagaagggtgcaccccacaacaaggcctgctgatgttgatccatcaagacgtcgtgcgtggcaccacctggagcatcagcgggattatgctgacatagtaagcgcaataaggtccgctatgcctggggcagttgtgcttggtgattatgctattgaaggcggagaaatattttcacatgaccgggaaaccagtgaaccaagtgggtctcttctgacaacattctttctatttcatatgctcagcagtagtccgattagatcaggtgatgagccaagaggcacatcaaggggcctgagaaggcagaggagacgctatctgtggggagagaatttgttaggtctccaatatgatgatgatgatgacgacgacgataacgaaggggaggaggatgaagtggatgctgtggatgaagttcagagaccaaggagtcgccggaggttcataagatcaagatcagaggagcgggcctaatacattgtggagatgtggatgatgtgcttccttgcttggttaaaatgctgtgcgcatccctgcaatcaaagaccaaaaggcaaatggacctcaagttcaagtttagatgatttggatgcgtctgacaccatccatgtgccctctttaatctgacgatcataagaaacactcattcttagggcaaagctggactgctctcagaccagaactgacatggaagctagcgtttggagatgctcgctccatcacaacagctggtgccgtcactcattcaccatgcctttttacctttgcactgcgtgtcatctgcatctgtagtatattctttccgtattacgtctcattgagtccatgctgctactgttctggttgatatccttgttcaaaggctataaaatttattatattttc

SEQ ID NO: 882 - protein, 1825 aa, Zea mays
  misc_feature: GI Number: 34912600; NR Description: P0046B10.17 [Oryza sativa (japonica cultivar-group)] >gi|11034559|dbj|BAB17083.1| P0410E01.4 [Oryza sativa (japonica cultivar-group)] >gi|21104687|dbj|BAB93277.1| P0046B10.17 [Oryza sativa (japonica
  misc_feature: GI Number: 5103842; NR Description: F9L1.39 [Arabidopsis thaliana]
ATCAACTCTATCCAGTTTCCTGTCTCGTTTCATATTGTTTTCCCAGAAATGGACCGGATGTGATTTGTATTCGTTTTTATCCCTAAATCTGAGTTTAGGGGGATTTTTAGGGAAATAATGGAGGTGCTGTAAGTACCCTTCCGTCTGTCTCTCCCTCACTCCCTTCGCGACGACTACGCCCGGTGCTCTTCTTCGGCCCCAGGTAGCTTTCGCTGCCGTCCTACGGCAGGTGCCCAAGTCTTCTTCGGGCCCTTCAACGACGACGAGCACTACCAGTTTGTTGAAGATGGAAAATAAAGAGTTGTTCAAGATGGGAAGTGCAGATACAGATACTGCTGCACTGCACAAGGAGTGGGATGATGTTCTCTGTCCGATATGCATGGACCATCCGCACAATGCTGTCCTTCTGTTGTGCAGCTCCCATGACAAAGGATGCCGATCCTATATATGTGATACAAGCTATAGGCATTCAAATTGCCTAGATAGGTTCAAGAAAATGAAAGTGAATGATGAGGACAGTCCTTCACAGTCAAGCTCGTCCATGCCTAGGGGTACAGGAAACCAAAATGTTGTCCAGAGATCTCGTTTTGGTCCCACTAGAGAGAGCCCCAGGCTACACATAGACATATCTGTACCCGATGAAACTTCCGATCATCAAGATGCCAGCCACAGACCTGCTGCCATAGTTGGAGAACAGGAAGAAAACATCTACAATGAAGGCCCAGATTTGACATTGGAAACTCACGAGGTTGGGATCAATGGTTCTTCAGTGTCAAGCGACGTGTCAAGCTTAAATCAATTGTTGTGCCCACTGTGCAGAGGGGTGGTTAGTGGCTGGAAGATCATCAAAGAAGCTAGACAGTATTTGGATGGGAAATCCAGAGCTTGCTCACGAGAAGCCTGCATGTTTTCTGGTAACTACAGGGAGATCCGTAGACATGCCAGAAGGGTGCACCCCACAACAAGGCCTGCTGATGTTGATCCATCAAGACGTCGTGCGTGGCACCACCTGGAGCATCAGCGGGATTATGCTGACATAGTAAGCGCAATAAGGTCCGCTATGCCTGGGGCAGTTGTGCTTGGTGATTATGCTATTGAAGGCGGAGAAATATTTTCACATGACCGGGAAACCAGTGAACCAAGTGGGTCTCTTCTGACAACATTCTTTCTATTTCATATGCTCAGCAGTAGTCCGATTAGATCAGGTGATGAGCCAAGAGGCACATCAAGGGGCCTGAGAAGGCAGAGGAGACGCTATCTGTGGGGAGAGAATTTGTTAGGTCTCCAATATGATGATGATGATGACGACGACGATAACGAAGGGGAGGAGGATGAAGTGGATGCTGTGGATGAAGTTCAGAGACCAAGGAGTCGCCGGAGGTTCATAAGATCAAGATCAGAGGAGCGGGCCTAATACATTGTGGAGATGTGGATGATGTGCTTCCTTGCTTGGTTAAAATGCTGTGCGCATCCCTGCAATCAAAGACCAAAAGGCAAATGGACCTCAAGTTCAAGTTTAGATGATTTGGATGCGTCTGACACCATCCATGTGCCCTCTTTAATCTGACGATCATAAGAAACACTCATTCTTAGGGCAAAGCTGGACTGCTCTCAGACCAGAACTGACATGGAAGCTAGCGTTTGGAGATGCTCGCTCCATCACAACAGCTGGTGCCGTCACTCATTCACCATGCCTTTTTACCTTTGCACTGCGTGTCATCTGCATCTGTAGTATATTCTTTCCGTATTACGTCTCATTGAGTCCATGCTGCTACTGTTCTGGTTGATATCCTTGTTCAAAGGCTATAAAATTTATTATATTTTC

SEQ ID NO: 883 - DNA, 1177 bp, Zea mays
  misc_feature (1)..(1177): Ceres cDNA ID no. 12374151
  misc_feature (1)..(1177): Ceres CLONE  ID no. 219954
  misc_feature (1)..(1177): Also known as  Ceres CDNA ID no. 23768179
atcagatctccagctagcttccttgctacttactcccctacccgctgcaccctcgccatggatccgccgagctccgatatcgtagtcgacactccatacttccgcatctacagtgaccggcgcatcgaccgcttggtcggcaccgataccgtgccggcgggctttgatcccaccaccggcgtcacctccaaagacgtcgttgtagacagcgacgccggcgtctacgttcgcctgtacctcccggacacggctacggggtccgatgattccaagaagctcccggtgctagtctacttccacggcggcggctttgtcacccactcggcagcgtctccgccctatcagtccttcctcaacaccctggccgcgaaggccggcctgctcatcgtctccgtgaactaccgcctcgcgccagagcacccgctgcctgcaggctacgaggactccttccgcgcgctcaggtggacggcctctggtagcggggacccctggctgtcacatcacggcgacctgggccgcatcttcctggccggcgacagcgccggtgggaacttcgtccacaacatcgctgtgatggcagccgcgtcggaggtgccagtgcgaatcaggggtgcggtcctcctgcacgcggggttcggtggcagggagcgcatcgacggagagacgccggagactgtggcgctgatggagaagctgtggggggtcgtgtgcctcgaggcgacggacggcctgaacgacccgcggataaatccgttggctgccgccgcggcgccgagcctgcggaacctgccgtgtgagagggtgctcgtctgcgcggcagagttggacttcctgcggccgaggaacagggcgtactacgaggccctcgcagcaagctggcggggcggcacggtggagtggttcgagtcgaagggcaaggagcacgtcttcttcctctacaaccccggctgcggcgaggccgtggagctcatggatcgtctggtcgcgttctttgctgggaactgaaattcgtcatgtgtggatgtgaccgcgaccacatccacatgcagtgagacggatggatcaaacgaagatgcagctcatcgccgaatcgaatggttgagctgtgtccaggaaaagaaaactaaaagtgactagaataattgagctcggagccttggattgatcagtttgtgct

SEQ ID NO: 884 - protein, 1177 aa, Zea mays
  misc_feature: PFam Name: Abhydrolase_3; PFam Description: alpha/beta
  misc_feature: PFam Name: COesterase; PFam Description: Carboxylesterase
  misc_feature: GI Number: 51535280; NR Description: putative PrMC3 [Oryza
  misc_feature: GI Number: 51535271; NR Description: putative PrMC3 [Oryza
  misc_feature: GI Number: 51536295; NR Description: putative PrMC3 [Oryza sativa (japonica cultivar-group)] >gi|51535241|dbj|BAD38290.1|
  misc_feature: GI Number: 51535273; NR Description: putative PrMC3 [Oryza
  misc_feature: GI Number: 51535268; NR Description: putative PrMC3 [Oryza
ATCAGATCTCCAGCTAGCTTCCTTGCTACTTACTCCCCTACCCGCTGCACCCTCGCCATGGATCCGCCGAGCTCCGATATCGTAGTCGACACTCCATACTTCCGCATCTACAGTGACCGGCGCATCGACCGCTTGGTCGGCACCGATACCGTGCCGGCGGGCTTTGATCCCACCACCGGCGTCACCTCCAAAGACGTCGTTGTAGACAGCGACGCCGGCGTCTACGTTCGCCTGTACCTCCCGGACACGGCTACGGGGTCCGATGATTCCAAGAAGCTCCCGGTGCTAGTCTACTTCCACGGCGGCGGCTTTGTCACCCACTCGGCAGCGTCTCCGCCCTATCAGTCCTTCCTCAACACCCTGGCCGCGAAGGCCGGCCTGCTCATCGTCTCCGTGAACTACCGCCTCGCGCCAGAGCACCCGCTGCCTGCAGGCTACGAGGACTCCTTCCGCGCGCTCAGGTGGACGGCCTCTGGTAGCGGGGACCCCTGGCTGTCACATCACGGCGACCTGGGCCGCATCTTCCTGGCCGGCGACAGCGCCGGTGGGAACTTCGTCCACAACATCGCTGTGATGGCAGCCGCGTCGGAGGTGCCAGTGCGAATCAGGGGTGCGGTCCTCCTGCACGCGGGGTTCGGTGGCAGGGAGCGCATCGACGGAGAGACGCCGGAGACTGTGGCGCTGATGGAGAAGCTGTGGGGGGTCGTGTGCCTCGAGGCGACGGACGGCCTGAACGACCCGCGGATAAATCCGTTGGCTGCCGCCGCGGCGCCGAGCCTGCGGAACCTGCCGTGTGAGAGGGTGCTCGTCTGCGCGGCAGAGTTGGACTTCCTGCGGCCGAGGAACAGGGCGTACTACGAGGCCCTCGCAGCAAGCTGGCGGGGCGGCACGGTGGAGTGGTTCGAGTCGAAGGGCAAGGAGCACGTCTTCTTCCTCTACAACCCCGGCTGCGGCGAGGCCGTGGAGCTCATGGATCGTCTGGTCGCGTTCTTTGCTGGGAACTGAAATTCGTCATGTGTGGATGTGACCGCGACCACATCCACATGCAGTGAGACGGATGGATCAAACGAAGATGCAGCTCATCGCCGAATCGAATGGTTGAGCTGTGTCCAGGAAAAGAAAACTAAAAGTGACTAGAATAATTGAGCTCGGAGCCTTGGATTGATCAGTTTGTGCT

SEQ ID NO: 885 - DNA, 1524 bp, Zea mays
  misc_feature (1)..(1524): Ceres cDNA ID no. 12374227
  misc_feature (1)..(1524): Ceres CLONE  ID no. 240206
  misc_feature (1)..(1524): Also known as  Ceres CDNA ID no. 23836574
taaaatcattgcagccctggtcctcacaacactctgtatatttgttctgaagcaatctcctggttttggtggcaatagtgtgttttctcgccatgaacatggggttacccacgtcttagtaacaggaggagctggttatattggttcacatgctgctttaaggctcttaaaggataactatcgagttactatcgtggataatctatctagaggaaacatgggagcagtaaaggttctgcagggcttatttccgcagcctgggagactacaattcatctttgctgatctggggaaccagaaatctgtatcctcatttatgcttctaaagctgctttgcttgtgccttttctgcttatggagagttacatccaaagtcttcttttcacttaactggctgccaggtcaacaagatatttgctgaaaatgcatttgatgctgtgatgcactttgcagctgttgcttatgtgggagagagcacattggaaccccttaggtactatcacaatattacatcgaacacactactgattttggaggctatggcatctcatggagtccaaacccttatttactccagtacatgtgctacctacggagaaccagataagatgcctattacagaagccacacctcagttccctatcaatccatatggaaaagctaagaaaatggcagaggatatcataatagatttctcaaactcaaagggagctgacatggctgtcatgattttaagatatttcaatgttattggatctgaccctgagggaagattaggtgaggctcctaggccagaacttcgagagcatggtcggatatctggggcttgctttgatgcagcattaggagtcattccaggattaaaggttaaaggaacagattatcccacagctgatggaacctgcataagagattatattgatgtcacagatttagttgatgctcatgtgaaagcactcaacaaggcagagcctagaaaagtcggcatttacaatgttggaacaggaagaggtcgctcagttaatgagtttgttgatgcctgcaagaaggcaactggggtcaacatcaaaattgagtacctcaacagaaggccaggagattatgcagaagtatacagcgacccaacaaagataaacaaggagctcaactggacagctcattataccgatctcaaagagagcctatcagtcgcatggaggtggcaaaagtcgcatccgcgtggctacgggccaaactaaatatagcctgctgatctataattcacttaatcgtcaatacatattagttctttagttagagatacaagatcttgctgcgatactcctcaaaatcagtccttcgtattcttctttctctcgtcctttttatttcaaaagtttgcatttttggctagcagaaacatgaatggtgatttggatgaaaaaaaggacctgtgatgacaatttcattgtttctgacacattgttggtaaaaaaaatgtaaattgcttcagccaatgagctgcaagattgattgaattgagtt

SEQ ID NO: 886 - protein, 1524 aa, Zea mays
  misc_feature: PFam Name: Epimerase; PFam Description: NAD dependent
  misc_feature: GI Number: 51978946; NR Description: PREDICTED P0495H05.61 gene product [Oryza sativa (japonica cultivar-group)] >gi|51963258|ref|XP_506159.1| PREDICTED P0495H05.61 gene product
  misc_feature: GI Number: 51964664; NR Description: PREDICTED P0582D05.120 gene product [Oryza sativa (japonica cultivar-group)] >gi|27529690|dbj|BAC53786.1| UDP-galactose 4-epimerase-like protein
  misc_feature: GI Number: 28395529; NR Description: UDP-D-xylose 4-epimerase [Arabidopsis thaliana] >gi|27363222|gb|AAO11530.1| At1g30620/T5I8_7 [Arabidopsis thaliana] >gi|18086329|gb|AAL57628.1| At1g30620/T5I8_7 [Arabidopsis
  misc_feature: GI Number: 25553524; NR Description: UDP-galactose
  misc_feature: GI Number: 50934141; NR Description: putative UDP-glucose 4-epimerase [Oryza sativa (japonica cultivar-group)] >gi|27260937|dbj|BAC45055.1| putative UDP-glucose 4-epimerase [Oryza sativa (japonica cultivar-group)]
TAAAATCATTGCAGCCCTGGTCCTCACAACACTCTGTATATTTGTTCTGAAGCAATCTCCTGGTTTTGGTGGCAATAGTGTGTTTTCTCGCCATGAACATGGGGTTACCCACGTCTTAGTAACAGGAGGAGCTGGTTATATTGGTTCACATGCTGCTTTAAGGCTCTTAAAGGATAACTATCGAGTTACTATCGTGGATAATCTATCTAGAGGAAACATGGGAGCAGTAAAGGTTCTGCAGGGCTTATTTCCGCAGCCTGGGAGACTACAATTCATCTTTGCTGATCTGGGGAACCAGAAATCTGTATCCTCATTTATGCTTCTAAAGCTGCTTTGCTTGTGCCTTTTCTGCTTATGGAGAGTTACATCCAAAGTCTTCTTTTCACTTAACTGGCTGCCAGGTCAACAAGATATTTGCTGAAAATGCATTTGATGCTGTGATGCACTTTGCAGCTGTTGCTTATGTGGGAGAGAGCACATTGGAACCCCTTAGGTACTATCACAATATTACATCGAACACACTACTGATTTTGGAGGCTATGGCATCTCATGGAGTCCAAACCCTTATTTACTCCAGTACATGTGCTACCTACGGAGAACCAGATAAGATGCCTATTACAGAAGCCACACCTCAGTTCCCTATCAATCCATATGGAAAAGCTAAGAAAATGGCAGAGGATATCATAATAGATTTCTCAAACTCAAAGGGAGCTGACATGGCTGTCATGATTTTAAGATATTTCAATGTTATTGGATCTGACCCTGAGGGAAGATTAGGTGAGGCTCCTAGGCCAGAACTTCGAGAGCATGGTCGGATATCTGGGGCTTGCTTTGATGCAGCATTAGGAGTCATTCCAGGATTAAAGGTTAAAGGAACAGATTATCCCACAGCTGATGGAACCTGCATAAGAGATTATATTGATGTCACAGATTTAGTTGATGCTCATGTGAAAGCACTCAACAAGGCAGAGCCTAGAAAAGTCGGCATTTACAATGTTGGAACAGGAAGAGGTCGCTCAGTTAATGAGTTTGTTGATGCCTGCAAGAAGGCAACTGGGGTCAACATCAAAATTGAGTACCTCAACAGAAGGCCAGGAGATTATGCAGAAGTATACAGCGACCCAACAAAGATAAACAAGGAGCTCAACTGGACAGCTCATTATACCGATCTCAAAGAGAGCCTATCAGTCGCATGGAGGTGGCAAAAGTCGCATCCGCGTGGCTACGGGCCAAACTAAATATAGCCTGCTGATCTATAATTCACTTAATCGTCAATACATATTAGTTCTTTAGTTAGAGATACAAGATCTTGCTGCGATACTCCTCAAAATCAGTCCTTCGTATTCTTCTTTCTCTCGTCCTTTTTATTTCAAAAGTTTGCATTTTTGGCTAGCAGAAACATGAATGGTGATTTGGATGAAAAAAAGGACCTGTGATGACAATTTCATTGTTTCTGACACATTGTTGGTAAAAAAAATGTAAATTGCTTCAGCCAATGAGCTGCAAGATTGATTGAATTGAGTT

SEQ ID NO: 887 - DNA, 1277 bp, Zea mays
  misc_feature (1)..(1277): Ceres cDNA ID no. 12374431
  misc_feature (1)..(1277): Ceres CLONE  ID no. 280920
  misc_feature (1)..(1277): Also known as  Ceres CDNA ID no. 23758289
caagataagtggtgcctccatcaggaatttcatcgatctcaatgatgctgtgccaaacgatgacaattctgaagaatcagtagtgtcacatgaatgccaggcggaaccttcacggaacaaccatcctaaacgagcatttgtgattgatctagaggtgccggcttgtgaagaggatgctgcttgggattttgatcaagaatgtgcacagcctaaacctgatgcacaccaggaagttgacggcagatctgatacatctgctctagctgcagctgagaacatcgtagcgttgtcaaggattattccaacagctgctagaggcatctgatgatatgttgcagtggtttgcagatctcgctgtattgaacatcaaggaccttgctgagcaagctgaactccaagcttgtaccaatgattccagtaacgacgagtcagattcattcgaatccttgacactgaagctggaagagaccaagattgatgagtactggagcaggccactggaacctgaaatcacaaccgatgaacaattaatttcaactgctcaccttctcaccaagcccagaaggggccagcaaaggaggcgacggcagaagcgggatttccagaaagatatcttgcctggcctttcgtcactttcccggcctgaaatcatagaggatgtccagttgcttgaggggttagtccaggcttctggtggatcctgggagtcgagtttaactaggcgaggacgttatggtgggcggactcgaggtaggaaacctcggaaaactgtagtaactgtaattgtagaagaggaggtcgaggttagcccaccgccgaaacctgttggcactggcgacctcgaagccgatggtaggggtatggttggatggggcagaacaacaaggcggtgtcgcagagcgagatgtccgtcaggtaacaacttggctgctgcgtcttgagaaagggtattgccagcaagcattggacctgattaggtacttggtggttcacaattgttatagactccgatggatggactggtataaggtgatcacagtcatgagtgtacatactctgtcggcgtattggcctcaccccaactttcatgcttttgggttgaaacatggtttacgttcttataataagttccgtaaattagctggtaagacatttctgcgacagcattgtattaagctgttccaggttatgaggtccggtataaattcattgtgagaaaaaaaactgcaatgcctgtaaaccaccttgatctctgaagattagctcatcgcatgcgc

SEQ ID NO: 888 - protein, 1277 aa, Zea mays
CAAGATAAGTGGTGCCTCCATCAGGAATTTCATCGATCTCAATGATGCTGTGCCAAACGATGACAATTCTGAAGAATCAGTAGTGTCACATGAATGCCAGGCGGAACCTTCACGGAACAACCATCCTAAACGAGCATTTGTGATTGATCTAGAGGTGCCGGCTTGTGAAGAGGATGCTGCTTGGGATTTTGATCAAGAATGTGCACAGCCTAAACCTGATGCACACCAGGAAGTTGACGGCAGATCTGATACATCTGCTCTAGCTGCAGCTGAGAACATCGTAGCGTTGTCAAGGATTATTCCAACAGCTGCTAGAGGCATCTGATGATATGTTGCAGTGGTTTGCAGATCTCGCTGTATTGAACATCAAGGACCTTGCTGAGCAAGCTGAACTCCAAGCTTGTACCAATGATTCCAGTAACGACGAGTCAGATTCATTCGAATCCTTGACACTGAAGCTGGAAGAGACCAAGATTGATGAGTACTGGAGCAGGCCACTGGAACCTGAAATCACAACCGATGAACAATTAATTTCAACTGCTCACCTTCTCACCAAGCCCAGAAGGGGCCAGCAAAGGAGGCGACGGCAGAAGCGGGATTTCCAGAAAGATATCTTGCCTGGCCTTTCGTCACTTTCCCGGCCTGAAATCATAGAGGATGTCCAGTTGCTTGAGGGGTTAGTCCAGGCTTCTGGTGGATCCTGGGAGTCGAGTTTAACTAGGCGAGGACGTTATGGTGGGCGGACTCGAGGTAGGAAACCTCGGAAAACTGTAGTAACTGTAATTGTAGAAGAGGAGGTCGAGGTTAGCCCACCGCCGAAACCTGTTGGCACTGGCGACCTCGAAGCCGATGGTAGGGGTATGGTTGGATGGGGCAGAACAACAAGGCGGTGTCGCAGAGCGAGATGTCCGTCAGGTAACAACTTGGCTGCTGCGTCTTGAGAAAGGGTATTGCCAGCAAGCATTGGACCTGATTAGGTACTTGGTGGTTCACAATTGTTATAGACTCCGATGGATGGACTGGTATAAGGTGATCACAGTCATGAGTGTACATACTCTGTCGGCGTATTGGCCTCACCCCAACTTTCATGCTTTTGGGTTGAAACATGGTTTACGTTCTTATAATAAGTTCCGTAAATTAGCTGGTAAGACATTTCTGCGACAGCATTGTATTAAGCTGTTCCAGGTTATGAGGTCCGGTATAAATTCATTGTGAGAAAAAAAACTGCAATGCCTGTAAACCACCTTGATCTCTGAAGATTAGCTCATCGCATGCGC

SEQ ID NO: 889 - DNA, 1867 bp, Zea mays
  misc_feature (1)..(1867): Ceres cDNA ID no. 12374910
  misc_feature (1)..(1867): Ceres CLONE  ID no. 324476
  misc_feature (1)..(1867): Also known as  Ceres CDNA ID no. 23790509
gtccatggtatgcgcgggaacctcccgtctctcgccgcggccagtaatggcgtcgctctccctctgtccttcttccacacgaagcagctccacgcgcgcctcatcgtcgcatccccctcctccgcctctggccctgcctacctccgcctcctagtgctccgctcctatgctgcccgcggagacctttcctccgcccgccgcctgctggacgaggctccccgcccggcctcgccgcttctctacaacgccctaatccgcgcgcacgcccgccgtctcgaccttccagccgggctcgcgcttttcgcccgcatgcgctgctccgccactccgcccgacgcgcacaccttcgcctgcgtcctccgcgcctgcgctgaatcctcgcgcccggatgctgttaaggtcgttcatggtatcgctacaacatgcggtatgtgctcccgtccgattgtcctgagctcgcttgtcagtgcgtacgcgaagcttggcctcgtggacaatgctcgcagcttgttcgatggattgtgtgagccggacttggtcatttggaactccatgatgtccgcatatgggtaccaagggatgtggtatgatggtctacagatgttctccttaatgcggagagctgggcagcatccggatgggtattcaatggttagcttagtctcatgcttctggaatccggaaatacttgcatttggtcaagcagttcatggaatatgtgtcaagggaggttatgactctggacaccatgtgagaagcacacttgtgtcaatgtacatgaggtgtgggtgtgtggaatctggccaaagattgtttggtagcttgcctgatgtggatttgattacctggtcgtcactgattactgggctaatacaaacgggcaagtatgaggaatcatttgatttgttccggaaaatgtgctttacaggtaggaggcccgacagccatattgattgctagtgttctctcggtatttgcttctactgctgctattagctataccaaggaggtccactgttatgcagtcaagcttggagctgatatagacataagagtctcttcttcgctaatggatgcttatgcaaaatgtggtttcactgagctcggatactgggtgttccgccaagtacctaataagaactcagtcatgtacaacacggtcatatcaaaccttgaatctcacgggtttgcaactaaggctattgaagtcctagatgagatggttaatgataagctcaggcctgatagtgctaccttctcctctttacttgctgcttgttgtcatgtggggcacttggaggagggatggaagttgttcaggagaatgagggatgagttcaagatagttgttgaaatggagcactatgtgtacatggtgaggcttcttgcaacatttggccagctgaaggaggcatatgatcttatacagacaatgcaaatccaaccagattgtggtgtgtggggtgcattgctttggggttgttgtgtccatcgtgattctagcttcggcaggattgttgctgaaaagctatgtgaactcaattcagacaaagctgcttacagggttatgctctcaaacatgtatgcctcacaagagatgtggtgggatgctgaggaggttagggatgagttatcaaaagaaaatatgtacaagaacacagggacgagttgggttggtgaagtaaaaaaatgatggttggcatttgtcattgagaaagcatgtcagatatcaagtacatatgaactctatattgttatattctggtagagatgatatcttgtgaaactccaaacatgtactcgttggattttagcttaaccagttttgtactcagtctttccttataatcatgggaggttcatttgc

SEQ ID NO: 890 - protein, 1867 aa, Zea mays
  misc_feature: PFam Name: PPR; PFam Description: PPR repeat
  misc_feature: GI Number: 34913768; NR Description: OSJNBa0051H17.34 [Oryza sativa (japonica cultivar-group)] >gi|20146445|dbj|BAB89225.1| OSJNBa0026J14.12 [Oryza sativa (japonica cultivar-group)] >gi|20161803|dbj|BAB90718.1| OSJNBa0051H17.34 [Oryza sativa
  misc_feature: GI Number: 57900513; NR Description: pentatricopeptide (PPR) repeat-containing protein-like [Oryza sativa (japonica cultivar-group)] gi|57900029|dbj|BAD88071.1| pentatricopeptide (PPR) repeat-containing protein-like [Oryza sativa (japonica
  misc_feature: GI Number: 55773756; NR Description: pentatricopeptide (PPR) repeat-containing protein-like [Oryza sativa (japonica
  misc_feature: GI Number: 15230593; NR Description: pentatricopeptide (PPR)
  misc_feature: GI Number: 11994419; NR Description: selenium-binding
GTCCATGGTATGCGCGGGAACCTCCCGTCTCTCGCCGCGGCCAGTAATGGCGTCGCTCTCCCTCTGTCCTTCTTCCACACGAAGCAGCTCCACGCGCGCCTCATCGTCGCATCCCCCTCCTCCGCCTCTGGCCCTGCCTACCTCCGCCTCCTAGTGCTCCGCTCCTATGCTGCCCGCGGAGACCTTTCCTCCGCCCGCCGCCTGCTGGACGAGGCTCCCCGCCCGGCCTCGCCGCTTCTCTACAACGCCCTAATCCGCGCGCACGCCCGCCGTCTCGACCTTCCAGCCGGGCTCGCGCTTTTCGCCCGCATGCGCTGCTCCGCCACTCCGCCCGACGCGCACACCTTCGCCTGCGTCCTCCGCGCCTGCGCTGAATCCTCGCGCCCGGATGCTGTTAAGGTCGTTCATGGTATCGCTACAACATGCGGTATGTGCTCCCGTCCGATTGTCCTGAGCTCGCTTGTCAGTGCGTACGCGAAGCTTGGCCTCGTGGACAATGCTCGCAGCTTGTTCGATGGATTGTGTGAGCCGGACTTGGTCATTTGGAACTCCATGATGTCCGCATATGGGTACCAAGGGATGTGGTATGATGGTCTACAGATGTTCTCCTTAATGCGGAGAGCTGGGCAGCATCCGGATGGGTATTCAATGGTTAGCTTAGTCTCATGCTTCTGGAATCCGGAAATACTTGCATTTGGTCAAGCAGTTCATGGAATATGTGTCAAGGGAGGTTATGACTCTGGACACCATGTGAGAAGCACACTTGTGTCAATGTACATGAGGTGTGGGTGTGTGGAATCTGGCCAAAGATTGTTTGGTAGCTTGCCTGATGTGGATTTGATTACCTGGTCGTCACTGATTACTGGGCTAATACAAACGGGCAAGTATGAGGAATCATTTGATTTGTTCCGGAAAATGTGCTTTACAGGTAGGAGGCCCGACAGCCATATTGATTGCTAGTGTTCTCTCGGTATTTGCTTCTACTGCTGCTATTAGCTATACCAAGGAGGTCCACTGTTATGCAGTCAAGCTTGGAGCTGATATAGACATAAGAGTCTCTTCTTCGCTAATGGATGCTTATGCAAAATGTGGTTTCACTGAGCTCGGATACTGGGTGTTCCGCCAAGTACCTAATAAGAACTCAGTCATGTACAACACGGTCATATCAAACCTTGAATCTCACGGGTTTGCAACTAAGGCTATTGAAGTCCTAGATGAGATGGTTAATGATAAGCTCAGGCCTGATAGTGCTACCTTCTCCTCTTTACTTGCTGCTTGTTGTCATGTGGGGCACTTGGAGGAGGGATGGAAGTTGTTCAGGAGAATGAGGGATGAGTTCAAGATAGTTGTTGAAATGGAGCACTATGTGTACATGGTGAGGCTTCTTGCAACATTTGGCCAGCTGAAGGAGGCATATGATCTTATACAGACAATGCAAATCCAACCAGATTGTGGTGTGTGGGGTGCATTGCTTTGGGGTTGTTGTGTCCATCGTGATTCTAGCTTCGGCAGGATTGTTGCTGAAAAGCTATGTGAACTCAATTCAGACAAAGCTGCTTACAGGGTTATGCTCTCAAACATGTATGCCTCACAAGAGATGTGGTGGGATGCTGAGGAGGTTAGGGATGAGTTATCAAAAGAAAATATGTACAAGAACACAGGGACGAGTTGGGTTGGTGAAGTAAAAAAATGATGGTTGGCATTTGTCATTGAGAAAGCATGTCAGATATCAAGTACATATGAACTCTATATTGTTATATTCTGGTAGAGATGATATCTTGTGAAACTCCAAACATGTACTCGTTGGATTTTAGCTTAACCAGTTTTGTACTCAGTCTTTCCTTATAATCATGGGAGGTTCATTTGC

SEQ ID NO: 891 - DNA, 1132 bp, Zea mays
  misc_feature (1)..(1132): Ceres cDNA ID no. 12375190
  misc_feature (1)..(1132): Ceres CLONE  ID no. 352519
  misc_feature (1)..(1132): Also known as  Ceres CDNA ID no. 23796183
gcacgagaccattacctagaacatcctaatcgaaaaacactttcctttccgcggcccctctgctcaccgcactccgttgcctgatggcgtcgccggcggcggggacgccgcccttcctgacgaaaacttacgccatggtggaggactcggccacggacgacacgatctcgtggaacgacaccggcacggccttcgtggtgtggcgccccgctgagttcgcccgtgaccttcttcccaagcacttcaagcacagcaacttctcctcgttcgtccgccagctcaacacctacggattcaagaaggtagtcggggacagatgggagtttgccaacgacggcttccggagaggcgagaagcaccttctcgccggaatacagaggcggaaggggaccggcgccgtggcggcggtaccggtgccgggcataccggcggggataccgttaccgctctcgtccccgcccacgagctctggcggggagccggcggtctcctcgtcgccgccgcgtggctcgacagctggagttagcggcgcggtggccgagctggaggaggagaacgcgcggctgcgacgcgagaatgcgaggctggcgcgggagctggcccgcgcgcggcgcctctgcgacggcgtgcgccagctcatggcgcggtacgacgacgaccaaggcagaggcggagatgaggatccggcggacggcgacgaggggcatggcggcagtggggaaggccccagcggcccagaggtgaagccaatgctgttcggcgtcccaatcggggccaagcggctacgcggtgcgcgtggtgatggagacgatgtagatgacggcgaggacaacgacgaggaaccagatgaagacgacgagaggcaaacggtgcggaagcagggggttaaagcggccaggaggaacgaggcgtcggatctggacgtgctgacgctgtccgtgcgggcggccgcggcggcgaggacgggcggaggatcacgtgaccgcaaaagccccattaccgcccaccccgataggagcctcagcctagggctgaaatgactgacactcgtgtagagtactgtagtatcgattgtagtattgtattgagtgatgctgcacgcttgaattgaatcatctagaaatcaaaattt

SEQ ID NO: 892 - protein, 1132 aa, Zea mays
  misc_feature: PFam Name: HSF_DNA-bind; PFam Description: HSF-type DNA-binding
  misc_feature: GI Number: 33591096; NR Description: heat shock factor RHSF1
  misc_feature: GI Number: 33591098; NR Description: heat shock factor RHSF2
  misc_feature: GI Number: 50948215; NR Description: putative heat shock factor RHSF2 [Oryza sativa (japonica cultivar-group)] >gi|42408097|dbj|BAD09238.1| putative heat shock factor RHSF2 [Oryza sativa (japonica cultivar-group)]
  misc_feature: GI Number: 30794050; NR Description: putative heat shock factor 6 [Arabidopsis thaliana] >gi|30793833|gb|AAP40369.1| putative heat shock factor 6 [Arabidopsis thaliana] >gi|10176919|dbj|BAB10163.1| heat shock factor 6 [Arabidopsis
  misc_feature: GI Number: 51536304; NR Description: putative heat shock
GCACGAGACCATTACCTAGAACATCCTAATCGAAAAACACTTTCCTTTCCGCGGCCCCTCTGCTCACCGCACTCCGTTGCCTGATGGCGTCGCCGGCGGCGGGGACGCCGCCCTTCCTGACGAAAACTTACGCCATGGTGGAGGACTCGGCCACGGACGACACGATCTCGTGGAACGACACCGGCACGGCCTTCGTGGTGTGGCGCCCCGCTGAGTTCGCCCGTGACCTTCTTCCCAAGCACTTCAAGCACAGCAACTTCTCCTCGTTCGTCCGCCAGCTCAACACCTACGGATTCAAGAAGGTAGTCGGGGACAGATGGGAGTTTGCCAACGACGGCTTCCGGAGAGGCGAGAAGCACCTTCTCGCCGGAATACAGAGGCGGAAGGGGACCGGCGCCGTGGCGGCGGTACCGGTGCCGGGCATACCGGCGGGGATACCGTTACCGCTCTCGTCCCCGCCCACGAGCTCTGGCGGGGAGCCGGCGGTCTCCTCGTCGCCGCCGCGTGGCTCGACAGCTGGAGTTAGCGGCGCGGTGGCCGAGCTGGAGGAGGAGAACGCGCGGCTGCGACGCGAGAATGCGAGGCTGGCGCGGGAGCTGGCCCGCGCGCGGCGCCTCTGCGACGGCGTGCGCCAGCTCATGGCGCGGTACGACGACGACCAAGGCAGAGGCGGAGATGAGGATCCGGCGGACGGCGACGAGGGGCATGGCGGCAGTGGGGAAGGCCCCAGCGGCCCAGAGGTGAAGCCAATGCTGTTCGGCGTCCCAATCGGGGCCAAGCGGCTACGCGGTGCGCGTGGTGATGGAGACGATGTAGATGACGGCGAGGACAACGACGAGGAACCAGATGAAGACGACGAGAGGCAAACGGTGCGGAAGCAGGGGGTTAAAGCGGCCAGGAGGAACGAGGCGTCGGATCTGGACGTGCTGACGCTGTCCGTGCGGGCGGCCGCGGCGGCGAGGACGGGCGGAGGATCACGTGACCGCAAAAGCCCCATTACCGCCCACCCCGATAGGAGCCTCAGCCTAGGGCTGAAATGACTGACACTCGTGTAGAGTACTGTAGTATCGATTGTAGTATTGTATTGAGTGATGCTGCACGCTTGAATTGAATCATCTAGAAATCAAAATTT

SEQ ID NO: 893 - DNA, 2133 bp, Zea mays
  misc_feature (1)..(2133): Ceres cDNA ID no. 12375197
  misc_feature (1)..(2133): Ceres CLONE  ID no. 378001
  misc_feature (1)..(2133): Also known as  Ceres CDNA ID no. 23799460
gcacgagaccattacctagaacatcctaatcgaaaactaatcgaccacaggcggcggcggcgccagcgccgcgcagccatgctgctcgaccccaagtccccaacgccacgccacgccaccccattgccgctgcgtaggcagcgtagctgccgctccagcacggcgccttcccgtcgcctgttgcccaactcgtcatgtggtagcctggtaggctggtagcccaaggcgcagggccctgtcactcgcgcgcaacttgctcgacggaatgccgcatcgggacgtcatctcggccacggccgccatcggcgcgctaacccgcggcggccgacaccgcgacgccctcgcactgttctcccgagttctcgccggcggcgtcgcgcccaacgagttcactttcggtaccgtcctgcgctcggccaccgcgctccgagtccgagccccgcgcgtcggcgtgcagctccacgcctgcgctgccaagctcggcctctgctccaacgtcttcgtcggcagcgctctcctcgaccactacgccaagatgggcgccatgacggaggcccagcgcgcgctcgatgacacccgcgagccgaatgtggtctcctacaccgccctcatcgccggtttgctgaagaatgggatgtttgatgaggcagaccgattgttccggcgcatgccagagaggaacgtggtctcgtggaacgcgatgatcggcgggtacagtcaagccggtctcggtgaggaggctgtcaatctgttcctggaaatgtgccgaggaggcgtctcaccgaacgaaagcaccttcccctgcgtgctcacctctgttgccagtgcagggacacttggcgtaggcagaagcattcatgcatcagccatcaagttcttgggcaagcttgacgtttatataggtaattctcttgtgagcttctatgccaggtgcggtagcttggaggacagtgttttggctttcaaaaaaatcaatcggaaaaacgtggtctcctggaacgcactgatctgcgggtatgcgcagaatgggaagggggaagaggctttggacgcttacagaatgatgagagcaacgggcctcaagccagataacctcactcttctcggcttgctgtttggttgtaaccatactggtctagttgatgaaggttatgcattgttcaagaccgcagagagggagcaaccgggcatactgaaacctgagcattacgcttgtgtggttgatctactatctcgtgccaagcggttcgacgaggccagaaggtttcttgaggagctcccctttgagccaggcattgggttctggaaggctttgttagggggctgtcagattcactggaacagcaagctggctgagagcgttgcaaagcgcattcgtgcattggatccaaaggacacatcttcctacattcttctgtcaaatgtatactctgcgtcaggaagttggcagagtgtgtctatggtcaggagggagattaaggagaaggggctgaagaggatcaccggctgcagttggattgaggtccaggagaaggtccatgtcttcttcaatggagactgtaggcatcaccagagtgatgaaatttattcgatgctcgaatcatgtttttattccatggaagatgaaggtgaacactcaattgtgtgatgataaccaatgagtacccaagtgtgtcaaatgtggtttacttgtcatcatctttttaatcttacatgtggaaaacactagaccgtactgaacttcggtgatgttgctggaagaatgaataatcagattccagccatcatgcactgctgtagcaacaataaaagtcactccctcgatcccaacggcaaaggaaaggtgcaagttcatgccctaaagacgagaacaaacgaaggtgggcctccggtcagatacatgttgccagaaatcgtccaagctcccgctctcttgccatttttgttggtagattcaattagaagtccatgaacgcacattacatgaattatgaaaaactggccacaaggcaaacattgccacagaccagattttgcatagcactgccagctgatttgttatctgtactatctcacaatcctttgataaatgttatttatccccctgaacaaattacatgattcaggtgattg

SEQ ID NO: 894 - protein, 2133 aa, Zea mays
  misc_feature: PFam Name: PPR; PFam Description: PPR repeat
  misc_feature: GI Number: 34908128; NR Description: P0031D11.22 [Oryza sativa (japonica cultivar-group)] >gi|15623829|dbj|BAB67888.1| P0031D11.22 [Oryza sativa (japonica cultivar-group)] >gi|21104616|dbj|BAB93208.1| P0408C03.6 [Oryza sativa (japonica
  misc_feature: GI Number: 30694067; NR Description: pentatricopeptide (PPR)
  misc_feature: GI Number: 37536800; NR Description: putative PPR-repeat protein [Oryza sativa (japonica cultivar-group)] >gi|14165320|gb|AAK55452.1| putative PPR repeat protein [Oryza sativa (japonica cultivar-group)] >gi|31433484|gb|AAP54989.1|
  misc_feature: GI Number: 50899520; NR Description: putative pentatricopeptide (PPR) repeat-containing protein [Oryza sativa (japonica cultivar-group)] >gi|48716903|dbj|BAD23598.1| putative pentatricopeptide (PPR) repeat-containing protein [Oryza sativa
  misc_feature: GI Number: 34915288; NR Description: pentatricopeptide (PPR) repeat-containing protein-like [Oryza sativa (japonica cultivar-group)] >gi|22831309|dbj|BAC16163.1| pentatricopeptide (PPR) repeat-containing protein-like [Oryza sativa (japonica
GCACGAGACCATTACCTAGAACATCCTAATCGAAAACTAATCGACCACAGGCGGCGGCGGCGCCAGCGCCGCGCAGCCATGCTGCTCGACCCCAAGTCCCCAACGCCACGCCACGCCACCCCATTGCCGCTGCGTAGGCAGCGTAGCTGCCGCTCCAGCACGGCGCCTTCCCGTCGCCTGTTGCCCAACTCGTCATGTGGTAGCCTGGTAGGCTGGTAGCCCAAGGCGCAGGGCCCTGTCACTCGCGCGCAACTTGCTCGACGGAATGCCGCATCGGGACGTCATCTCGGCCACGGCCGCCATCGGCGCGCTAACCCGCGGCGGCCGACACCGCGACGCCCTCGCACTGTTCTCCCGAGTTCTCGCCGGCGGCGTCGCGCCCAACGAGTTCACTTTCGGTACCGTCCTGCGCTCGGCCACCGCGCTCCGAGTCCGAGCCCCGCGCGTCGGCGTGCAGCTCCACGCCTGCGCTGCCAAGCTCGGCCTCTGCTCCAACGTCTTCGTCGGCAGCGCTCTCCTCGACCACTACGCCAAGATGGGCGCCATGACGGAGGCCCAGCGCGCGCTCGATGACACCCGCGAGCCGAATGTGGTCTCCTACACCGCCCTCATCGCCGGTTTGCTGAAGAATGGGATGTTTGATGAGGCAGACCGATTGTTCCGGCGCATGCCAGAGAGGAACGTGGTCTCGTGGAACGCGATGATCGGCGGGTACAGTCAAGCCGGTCTCGGTGAGGAGGCTGTCAATCTGTTCCTGGAAATGTGCCGAGGAGGCGTCTCACCGAACGAAAGCACCTTCCCCTGCGTGCTCACCTCTGTTGCCAGTGCAGGGACACTTGGCGTAGGCAGAAGCATTCATGCATCAGCCATCAAGTTCTTGGGCAAGCTTGACGTTTATATAGGTAATTCTCTTGTGAGCTTCTATGCCAGGTGCGGTAGCTTGGAGGACAGTGTTTTGGCTTTCAAAAAAATCAATCGGAAAAACGTGGTCTCCTGGAACGCACTGATCTGCGGGTATGCGCAGAATGGGAAGGGGGAAGAGGCTTTGGACGCTTACAGAATGATGAGAGCAACGGGCCTCAAGCCAGATAACCTCACTCTTCTCGGCTTGCTGTTTGGTTGTAACCATACTGGTCTAGTTGATGAAGGTTATGCATTGTTCAAGACCGCAGAGAGGGAGCAACCGGGCATACTGAAACCTGAGCATTACGCTTGTGTGGTTGATCTACTATCTCGTGCCAAGCGGTTCGACGAGGCCAGAAGGTTTCTTGAGGAGCTCCCCTTTGAGCCAGGCATTGGGTTCTGGAAGGCTTTGTTAGGGGGCTGTCAGATTCACTGGAACAGCAAGCTGGCTGAGAGCGTTGCAAAGCGCATTCGTGCATTGGATCCAAAGGACACATCTTCCTACATTCTTCTGTCAAATGTATACTCTGCGTCAGGAAGTTGGCAGAGTGTGTCTATGGTCAGGAGGGAGATTAAGGAGAAGGGGCTGAAGAGGATCACCGGCTGCAGTTGGATTGAGGTCCAGGAGAAGGTCCATGTCTTCTTCAATGGAGACTGTAGGCATCACCAGAGTGATGAAATTTATTCGATGCTCGAATCATGTTTTTATTCCATGGAAGATGAAGGTGAACACTCAATTGTGTGATGATAACCAATGAGTACCCAAGTGTGTCAAATGTGGTTTACTTGTCATCATCTTTTTAATCTTACATGTGGAAAACACTAGACCGTACTGAACTTCGGTGATGTTGCTGGAAGAATGAATAATCAGATTCCAGCCATCATGCACTGCTGTAGCAACAATAAAAGTCACTCCCTCGATCCCAACGGCAAAGGAAAGGTGCAAGTTCATGCCCTAAAGACGAGAACAAACGAAGGTGGGCCTCCGGTCAGATACATGTTGCCAGAAATCGTCCAAGCTCCCGCTCTCTTGCCATTTTTGTTGGTAGATTCAATTAGAAGTCCATGAACGCACATTACATGAATTATGAAAAACTGGCCACAAGGCAAACATTGCCACAGACCAGATTTTGCATAGCACTGCCAGCTGATTTGTTATCTGTACTATCTCACAATCCTTTGATAAATGTTATTTATCCCCCTGAACAAATTACATGATTCAGGTGATTG

SEQ ID NO: 895 - DNA, 1337 bp, Zea mays
  misc_feature (1)..(1337): Ceres cDNA ID no. 12375504
  misc_feature (1)..(1337): Ceres CLONE  ID no. 389163
  misc_feature (1)..(1337): Also known as  Ceres CDNA ID no. 23808348
gcacgagaccattacctagaacatcctaatcgaaaaagcgcacaagcagcaacgccaacgccaacccaaccctaacccgatctcaccgaggacacacagacaccagaccaccggagcggaccaagtacgagcatgggcggcgccgcggaggaggcgttgcggcgggagtacgtggtcggcgaggagatcgggcgcggccggttcgggacggtccgccgctgctacgccgccgccacgggggagccgttcgcgctcaagacgacgcccaaggcggcgctgcgggcggacccgctggacctggcgctggcggagcaggagcccaaggtgcaccacctggcgtctgccgccagccgccacgtggtcgcgctgcacgccgccttcgtggacgccgacgccgtgcacctggtgctggacctgtgcgcgggcggggacctgttcgcgctcgtctccgcgcggggcgcgctcccagagcccgaggcggcggagctcatggcgcagctcgccgacgcgctcgccggctgccaccgccgcggggtcgcgcaccgcgacgtcaagcccgacaacctcctcttcgacgccgccgccggcggcgcgctcaggctcggggacttcggctccgccgcctggttcggggacggcaggcccatgacggggctggtcgggacgccctactacgtcgcgcccgaggtggtggccggcagggagtacaccgagaaggtggacgtctggagcgccggggtcgtgctctacatgatgctctccgggaccgtgcccttctccggcgccaccgcgggggagatcttccaggccgtgctccgcgggaacctgcgcttccctccgcgcgccttcgccgccgtctcgcccgaggccaaggacctcctgcgccgcatgctctgcagggacgtctggcgcaggctctccgccgagcaagtcctgaggcacccatggattgtgactcgcggcggaagtgtgcctggcggtagactggtttagatgctccgcgccgcatccgatgaatctccatccgaagtgtacatagtggcgtcctccatccaatccaagaggagtagagaaggaccttttgctgttgatctcttcgctatggttctggcaaatcatcgtgaatttggacactagtgccgtagttggttaccagtagcacgcagaagtaatcgttaggctaagcaggaatttaggagggctgcctcttcctgggtttgctctgttctgcagtaatcctgtgctcgtcttgtttgcattgcaatttgcaacccaaacccatgtatgtgtatagcacagccttcttatggctgaggaagagacgactagctctgttc

SEQ ID NO: 896 - protein, 1337 aa, Zea mays
  misc_feature: PFam Name: Pkinase; PFam Description: Protein kinase domain
  misc_feature: GI Number: 59803708; NR Description: phosphoenolpyruvate
  misc_feature: GI Number: 50915676; NR Description: putative phosphoenolpyruvate carboxylase kinase [Oryza sativa (japonica cultivar-group)] >gi|47497352|dbj|BAD19392.1| putative phosphoenolpyruvate carboxylase kinase [Oryza sativa (japonica
  misc_feature: GI Number: 15451567; NR Description: Putative
  misc_feature: GI Number: 15029405; NR Description: phosphoenolpyruvate
  misc_feature: GI Number: 59803714; NR Description: phosphoenolpyruvate
GCACGAGACCATTACCTAGAACATCCTAATCGAAAAAGCGCACAAGCAGCAACGCCAACGCCAACCCAACCCTAACCCGATCTCACCGAGGACACACAGACACCAGACCACCGGAGCGGACCAAGTACGAGCATGGGCGGCGCCGCGGAGGAGGCGTTGCGGCGGGAGTACGTGGTCGGCGAGGAGATCGGGCGCGGCCGGTTCGGGACGGTCCGCCGCTGCTACGCCGCCGCCACGGGGGAGCCGTTCGCGCTCAAGACGACGCCCAAGGCGGCGCTGCGGGCGGACCCGCTGGACCTGGCGCTGGCGGAGCAGGAGCCCAAGGTGCACCACCTGGCGTCTGCCGCCAGCCGCCACGTGGTCGCGCTGCACGCCGCCTTCGTGGACGCCGACGCCGTGCACCTGGTGCTGGACCTGTGCGCGGGCGGGGACCTGTTCGCGCTCGTCTCCGCGCGGGGCGCGCTCCCAGAGCCCGAGGCGGCGGAGCTCATGGCGCAGCTCGCCGACGCGCTCGCCGGCTGCCACCGCCGCGGGGTCGCGCACCGCGACGTCAAGCCCGACAACCTCCTCTTCGACGCCGCCGCCGGCGGCGCGCTCAGGCTCGGGGACTTCGGCTCCGCCGCCTGGTTCGGGGACGGCAGGCCCATGACGGGGCTGGTCGGGACGCCCTACTACGTCGCGCCCGAGGTGGTGGCCGGCAGGGAGTACACCGAGAAGGTGGACGTCTGGAGCGCCGGGGTCGTGCTCTACATGATGCTCTCCGGGACCGTGCCCTTCTCCGGCGCCACCGCGGGGGAGATCTTCCAGGCCGTGCTCCGCGGGAACCTGCGCTTCCCTCCGCGCGCCTTCGCCGCCGTCTCGCCCGAGGCCAAGGACCTCCTGCGCCGCATGCTCTGCAGGGACGTCTGGCGCAGGCTCTCCGCCGAGCAAGTCCTGAGGCACCCATGGATTGTGACTCGCGGCGGAAGTGTGCCTGGCGGTAGACTGGTTTAGATGCTCCGCGCCGCATCCGATGAATCTCCATCCGAAGTGTACATAGTGGCGTCCTCCATCCAATCCAAGAGGAGTAGAGAAGGACCTTTTGCTGTTGATCTCTTCGCTATGGTTCTGGCAAATCATCGTGAATTTGGACACTAGTGCCGTAGTTGGTTACCAGTAGCACGCAGAAGTAATCGTTAGGCTAAGCAGGAATTTAGGAGGGCTGCCTCTTCCTGGGTTTGCTCTGTTCTGCAGTAATCCTGTGCTCGTCTTGTTTGCATTGCAATTTGCAACCCAAACCCATGTATGTGTATAGCACAGCCTTCTTATGGCTGAGGAAGAGACGACTAGCTCTGTTC

SEQ ID NO: 897 - DNA, 1475 bp, Zea mays
  misc_feature (1)..(1475): Ceres cDNA ID no. 12375615
  misc_feature (1)..(1475): Ceres CLONE  ID no. 384800
  misc_feature (1)..(1475): Also known as  Ceres CDNA ID no. 23802804
gcacgagaccattacctagaacatcctaatcgaaaaaggagcttcatccaacagcccaagtgtccctgctacccccactggatcagcaagctagctacccagtggagagccacagccgaagccgaagccgaagctagagctagcaagcaatggctgcggcggctcctcctgcgcgtcctactagcagcatcagcagctgctgctgctgcatctcgcggcgcgccgccgccgtcgtgccggcgctgctgctgctggcggcgatggccgcctcctccggcgacgcgcagccttccccggggtactacccgagctccaggttcaggccggtgccgttcaaccgggcgtacaccaacaagtggggcccgcagcaccagacgctctccggcgaccattccgccctcaccatctggctcgacaagacctgcgggagtggtttcaagtcgaagcacgcgtacaggaacggctacttctccactcgcatcaagctccccgcccggatacaccgcgggcaccaacaccgccttctatctctccaacaacgaggcgcaccctggtttctacgacgagatcgacatggagttcctgggcaccatcccgggggagccctacacgctgcagacgaacgtgtacgtgcgcggcagcggcgacgggcgcatcgtggggcgggagatgcggttccacctgtggttcgaccccacggcggcctaccacacctacgccatcctgtggaaccccgacgccatcaccttcttcgtggacgacgtgcccgtccgccgctacgagcgccgcaccgagctcaccttcccggaccgccccatgtgggtctacggctccatctgggacgcctccgactgggccaccgacgacggccgccaccgcgccgactaccgctaccagcccttcgtcgcgcgcctcgaccgcttcgtcgtcgccggctgctccgccagcgccccgcccgcgtgcaggcccgtgccggcgtcccccgcgggggccgggctcacgccgcggcagtacgcggccatgcgctgggcgcagcagggccacatggtctactactactgcaacgacttccgcagggaccactcgctcacgcccgagtgctagcgagcgtgcctgtctgctgtgttgcgtcgtcgtcgtcgtccttgttgctttgtgctttgtttcgttgttgatgaaaaggtcgctaggcgtggctgccctactaccgcccgcgcccgccgctgctctctctgcttgcggtgactgaggcgcccgcgcgagccggtggttgaggcgttggtcgttggcttatcgccagcaaactcgtgtcgtcgctcgtctacgtacgcgtacggcgtacccattgcatttcttccggttgttgctttccatttggtctcgcatgcatcacacgaggcgccccaaaggggcaagcttccatgattcatacggatacactatgtataccatatatacatattatatatatattt

SEQ ID NO: 898 - protein, 1475 aa, Zea mays
  misc_feature: PFam Name: Glyco_hydro_16; PFam Description: Glycosyl
  misc_feature: PFam Name: XET_C; PFam Description: Xyloglucan
  misc_feature: PFam Name: Pyr_redox_2; PFam Description: Pyridine
  misc_feature: PFam Name: Pkinase; PFam Description: Protein kinase domain
  misc_feature: PFam Name: Mucin; PFam Description: Mucin-like glycoprotein
  misc_feature: GI Number: 34901732; NR Description: putative xyloglucan endo-transglycosylase [Oryza sativa (japonica cultivar-group)] >gi|27261015|dbj|BAC45131.1| putative xyloglucan
  misc_feature: GI Number: 37536586; NR Description: putative cellulase [Oryza sativa (japonica cultivar-group)] >gi|13357258|gb|AAK20055.1| putative cellulase [Oryza sativa (japonica cultivar-group)] >gi|31433363|gb|AAP54882.1| putative
  misc_feature: GI Number: 34902398; NR Description: Putative cellulase [Oryza sativa (japonica cultivar-group)] >gi|24476042|gb|AAN62784.1| Putative cellulase [Oryza sativa
  misc_feature: GI Number: 14029149; NR Description: xyloglucan
  misc_feature: GI Number: 17402583; NR Description: Xyloglucan
GCACGAGACCATTACCTAGAACATCCTAATCGAAAAAGGAGCTTCATCCAACAGCCCAAGTGTCCCTGCTACCCCCACTGGATCAGCAAGCTAGCTACCCAGTGGAGAGCCACAGCCGAAGCCGAAGCCGAAGCTAGAGCTAGCAAGCAATGGCTGCGGCGGCTCCTCCTGCGCGTCCTACTAGCAGCATCAGCAGCTGCTGCTGCTGCATCTCGCGGCGCGCCGCCGCCGTCGTGCCGGCGCTGCTGCTGCTGGCGGCGATGGCCGCCTCCTCCGGCGACGCGCAGCCTTCCCCGGGGTACTACCCGAGCTCCAGGTTCAGGCCGGTGCCGTTCAACCGGGCGTACACCAACAAGTGGGGCCCGCAGCACCAGACGCTCTCCGGCGACCATTCCGCCCTCACCATCTGGCTCGACAAGACCTGCGGGAGTGGTTTCAAGTCGAAGCACGCGTACAGGAACGGCTACTTCTCCACTCGCATCAAGCTCCCCGCCCGGATACACCGCGGGCACCAACACCGCCTTCTATCTCTCCAACAACGAGGCGCACCCTGGTTTCTACGACGAGATCGACATGGAGTTCCTGGGCACCATCCCGGGGGAGCCCTACACGCTGCAGACGAACGTGTACGTGCGCGGCAGCGGCGACGGGCGCATCGTGGGGCGGGAGATGCGGTTCCACCTGTGGTTCGACCCCACGGCGGCCTACCACACCTACGCCATCCTGTGGAACCCCGACGCCATCACCTTCTTCGTGGACGACGTGCCCGTCCGCCGCTACGAGCGCCGCACCGAGCTCACCTTCCCGGACCGCCCCATGTGGGTCTACGGCTCCATCTGGGACGCCTCCGACTGGGCCACCGACGACGGCCGCCACCGCGCCGACTACCGCTACCAGCCCTTCGTCGCGCGCCTCGACCGCTTCGTCGTCGCCGGCTGCTCCGCCAGCGCCCCGCCCGCGTGCAGGCCCGTGCCGGCGTCCCCCGCGGGGGCCGGGCTCACGCCGCGGCAGTACGCGGCCATGCGCTGGGCGCAGCAGGGCCACATGGTCTACTACTACTGCAACGACTTCCGCAGGGACCACTCGCTCACGCCCGAGTGCTAGCGAGCGTGCCTGTCTGCTGTGTTGCGTCGTCGTCGTCGTCCTTGTTGCTTTGTGCTTTGTTTCGTTGTTGATGAAAAGGTCGCTAGGCGTGGCTGCCCTACTACCGCCCGCGCCCGCCGCTGCTCTCTCTGCTTGCGGTGACTGAGGCGCCCGCGCGAGCCGGTGGTTGAGGCGTTGGTCGTTGGCTTATCGCCAGCAAACTCGTGTCGTCGCTCGTCTACGTACGCGTACGGCGTACCCATTGCATTTCTTCCGGTTGTTGCTTTCCATTTGGTCTCGCATGCATCACACGAGGCGCCCCAAAGGGGCAAGCTTCCATGATTCATACGGATACACTATGTATACCATATATACATATTATATATATATTT

SEQ ID NO: 899 - DNA, 1764 bp, Zea mays
  misc_feature (1)..(1764): Ceres cDNA ID no. 12375648
  misc_feature (1)..(1764): Ceres CLONE  ID no. 390106
  misc_feature (1)..(1764): Also known as  Ceres CDNA ID no. 23808366
atcacgcacggccacacctgccctccattccatccagcacctagaaaaaactaatcgcaattagttgacgcataatattttgagggaggagaaggggggaattgactagttgaccaatcgcgagtggcgatgatgatgcagttgggggccaggagtttggtgaggaggttctcccgtctcgccgcggcgggggccccggccgagacgacgtcggctggcgtgccgcgaatgccggcgttcgaccacgtcccgctgccctacgacgggccgagcgccgccgacatcgcccgcaagcgcgccgagtacctcagcccgtccctcttccacttctactccaagcctctgaacatcgtggagggcaagaggcagtacttgtacgacgagcacggccggcgctacctggacgcgttcgccggcatcgccaccgtgtgctgcggccactgccaccccgacgtcgtggacgcgatcaccaggcaggccaagcgcctgcagcactccaccgtgctctacctcaaccacgtcatcgccgatttcgccgaggcgctggcatccaagctgcccggcgacctcaaggtcgtcttcttcaccaactccggcacggaggcgaacgagctggccatcctgatggcgcggctgtacaccggctcccacgacatcatctccctccgcaactcgtaccacggcaacgcggccgggaccatgggagccaccgcgcagaagaactggaagttcaacgtcatccagagtggcgtgcaccacgcggtgaacccggacccctacagaggcgccttcggctccgacgccgagaagtacgtgcgggacgtgcaggagatcatcgagttcggcaccaccggccaggtcgccggcttcatatccgaggccatccagggcgtgggcggaatcgtggaggtgtcgccgggctacctgccgctggcgtacgacaaggtccggaaggccggcgggctctgcatcgccgacgaggtccaggcgggtttcgcccgcgtcggcagccacttctggggcttcgagacccacggcgtcgtccccgacatagtgaccatggcaaagggcatcggcaacggcatcccgctgggcgccgtggtgacgacgccggaggtcgcgcaggtgctgacccggcgctgctacttcaacacgttcggcggcaacccgctgtgcaccgccggcgggctcgccgtcctcgaggtgctcgagaaggagaggctccaggagaacgccttcgtcgtcggctcctacctcaaggaccgcctccgcggtctccaggagaagcacgagatcatcggcgacgtgaggggaacgggtttcatgctcggcatcgagctggtcaccgatcggcagctcaagacgccggcgaaagatgagatctgccacgccatggaatacatgaaagatatgggcgtcttggtcggcaaaggcgggttctatgggaacgtcttcaggatcactccccctctatgcttcaccaaggaagatgctgatttcttcgtcgaggtgatggacattgcgctgtcgaagctctgagctgtggccgtcaggcggaggggcggtgtgtctgtctgtatatataatcctcgcccgagtttagcagctgcgtcggagttgtactatctcactcaagagaatggcgaaaaaaccttggcagtttgtgactcaaggggaaaaaactaaaccatgcagacgaatttggcttatcgcaacgctagcttttaattcagctttcgtctggagatgacgtgccttgtaacg

SEQ ID NO: 900 - protein, 1764 aa, Zea mays
  misc_feature: PFam Name: Aminotran_3; PFam Description: Aminotransferase
  misc_feature: GI Number: 25141217; NR Description: At4g39660/T19P19_50 [Arabidopsis thaliana] >gi|15809992|gb|AAL06923.1| AT4g39660/T19P19_50 [Arabidopsis thaliana] >gi|18420498|ref|NP_568064.1| alanine--glyoxylate
  misc_feature: GI Number: 5731259; NR Description: alanine:glyoxylate
  misc_feature: GI Number: 6403506; NR Description: putative aminotransferase [Arabidopsis thaliana] >gi|20466700|gb|AAM20667.1| putative aminotransferase [Arabidopsis thaliana] >gi|15231974|ref|NP_187498.1| alanine--glyoxylate
  misc_feature: GI Number: 52353685; NR Description: putative aminotransferase [Oryza sativa (japonica cultivar-group)] >gi|52353616|gb|AAU44182.1| putative aminotransferase class-III
  misc_feature: GI Number: 15028237; NR Description: putative
ATCACGCACGGCCACACCTGCCCTCCATTCCATCCAGCACCTAGAAAAAACTAATCGCAATTAGTTGACGCATAATATTTTGAGGGAGGAGAAGGGGGGAATTGACTAGTTGACCAATCGCGAGTGGCGATGATGATGCAGTTGGGGGCCAGGAGTTTGGTGAGGAGGTTCTCCCGTCTCGCCGCGGCGGGGGCCCCGGCCGAGACGACGTCGGCTGGCGTGCCGCGAATGCCGGCGTTCGACCACGTCCCGCTGCCCTACGACGGGCCGAGCGCCGCCGACATCGCCCGCAAGCGCGCCGAGTACCTCAGCCCGTCCCTCTTCCACTTCTACTCCAAGCCTCTGAACATCGTGGAGGGCAAGAGGCAGTACTTGTACGACGAGCACGGCCGGCGCTACCTGGACGCGTTCGCCGGCATCGCCACCGTGTGCTGCGGCCACTGCCACCCCGACGTCGTGGACGCGATCACCAGGCAGGCCAAGCGCCTGCAGCACTCCACCGTGCTCTACCTCAACCACGTCATCGCCGATTTCGCCGAGGCGCTGGCATCCAAGCTGCCCGGCGACCTCAAGGTCGTCTTCTTCACCAACTCCGGCACGGAGGCGAACGAGCTGGCCATCCTGATGGCGCGGCTGTACACCGGCTCCCACGACATCATCTCCCTCCGCAACTCGTACCACGGCAACGCGGCCGGGACCATGGGAGCCACCGCGCAGAAGAACTGGAAGTTCAACGTCATCCAGAGTGGCGTGCACCACGCGGTGAACCCGGACCCCTACAGAGGCGCCTTCGGCTCCGACGCCGAGAAGTACGTGCGGGACGTGCAGGAGATCATCGAGTTCGGCACCACCGGCCAGGTCGCCGGCTTCATATCCGAGGCCATCCAGGGCGTGGGCGGAATCGTGGAGGTGTCGCCGGGCTACCTGCCGCTGGCGTACGACAAGGTCCGGAAGGCCGGCGGGCTCTGCATCGCCGACGAGGTCCAGGCGGGTTTCGCCCGCGTCGGCAGCCACTTCTGGGGCTTCGAGACCCACGGCGTCGTCCCCGACATAGTGACCATGGCAAAGGGCATCGGCAACGGCATCCCGCTGGGCGCCGTGGTGACGACGCCGGAGGTCGCGCAGGTGCTGACCCGGCGCTGCTACTTCAACACGTTCGGCGGCAACCCGCTGTGCACCGCCGGCGGGCTCGCCGTCCTCGAGGTGCTCGAGAAGGAGAGGCTCCAGGAGAACGCCTTCGTCGTCGGCTCCTACCTCAAGGACCGCCTCCGCGGTCTCCAGGAGAAGCACGAGATCATCGGCGACGTGAGGGGAACGGGTTTCATGCTCGGCATCGAGCTGGTCACCGATCGGCAGCTCAAGACGCCGGCGAAAGATGAGATCTGCCACGCCATGGAATACATGAAAGATATGGGCGTCTTGGTCGGCAAAGGCGGGTTCTATGGGAACGTCTTCAGGATCACTCCCCCTCTATGCTTCACCAAGGAAGATGCTGATTTCTTCGTCGAGGTGATGGACATTGCGCTGTCGAAGCTCTGAGCTGTGGCCGTCAGGCGGAGGGGCGGTGTGTCTGTCTGTATATATAATCCTCGCCCGAGTTTAGCAGCTGCGTCGGAGTTGTACTATCTCACTCAAGAGAATGGCGAAAAAACCTTGGCAGTTTGTGACTCAAGGGGAAAAAACTAAACCATGCAGACGAATTTGGCTTATCGCAACGCTAGCTTTTAATTCAGCTTTCGTCTGGAGATGACGTGCCTTGTAACG

SEQ ID NO: 901 - DNA, 1783 bp, Zea mays
  misc_feature (1)..(1783): Ceres cDNA ID no. 12376532
  misc_feature (1)..(1783): Ceres CLONE  ID no. 336252
  misc_feature (1)..(1783): Also known as  Ceres CDNA ID no. 23778773
aagagctaccgcttcttctcgcagctcgaggcgctgcacgcctcggcgccgcctccgccgcccccgccctcgggcatgaccacggtgcaagctagccctcatcagccgatggaaatggcatggacggcgggccctacggtgctgggccctgccgccgtcgccggcctgccagacctcagcttctcgtcgatgtccgagtccgactcagagtacgactcggacgacgactctggtgcgggggaggagggcctcagcgggggcgagtgcgacagggagatgatggccatcttcgaggggatgatgaagcagttcacggagaagcaagaccgccatgcagcgcgtgttcctggagacgctggagcggtgcgaggcagagcgcacggcgcgcgaggaggcgtggcggcgccaggaggtcgcccgcatgaaccgcgagcgcgagcagctcgccagggagcgcgccgccgcggcctcccgcgacgccgcgctgatcgcgttcctccagcgtgtcggcggggggcagggcgagcccgcgcggctccctccgcacggcgccggcgtcgtgcccgcgccgccgatgccggactgcgcccctccgtcgcctcggcgcgacgcggcggccgcctcgcttcagcagctggtgcccgcaccgccgaaggcggtggaggccttggcgcgcgctggaggagagggcggcgggtccacgccgtcgcggtggcccaaggaggaagtggaggcgctgatccagatgcggaacgagaagggcgagaagtaccacgacgcgggggccaaggggcccctttgggaggacatcgccgccgcgatgcgggggatcgggtacagccggagcgccaagcggtgcaaggagaagtgggagaacatcaacaagtactacaagaaggtgaaggagagcaacaagaggcgccccgaggactccaagacctgtccttacttccaccagctcgacgccatgtaccgcaacaaacaccgcggcggcacaggcggcagaacggcacccagagcgaacatggcctccgccgtcgccgtcgccgtcgcagcaaacgtgcaggacaacccgagcaagcgcgagctcgagggaaagagcagcaacgatgccgacaaccggaagaatggtgaacaggggaacgtgcttacttctcccgctagcggcgatacagcaccaggtggcgccgccaaaaacaagacggcagagggcaatgtggatgatacagatgtgcagcaccagcagcggttcagtgccgacgagacggacagcgacgacgaggacatgtacatggcaagaaactacacagtctacactgaagaaggcaacgacgaagacaaaatgaagtacaagatgggcgtccaggagcgtgatgtgatcgggagcagcgggcaacgtgcttgcgccaccaccaccagcagcagcagcagccacggctgcggcaccgacgagttcagctgccccaacgagcagcaccttccttgccgttcagtagagggcaatgctgcaggaggaggcccggtgccagccgatcagcaccagtgcatcaccaccttttgcggcccataatcaccgagtatacttgccctgcatctgaaccatccgaataccatttattgatttgttctgtaataagtaccagatcatggaaacctcaaaaggtaaaaagaagacaatgaagaacagaggaggcagcagagacgcctaaacagaaagttcttttcttttttctctcattataggtcatgttatactttacctattgctaacaattgtacattc

SEQ ID NO: 902 - protein, 1783 aa, Zea mays
  misc_feature: PFam Name: Myb_DNA-binding; PFam Description: Myb-like
  misc_feature: GI Number: 50911273; NR Description: putative DNA-binding protein Gt-2 [Oryza sativa (japonica cultivar-group)] >gi|49388398|dbj|BAD25534.1| putative DNA-binding protein Gt-2 [Oryza sativa (japonica cultivar-group)]
  misc_feature: GI Number: 20249; NR Description: gt-2 [Oryza sativa]
  misc_feature: GI Number: 18182309; NR Description: GT-2 factor [Glycine max]
  misc_feature: GI Number: 13646986; NR Description: DNA-binding protein DF1
  misc_feature: GI Number: 30699205; NR Description: trihelix DNA-binding
AAGAGCTACCGCTTCTTCTCGCAGCTCGAGGCGCTGCACGCCTCGGCGCCGCCTCCGCCGCCCCCGCCCTCGGGCATGACCACGGTGCAAGCTAGCCCTCATCAGCCGATGGAAATGGCATGGACGGCGGGCCCTACGGTGCTGGGCCCTGCCGCCGTCGCCGGCCTGCCAGACCTCAGCTTCTCGTCGATGTCCGAGTCCGACTCAGAGTACGACTCGGACGACGACTCTGGTGCGGGGGAGGAGGGCCTCAGCGGGGGCGAGTGCGACAGGGAGATGATGGCCATCTTCGAGGGGATGATGAAGCAGTTCACGGAGAAGCAAGACCGCCATGCAGCGCGTGTTCCTGGAGACGCTGGAGCGGTGCGAGGCAGAGCGCACGGCGCGCGAGGAGGCGTGGCGGCGCCAGGAGGTCGCCCGCATGAACCGCGAGCGCGAGCAGCTCGCCAGGGAGCGCGCCGCCGCGGCCTCCCGCGACGCCGCGCTGATCGCGTTCCTCCAGCGTGTCGGCGGGGGGCAGGGCGAGCCCGCGCGGCTCCCTCCGCACGGCGCCGGCGTCGTGCCCGCGCCGCCGATGCCGGACTGCGCCCCTCCGTCGCCTCGGCGCGACGCGGCGGCCGCCTCGCTTCAGCAGCTGGTGCCCGCACCGCCGAAGGCGGTGGAGGCCTTGGCGCGCGCTGGAGGAGAGGGCGGCGGGTCCACGCCGTCGCGGTGGCCCAAGGAGGAAGTGGAGGCGCTGATCCAGATGCGGAACGAGAAGGGCGAGAAGTACCACGACGCGGGGGCCAAGGGGCCCCTTTGGGAGGACATCGCCGCCGCGATGCGGGGGATCGGGTACAGCCGGAGCGCCAAGCGGTGCAAGGAGAAGTGGGAGAACATCAACAAGTACTACAAGAAGGTGAAGGAGAGCAACAAGAGGCGCCCCGAGGACTCCAAGACCTGTCCTTACTTCCACCAGCTCGACGCCATGTACCGCAACAAACACCGCGGCGGCACAGGCGGCAGAACGGCACCCAGAGCGAACATGGCCTCCGCCGTCGCCGTCGCCGTCGCAGCAAACGTGCAGGACAACCCGAGCAAGCGCGAGCTCGAGGGAAAGAGCAGCAACGATGCCGACAACCGGAAGAATGGTGAACAGGGGAACGTGCTTACTTCTCCCGCTAGCGGCGATACAGCACCAGGTGGCGCCGCCAAAAACAAGACGGCAGAGGGCAATGTGGATGATACAGATGTGCAGCACCAGCAGCGGTTCAGTGCCGACGAGACGGACAGCGACGACGAGGACATGTACATGGCAAGAAACTACACAGTCTACACTGAAGAAGGCAACGACGAAGACAAAATGAAGTACAAGATGGGCGTCCAGGAGCGTGATGTGATCGGGAGCAGCGGGCAACGTGCTTGCGCCACCACCACCAGCAGCAGCAGCAGCCACGGCTGCGGCACCGACGAGTTCAGCTGCCCCAACGAGCAGCACCTTCCTTGCCGTTCAGTAGAGGGCAATGCTGCAGGAGGAGGCCCGGTGCCAGCCGATCAGCACCAGTGCATCACCACCTTTTGCGGCCCATAATCACCGAGTATACTTGCCCTGCATCTGAACCATCCGAATACCATTTATTGATTTGTTCTGTAATAAGTACCAGATCATGGAAACCTCAAAAGGTAAAAAGAAGACAATGAAGAACAGAGGAGGCAGCAGAGACGCCTAAACAGAAAGTTCTTTTCTTTTTTCTCTCATTATAGGTCATGTTATACTTTACCTATTGCTAACAATTGTACATTC

SEQ ID NO: 903 - DNA, 1336 bp, Zea mays
  misc_feature (1)..(1336): Ceres cDNA ID no. 12376632
  misc_feature (1)..(1336): Ceres CLONE  ID no. 380388
  misc_feature (1)..(1336): Also known as  Ceres CDNA ID no. 23802764
  misc_feature (692)..(692): n is a, c, t, g, unknown, or other
  misc_feature (693)..(693): n is a, c, t, g, unknown, or other
gcacgagaccattacctagaacatcctaatcgaaaaatcagttcagtaagttcagccttcttgacttgtacagttgtactgaggtaggtctcgtctgagttggcaacgaccatgcctgccgtctcggccgccgcctgctgcgccgccacaacgccggcaaacgaggtggcggaggacctcctcggcttcctccgcgttctcagagacggcaccgtgctccggtcgccggcggacccagtgttctgcccggccaccttccccggcagccacccgtccgtgcagtggaaggaggccgtctacgacaagcccaagaacctccgcgtccgcgtgtacaggccgacgacgccgccggggacgaagaagaagctcccagtgctcgtccacttccacggcggcggcttctgcctggggtcgtgcacgtgggccaacgtccacgagttctgcctccgcctggccgcggaggccggcgccgtcgtgctctccgcgggataccgcctggcccccgagcaccgcctccccgcggccttcgacgacggggccgggttcatgcgctggctccgggaccagtcagcgatcggcggcgccggcgcctccgacgcctggctcgcggaggccgccgatttcggccgcgtgctcgtcaccggcgactcggcgggcgccacgatcgcgcaccacctcgccgtgcgcgccgnnctcggccgcggcggagccagagccggagccggagccgggcctcctcacggtccgcggctacgttctgctcatgccgttcttcggcggcgtccggcgcacggcctcggaggccgagtgcgcggaggaggcgttcccgaaccttgacctggtggaccggttctggaggctgtcgctgccggccggcgccaccagggaccacccggcgtccaacccgttcgggccggacagccctgacctgggcccggtggacttccggtccgtgctcgtggtggccggcggcctcgacctgatacgcgaccgcaccgtcgactacgccgagcggctggcggcgatgggcaagcccgtggagctcgccgagttcgccggcatgccccacgggttctacctgcaccagccggggtcccaggccaccggcgagctcatccagaccgtcgcccggttcgtccacgtcgttgcgccagaggctgcggcttaatttactcggcatatgcatgcatccgtgcatgtatcccgtttcttgtcgtcgtgttgtggttcactcgtatacctcatcttttttctcttatgaaattcttgtagagtaaaacccttctctctctgatgtctcggttgaatgatccaaataatggaccactggtttggg

SEQ ID NO: 904 - protein, 1336 aa, Zea mays
  misc_feature: PFam Name: Abhydrolase_3; PFam Description: alpha/beta
  misc_feature: PFam Name: COesterase; PFam Description: Carboxylesterase
  misc_feature: PFam Name: Pkinase; PFam Description: Protein kinase domain
  misc_feature: PFam Name: FH2; PFam Description: Formin Homology 2 Domain
  misc_feature: PFam Name: Cupin_1; PFam Description: Cupin
  misc_feature: GI Number: 34899932; NR Description: putative cell death associated protein [Oryza sativa (japonica cultivar-group)] >gi|23617083|dbj|BAC20766.1| putative cell death associated protein
  misc_feature: GI Number: 34899936; NR Description: putative cell death associated protein [Oryza sativa (japonica cultivar-group)] >gi|23617085|dbj|BAC20768.1| putative cell death associated protein
  misc_feature: GI Number: 50919067; NR Description: putative esterase [Oryza sativa (japonica cultivar-group)] >gi|27819508|gb|AAO24912.1|
  misc_feature: GI Number: 34895938; NR Description: P0030H07.40 [Oryza sativa (japonica cultivar-group)] >gi|13872965|dbj|BAB44070.1| P0030H07.40 [Oryza sativa (japonica cultivar-group)] >gi|15528618|dbj|BAB64639.1| P0011G08.10 [Oryza sativa (japonica
  misc_feature: GI Number: 34895916; NR Description: P0030H07.24 [Oryza sativa (japonica cultivar-group)] >gi|13872954|dbj|BAB44059.1|
GCACGAGACCATTACCTAGAACATCCTAATCGAAAAATCAGTTCAGTAAGTTCAGCCTTCTTGACTTGTACAGTTGTACTGAGGTAGGTCTCGTCTGAGTTGGCAACGACCATGCCTGCCGTCTCGGCCGCCGCCTGCTGCGCCGCCACAACGCCGGCAAACGAGGTGGCGGAGGACCTCCTCGGCTTCCTCCGCGTTCTCAGAGACGGCACCGTGCTCCGGTCGCCGGCGGACCCAGTGTTCTGCCCGGCCACCTTCCCCGGCAGCCACCCGTCCGTGCAGTGGAAGGAGGCCGTCTACGACAAGCCCAAGAACCTCCGCGTCCGCGTGTACAGGCCGACGACGCCGCCGGGGACGAAGAAGAAGCTCCCAGTGCTCGTCCACTTCCACGGCGGCGGCTTCTGCCTGGGGTCGTGCACGTGGGCCAACGTCCACGAGTTCTGCCTCCGCCTGGCCGCGGAGGCCGGCGCCGTCGTGCTCTCCGCGGGATACCGCCTGGCCCCCGAGCACCGCCTCCCCGCGGCCTTCGACGACGGGGCCGGGTTCATGCGCTGGCTCCGGGACCAGTCAGCGATCGGCGGCGCCGGCGCCTCCGACGCCTGGCTCGCGGAGGCCGCCGATTTCGGCCGCGTGCTCGTCACCGGCGACTCGGCGGGCGCCACGATCGCGCACCACCTCGCCGTGCGCGCCGNNCTCGGCCGCGGCGGAGCCAGAGCCGGAGCCGGAGCCGGGCCTCCTCACGGTCCGCGGCTACGTTCTGCTCATGCCGTTCTTCGGCGGCGTCCGGCGCACGGCCTCGGAGGCCGAGTGCGCGGAGGAGGCGTTCCCGAACCTTGACCTGGTGGACCGGTTCTGGAGGCTGTCGCTGCCGGCCGGCGCCACCAGGGACCACCCGGCGTCCAACCCGTTCGGGCCGGACAGCCCTGACCTGGGCCCGGTGGACTTCCGGTCCGTGCTCGTGGTGGCCGGCGGCCTCGACCTGATACGCGACCGCACCGTCGACTACGCCGAGCGGCTGGCGGCGATGGGCAAGCCCGTGGAGCTCGCCGAGTTCGCCGGCATGCCCCACGGGTTCTACCTGCACCAGCCGGGGTCCCAGGCCACCGGCGAGCTCATCCAGACCGTCGCCCGGTTCGTCCACGTCGTTGCGCCAGAGGCTGCGGCTTAATTTACTCGGCATATGCATGCATCCGTGCATGTATCCCGTTTCTTGTCGTCGTGTTGTGGTTCACTCGTATACCTCATCTTTTTTCTCTTATGAAATTCTTGTAGAGTAAAACCCTTCTCTCTCTGATGTCTCGGTTGAATGATCCAAATAATGGACCACTGGTTTGGG

SEQ ID NO: 905 - DNA, 1581 bp, Zea mays
  misc_feature (1)..(1581): Ceres cDNA ID no. 12376644
  misc_feature (1)..(1581): Ceres CLONE  ID no. 346362
  misc_feature (1)..(1581): Also known as  Ceres CDNA ID no. 23788332
gcacgagaccattacctagaacatcctaatcgaaaagaaatgaaactcgcgacagacagttcgtcctctgctccgtggaccctattcctgcgattatctggttgctcacatggacggtgatccgtgatccccggtgaccaagggtgttgaatcctcatgcaggcagaggcagaaacactgcccgaggctgatgcctgatggtgcgatcccgttccctgtcgccatcgagttcgttttttcgttgcttgacagccttaaagcggcgcacgaatgccacgagccactgaggcggcttcccagttcactccaggcccagggcgcccggtcgccatgaactcccgctcctcctccggcggcgtgcggtccgagagctcgctgtcgttgggggagcgcctctgcgcggtcttcttccccgtcatcgccatcgccgaggccgttttcttcgccttcaccgactgcctcgcggacctctgcaccgactccggctcctcgcactcgcgccgcttcggcgcgggcgcgtcctcctccgccgccaggaacagtcggagcaaccattgccagccccaccacagacctttcctacgccgcgccgctcgggtggatggacctcccccaacctccgccagctcgcacgcctcgccgacgagtcccgatgcttctcggtgaacgaggtggaggcgctctttgagctctacaagaagatcagctgctccatcatcgacgacggcctcatccacaaggaagaacttcagctggcactgttcaaaactccaagcggcgagaatctttttcttgatagagtttttttatttgtttgatgagaagaaaaatggtgtgatcgagtttgatgagtttattcattccctaagtgtcttccaccccttggcaccaattgaagacaagatcgattttgcatttaggttgtatgacttgagacaaactgggtttattgagcgtgaagaggttaagcaaatggtaattgctattttgatggaatctgatttaaaattatcagatgacttactcgaggccatcatagataagacatttgaagatgctgatgcggataaggatggaaaaataaataaagaggagtggaaggaatttgcgttacgccaccctaacctgttaaagaatatgacactgccttatctgagggacatcacaaccgtcttccctagtttcgtcttcaacacggcggtggaagattagtcgctccaattgaaggcaataaagcagtactggggattgcttgaggtgcacaaggttcctgaaacctgacggctgttggtcgccttcaaccactgagaatccgatgtgttctgagcatcaaggcagccgccacctgaccatcactcctgctataaattgtaatattataatataaggctcatccggggtggcagatcggcagcgggaacttacctgatataatttcttgctgccgtttttgcgcagcaatggattgagagtcggtagctgtagatacatctagcttccattctgtacgtagggatccaggaactgtaaatacgttctatggaattgtatcggaaagttcctagtacgccagccagatct

SEQ ID NO: 906 - protein, 1581 aa, Zea mays
  misc_feature: PFam Name: efhand; PFam Description: EF hand
  misc_feature: GI Number: 34913062; NR Description: putative calcium sensor
  misc_feature: GI Number: 56785307; NR Description: calcineurin B-like [Oryza sativa (japonica cultivar-group)] gi|56784147|dbj|BAD81532.1| calcineurin B-like [Oryza sativa
  misc_feature: GI Number: 29150248; NR Description: calcineurin B-like protein 10 [Arabidopsis thaliana] >gi|15234011|ref|NP_195026.1|
  misc_feature: GI Number: 21553482; NR Description: calcineurin B-like protein 3 [Arabidopsis thaliana] >gi|30687272|ref|NP_849449.1|
  misc_feature: GI Number: 50907083; NR Description: putative calcineurin B [Oryza sativa (japonica cultivar-group)] >gi|47847964|dbj|BAD21753.1| putative calcineurin B [Oryza sativa
GCACGAGACCATTACCTAGAACATCCTAATCGAAAAGAAATGAAACTCGCGACAGACAGTTCGTCCTCTGCTCCGTGGACCCTATTCCTGCGATTATCTGGTTGCTCACATGGACGGTGATCCGTGATCCCCGGTGACCAAGGGTGTTGAATCCTCATGCAGGCAGAGGCAGAAACACTGCCCGAGGCTGATGCCTGATGGTGCGATCCCGTTCCCTGTCGCCATCGAGTTCGTTTTTTCGTTGCTTGACAGCCTTAAAGCGGCGCACGAATGCCACGAGCCACTGAGGCGGCTTCCCAGTTCACTCCAGGCCCAGGGCGCCCGGTCGCCATGAACTCCCGCTCCTCCTCCGGCGGCGTGCGGTCCGAGAGCTCGCTGTCGTTGGGGGAGCGCCTCTGCGCGGTCTTCTTCCCCGTCATCGCCATCGCCGAGGCCGTTTTCTTCGCCTTCACCGACTGCCTCGCGGACCTCTGCACCGACTCCGGCTCCTCGCACTCGCGCCGCTTCGGCGCGGGCGCGTCCTCCTCCGCCGCCAGGAACAGTCGGAGCAACCATTGCCAGCCCCACCACAGACCTTTCCTACGCCGCGCCGCTCGGGTGGATGGACCTCCCCCAACCTCCGCCAGCTCGCACGCCTCGCCGACGAGTCCCGATGCTTCTCGGTGAACGAGGTGGAGGCGCTCTTTGAGCTCTACAAGAAGATCAGCTGCTCCATCATCGACGACGGCCTCATCCACAAGGAAGAACTTCAGCTGGCACTGTTCAAAACTCCAAGCGGCGAGAATCTTTTTCTTGATAGAGTTTTTTTATTTGTTTGATGAGAAGAAAAATGGTGTGATCGAGTTTGATGAGTTTATTCATTCCCTAAGTGTCTTCCACCCCTTGGCACCAATTGAAGACAAGATCGATTTTGCATTTAGGTTGTATGACTTGAGACAAACTGGGTTTATTGAGCGTGAAGAGGTTAAGCAAATGGTAATTGCTATTTTGATGGAATCTGATTTAAAATTATCAGATGACTTACTCGAGGCCATCATAGATAAGACATTTGAAGATGCTGATGCGGATAAGGATGGAAAAATAAATAAAGAGGAGTGGAAGGAATTTGCGTTACGCCACCCTAACCTGTTAAAGAATATGACACTGCCTTATCTGAGGGACATCACAACCGTCTTCCCTAGTTTCGTCTTCAACACGGCGGTGGAAGATTAGTCGCTCCAATTGAAGGCAATAAAGCAGTACTGGGGATTGCTTGAGGTGCACAAGGTTCCTGAAACCTGACGGCTGTTGGTCGCCTTCAACCACTGAGAATCCGATGTGTTCTGAGCATCAAGGCAGCCGCCACCTGACCATCACTCCTGCTATAAATTGTAATATTATAATATAAGGCTCATCCGGGGTGGCAGATCGGCAGCGGGAACTTACCTGATATAATTTCTTGCTGCCGTTTTTGCGCAGCAATGGATTGAGAGTCGGTAGCTGTAGATACATCTAGCTTCCATTCTGTACGTAGGGATCCAGGAACTGTAAATACGTTCTATGGAATTGTATCGGAAAGTTCCTAGTACGCCAGCCAGATCT

SEQ ID NO: 907 - DNA, 1723 bp, Zea mays
  misc_feature (1)..(1723): Ceres cDNA ID no. 12376740
  misc_feature (1)..(1723): Ceres CLONE  ID no. 276148
  misc_feature (1)..(1723): Also known as  Ceres CDNA ID no. 23775131
gcacgagaccattacctagaacatcctaatcgaaaaatcgtctgcaactgcatcgctcgctctctcctttcactgggaacatctatcagctcgcgctcattggccatctttggcttccatggagaggctcattgccggcctacttggcttcctattggttgcatcggtaggaagccatgcagctcgtgctccggatcagtactggaagtctgctcttcccaacactcccatgccgacctccctctcccaactcctcgacgccgctccagccggcggcggcacgaccgtcaacgtcggctggggcggtgtttcacgtcgatgctgggcacggtaagcccgggggtacgacggttgacgtaggcaagggcggcgtcggcgtcaacgttaaccctggcaggagcggcaagcccggcggcacgacggttggcgtcgggaagggcggagtcggcgttaacgtcaacccgggatacggaaagcccggcggcaccaccgttggcgtcggaaagggtggcgttggcgttaacgtcaaccccggcaagcccggtggcacaacggtcggcgtcggcaagggcggagtgggcgtcaacgtcaatcccggcaaaccggccggtggtgccggtacaaccgttggcgttggcaaaggcggcgtgggcgtgggcgtcaatcccgggcacggcaagccgggcggcaccacggtcggcgttggcaagggcggggttggcgttcacgtgaacccgggaaagaagcccgtccacgtcaacgtctcccctttcatctacacgtacgccgcgtcggagacgcagctgcacgacgaccccagcgtggcgctcttcttccaggagacggacctccggcccggtaagaagatgaccgtccagttcgccagcaccgggacgaccggcaccaagttcctcccgcggagcgaggccgaggccatcccgttctcctcacagaaggtgcccgagatcctcgcccgcctctcggtggacccggactccgtcgaggcggcggagatggcgcagacgctgcgcgactgcgaggcgcccgcggccaagggcgagaagaaggcgtgcgccacgtcgctggagtccatggtggacttcgccaccgccagcctcgggaccaggcacgtgagggccgtgtcgaccgtcgtggcgaaggagggatcgccgaagcaggagtacacggtgaccggcgtggagcgcgctgccggcggcaccgacgacgacggccgggtcgtggcctgccacgcggagccgtacgcgtacgccgtgttcgcgtgccacctgacgccgcagacgcgggcgtactctgtgtcgatgctcggcagggacggcacggccgtggacgctgtcgcggtgtgccacgccgacacgtccggctggaaccccaagcacgtcgccttccaggtgctcaacgtgaagcccggcaccgtgccggtctgccacttcctgccgcaggaccacgtcgtctggacccgcagcggctgagtctgctggatggccgccgtttgctcgcgtcgcgccgcctggagtgatttgttatgttccagtggcctctaggcatactgtcatattattattataccgaggtatcacgagtttgcttatgtttccagtacttgatgcttgtatggatatggtgtagccagctcagcaagtatcaacccacctgcttaattctgttgtatagttttaaataaacagacaacctctttatgggc

SEQ ID NO: 908 - protein, 1723 aa, Zea mays
  misc_feature: PFam Name: BURP; PFam Description: BURP domain
  misc_feature: PFam Name: Sporozoite_P67; PFam Description: Sporozoite P67
  misc_feature: PFam Name: Dehydrin; PFam Description: Dehydrin
  misc_feature: PFam Name: GRP; PFam Description: Glycine rich protein family
  misc_feature: PFam Name: Pkinase; PFam Description: Protein kinase domain
  misc_feature: GI Number: 34910186; NR Description: putative dehydration-responsive protein RD22 precursor [Oryza sativa (japonica cultivar-group)] >gi|15624018|dbj|BAB68072.1| putative dehydration-responsive protein RD22 precursor [Oryza sativa
  misc_feature: GI Number: 49615303; NR Description: dehydration-induced
  misc_feature: GI Number: 54645911; NR Description: RD22-like protein [Vitis
  misc_feature: GI Number: 32815851; NR Description: At5g25610/T14C9_150 [Arabidopsis thaliana] >gi|391608|dbj|BAA01546.1| rd22 [Arabidopsis thaliana] >gi|19699081|gb|AAL90908.1| AT5g25610/T14C9_150 [Arabidopsis thaliana]
  misc_feature: GI Number: 14422444; NR Description: BURP domain-containing
GCACGAGACCATTACCTAGAACATCCTAATCGAAAAATCGTCTGCAACTGCATCGCTCGCTCTCTCCTTTCACTGGGAACATCTATCAGCTCGCGCTCATTGGCCATCTTTGGCTTCCATGGAGAGGCTCATTGCCGGCCTACTTGGCTTCCTATTGGTTGCATCGGTAGGAAGCCATGCAGCTCGTGCTCCGGATCAGTACTGGAAGTCTGCTCTTCCCAACACTCCCATGCCGACCTCCCTCTCCCAACTCCTCGACGCCGCTCCAGCCGGCGGCGGCACGACCGTCAACGTCGGCTGGGGCGGTGTTTCACGTCGATGCTGGGCACGGTAAGCCCGGGGGTACGACGGTTGACGTAGGCAAGGGCGGCGTCGGCGTCAACGTTAACCCTGGCAGGAGCGGCAAGCCCGGCGGCACGACGGTTGGCGTCGGGAAGGGCGGAGTCGGCGTTAACGTCAACCCGGGATACGGAAAGCCCGGCGGCACCACCGTTGGCGTCGGAAAGGGTGGCGTTGGCGTTAACGTCAACCCCGGCAAGCCCGGTGGCACAACGGTCGGCGTCGGCAAGGGCGGAGTGGGCGTCAACGTCAATCCCGGCAAACCGGCCGGTGGTGCCGGTACAACCGTTGGCGTTGGCAAAGGCGGCGTGGGCGTGGGCGTCAATCCCGGGCACGGCAAGCCGGGCGGCACCACGGTCGGCGTTGGCAAGGGCGGGGTTGGCGTTCACGTGAACCCGGGAAAGAAGCCCGTCCACGTCAACGTCTCCCCTTTCATCTACACGTACGCCGCGTCGGAGACGCAGCTGCACGACGACCCCAGCGTGGCGCTCTTCTTCCAGGAGACGGACCTCCGGCCCGGTAAGAAGATGACCGTCCAGTTCGCCAGCACCGGGACGACCGGCACCAAGTTCCTCCCGCGGAGCGAGGCCGAGGCCATCCCGTTCTCCTCACAGAAGGTGCCCGAGATCCTCGCCCGCCTCTCGGTGGACCCGGACTCCGTCGAGGCGGCGGAGATGGCGCAGACGCTGCGCGACTGCGAGGCGCCCGCGGCCAAGGGCGAGAAGAAGGCGTGCGCCACGTCGCTGGAGTCCATGGTGGACTTCGCCACCGCCAGCCTCGGGACCAGGCACGTGAGGGCCGTGTCGACCGTCGTGGCGAAGGAGGGATCGCCGAAGCAGGAGTACACGGTGACCGGCGTGGAGCGCGCTGCCGGCGGCACCGACGACGACGGCCGGGTCGTGGCCTGCCACGCGGAGCCGTACGCGTACGCCGTGTTCGCGTGCCACCTGACGCCGCAGACGCGGGCGTACTCTGTGTCGATGCTCGGCAGGGACGGCACGGCCGTGGACGCTGTCGCGGTGTGCCACGCCGACACGTCCGGCTGGAACCCCAAGCACGTCGCCTTCCAGGTGCTCAACGTGAAGCCCGGCACCGTGCCGGTCTGCCACTTCCTGCCGCAGGACCACGTCGTCTGGACCCGCAGCGGCTGAGTCTGCTGGATGGCCGCCGTTTGCTCGCGTCGCGCCGCCTGGAGTGATTTGTTATGTTCCAGTGGCCTCTAGGCATACTGTCATATTATTATTATACCGAGGTATCACGAGTTTGCTTATGTTTCCAGTACTTGATGCTTGTATGGATATGGTGTAGCCAGCTCAGCAAGTATCAACCCACCTGCTTAATTCTGTTGTATAGTTTTAAATAAACAGACAACCTCTTTATGGGC

SEQ ID NO: 909 - DNA, 1796 bp, Zea mays
  misc_feature (1)..(1796): Ceres cDNA ID no. 12376810
  misc_feature (1)..(1796): Ceres CLONE  ID no. 383013
  misc_feature (1)..(1796): Also known as  Ceres CDNA ID no. 23805412
gcacgagaccattacctagaacatcctaatcaaaaaaccaaccaacgcaccagccacaagtgacaagtccaatcaccaacaggccgcgtgcgggcagcggccggccactgcaccatgtcgtccagcagggaggtgatggtgctcagcgacagcgaggtgcagtccgccccgccaacgccgcgaccaccgccgccggtgtcggccccgccatcgcagatacactcaccgtcgcccgcccgctcgccgctcgccagcccggtcaggaaggcggtggcgggcgtcaaggcgggctgcctggaggaggaggtgggcggccacgtcacgcggctcgcggacccgcgcgacgcctggctgcccgtcaccgagtccaggagcggcaacgcctactacgccgcgttccacagcctcagctccggcatcgggttccaggcgctcgtgctccccacggccttcgcctccctcggatggacgtgggcgatcatctgcctgacgctggcgttcgggtggcagctctacacgctgtggctgctcgtcaggctccacgagcctgtcgcgggcgccacccgctacagccggtacatgcacctcgccaccaccgtgcttcggcgacagatgggccaatatcctggcgctgctcccggtgacgtacctgtcggcggggatctgcacggcgctcatcatcgtcggcggcggcagcatgaagatgctgttcggcatcgcgtacggcgggtcgtgcctggcgcggccgctcaccgccgtggagtggtacctcgtcttcgtgtgcgcggccgtggtgctgtcccagctccccaacctcaactccatcgccggcgtgtctctggtggccgccgtcgccgccgtcgcctactgcaccatgatctgggccgtgtccgtggccaggggtagggtagccggcgtctcctacgaccccgtccacaaggcccccgacgacgtggacgccgcactcggcgtcctgaatggccttggcatcattgccttcgccttcaggggccacaatgtggtgctggagatccagggcacgatgccgtcgactctgaaacacccgtctcatgtgcccatgtggaagggcgttaaggtagcatacgccatcattgcgctctgcctgtaccccatcgccatcggtggcttttgggcatacggcaaccagatacctcccaatggcatcctgagcgccctgtacaagttccacagccgcgacgcgtccaggcttgtgctgggggtcaccacactgctggtcatcatcaactgcctgaccacgttccagatctacgccatgccggtgtacgacaacatggaggccgggtacgtgcacaagaagaaccggccgtgcccgtgtggatgcgctcgggcttccgcgccttcttcggcgcggtcaacctcctcgtcgccgtcgcgatgccgttcctgtcggagctcgccggcctcttcggagggatctcgctgccggtcaccctggcctacccgtgcttcatgtgggtggcgatcaagaagccgcggaagggcaccgccacgtggaacgtcaactgggcgctgggaatccttggcatgaggcataaggccttgtcctcatagtcgggaacctgtggggtctcgtggagaaaggcatgcgtgtcaagttcttcaagcctgccgatttccagtgataaaaagatgcagatttgtcactcagttggattcgtaatcgtaatgcaatgcttttagatatgttgatttcttcctcaggaatgtataatgttgtgtacatattagcaatttgcaagaagcaacgtcgtctg

SEQ ID NO: 910 - protein, 1796 aa, Zea mays
  misc_feature: PFam Name: Aa_trans; PFam Description: Transmembrane amino
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: Peptidase_S8; PFam Description: Subtilase family
  misc_feature: GI Number: 452593; NR Description: ORF [Lilium longiflorum]
  misc_feature: GI Number: 5688864; NR Description: amino acid
  misc_feature: GI Number: 21436363; NR Description: putative lysine and histidine specific transporter protein [Arabidopsis thaliana] >gi|17529318|gb|AAL38886.1| putative lysine and histidine specific
  misc_feature: GI Number: 28393033; NR Description: putative amino acid permease [Arabidopsis thaliana] >gi|18418590|ref|NP_567977.1| amino
  misc_feature: GI Number: 21593132; NR Description: amino acid permease-like
GCACGAGACCATTACCTAGAACATCCTAATCAAAAAACCAACCAACGCACCAGCCACAAGTGACAAGTCCAATCACCAACAGGCCGCGTGCGGGCAGCGGCCGGCCACTGCACCATGTCGTCCAGCAGGGAGGTGATGGTGCTCAGCGACAGCGAGGTGCAGTCCGCCCCGCCAACGCCGCGACCACCGCCGCCGGTGTCGGCCCCGCCATCGCAGATACACTCACCGTCGCCCGCCCGCTCGCCGCTCGCCAGCCCGGTCAGGAAGGCGGTGGCGGGCGTCAAGGCGGGCTGCCTGGAGGAGGAGGTGGGCGGCCACGTCACGCGGCTCGCGGACCCGCGCGACGCCTGGCTGCCCGTCACCGAGTCCAGGAGCGGCAACGCCTACTACGCCGCGTTCCACAGCCTCAGCTCCGGCATCGGGTTCCAGGCGCTCGTGCTCCCCACGGCCTTCGCCTCCCTCGGATGGACGTGGGCGATCATCTGCCTGACGCTGGCGTTCGGGTGGCAGCTCTACACGCTGTGGCTGCTCGTCAGGCTCCACGAGCCTGTCGCGGGCGCCACCCGCTACAGCCGGTACATGCACCTCGCCACCACCGTGCTTCGGCGACAGATGGGCCAATATCCTGGCGCTGCTCCCGGTGACGTACCTGTCGGCGGGGATCTGCACGGCGCTCATCATCGTCGGCGGCGGCAGCATGAAGATGCTGTTCGGCATCGCGTACGGCGGGTCGTGCCTGGCGCGGCCGCTCACCGCCGTGGAGTGGTACCTCGTCTTCGTGTGCGCGGCCGTGGTGCTGTCCCAGCTCCCCAACCTCAACTCCATCGCCGGCGTGTCTCTGGTGGCCGCCGTCGCCGCCGTCGCCTACTGCACCATGATCTGGGCCGTGTCCGTGGCCAGGGGTAGGGTAGCCGGCGTCTCCTACGACCCCGTCCACAAGGCCCCCGACGACGTGGACGCCGCACTCGGCGTCCTGAATGGCCTTGGCATCATTGCCTTCGCCTTCAGGGGCCACAATGTGGTGCTGGAGATCCAGGGCACGATGCCGTCGACTCTGAAACACCCGTCTCATGTGCCCATGTGGAAGGGCGTTAAGGTAGCATACGCCATCATTGCGCTCTGCCTGTACCCCATCGCCATCGGTGGCTTTTGGGCATACGGCAACCAGATACCTCCCAATGGCATCCTGAGCGCCCTGTACAAGTTCCACAGCCGCGACGCGTCCAGGCTTGTGCTGGGGGTCACCACACTGCTGGTCATCATCAACTGCCTGACCACGTTCCAGATCTACGCCATGCCGGTGTACGACAACATGGAGGCCGGGTACGTGCACAAGAAGAACCGGCCGTGCCCGTGTGGATGCGCTCGGGCTTCCGCGCCTTCTTCGGCGCGGTCAACCTCCTCGTCGCCGTCGCGATGCCGTTCCTGTCGGAGCTCGCCGGCCTCTTCGGAGGGATCTCGCTGCCGGTCACCCTGGCCTACCCGTGCTTCATGTGGGTGGCGATCAAGAAGCCGCGGAAGGGCACCGCCACGTGGAACGTCAACTGGGCGCTGGGAATCCTTGGCATGAGGCATAAGGCCTTGTCCTCATAGTCGGGAACCTGTGGGGTCTCGTGGAGAAAGGCATGCGTGTCAAGTTCTTCAAGCCTGCCGATTTCCAGTGATAAAAAGATGCAGATTTGTCACTCAGTTGGATTCGTAATCGTAATGCAATGCTTTTAGATATGTTGATTTCTTCCTCAGGAATGTATAATGTTGTGTACATATTAGCAATTTGCAAGAAGCAACGTCGTCTG

SEQ ID NO: 911 - DNA, 1092 bp, Zea mays
  misc_feature (1)..(1092): Ceres cDNA ID no. 12376878
  misc_feature (1)..(1092): Ceres CLONE  ID no. 393147
  misc_feature (1)..(1092): Also known as  Ceres CDNA ID no. 23805487
gcacgagaccatttacctagaacatcctaatcaaaaaaatccatcttcagagagagagagagagatagagagagagagagagttggtttgcatggggtgtgtgtcctccaaggagtccagacgacgacctccgggatacgaggatcccaacaccttagctagagagaccacgttttctgtcaacgaagtggaggccctctacgagctgtacaagaggataagctattccataaccaaagacggcctaatccacaaggaggagttccagctcgctctcttccggaacagtaacaagaggaaccttttcgccgatcggatatttgacctgttcgacctgaagcgcaacggagtgattgagttcggggagttcgttcgctccctcgacgttttccacccagctacgcccgtggaagaaaagatcgcctttgcgtttcggctgtacgatctgagaggcactggattcattggacgcgaagagctgaaggaaatggtgctggccattctgaacgaatcagaattacttctttccgacgacgccgtcgaagaaatcgtggatcagactttcaggcaagcggacatgaacggcgacgggaagatagatcctgatgaatggaaggtgttcgcgagcaaaaacccggcacttctaaagaacatgacgctcccatacctcaagtaaaaacccggtacttctaaagaacattaattacccgcaccgcacatgactgggcggcttgatctgacgacgacgtgttgcattttgttgttgttgttgttgttgttgttgttgttgttgttgttgttgttgtgcatcgtcatcttgtacacgtacagggacataaccatggcgttccccagctttgttctcaactctggagccagtgacgacgagttgtagtagctgcgagcatgcatggccaagctgcgagcgaggaaggaacgctgacctcactcctcagttcactaagtttcagacggagcagcagcaggaggacccctcctgaaaggtgatttggaagctggtggttcactcaagctgctaggatcatctgtggaagaacacacatgctccatacttgcccagcccacagcaac

SEQ ID NO: 912 - protein, 1092 aa, Zea mays
  misc_feature: PFam Name: efhand; PFam Description: EF hand
  misc_feature: GI Number: 50907083; NR Description: putative calcineurin B [Oryza sativa (japonica cultivar-group)] >gi|47847964|dbj|BAD21753.1| putative calcineurin B [Oryza sativa
  misc_feature: GI Number: 50907095; NR Description: putative calcineurin B [Oryza sativa (japonica cultivar-group)] >gi|47847971|dbj|BAD21759.1| putative calcineurin B [Oryza sativa
  misc_feature: GI Number: 50932465; NR Description: putative calcineurin B-like protein 8 (CBL8) [Oryza sativa (japonica cultivar-group)] >gi|45680422|gb|AAS75223.1| putative calcineurin B-like protein [Oryza sativa (japonica cultivar-group)] (CBL8) [Oryza sativa
  misc_feature: GI Number: 66765939; NR Description: calcium sensor
  misc_feature: GI Number: 20465717; NR Description: putative calcium sensor-like protein [Arabidopsis thaliana] >gi|17381074|gb|AAL36349.1| putative calcium sensor homolog [Arabidopsis thaliana] >gi|10177086|dbj|BAB10392.1| calcium sensor
GCACGAGACCATTTACCTAGAACATCCTAATCAAAAAAATCCATCTTCAGAGAGAGAGAGAGAGATAGAGAGAGAGAGAGAGTTGGTTTGCATGGGGTGTGTGTCCTCCAAGGAGTCCAGACGACGACCTCCGGGATACGAGGATCCCAACACCTTAGCTAGAGAGACCACGTTTTCTGTCAACGAAGTGGAGGCCCTCTACGAGCTGTACAAGAGGATAAGCTATTCCATAACCAAAGACGGCCTAATCCACAAGGAGGAGTTCCAGCTCGCTCTCTTCCGGAACAGTAACAAGAGGAACCTTTTCGCCGATCGGATATTTGACCTGTTCGACCTGAAGCGCAACGGAGTGATTGAGTTCGGGGAGTTCGTTCGCTCCCTCGACGTTTTCCACCCAGCTACGCCCGTGGAAGAAAAGATCGCCTTTGCGTTTCGGCTGTACGATCTGAGAGGCACTGGATTCATTGGACGCGAAGAGCTGAAGGAAATGGTGCTGGCCATTCTGAACGAATCAGAATTACTTCTTTCCGACGACGCCGTCGAAGAAATCGTGGATCAGACTTTCAGGCAAGCGGACATGAACGGCGACGGGAAGATAGATCCTGATGAATGGAAGGTGTTCGCGAGCAAAAACCCGGCACTTCTAAAGAACATGACGCTCCCATACCTCAAGTAAAAACCCGGTACTTCTAAAGAACATTAATTACCCGCACCGCACATGACTGGGCGGCTTGATCTGACGACGACGTGTTGCATTTTGTTGTTGTTGTTGTTGTTGTTGTTGTTGTTGTTGTTGTTGTTGTTGTGCATCGTCATCTTGTACACGTACAGGGACATAACCATGGCGTTCCCCAGCTTTGTTCTCAACTCTGGAGCCAGTGACGACGAGTTGTAGTAGCTGCGAGCATGCATGGCCAAGCTGCGAGCGAGGAAGGAACGCTGACCTCACTCCTCAGTTCACTAAGTTTCAGACGGAGCAGCAGCAGGAGGACCCCTCCTGAAAGGTGATTTGGAAGCTGGTGGTTCACTCAAGCTGCTAGGATCATCTGTGGAAGAACACACATGCTCCATACTTGCCCAGCCCACAGCAAC

SEQ ID NO: 913 - DNA, 1329 bp, Arabidopsis thaliana
  misc_feature (1)..(1329): Ceres cDNA ID no. 12377456
  misc_feature (1)..(1329): Ceres CLONE  ID no. 147857
  misc_feature (1)..(1329): Also known as  Ceres CDNA ID no. 23378226
atggagccaaagtttcatgcttttatgtttccatggtttgcttttggtcatatgattccatttctacatcttgcaaacaaactagctgaaaaaggtcaccgagttactttcttgctacctaagaaagcacaaaaacagttggaacatcacaacttgttcccagacagtattgtctttcaccctctcacagttcctcctgtcaatggcctccctgctggtgccgagacaacctcggatatccccatctcgttggacaacctcttgtccaaagccttggatctcactcgcgatcaggttgaagctgcggttcgtgctttgagacctgacttgatctttttcgattttgctcaatggattccagatatggctaaagaacatatgatcaagagtgtgagttacatcattgtatctgcgacaacaatagctcatacacatgtccctggaggtaaattaggtgttcgcccaccgggttatccgtcatcaaaggtgatgttccgtgaaaacgatgttcatgccttagcaaccttatcgatattttacaagagactgtatcatcagatcactacaggtcttaagagctgtgatgtcattgcattgaggacttgcaaagaagtcgaaggtatgttctgcgactttatatcgcgtcaataccataagaaggttctcttgactggtccaatgttccctgagccagacacaagtaaaccactagaagaacgctggaatcattttctaagcgggttcgcgccgaagtcagtagtgttttgttcacctggcagccaagtaattcttgagaaagatcaattccaagaactctgtttagggatggagctaacaggtttaccatttcttttagcggtaaagccaccaagaggatcatcaacggtccaagaagggttaccagaagggttcgaggagcgggtgaaagatcgtggtgttgtttggggaggatgggtgcaacaacctttgatattggctcatccatcaataggttgctttgtgaaccattgtggtcccggaacaatatgggagtctttggtgagtgattgccaaatggttttgattccatttttaagtgatcaagttctcttcacaagattgatgaccgaggaattcgaggtctctgtagaagtgccgagggaaaaaacaggatggttttcaaaggagagcttgagcaatgctatcaaatctgtgatggataaagacagtgacattgggaagttagtgaggagtaaccacaccaaattgaaggagattttagttagtcctggattattgactggttacgttgatcactttgtagagggattgcaagagaatttgatttga

SEQ ID NO: 914 - protein, 1329 aa, Arabidopsis thaliana
  misc_feature: PFam Name: UDPGT; PFam Description: UDP-glucoronosyl and
  misc_feature: PFam Name: Glyco_transf_28; PFam Description:
  misc_feature: GI Number: 29028768; NR Description: At2g22930 [Arabidopsis thaliana] >gi|3445210|gb|AAC32440.1| putative flavonol 3-O-glucosyltransferase [Arabidopsis thaliana]
  misc_feature: GI Number: 5042426; NR Description: Similar to Flavonol 3-O-Glucosyltransferase [Arabidopsis thaliana] >gi|15217773|ref|NP_176671.1| glycosyltransferase family protein
  misc_feature: GI Number: 5042427; NR Description: Similar to Flavonol 3-O-Glucosyltransferase [Arabidopsis thaliana] >gi|15217796|ref|NP_176672.1| glycosyltransferase family protein
  misc_feature: GI Number: 42566366; NR Description: glycosyltransferase
  misc_feature: GI Number: 23296737; NR Description: putative UDP rhamnose-anthocyanidin-3-glucoside rhamnosyltransferase [Arabidopsis thaliana] >gi|17979396|gb|AAL49923.1| putative UDP rhamnose-anthocyanidin-3-glucoside rhamnosyltransferase
ATGGAGCCAAAGTTTCATGCTTTTATGTTTCCATGGTTTGCTTTTGGTCATATGATTCCATTTCTACATCTTGCAAACAAACTAGCTGAAAAAGGTCACCGAGTTACTTTCTTGCTACCTAAGAAAGCACAAAAACAGTTGGAACATCACAACTTGTTCCCAGACAGTATTGTCTTTCACCCTCTCACAGTTCCTCCTGTCAATGGCCTCCCTGCTGGTGCCGAGACAACCTCGGATATCCCCATCTCGTTGGACAACCTCTTGTCCAAAGCCTTGGATCTCACTCGCGATCAGGTTGAAGCTGCGGTTCGTGCTTTGAGACCTGACTTGATCTTTTTCGATTTTGCTCAATGGATTCCAGATATGGCTAAAGAACATATGATCAAGAGTGTGAGTTACATCATTGTATCTGCGACAACAATAGCTCATACACATGTCCCTGGAGGTAAATTAGGTGTTCGCCCACCGGGTTATCCGTCATCAAAGGTGATGTTCCGTGAAAACGATGTTCATGCCTTAGCAACCTTATCGATATTTTACAAGAGACTGTATCATCAGATCACTACAGGTCTTAAGAGCTGTGATGTCATTGCATTGAGGACTTGCAAAGAAGTCGAAGGTATGTTCTGCGACTTTATATCGCGTCAATACCATAAGAAGGTTCTCTTGACTGGTCCAATGTTCCCTGAGCCAGACACAAGTAAACCACTAGAAGAACGCTGGAATCATTTTCTAAGCGGGTTCGCGCCGAAGTCAGTAGTGTTTTGTTCACCTGGCAGCCAAGTAATTCTTGAGAAAGATCAATTCCAAGAACTCTGTTTAGGGATGGAGCTAACAGGTTTACCATTTCTTTTAGCGGTAAAGCCACCAAGAGGATCATCAACGGTCCAAGAAGGGTTACCAGAAGGGTTCGAGGAGCGGGTGAAAGATCGTGGTGTTGTTTGGGGAGGATGGGTGCAACAACCTTTGATATTGGCTCATCCATCAATAGGTTGCTTTGTGAACCATTGTGGTCCCGGAACAATATGGGAGTCTTTGGTGAGTGATTGCCAAATGGTTTTGATTCCATTTTTAAGTGATCAAGTTCTCTTCACAAGATTGATGACCGAGGAATTCGAGGTCTCTGTAGAAGTGCCGAGGGAAAAAACAGGATGGTTTTCAAAGGAGAGCTTGAGCAATGCTATCAAATCTGTGATGGATAAAGACAGTGACATTGGGAAGTTAGTGAGGAGTAACCACACCAAATTGAAGGAGATTTTAGTTAGTCCTGGATTATTGACTGGTTACGTTGATCACTTTGTAGAGGGATTGCAAGAGAATTTGATTTGA

SEQ ID NO: 915 - DNA, 1206 bp, Arabidopsis thaliana
  misc_feature (1)..(1206): Ceres cDNA ID no. 12377569
  misc_feature (1)..(1206): Ceres CLONE  ID no. 8849
  misc_feature (1)..(1206): Also known as  Ceres CDNA ID no. 23378298
actctcaaaatcatcttcttcacccaaaaacccctaaaagccttatcccttcttcttcccatggctgcttcagcttcgtctctcgctctctcttccttcaaccctaaatctcttcctttcggcgtctccagacctgcctccgtttccctcttatctccttccctctcctttaaactcaattccgactccgtttccttctccatcgccgccaaatggaactctcccgcttctcgcttcgtccgtaacgttgcgattacctcagagttcgaggtggaagaagatggtttcgctgacgtcgctccgccaaaagagcaatctttctctgctgaccttaaactcttcgttggtaaccttcctttcaacgttgacagtgctcagctcgctcagctctttgagagtgccggaaatgttgagatggttgaggtaatctatgacaaaattacaggaagaagcagaggttttggattcgtgactatgtcttcagtttctgaagttgaggcagctgctcagcagttcaatggctatgagttggatggtagacctttgagagtcaatgctggtcccccaccaccaaagagggaagatggtttctccagaggacctaggagcagctttggaagctcaggttctggatatggaggaggtggtggttctggtgctggttcaggaaaccgtgtttatgtgggtaacctctcttggggagttgatgacatggctcttgagagtttgttctcggagcaaggaaaggttgttgaggccagagtcatctacgacagggacagtggtcgatccaagggttttggatttgtgacatacgactcttctcaagaggtccaaaatgccatcaagtccttggatggtgctgatttggacggtagacaaattagagtctcggaagctgaggctaggcctccaaggcgccaatattgagcaccaatctatgacttcctattctcaaaaacgcatattctggagggcgcttcgaagtaaagagggtttgtgagatgatggcagtttcagacggtactaagctcttagcttcgcctatgtttgttgccttggatgcaagaaggtcgtaaaggaatggtctttttttttttgagaaacgtataattaagatagaaactggagagaccatgttcttgtctgtctgaatgctgccattgactgcttcgctttggttttgattcaatttttttttctctc

SEQ ID NO: 916 - protein, 1206 aa, Arabidopsis thaliana
  misc_feature: PFam Name: RRM_1; PFam Description: RNA recognition motif.
  misc_feature: GI Number: 21617920; NR Description: putative RNA-binding
  misc_feature: GI Number: 16323482; NR Description: putative RNA-binding protein [Arabidopsis thaliana] >gi|13877809|gb|AAK43982.1| putative RNA-binding protein [Arabidopsis thaliana] >gi|20197716|gb|AAM15222.1| putative RNA-binding protein
  misc_feature: GI Number: 21593426; NR Description: RNA-binding protein cp29 protein [Arabidopsis thaliana] >gi|6729497|emb|CAB67653.1| RNA-binding protein cp29 protein [Arabidopsis thaliana] >gi|18655393|gb|AAL76152.1| AT3g53460/F4P12_160 [Arabidopsis
  misc_feature: GI Number: 681902; NR Description: cp29 [Arabidopsis thaliana] >gi|1076303|pir||S53490 RNA-binding protein cp29 precursor - Arabidopsis thaliana >gi|30693824|ref|NP_850692.1| 29 kDa ribonucleoprotein, chloroplast / RNA-binding protein cp 29
  misc_feature: GI Number: 681904; NR Description: cp29 [Arabidopsis thaliana]
ACTCTCAAAATCATCTTCTTCACCCAAAAACCCCTAAAAGCCTTATCCCTTCTTCTTCCCATGGCTGCTTCAGCTTCGTCTCTCGCTCTCTCTTCCTTCAACCCTAAATCTCTTCCTTTCGGCGTCTCCAGACCTGCCTCCGTTTCCCTCTTATCTCCTTCCCTCTCCTTTAAACTCAATTCCGACTCCGTTTCCTTCTCCATCGCCGCCAAATGGAACTCTCCCGCTTCTCGCTTCGTCCGTAACGTTGCGATTACCTCAGAGTTCGAGGTGGAAGAAGATGGTTTCGCTGACGTCGCTCCGCCAAAAGAGCAATCTTTCTCTGCTGACCTTAAACTCTTCGTTGGTAACCTTCCTTTCAACGTTGACAGTGCTCAGCTCGCTCAGCTCTTTGAGAGTGCCGGAAATGTTGAGATGGTTGAGGTAATCTATGACAAAATTACAGGAAGAAGCAGAGGTTTTGGATTCGTGACTATGTCTTCAGTTTCTGAAGTTGAGGCAGCTGCTCAGCAGTTCAATGGCTATGAGTTGGATGGTAGACCTTTGAGAGTCAATGCTGGTCCCCCACCACCAAAGAGGGAAGATGGTTTCTCCAGAGGACCTAGGAGCAGCTTTGGAAGCTCAGGTTCTGGATATGGAGGAGGTGGTGGTTCTGGTGCTGGTTCAGGAAACCGTGTTTATGTGGGTAACCTCTCTTGGGGAGTTGATGACATGGCTCTTGAGAGTTTGTTCTCGGAGCAAGGAAAGGTTGTTGAGGCCAGAGTCATCTACGACAGGGACAGTGGTCGATCCAAGGGTTTTGGATTTGTGACATACGACTCTTCTCAAGAGGTCCAAAATGCCATCAAGTCCTTGGATGGTGCTGATTTGGACGGTAGACAAATTAGAGTCTCGGAAGCTGAGGCTAGGCCTCCAAGGCGCCAATATTGAGCACCAATCTATGACTTCCTATTCTCAAAAACGCATATTCTGGAGGGCGCTTCGAAGTAAAGAGGGTTTGTGAGATGATGGCAGTTTCAGACGGTACTAAGCTCTTAGCTTCGCCTATGTTTGTTGCCTTGGATGCAAGAAGGTCGTAAAGGAATGGTCTTTTTTTTTTTGAGAAACGTATAATTAAGATAGAAACTGGAGAGACCATGTTCTTGTCTGTCTGAATGCTGCCATTGACTGCTTCGCTTTGGTTTTGATTCAATTTTTTTTTCTCTC

SEQ ID NO: 917 - DNA, 994 bp, Zea mays
  misc_feature (1)..(994): Ceres cDNA ID no. 12377725
  misc_feature (1)..(994): Ceres CLONE  ID no. 349792
  misc_feature (1)..(994): Also known as  Ceres CDNA ID no. 23789363
gcacgagaccattacctagaacatcctaatcgaaaaaccatcctgcacacactgcaatctccgtccatccctccgtttccttttttcctctgttgccatcagttcagtagtagcctgcagctctcccaccttctcgctgcgctgtactgtgctggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaacttccacttcgttgagaactgggttaagatcggcttccctgccaagattaaggtgaagaaagaccacgcatcggtgccgttcgatgaccagtgctctattctagagaaggaggccgtgaacctgtccctggagaacctcaagacctaccccttcgtcaaggaagggctggccaacgggacgctcaagctggtcggcggccactacaacttcgtgtcaggggagttccacccttggcactgaagtgattttttttgtaattcctcggcactgaagtgaagttttgtctgaatattgcctcgtaacataattgcccggtccctgttctagttgtggcgcagtctggtttgttttgacatttgttttcaaggttcatccttatttgcattgcatttgtttatggcttgacgttaacatttggaacaagtatttgtcaccgctcatgtcgatggtgtaaaacatg

SEQ ID NO: 918 - protein, 994 aa, Zea mays
  misc_feature: PFam Name: Pro_CA; PFam Description: Carbonic anhydrase
  misc_feature: GI Number: 5917783; NR Description: carbonic anhydrase 3 [Oryza sativa] >gi|7436816|pir||T03254 probable carbonate dehydratase (EC 4.2.1.1), chloroplast - rice
  misc_feature: GI Number: 34911604; NR Description: carbonic anhydrase [Oryza sativa (japonica cultivar-group)] >gi|3345477|dbj|BAA31953.1| carbonic anhydrase [Oryza sativa] >gi|15290096|dbj|BAB63789.1| carbonic anhydrase [Oryza sativa
  misc_feature: GI Number: 729003; NR Description: CARBONIC ANHYDRASE, CHLOROPLAST PRECURSOR (CARBONATE DEHYDRATASE) >gi|7436817|pir||T04478 probable carbonate dehydratase (EC 4.2.1.1)
  misc_feature: GI Number: 882248; NR Description: carbonic anhydrase 1
  misc_feature: GI Number: 882246; NR Description: carbonic anhydrase 2
GCACGAGACCATTACCTAGAACATCCTAATCGAAAAACCATCCTGCACACACTGCAATCTCCGTCCATCCCTCCGTTTCCTTTTTTCCTCTGTTGCCATCAGTTCAGTAGTAGCCTGCAGCTCTCCCACCTTCTCGCTGCGCTGTACTGTGCTGGCAGGGGAGGGGCCATGGACGACCCCGTCGAGCGCTTGAAGGACGGGTTCCACAAGTTCAAGACCGAGGTCTATGACAAGAAGCCGGAGCTGTTCGAGCCTCTCAAGGCCGGCCAGGCCCCCAAGTACGTGGTGTTCGCCTGCTCCGACTCCCGCGTGTGCCCGTCGGTGACCCTGGGCCTGCAGCCCGGCGAGGCCTTCACCGTCCGCAACATCGCCGCCATGGTCCCAGCCTACGACAAGACCAAGTACACCGGCATCGGGTCCGCCATCGAGTACGCCGTGTGCGCGCTCAAGGTGGAGGTCCTCGTGGTCATTGGCCACAGCTGCTGCGGTGGCATCAGGGCGCTCCTCTCCCTCCAGGACGGCGCACCTGACAACTTCCACTTCGTTGAGAACTGGGTTAAGATCGGCTTCCCTGCCAAGATTAAGGTGAAGAAAGACCACGCATCGGTGCCGTTCGATGACCAGTGCTCTATTCTAGAGAAGGAGGCCGTGAACCTGTCCCTGGAGAACCTCAAGACCTACCCCTTCGTCAAGGAAGGGCTGGCCAACGGGACGCTCAAGCTGGTCGGCGGCCACTACAACTTCGTGTCAGGGGAGTTCCACCCTTGGCACTGAAGTGATTTTTTTTGTAATTCCTCGGCACTGAAGTGAAGTTTTGTCTGAATATTGCCTCGTAACATAATTGCCCGGTCCCTGTTCTAGTTGTGGCGCAGTCTGGTTTGTTTTGACATTTGTTTTCAAGGTTCATCCTTATTTGCATTGCATTTGTTTATGGCTTGACGTTAACATTTGGAACAAGTATTTGTCACCGCTCATGTCGATGGTGTAAAACATG

SEQ ID NO: 919 - DNA, 2228 bp, Zea mays
  misc_feature (1)..(2228): Ceres cDNA ID no. 12377954
  misc_feature (1)..(2228): Ceres CLONE  ID no. 357049
  misc_feature (1)..(2228): Also known as  Ceres CDNA ID no. 23850344
gcacgagaccattacctagaacatcctaatcgaaaaaccttcctccgttgcctcctcttccgcggccccgtcgatgggcttggctttaccagtggcgggttcccacacgggggctagacgccgccaccgctgaccccgtctacaccgaatcccccgcgcgatttaacccctcgcctcgctcgccgcctccgcttccatacaaccgcgcactccaaacgcgcacgcgctgttcgttcctcggccgctctgtccacccccgtccttctccgccctcaacagatctccgccggccgtgcggttccttaattcgccttctccgggactgtcggatctccgcggcggctggggatgggcaactgctgcgtgacgccgaaagcagccgacgacgccggcggcggcaagaagcccaaggagccgaagcagaagaagggtaagaagccgaaccccttctcgatcgattacaaccgctcggggccaggcgagcgcgccaaagctggtggtgctgcgggatcccacggggcgggacatcgcggcgcggtacgagctcggcgcggagctcgggcgcggcgagttcggggttacctacctctgcacagaccgtgcctcaggggaggcgctggcctgcaagtctatctccaagaagaagctccgcaccgccgtcgacctcgaggacgtgcgccgggaggtggagatcatgcgccacctccccaagcaccccaacgtcgtcacgctcagggacacgtacgaggacgacaatgccgtgcacctcgtcatggagctctgcgagggcggtgagctcttcgaccgcatcgtggcgcggggacactacactgagcgtgctgccgccttggtcttacgcactatcgttgaggtcgtgcagatgtgccataagcatggagtgatgcacagggatctcaaaccagaaaatttcttgtttgcaaacaagaaagaatcagcggcacttaaggccattgattttggcctgtctgtatttttcacaccaggcgaacggttttctgagattgttggaagtccttattacatggctccagaggtgctaaagagaaactatggcccagaggttgatgtttggagtgcaggagtgattctgtacattcttctttgtggtgtccccccattctgggcagaaacggaacagggtgttgctcaggcaatcattcgatctgtcattgatttcaaaagagatccatggccaagggtgtctgataatgccaaagaccttgtcagaggaatgctgaatccggacccaaaacgacgattgacagctcaccaagtgcttggtcacccatggttgcagaacattaagaaggctccaaatgtcaatttgggtgaaactgttaaggccagactccaacaattctctgtgatgaacaagttcaagaagcatgcacttagggttatagctgagcatctttcggtagaagaggctgctgacataaaggatatgtttgagaagatggatcttaacaaggatcaaatgcttagtttcgaggagctgaagcttggtctgcataagtttggtcaccagatgcctgatgcagatgttcaaacactaatggaagcggcggatgctgatggaaatggatccttgaattatggagaatttgttacattatttgttcatctaagaaagattggaaatgatgagcatctgcataaggcatttgcatacttcgaccggaaccagagtggttatattgaaattgatgaactccgtgagtcattagctgatgaccttggacaaaaccgtgaagagattatcaatgccatcatccgtgatgtagacaccgataaggatggcaagataagctacgatgagtttgcgacgatgatgaaggccggaacagactggaggaaagcatccagacagtactcgagagagcggttcaccagtctgagccttaagctgcaaaaggatggatcgctgcagatgacgagtacacggtagcccgataacaccataggcaagttgtgaattacagatggaaaccatgtgtagatttttctggttgtttgttgacagctcttctgcttgtcctgatgttccattgctttgtattcttcgcttgcggcctgtttgaaggattaggggggattgtttatgctatgattgtatttagactgcatgatccatgcctcgctcgtttccaaagtgtactgtacaaaagaaagaggagaaagggattatgaggctctgctcatttctt

SEQ ID NO: 920 - protein, 2228 aa, Zea mays
  misc_feature: PFam Name: Pkinase; PFam Description: Protein kinase domain
  misc_feature: GI Number: 17386100; NR Description: AT4g23650/F9D16_120 [Arabidopsis thaliana] >gi|15450437|gb|AAK96512.1|
  misc_feature: GI Number: 31711962; NR Description: At3g20410 [Arabidopsis thaliana] >gi|9294561|dbj|BAB02824.1| calmodulin-domain protein kinase CDPK isoform 9 [Arabidopsis thaliana] >gi|21539465|gb|AAM53285.1| calmodulin-domain protein kinase CDPK
  misc_feature: GI Number: 45773914; NR Description: At3g57530 [Arabidopsis thaliana] >gi|44681392|gb|AAS47636.1| At3g57530 [Arabidopsis thaliana] >gi|30694663|ref|NP_191312.2| calcium-dependent protein
  misc_feature: GI Number: 4336426; NR Description: Ca2+-dependent protein
  misc_feature: GI Number: 38344274; NR Description: OSJNBa0013K16.2 [Oryza sativa (japonica cultivar-group)] >gi|10944296|dbj|BAB16888.1|
GCACGAGACCATTACCTAGAACATCCTAATCGAAAAACCTTCCTCCGTTGCCTCCTCTTCCGCGGCCCCGTCGATGGGCTTGGCTTTACCAGTGGCGGGTTCCCACACGGGGGCTAGACGCCGCCACCGCTGACCCCGTCTACACCGAATCCCCCGCGCGATTTAACCCCTCGCCTCGCTCGCCGCCTCCGCTTCCATACAACCGCGCACTCCAAACGCGCACGCGCTGTTCGTTCCTCGGCCGCTCTGTCCACCCCCGTCCTTCTCCGCCCTCAACAGATCTCCGCCGGCCGTGCGGTTCCTTAATTCGCCTTCTCCGGGACTGTCGGATCTCCGCGGCGGCTGGGGATGGGCAACTGCTGCGTGACGCCGAAAGCAGCCGACGACGCCGGCGGCGGCAAGAAGCCCAAGGAGCCGAAGCAGAAGAAGGGTAAGAAGCCGAACCCCTTCTCGATCGATTACAACCGCTCGGGGCCAGGCGAGCGCGCCAAAGCTGGTGGTGCTGCGGGATCCCACGGGGCGGGACATCGCGGCGCGGTACGAGCTCGGCGCGGAGCTCGGGCGCGGCGAGTTCGGGGTTACCTACCTCTGCACAGACCGTGCCTCAGGGGAGGCGCTGGCCTGCAAGTCTATCTCCAAGAAGAAGCTCCGCACCGCCGTCGACCTCGAGGACGTGCGCCGGGAGGTGGAGATCATGCGCCACCTCCCCAAGCACCCCAACGTCGTCACGCTCAGGGACACGTACGAGGACGACAATGCCGTGCACCTCGTCATGGAGCTCTGCGAGGGCGGTGAGCTCTTCGACCGCATCGTGGCGCGGGGACACTACACTGAGCGTGCTGCCGCCTTGGTCTTACGCACTATCGTTGAGGTCGTGCAGATGTGCCATAAGCATGGAGTGATGCACAGGGATCTCAAACCAGAAAATTTCTTGTTTGCAAACAAGAAAGAATCAGCGGCACTTAAGGCCATTGATTTTGGCCTGTCTGTATTTTTCACACCAGGCGAACGGTTTTCTGAGATTGTTGGAAGTCCTTATTACATGGCTCCAGAGGTGCTAAAGAGAAACTATGGCCCAGAGGTTGATGTTTGGAGTGCAGGAGTGATTCTGTACATTCTTCTTTGTGGTGTCCCCCCATTCTGGGCAGAAACGGAACAGGGTGTTGCTCAGGCAATCATTCGATCTGTCATTGATTTCAAAAGAGATCCATGGCCAAGGGTGTCTGATAATGCCAAAGACCTTGTCAGAGGAATGCTGAATCCGGACCCAAAACGACGATTGACAGCTCACCAAGTGCTTGGTCACCCATGGTTGCAGAACATTAAGAAGGCTCCAAATGTCAATTTGGGTGAAACTGTTAAGGCCAGACTCCAACAATTCTCTGTGATGAACAAGTTCAAGAAGCATGCACTTAGGGTTATAGCTGAGCATCTTTCGGTAGAAGAGGCTGCTGACATAAAGGATATGTTTGAGAAGATGGATCTTAACAAGGATCAAATGCTTAGTTTCGAGGAGCTGAAGCTTGGTCTGCATAAGTTTGGTCACCAGATGCCTGATGCAGATGTTCAAACACTAATGGAAGCGGCGGATGCTGATGGAAATGGATCCTTGAATTATGGAGAATTTGTTACATTATTTGTTCATCTAAGAAAGATTGGAAATGATGAGCATCTGCATAAGGCATTTGCATACTTCGACCGGAACCAGAGTGGTTATATTGAAATTGATGAACTCCGTGAGTCATTAGCTGATGACCTTGGACAAAACCGTGAAGAGATTATCAATGCCATCATCCGTGATGTAGACACCGATAAGGATGGCAAGATAAGCTACGATGAGTTTGCGACGATGATGAAGGCCGGAACAGACTGGAGGAAAGCATCCAGACAGTACTCGAGAGAGCGGTTCACCAGTCTGAGCCTTAAGCTGCAAAAGGATGGATCGCTGCAGATGACGAGTACACGGTAGCCCGATAACACCATAGGCAAGTTGTGAATTACAGATGGAAACCATGTGTAGATTTTTCTGGTTGTTTGTTGACAGCTCTTCTGCTTGTCCTGATGTTCCATTGCTTTGTATTCTTCGCTTGCGGCCTGTTTGAAGGATTAGGGGGGATTGTTTATGCTATGATTGTATTTAGACTGCATGATCCATGCCTCGCTCGTTTCCAAAGTGTACTGTACAAAAGAAAGAGGAGAAAGGGATTATGAGGCTCTGCTCATTTCTT

SEQ ID NO: 921 - DNA, 962 bp, Zea mays
  misc_feature (1)..(962): Ceres cDNA ID no. 12378113
  misc_feature (1)..(962): Ceres CLONE  ID no. 448138
  misc_feature (1)..(962): Also known as  Ceres CDNA ID no. 23809673
catgttacaggaatgacccagagacatcaaagatgttagggactagaatgtggcctcctgagggtgaagtttataaaaccgacattgtagctgttgggcagggaaggcctggatcatgtaattgcctctacccaggatccttcctctgcagacagctccacacaaatgaagcaagagatcagctacgctctgaacttggtcgagtttttacaatgtggcaatttgattctatgggggaggaggtttctaagctgtggagtcgtgatgagcaactaaagttcgacgcacttgagcaattggttcccgttatggatcaaaagacatattgggctgttgtgtcgaaaaattttgcttcaaagcccaggatagatttgataaagtactatctgaatgtgttcctgatgagaagagtgttgtaccagtgcagactcggtcttctggaaattgatagtgacgaagatgacgtggaggaagaagaggatgaagatcaacctgaaggatccagctctcttcagaggactcaagatgcccaagacttgaagaaggtgccatgattctgctgacaaccaatctgacatgcttttttgcatgtgccttttgttcaagtttatgctgagacattgcatcaagtgatgcaccattgctccgagtgattgcaagtctaattttttgcagattttttggttgagggttgcattcactttggttcagccatcttttgtggacagaaaactaaaccgagtgttaaatcatccccgcgcgtctatctaggcaagcaaatcaatacttcaacctcaccagatccaaatcattttctgttgtaagggggagggggttaagcaggtcatcatctcatccgcatttggttggcttgtgctcttggcatgacaaaaccttcgagtctgactagtttggttacctatgttcagcggatacatcagaatcttccagatgttatttcc

SEQ ID NO: 922 - protein, 962 aa, Zea mays
  misc_feature: PFam Name: ELM2; PFam Description: ELM2 domain
  misc_feature: GI Number: 56784258; NR Description: MYB transcription
  misc_feature: GI Number: 34908364; NR Description: P0529E05.8 [Oryza sativa (japonica cultivar-group)] >gi|18461195|dbj|BAB84392.1| P0529E05.8
  misc_feature: GI Number: 42570671; NR Description: myb family transcription
  misc_feature: GI Number: 28394109; NR Description: putative MYB family transcription factor [Arabidopsis thaliana] >gi|27754610|gb|AAO22751.1| putative MYB family transcription factor [Arabidopsis thaliana] >gi|4335752|gb|AAD17429.1| putative
  misc_feature: GI Number: 30102658; NR Description: At1g13880 [Arabidopsis thaliana] >gi|8778387|gb|AAF79395.1| F16A14.9 [Arabidopsis thaliana] >gi|15222974|ref|NP_172841.1| ELM2 domain-containing
CATGTTACAGGAATGACCCAGAGACATCAAAGATGTTAGGGACTAGAATGTGGCCTCCTGAGGGTGAAGTTTATAAAACCGACATTGTAGCTGTTGGGCAGGGAAGGCCTGGATCATGTAATTGCCTCTACCCAGGATCCTTCCTCTGCAGACAGCTCCACACAAATGAAGCAAGAGATCAGCTACGCTCTGAACTTGGTCGAGTTTTTACAATGTGGCAATTTGATTCTATGGGGGAGGAGGTTTCTAAGCTGTGGAGTCGTGATGAGCAACTAAAGTTCGACGCACTTGAGCAATTGGTTCCCGTTATGGATCAAAAGACATATTGGGCTGTTGTGTCGAAAAATTTTGCTTCAAAGCCCAGGATAGATTTGATAAAGTACTATCTGAATGTGTTCCTGATGAGAAGAGTGTTGTACCAGTGCAGACTCGGTCTTCTGGAAATTGATAGTGACGAAGATGACGTGGAGGAAGAAGAGGATGAAGATCAACCTGAAGGATCCAGCTCTCTTCAGAGGACTCAAGATGCCCAAGACTTGAAGAAGGTGCCATGATTCTGCTGACAACCAATCTGACATGCTTTTTTGCATGTGCCTTTTGTTCAAGTTTATGCTGAGACATTGCATCAAGTGATGCACCATTGCTCCGAGTGATTGCAAGTCTAATTTTTTGCAGATTTTTTGGTTGAGGGTTGCATTCACTTTGGTTCAGCCATCTTTTGTGGACAGAAAACTAAACCGAGTGTTAAATCATCCCCGCGCGTCTATCTAGGCAAGCAAATCAATACTTCAACCTCACCAGATCCAAATCATTTTCTGTTGTAAGGGGGAGGGGGTTAAGCAGGTCATCATCTCATCCGCATTTGGTTGGCTTGTGCTCTTGGCATGACAAAACCTTCGAGTCTGACTAGTTTGGTTACCTATGTTCAGCGGATACATCAGAATCTTCCAGATGTTATTTCC

SEQ ID NO: 923 - DNA, 1811 bp, Zea mays
  misc_feature (1)..(1811): Ceres cDNA ID no. 12379731
  misc_feature (1)..(1811): Ceres CLONE  ID no. 295593
  misc_feature (1)..(1811): Also known as  Ceres CDNA ID no. 23781021
gataataaagccctacctctcacatcggcaacaggacgaggccagggcatccacgaccacgacacggacacagggagccgcccgccatgccaccgcacggcggcatgctcgcgtacgccgccctcgcgctcgcggcgctgcggctgctgctgtcctacaagtcggcgctctacgcgctgcgccgcctgtggcggtgcgccgacgagtgggcgcaggcgtaccagtaccacgaggtgccgcgcttcgccggggcccagtgcgggtgcgacggcgcagagaacccgctgttccgcaaggtcgccgcgtacgtggcggcgctgccgtcgctggaggacgccgacgctgcgtgcgtggtgtcgtcggcgtcaaggaccaacggcgggctgtccctgcagctcggcccgggccacaccgcgagggacacgtaccttggcgcgcgcctcgcgtggaccagcgcgggcggcgagcgcctggtgctgcgcgtgcgccgccacgaccgctcccgcgtgctgcgaccttacctgcagcacgtggagtccgtggcagaggagatggagcagcgccgccgcgagctgcgcctcttcgccaacaccgccgtggacgcgaccacgggcgcgccgcgctgggcgtcggcgcccttcacccacccggccacgctcgacgccgtggccatggacccggacctcaaggcccgcgtccgcgccgacctcgagagcttcctcaagggccgcgcctactaccaccgcctcggccgcgtctggcgccggagctacctcctctacggcccgccgggcaccggcaagtccacgttcgcggcggccatggccaggttcctgggctacgacgtctacgacgtcgacctgtctcgcgccgacgccgccggcgacgacctccgcgcgctgctcctgcacaccaccccgcgctcgctcgtcctcgtcgaggacctggaccggtacctgcagggcggcggcggggacgcggaggcgcgcgcggccagggtgctgagcttcatggacggcatcgcgtcgtgctgcggcgaggagcgtgtcatggtgttcaccatgcgcgggggcaaggacgccgtggacgccgcggtggtgcgcccgggccggctggacgtgcacatccagttcacgctctgcgacttcgaggccttcaaggcgctggccagcaactacctggggctcaaggaccacaagctgtacccgcaggtggaggaggggttccacgccgccggcgcccgcctcagcccgggccgagcttggcgagatcatgctggccaaccgcgcgtccccgagccgcgcgctccgcagcgtgatcaccaagctccagcgcgtcgcgtccggaggcgccgcgccgccgcggaacccggcgcacaggcggaacacgagctggtccggcgcctggaccggacagcagtgggaggaccaggcccagccggcgcgagccagcgcggtctccgtggaggtcgacgagacggccgccggggcaccggcgacgtgcggcggggtgttcggaaaggaggcgcccatgagggagttcaagaagctgtacgggctgatcaaggtcaggagccggagggagggcgccggcgccgtgccactggaaggcgacgcgcacgggccgccgacgccgggcaaccatgacagggagcggtgatcgccgtggatggtagaattgtagtggtgtgcaaaaagaaagcatttttatttctttctctttttttttcttgttattgttacagtttatcacactactctactaatgtgtcagtgactgcaagtaggaatggcaatagatgaattggatgg

SEQ ID NO: 924 - protein, 1811 aa, Zea mays
  misc_feature: PFam Name: AAA; PFam Description: ATPase family associated
  misc_feature: PFam Name: SerH; PFam Description: Cell surface
  misc_feature: PFam Name: Glutenin_hmw; PFam Description: High molecular
  misc_feature: PFam Name: Peptidase_S8; PFam Description: Subtilase family
  misc_feature: PFam Name: Mucin; PFam Description: Mucin-like glycoprotein
  misc_feature: GI Number: 30690453; NR Description: AAA-type ATPase family
  misc_feature: GI Number: 50726339; NR Description: AAA ATPase, central region (50.1 kD)-like protein [Oryza sativa (japonica
  misc_feature: GI Number: 15233040; NR Description: AAA-type ATPase family
  misc_feature: GI Number: 9294274; NR Description: mitochondrial
  misc_feature: GI Number: 62321200; NR Description: BCS1 like mitochondrial
GATAATAAAGCCCTACCTCTCACATCGGCAACAGGACGAGGCCAGGGCATCCACGACCACGACACGGACACAGGGAGCCGCCCGCCATGCCACCGCACGGCGGCATGCTCGCGTACGCCGCCCTCGCGCTCGCGGCGCTGCGGCTGCTGCTGTCCTACAAGTCGGCGCTCTACGCGCTGCGCCGCCTGTGGCGGTGCGCCGACGAGTGGGCGCAGGCGTACCAGTACCACGAGGTGCCGCGCTTCGCCGGGGCCCAGTGCGGGTGCGACGGCGCAGAGAACCCGCTGTTCCGCAAGGTCGCCGCGTACGTGGCGGCGCTGCCGTCGCTGGAGGACGCCGACGCTGCGTGCGTGGTGTCGTCGGCGTCAAGGACCAACGGCGGGCTGTCCCTGCAGCTCGGCCCGGGCCACACCGCGAGGGACACGTACCTTGGCGCGCGCCTCGCGTGGACCAGCGCGGGCGGCGAGCGCCTGGTGCTGCGCGTGCGCCGCCACGACCGCTCCCGCGTGCTGCGACCTTACCTGCAGCACGTGGAGTCCGTGGCAGAGGAGATGGAGCAGCGCCGCCGCGAGCTGCGCCTCTTCGCCAACACCGCCGTGGACGCGACCACGGGCGCGCCGCGCTGGGCGTCGGCGCCCTTCACCCACCCGGCCACGCTCGACGCCGTGGCCATGGACCCGGACCTCAAGGCCCGCGTCCGCGCCGACCTCGAGAGCTTCCTCAAGGGCCGCGCCTACTACCACCGCCTCGGCCGCGTCTGGCGCCGGAGCTACCTCCTCTACGGCCCGCCGGGCACCGGCAAGTCCACGTTCGCGGCGGCCATGGCCAGGTTCCTGGGCTACGACGTCTACGACGTCGACCTGTCTCGCGCCGACGCCGCCGGCGACGACCTCCGCGCGCTGCTCCTGCACACCACCCCGCGCTCGCTCGTCCTCGTCGAGGACCTGGACCGGTACCTGCAGGGCGGCGGCGGGGACGCGGAGGCGCGCGCGGCCAGGGTGCTGAGCTTCATGGACGGCATCGCGTCGTGCTGCGGCGAGGAGCGTGTCATGGTGTTCACCATGCGCGGGGGCAAGGACGCCGTGGACGCCGCGGTGGTGCGCCCGGGCCGGCTGGACGTGCACATCCAGTTCACGCTCTGCGACTTCGAGGCCTTCAAGGCGCTGGCCAGCAACTACCTGGGGCTCAAGGACCACAAGCTGTACCCGCAGGTGGAGGAGGGGTTCCACGCCGCCGGCGCCCGCCTCAGCCCGGGCCGAGCTTGGCGAGATCATGCTGGCCAACCGCGCGTCCCCGAGCCGCGCGCTCCGCAGCGTGATCACCAAGCTCCAGCGCGTCGCGTCCGGAGGCGCCGCGCCGCCGCGGAACCCGGCGCACAGGCGGAACACGAGCTGGTCCGGCGCCTGGACCGGACAGCAGTGGGAGGACCAGGCCCAGCCGGCGCGAGCCAGCGCGGTCTCCGTGGAGGTCGACGAGACGGCCGCCGGGGCACCGGCGACGTGCGGCGGGGTGTTCGGAAAGGAGGCGCCCATGAGGGAGTTCAAGAAGCTGTACGGGCTGATCAAGGTCAGGAGCCGGAGGGAGGGCGCCGGCGCCGTGCCACTGGAAGGCGACGCGCACGGGCCGCCGACGCCGGGCAACCATGACAGGGAGCGGTGATCGCCGTGGATGGTAGAATTGTAGTGGTGTGCAAAAAGAAAGCATTTTTATTTCTTTCTCTTTTTTTTTCTTGTTATTGTTACAGTTTATCACACTACTCTACTAATGTGTCAGTGACTGCAAGTAGGAATGGCAATAGATGAATTGGATGG

SEQ ID NO: 925 - DNA, 1452 bp, Zea mays
  misc_feature (1)..(1452): Ceres cDNA ID no. 12381050
  misc_feature (1)..(1452): Ceres CLONE  ID no. 336008
  misc_feature (1)..(1452): Also known as  Ceres CDNA ID no. 23774685
  misc_feature (480)..(480): n is a, c, t, g, unknown, or other
  misc_feature (481)..(481): n is a, c, t, g, unknown, or other
  misc_feature (483)..(483): n is a, c, t, g, unknown, or other
  misc_feature (486)..(486): n is a, c, t, g, unknown, or other
  misc_feature (487)..(487): n is a, c, t, g, unknown, or other
  misc_feature (489)..(489): n is a, c, t, g, unknown, or other
  misc_feature (510)..(510): n is a, c, t, g, unknown, or other
  misc_feature (522)..(522): n is a, c, t, g, unknown, or other
acttttgctcttgcctcttggcctttccctcatcgcctaatgtcttggacccttgccccgcctcctgcaagttgcaggcaaccgagaagctaccactactagctgctcaggctctgctcagctcaaaaggcgttcaggtttagtgcacgaaatgagcagcgcgctgcccgcggcagatcgggcgacagggagaaggaggagggagagatgttgctgctaggattagccacgggctgctgcgtcctcgccgtcgccggggaagccgagaagcaggacggcggcggggcgtcgtcctccgggggcggtcatggtcttggttccaagattagccccgccgtgctgttcgccgtggtgatagcggccgtggtgctgttcgtctcctgcctgctgcatctcttggtcaggctcttgctcaggcgcggccgtgcccgtgcccgtgcgcgcgcgggggccgaggccggtgccggcgccggcggtggnncnganncngcgggcggtggcggggaggantccgcgttgcanaggcagctgcagcagctgttccacctgcacgacgccgggctggaccaggacgtcatcgacgcgctcccggtgttcctgtaccgggaggtggtcggcgccggcgccggcgccaaggagccgttcgactgcgcggtctgcctgtgcgagttcgccggcgaggaccggctgcggctgctgccgctgtgcgggcacgcgttccacatcggctgcatcgacacctggctgctctccaactccacgtgcccgctgtgccggtgcgcgctcggcgccgacgctgccgcgctgttggacgaggaaggcatgtgggagcacgaggacgccgtgctccccgtgcgcctcggcaagttcaagaacctggccagggcggcgcctggccccgtgcgcgccggcgccggcattgtgaccagggaggccggcgagacgagcagcagcagcctggacgccaggcggtgctactccatgggctcctaccagtacgtcctcgccgaggcgagcctccaggtgtccgtccacaggaggcacggcgacggccatggcaggggcggggcgggtctcagaggcgtcggcgtcggcgtgggctccaaccgcgccggcgccacagaggggaagaggatcggcgcgggcagcaaaggcgacagcttctcggtgtccaagatttggcagtggccgcggaacggcaaggagaagcttcccgtgctcgcgtccgatgactcgccggccatgaacggcaggctgccgtggcagaggccaagtcccggggattcgtgaatcgtgtcgtgacacagagaaagcgtgtgtggtggtgcgtgctccaaacttgtattgagcttgtctgctcgcccttttaaccgctgatgatgaattggttcataggcattcgttgtttatcttatcttactagtaataataaatctcatttgcttgcttgcc

SEQ ID NO: 926 - protein, 1452 aa, Zea mays
  misc_feature: PFam Name: zf-C3HC4; PFam Description: Zinc finger, C3HC4
  misc_feature: PFam Name: Peptidase_S8; PFam Description: Subtilase family
  misc_feature: PFam Name: Aminotran_3; PFam Description: Aminotransferase
  misc_feature: PFam Name: Glutenin_hmw; PFam Description: High molecular
  misc_feature: PFam Name: SerH; PFam Description: Cell surface
  misc_feature: GI Number: 51535192; NR Description: putative RING finger 1
  misc_feature: GI Number: 50912659; NR Description: putative RING finger 1 [Oryza sativa (japonica cultivar-group)] >gi|46390292|dbj|BAD15742.1| putative RING finger 1 [Oryza sativa
  misc_feature: GI Number: 34898398; NR Description: Similar to Arabidopsis thaliana RING-H2 finger protein RHX1a mRNA, partial cds.(AF079184) [Oryza sativa (japonica cultivar-group)] >gi|5091511|dbj|BAA78746.1| Similar to Arabidopsis [Oryza sativa
  misc_feature: GI Number: 10177512; NR Description: RING zinc finger protein-like [Arabidopsis thaliana] >gi|51970768|dbj|BAD44076.1| RING finger -like protein [Arabidopsis thaliana] >gi|15242616|ref|NP_198841.1| zinc finger (C3HC4-type RING
  misc_feature: GI Number: 50899922; NR Description: RING finger 1 [Oryza sativa (japonica cultivar-group)] >gi|8698835|dbj|BAA96875.1| RING finger 1 [Oryza sativa (japonica cultivar-group)] >gi|49387697|dbj|BAD26043.1| RING finger 1 [Oryza finger 1 [Oryza
ACTTTTGCTCTTGCCTCTTGGCCTTTCCCTCATCGCCTAATGTCTTGGACCCTTGCCCCGCCTCCTGCAAGTTGCAGGCAACCGAGAAGCTACCACTACTAGCTGCTCAGGCTCTGCTCAGCTCAAAAGGCGTTCAGGTTTAGTGCACGAAATGAGCAGCGCGCTGCCCGCGGCAGATCGGGCGACAGGGAGAAGGAGGAGGGAGAGATGTTGCTGCTAGGATTAGCCACGGGCTGCTGCGTCCTCGCCGTCGCCGGGGAAGCCGAGAAGCAGGACGGCGGCGGGGCGTCGTCCTCCGGGGGCGGTCATGGTCTTGGTTCCAAGATTAGCCCCGCCGTGCTGTTCGCCGTGGTGATAGCGGCCGTGGTGCTGTTCGTCTCCTGCCTGCTGCATCTCTTGGTCAGGCTCTTGCTCAGGCGCGGCCGTGCCCGTGCCCGTGCGCGCGCGGGGGCCGAGGCCGGTGCCGGCGCCGGCGGTGGNNCNGANNCNGCGGGCGGTGGCGGGGAGGANTCCGCGTTGCANAGGCAGCTGCAGCAGCTGTTCCACCTGCACGACGCCGGGCTGGACCAGGACGTCATCGACGCGCTCCCGGTGTTCCTGTACCGGGAGGTGGTCGGCGCCGGCGCCGGCGCCAAGGAGCCGTTCGACTGCGCGGTCTGCCTGTGCGAGTTCGCCGGCGAGGACCGGCTGCGGCTGCTGCCGCTGTGCGGGCACGCGTTCCACATCGGCTGCATCGACACCTGGCTGCTCTCCAACTCCACGTGCCCGCTGTGCCGGTGCGCGCTCGGCGCCGACGCTGCCGCGCTGTTGGACGAGGAAGGCATGTGGGAGCACGAGGACGCCGTGCTCCCCGTGCGCCTCGGCAAGTTCAAGAACCTGGCCAGGGCGGCGCCTGGCCCCGTGCGCGCCGGCGCCGGCATTGTGACCAGGGAGGCCGGCGAGACGAGCAGCAGCAGCCTGGACGCCAGGCGGTGCTACTCCATGGGCTCCTACCAGTACGTCCTCGCCGAGGCGAGCCTCCAGGTGTCCGTCCACAGGAGGCACGGCGACGGCCATGGCAGGGGCGGGGCGGGTCTCAGAGGCGTCGGCGTCGGCGTGGGCTCCAACCGCGCCGGCGCCACAGAGGGGAAGAGGATCGGCGCGGGCAGCAAAGGCGACAGCTTCTCGGTGTCCAAGATTTGGCAGTGGCCGCGGAACGGCAAGGAGAAGCTTCCCGTGCTCGCGTCCGATGACTCGCCGGCCATGAACGGCAGGCTGCCGTGGCAGAGGCCAAGTCCCGGGGATTCGTGAATCGTGTCGTGACACAGAGAAAGCGTGTGTGGTGGTGCGTGCTCCAAACTTGTATTGAGCTTGTCTGCTCGCCCTTTTAACCGCTGATGATGAATTGGTTCATAGGCATTCGTTGTTTATCTTATCTTACTAGTAATAATAAATCTCATTTGCTTGCTTGCC

SEQ ID NO: 927 - DNA, 1771 bp, Zea mays
  misc_feature (1)..(1771): Ceres cDNA ID no. 12381090
  misc_feature (1)..(1771): Ceres CLONE  ID no. 339381
  misc_feature (1)..(1771): Also known as  Ceres CDNA ID no. 23768495
gcacgagaccattacctagaacatcctaatcgaaaaatcgaatcgcgaccaaaccaaatcctccaccccggcgcgctgccccatcacccttcccgctgtgctcacgcaccaaaccccactccgttcctcactgcaatccaccgccccagctctttcgcgcaatggcggccgtcgcggcgccggcgccgccaccgccggcggcagctgagcctggaggacctcaaggtggtgtccgtgctcgggcgcggcgccaagggcgtcgtgttccacgtcgtgcacgctcccggggaaccggacggcgagggcgagggcgccgccgcagccgcggccatggcgctcaaggcggtctcgcgggaggcagcgcggcacaagaaggcggccagcggggacggggacggccaccgccggatctggttcgagcgggatgtgctcctggcgctgcgccacccgctgctcccttccctgcgaggcatcctcgccaccgacgcgatcgtcggcttcgccatggaccgctgcggcggcggggacctcaactcgctgcggcggcggcagacggagaagatgttctccgactccgtcatacggttctacgcggcggagctggtgctggcgctcgagtacctgcacagtctcggcgtcgtgtaccgggacctcaagccggagaacgtcctcatccaggacagcggccacatcatgctcgtcgacttcgacctctccacgcggctcccggccgcagccgcaggagccagacgcgccggccaccagtcccaagccggcgcctccggtcgccgcgccgtccccgagccgcggcagagcaaggaagccggcgggcgccgccctgtgcttcccattccgcaccaccggcagcgctgcgaagcctgccgcggactcgccgtcgccgctgtccacctcgcggacggcctcgtcgtcgtcgtcgtcctcgacggcgaccacggcctcctcctcggcggcgtcggccggcacgcggactcccgcgaagtcgaactcgttcgtggggacggaggactacgtggcgccggagatcatcgccgggcgcgggcacgacttcgccgtggactggtggggcctgggcgtggtgctctacgagatgctctacggccgcacgccgttccgggggcagaaccgcaaggagaccttctaccgcgtcctcgccaagcagccggagctcgtcggcgagcagacgccgctgcgcgacctcatcgcccgcctcctcgagaaggaccccgagaggcgcatcggcgcgcgcggcgtcaaggcccaccccttcttcggcggcgtcgactggaacgcatcctgcaggtggcgcgcccgccgttcatcccggcgccgccgcaggacgaggacggcgacgaggcgctcgacgtcgagaaggtcgtccgcgaggtgttcgcgtccaaggagggcgagggagggaaggcttcgcctgtggcagacggaggccctgtgggcggcgacggcgacgggaggagagatcattccaaagatggtgatttctcagtgtttttctgagctatttattttctttagatttgttctttctttttctttagatttgtactgtatgaacatgatggcatttagcaactgaggttaggagtgagtacggcgcaatggccggtggagtacataaattaaagaggtgcaggtgctcccgctcaatggggtatagccaatatatagggtttttttttgctgtgtactttgcttgatcataataaataataatgatagcgcagttgtgctcaaacgc

SEQ ID NO: 928 - protein, 1771 aa, Zea mays
  misc_feature: PFam Name: Pkinase; PFam Description: Protein kinase domain
  misc_feature: GI Number: 9294182; NR Description: protein kinases-like protein [Arabidopsis thaliana] >gi|15230825|ref|NP_189162.1|
  misc_feature: GI Number: 9294410; NR Description: protein kinase-like protein [Arabidopsis thaliana] >gi|15232374|ref|NP_188719.1|
  misc_feature: GI Number: 42563343; NR Description: protein kinase, putative
  misc_feature: GI Number: 19310387; NR Description: At2g44830/T13E15.16
  misc_feature: GI Number: 30689844; NR Description: protein kinase, putative
GCACGAGACCATTACCTAGAACATCCTAATCGAAAAATCGAATCGCGACCAAACCAAATCCTCCACCCCGGCGCGCTGCCCCATCACCCTTCCCGCTGTGCTCACGCACCAAACCCCACTCCGTTCCTCACTGCAATCCACCGCCCCAGCTCTTTCGCGCAATGGCGGCCGTCGCGGCGCCGGCGCCGCCACCGCCGGCGGCAGCTGAGCCTGGAGGACCTCAAGGTGGTGTCCGTGCTCGGGCGCGGCGCCAAGGGCGTCGTGTTCCACGTCGTGCACGCTCCCGGGGAACCGGACGGCGAGGGCGAGGGCGCCGCCGCAGCCGCGGCCATGGCGCTCAAGGCGGTCTCGCGGGAGGCAGCGCGGCACAAGAAGGCGGCCAGCGGGGACGGGGACGGCCACCGCCGGATCTGGTTCGAGCGGGATGTGCTCCTGGCGCTGCGCCACCCGCTGCTCCCTTCCCTGCGAGGCATCCTCGCCACCGACGCGATCGTCGGCTTCGCCATGGACCGCTGCGGCGGCGGGGACCTCAACTCGCTGCGGCGGCGGCAGACGGAGAAGATGTTCTCCGACTCCGTCATACGGTTCTACGCGGCGGAGCTGGTGCTGGCGCTCGAGTACCTGCACAGTCTCGGCGTCGTGTACCGGGACCTCAAGCCGGAGAACGTCCTCATCCAGGACAGCGGCCACATCATGCTCGTCGACTTCGACCTCTCCACGCGGCTCCCGGCCGCAGCCGCAGGAGCCAGACGCGCCGGCCACCAGTCCCAAGCCGGCGCCTCCGGTCGCCGCGCCGTCCCCGAGCCGCGGCAGAGCAAGGAAGCCGGCGGGCGCCGCCCTGTGCTTCCCATTCCGCACCACCGGCAGCGCTGCGAAGCCTGCCGCGGACTCGCCGTCGCCGCTGTCCACCTCGCGGACGGCCTCGTCGTCGTCGTCGTCCTCGACGGCGACCACGGCCTCCTCCTCGGCGGCGTCGGCCGGCACGCGGACTCCCGCGAAGTCGAACTCGTTCGTGGGGACGGAGGACTACGTGGCGCCGGAGATCATCGCCGGGCGCGGGCACGACTTCGCCGTGGACTGGTGGGGCCTGGGCGTGGTGCTCTACGAGATGCTCTACGGCCGCACGCCGTTCCGGGGGCAGAACCGCAAGGAGACCTTCTACCGCGTCCTCGCCAAGCAGCCGGAGCTCGTCGGCGAGCAGACGCCGCTGCGCGACCTCATCGCCCGCCTCCTCGAGAAGGACCCCGAGAGGCGCATCGGCGCGCGCGGCGTCAAGGCCCACCCCTTCTTCGGCGGCGTCGACTGGAACGCATCCTGCAGGTGGCGCGCCCGCCGTTCATCCCGGCGCCGCCGCAGGACGAGGACGGCGACGAGGCGCTCGACGTCGAGAAGGTCGTCCGCGAGGTGTTCGCGTCCAAGGAGGGCGAGGGAGGGAAGGCTTCGCCTGTGGCAGACGGAGGCCCTGTGGGCGGCGACGGCGACGGGAGGAGAGATCATTCCAAAGATGGTGATTTCTCAGTGTTTTTCTGAGCTATTTATTTTCTTTAGATTTGTTCTTTCTTTTTCTTTAGATTTGTACTGTATGAACATGATGGCATTTAGCAACTGAGGTTAGGAGTGAGTACGGCGCAATGGCCGGTGGAGTACATAAATTAAAGAGGTGCAGGTGCTCCCGCTCAATGGGGTATAGCCAATATATAGGGTTTTTTTTTGCTGTGTACTTTGCTTGATCATAATAAATAATAATGATAGCGCAGTTGTGCTCAAACGC

SEQ ID NO: 929 - DNA, 1844 bp, Zea mays
  misc_feature (1)..(1844): Ceres cDNA ID no. 12381094
  misc_feature (1)..(1844): Ceres CLONE  ID no. 333700
  misc_feature (1)..(1844): Also known as  Ceres CDNA ID no. 23778619
gcacgagaccatcacctagaacatcctaatcgaaaaaaaacgttagccttttccaatcagggagagagctcaaacatggcactcgaacccgtcgctctcctgctcacggtcctcgtcgccgcgccgctcacggtcctcctcctcctcctcttcctcgtcgccggcaacaagaggcccgctcgtgctgcttctcccacgccgcgccaccgcttgaggctgccgctgccgccgtcgccgcggggcctcccgctgctgggccacctgcacctgctgggctcgctgccgcaccgcgcgctggcgtctctggcgcgcgcgcacggccccgtgctgctgctccgcctgggccgcgtgcccaccgtggtcgtgtcctccgctgccgccgccgaggaggtgatgcgggcgcgggacctggcgttcgcgaaccggcccgcgagcgccatgggccgtgcgcctcctctacggccgcgacgtcgcgttcgcgccctacggcgagtactggcgccaggcgcgccgcgtctgcgtcgtccacctcctcagcgcgcgtcacgtcgggtccttccgccgtgtccgagagcaggaggccgccgcgctggtcgcacgcgtcgcccgggacagcgccggtggcgcggccgtcggcctcagcgatctcctcaccgagtacgccaacgccgtcgtgtcgcgcgccgcgttcggcgacgagagcgcgcgcgggctgttgggcgaattcgactccggccgtcggcagaggaaagtgctcaccgacttccagaagctcgtggggacgacgcccgtcggggagctgctgccgtggctgggctgggtggacgccgtcacggggctggaggggaagatcaggcggacgttcgaggcgctcgacgggttgctcgagaaggtgatcgatgaccaccggcggcggcctcgcagcggggaggagggcggtgaccgggacttcgtggacgtgttgctggacgtccacaacaaggaccaagagcacggcatccaactagagaccaacgaaatcaaggccatcatcttggacatgttcgcggcaggcacggacacgatagccacggcgatggaatgggccatggcggagctcgtcacccacccgcgtgccatgcggagagcccaggacgaggtccgcgcggcggcggccggctcaaccggcgtgaacgaggaccacgtcgcgcagctggactacctcaaggccgtgctgaaggagacgctccggttgcacgcgccgttgccactgctggtgccccgggagccggcggcggacaccgagatcctggggtaccacgtcccggcgcgcacgcgcgtgctggtcaacgcctgggctattggccgggaccccgcgacgtgggagcgcgccgaggaattcgtgccagagaggttcttgggcggcgccgccgcagctgacgtcggcttcaaggggcagcacttcgagctcctgccgttcggcggcggcaggaggatgtgccccggaatcgcgtttgcggagggaagcgccgagatggccctggcgagcctgctgtatcattttgactgggaggcggcgagccggggccagaacgggaaagggacgctgtcgctggacatgaccgagatgaacggattagccgtgcatatcaactccggtcttccgcttgtagccaagccgtggatccccttcaagaactaggagaagatattggagatatttggttttttactgcaaacaatgtgcttgattttaatgttattttagacatttttgctcttcttcgtccttctccctttttccctttttgtgtgtgtacgcttgtaaaaaaagacaaaatatcaaaataatctctactaccccg

SEQ ID NO: 930 - protein, 1844 aa, Zea mays
  misc_feature: PFam Name: p450; PFam Description: Cytochrome P450
  misc_feature: GI Number: 34904238; NR Description: putative cytochrome P-450LXXIA1 (cyp71A1) family [Oryza sativa (japonica cultivar-group)] >gi|17385730|dbj|BAB78670.1| putative cytochrome P-450LXXIA1 (cyp71A1) family [Oryza sativa (japonica
  misc_feature: GI Number: 34904240; NR Description: putative cytochrome P-450LXXIA1 (cyp71A1) family [Oryza sativa (japonica cultivar-group)] >gi|17385731|dbj|BAB78671.1| putative cytochrome P-450LXXIA1 (cyp71A1) family [Oryza sativa (japonica
  misc_feature: GI Number: 34904242; NR Description: putative cytochrome P-450LXXIA1 (cyp71A1) family [Oryza sativa (japonica cultivar-group)] >gi|17385732|dbj|BAB78672.1| putative cytochrome P-450LXXIA1 (cyp71A1) family [Oryza sativa (japonica
  misc_feature: GI Number: 25282608; NR Description: cytochrome P-450LXXIA1 [similarity] - avocado >gi|166949|gb|AAA32913.1| cytochrome
  misc_feature: GI Number: 117188; NR Description: CYTOCHROME P450 71A1 (CYPLXXIA1) (ARP-2) >gi|81423|pir||A35867 cytochrome P450 71A1 -
GCACGAGACCATCACCTAGAACATCCTAATCGAAAAAAAACGTTAGCCTTTTCCAATCAGGGAGAGAGCTCAAACATGGCACTCGAACCCGTCGCTCTCCTGCTCACGGTCCTCGTCGCCGCGCCGCTCACGGTCCTCCTCCTCCTCCTCTTCCTCGTCGCCGGCAACAAGAGGCCCGCTCGTGCTGCTTCTCCCACGCCGCGCCACCGCTTGAGGCTGCCGCTGCCGCCGTCGCCGCGGGGCCTCCCGCTGCTGGGCCACCTGCACCTGCTGGGCTCGCTGCCGCACCGCGCGCTGGCGTCTCTGGCGCGCGCGCACGGCCCCGTGCTGCTGCTCCGCCTGGGCCGCGTGCCCACCGTGGTCGTGTCCTCCGCTGCCGCCGCCGAGGAGGTGATGCGGGCGCGGGACCTGGCGTTCGCGAACCGGCCCGCGAGCGCCATGGGCCGTGCGCCTCCTCTACGGCCGCGACGTCGCGTTCGCGCCCTACGGCGAGTACTGGCGCCAGGCGCGCCGCGTCTGCGTCGTCCACCTCCTCAGCGCGCGTCACGTCGGGTCCTTCCGCCGTGTCCGAGAGCAGGAGGCCGCCGCGCTGGTCGCACGCGTCGCCCGGGACAGCGCCGGTGGCGCGGCCGTCGGCCTCAGCGATCTCCTCACCGAGTACGCCAACGCCGTCGTGTCGCGCGCCGCGTTCGGCGACGAGAGCGCGCGCGGGCTGTTGGGCGAATTCGACTCCGGCCGTCGGCAGAGGAAAGTGCTCACCGACTTCCAGAAGCTCGTGGGGACGACGCCCGTCGGGGAGCTGCTGCCGTGGCTGGGCTGGGTGGACGCCGTCACGGGGCTGGAGGGGAAGATCAGGCGGACGTTCGAGGCGCTCGACGGGTTGCTCGAGAAGGTGATCGATGACCACCGGCGGCGGCCTCGCAGCGGGGAGGAGGGCGGTGACCGGGACTTCGTGGACGTGTTGCTGGACGTCCACAACAAGGACCAAGAGCACGGCATCCAACTAGAGACCAACGAAATCAAGGCCATCATCTTGGACATGTTCGCGGCAGGCACGGACACGATAGCCACGGCGATGGAATGGGCCATGGCGGAGCTCGTCACCCACCCGCGTGCCATGCGGAGAGCCCAGGACGAGGTCCGCGCGGCGGCGGCCGGCTCAACCGGCGTGAACGAGGACCACGTCGCGCAGCTGGACTACCTCAAGGCCGTGCTGAAGGAGACGCTCCGGTTGCACGCGCCGTTGCCACTGCTGGTGCCCCGGGAGCCGGCGGCGGACACCGAGATCCTGGGGTACCACGTCCCGGCGCGCACGCGCGTGCTGGTCAACGCCTGGGCTATTGGCCGGGACCCCGCGACGTGGGAGCGCGCCGAGGAATTCGTGCCAGAGAGGTTCTTGGGCGGCGCCGCCGCAGCTGACGTCGGCTTCAAGGGGCAGCACTTCGAGCTCCTGCCGTTCGGCGGCGGCAGGAGGATGTGCCCCGGAATCGCGTTTGCGGAGGGAAGCGCCGAGATGGCCCTGGCGAGCCTGCTGTATCATTTTGACTGGGAGGCGGCGAGCCGGGGCCAGAACGGGAAAGGGACGCTGTCGCTGGACATGACCGAGATGAACGGATTAGCCGTGCATATCAACTCCGGTCTTCCGCTTGTAGCCAAGCCGTGGATCCCCTTCAAGAACTAGGAGAAGATATTGGAGATATTTGGTTTTTTACTGCAAACAATGTGCTTGATTTTAATGTTATTTTAGACATTTTTGCTCTTCTTCGTCCTTCTCCCTTTTTCCCTTTTTGTGTGTGTACGCTTGTAAAAAAAGACAAAATATCAAAATAATCTCTACTACCCCG

SEQ ID NO: 931 - DNA, 1504 bp, Zea mays
  misc_feature (1)..(1504): Ceres cDNA ID no. 12381098
  misc_feature (1)..(1504): Ceres CLONE  ID no. 279666
  misc_feature (1)..(1504): Also known as  Ceres CDNA ID no. 23835339
aagccaacacggtcacacgactgcataattgtgctcgctcgccgggccccgggacgtgacacatcgcacggccgaagcagcttgccggctgccgcgtttcgcctcccgcctgccgtgccgcccgtgaccgcgagaaggccggcagctttgcatgaggaggaggaggatgggggcactgcacgtcgtcggcgagcccaggatcagcttccgccagcagcctgcagcagtcgtcgcgaagaacggcggccacggcgccgtcgtcgaggagatccacggcctgatccgcgtctacaaggacggacacgtggagcggctcccggcgatcccagccgtgccctgcacgtggggcggcacggcccccggacgcgccgggcggcgtcgtcgcgagggacgtggtggtggaccccgcgacgggggtgtgggcgcggctgtacgcgccgacgtcggcgggggacggagccaggcgccccgtcgtggtgtacttccacggcggcgggttctgcgtcgggtccgcggcctggagctgctaccacgagttcctcgcccagctcgcggcgcgcgcgggctgcgccgtgatgtccgtggactaccggctggcgcccgagcaccgcctgccggccgcgttcgacgacgggctggccgcggtgcggtggctgcggcaccaggccgcagcgtcagcgtcagcgtcagcgtgctgcaacgacgacctgtcgtggtggcgggcccgctgcggctttgaccgcgtgttcctcatgggcgacagcgcgggcgccagcatcgccttgcacgtggccgcgaggctcgggcagggccagcttggcgcgctgccccccttgaccgtcaggggccccgtcctgatccagccattcctgggcggcgaggggcgtaccgcgtccgagaagaacgtggcgcagccgccacggtcggcgctgacgctggccacctccgactgctactggcggctggcgctgccggccggagccagccgcgagcacccctggtgcaacccgctgtcgggccgcgccgcgccgcgcctggagaccactccgctgcccccgctcctggtgtgcgtctcggagacggacatcctgcgggaccgcaacctggagctgtgcagggcgttgcgcgaggcgggcaagcgcgtggagcaggccgtgtacggcggcgtcgggcacgcgttccaggtgctccacaactgccacctgtcccagccgcggacgcaggagatgctcgcgcacatcaaggccttcgtcagcgccaggtagcaggcgccgcagcagcagccgcctcctccattcgtcgttggtccctaacaaacagacactcgccatgttaattaatccactacctaatcctaatccaatcgaagagtagatgccgtgtaagcaaccagaaccagccttgtgcagtactgtatcagtagtgtgtgacttggagcagaaagcgtccaatgcccagcccgggttgttgttgtagcggtgtcggaaagcaaaagcttatcact

SEQ ID NO: 932 - protein, 1504 aa, Zea mays
  misc_feature: PFam Name: Abhydrolase_3; PFam Description: alpha/beta
  misc_feature: PFam Name: COesterase; PFam Description: Carboxylesterase
  misc_feature: GI Number: 21593215; NR Description: unknown [Arabidopsis thaliana]
  misc_feature: GI Number: 34899932; NR Description: putative cell death associated protein [Oryza sativa (japonica cultivar-group)] >gi|23617083|dbj|BAC20766.1| putative cell death associated protein
  misc_feature: GI Number: 34895936; NR Description: P0030H07.39 [Oryza sativa (japonica cultivar-group)] >gi|13872964|dbj|BAB44069.1| P0030H07.39 [Oryza sativa (japonica cultivar-group)] >gi|15528617|dbj|BAB64638.1| P0011G08.9 [Oryza sativa (japonica
  misc_feature: GI Number: 50919067; NR Description: putative esterase [Oryza sativa (japonica cultivar-group)] >gi|27819508|gb|AAO24912.1|
  misc_feature: GI Number: 5487873; NR Description: PrMC3 [Pinus radiata]
AAGCCAACACGGTCACACGACTGCATAATTGTGCTCGCTCGCCGGGCCCCGGGACGTGACACATCGCACGGCCGAAGCAGCTTGCCGGCTGCCGCGTTTCGCCTCCCGCCTGCCGTGCCGCCCGTGACCGCGAGAAGGCCGGCAGCTTTGCATGAGGAGGAGGAGGATGGGGGCACTGCACGTCGTCGGCGAGCCCAGGATCAGCTTCCGCCAGCAGCCTGCAGCAGTCGTCGCGAAGAACGGCGGCCACGGCGCCGTCGTCGAGGAGATCCACGGCCTGATCCGCGTCTACAAGGACGGACACGTGGAGCGGCTCCCGGCGATCCCAGCCGTGCCCTGCACGTGGGGCGGCACGGCCCCCGGACGCGCCGGGCGGCGTCGTCGCGAGGGACGTGGTGGTGGACCCCGCGACGGGGGTGTGGGCGCGGCTGTACGCGCCGACGTCGGCGGGGGACGGAGCCAGGCGCCCCGTCGTGGTGTACTTCCACGGCGGCGGGTTCTGCGTCGGGTCCGCGGCCTGGAGCTGCTACCACGAGTTCCTCGCCCAGCTCGCGGCGCGCGCGGGCTGCGCCGTGATGTCCGTGGACTACCGGCTGGCGCCCGAGCACCGCCTGCCGGCCGCGTTCGACGACGGGCTGGCCGCGGTGCGGTGGCTGCGGCACCAGGCCGCAGCGTCAGCGTCAGCGTCAGCGTGCTGCAACGACGACCTGTCGTGGTGGCGGGCCCGCTGCGGCTTTGACCGCGTGTTCCTCATGGGCGACAGCGCGGGCGCCAGCATCGCCTTGCACGTGGCCGCGAGGCTCGGGCAGGGCCAGCTTGGCGCGCTGCCCCCCTTGACCGTCAGGGGCCCCGTCCTGATCCAGCCATTCCTGGGCGGCGAGGGGCGTACCGCGTCCGAGAAGAACGTGGCGCAGCCGCCACGGTCGGCGCTGACGCTGGCCACCTCCGACTGCTACTGGCGGCTGGCGCTGCCGGCCGGAGCCAGCCGCGAGCACCCCTGGTGCAACCCGCTGTCGGGCCGCGCCGCGCCGCGCCTGGAGACCACTCCGCTGCCCCCGCTCCTGGTGTGCGTCTCGGAGACGGACATCCTGCGGGACCGCAACCTGGAGCTGTGCAGGGCGTTGCGCGAGGCGGGCAAGCGCGTGGAGCAGGCCGTGTACGGCGGCGTCGGGCACGCGTTCCAGGTGCTCCACAACTGCCACCTGTCCCAGCCGCGGACGCAGGAGATGCTCGCGCACATCAAGGCCTTCGTCAGCGCCAGGTAGCAGGCGCCGCAGCAGCAGCCGCCTCCTCCATTCGTCGTTGGTCCCTAACAAACAGACACTCGCCATGTTAATTAATCCACTACCTAATCCTAATCCAATCGAAGAGTAGATGCCGTGTAAGCAACCAGAACCAGCCTTGTGCAGTACTGTATCAGTAGTGTGTGACTTGGAGCAGAAAGCGTCCAATGCCCAGCCCGGGTTGTTGTTGTAGCGGTGTCGGAAAGCAAAAGCTTATCACT

SEQ ID NO: 933 - DNA, 1248 bp, Zea mays
  misc_feature (1)..(1248): Ceres cDNA ID no. 12381217
  misc_feature (1)..(1248): Ceres CLONE  ID no. 295999
  misc_feature (1)..(1248): Also known as  Ceres CDNA ID no. 23761074
gcacgagaccattacctagaacatcctaatcgaaaaagtcacggacacatggtgtgtttggttggatctcgtcccggtctttcacctccaacaaaacacatcctaatcgactcgcgaccccgtttcccggagagccgcgacggtgcgacgccgaactccctaaccctaagtccctaagcgtaggcggcggggggcggcggtgcgaggcaagctgcacagcaacacgggccacgggcgcggcctccgcctccgcctccacgcttctgctgctaggctgcaagggcggcggcgcggcgcggtgggcggcggacagctggccaggtccagcccagtagtccaggtgacgaggtccgcactccgcaacggttctggcgttctgcagctgaggatagacgagagaggaagtgaggatttatattagtgatttacaaggcaacttgaaagacagcagggttgcatcccacaatgtcagctcccaacagtgatagcaacatgcagcagctagtccctatagcaccaccaggaaaggcttctggtggtgacagtgggaaggagctggttgtggcagatcctgcaggtaagagatcaggaggtgtaaaactgcgagaggatgaggaagacctggaggtgaagctcaggcgcatcatggagaatgtccctgtgcgtgtcagtaacacatcagggtcatctgctggctctggctctggtgatttccaccagtatcggcaaatgaggaggagagagcaggaccgtctagcacgaatggatgcggactaccagaagagaaaagagatagctgagttcgaactgcggagggaggagaggatgaaagcagctgaggagcggacagccaagaagcgcctgaaacggcaaaagaagaaacagcgtaagaaagagaagcgagctaaaactggtgataatggtggtgaagaacctaacagagtggagtcgtctgacgatgacgaaggctcagatgacgatgacaagtccaagcaatgacacgtcaatttcgcacctgaagatgatttcggactctctggttgtctgggcaatgaaacaaacgtctgtacggttgttgtaacaggttacagggcgaatctggtgctgtttctgtaagaggatatgatattctgagcagagatggatagcactagataatttgctgttagtgttcatcattcagagaagtgacctgcgtcagtaccttttgttcaggtctatattatatcagctgccttttttggctcc

SEQ ID NO: 934 - protein, 1248 aa, Zea mays
  misc_feature: GI Number: 31240511; NR Description: ENSANGP00000021234 [Anopheles gambiae] >gi|21287802|gb|EAA00123.1| ENSANGP00000021234
  misc_feature: GI Number: 62204451; NR Description: Unknown (protein for
  misc_feature: GI Number: 50758092; NR Description: PREDICTED: similar to adaptor protein with pleckstrin homology and src homology 2 domains
GCACGAGACCATTACCTAGAACATCCTAATCGAAAAAGTCACGGACACATGGTGTGTTTGGTTGGATCTCGTCCCGGTCTTTCACCTCCAACAAAACACATCCTAATCGACTCGCGACCCCGTTTCCCGGAGAGCCGCGACGGTGCGACGCCGAACTCCCTAACCCTAAGTCCCTAAGCGTAGGCGGCGGGGGGCGGCGGTGCGAGGCAAGCTGCACAGCAACACGGGCCACGGGCGCGGCCTCCGCCTCCGCCTCCACGCTTCTGCTGCTAGGCTGCAAGGGCGGCGGCGCGGCGCGGTGGGCGGCGGACAGCTGGCCAGGTCCAGCCCAGTAGTCCAGGTGACGAGGTCCGCACTCCGCAACGGTTCTGGCGTTCTGCAGCTGAGGATAGACGAGAGAGGAAGTGAGGATTTATATTAGTGATTTACAAGGCAACTTGAAAGACAGCAGGGTTGCATCCCACAATGTCAGCTCCCAACAGTGATAGCAACATGCAGCAGCTAGTCCCTATAGCACCACCAGGAAAGGCTTCTGGTGGTGACAGTGGGAAGGAGCTGGTTGTGGCAGATCCTGCAGGTAAGAGATCAGGAGGTGTAAAACTGCGAGAGGATGAGGAAGACCTGGAGGTGAAGCTCAGGCGCATCATGGAGAATGTCCCTGTGCGTGTCAGTAACACATCAGGGTCATCTGCTGGCTCTGGCTCTGGTGATTTCCACCAGTATCGGCAAATGAGGAGGAGAGAGCAGGACCGTCTAGCACGAATGGATGCGGACTACCAGAAGAGAAAAGAGATAGCTGAGTTCGAACTGCGGAGGGAGGAGAGGATGAAAGCAGCTGAGGAGCGGACAGCCAAGAAGCGCCTGAAACGGCAAAAGAAGAAACAGCGTAAGAAAGAGAAGCGAGCTAAAACTGGTGATAATGGTGGTGAAGAACCTAACAGAGTGGAGTCGTCTGACGATGACGAAGGCTCAGATGACGATGACAAGTCCAAGCAATGACACGTCAATTTCGCACCTGAAGATGATTTCGGACTCTCTGGTTGTCTGGGCAATGAAACAAACGTCTGTACGGTTGTTGTAACAGGTTACAGGGCGAATCTGGTGCTGTTTCTGTAAGAGGATATGATATTCTGAGCAGAGATGGATAGCACTAGATAATTTGCTGTTAGTGTTCATCATTCAGAGAAGTGACCTGCGTCAGTACCTTTTGTTCAGGTCTATATTATATCAGCTGCCTTTTTTGGCTCC

SEQ ID NO: 935 - DNA, 1413 bp, Zea mays
  misc_feature (1)..(1413): Ceres cDNA ID no. 12381429
  misc_feature (1)..(1413): Ceres CLONE  ID no. 325361
  misc_feature (1)..(1413): Also known as  Ceres CDNA ID no. 23792998
acgactttatacatccgcttcctccagtcatcaaagaaacagagcgagcctagactgtgaggaagaaaggactaccatgggcgacgtcgctgccggcgctgccgccctgagtccacccccgatgaccaaggagaccaacctcttcatgcaaatcgtcggcaacccggacggcacggtcacgcgccccgaggtccccctcgtcccggcctcagccgaagccactggcggcgtcatctccagggacgtgcccctcgacgcctccgccggcacgtacctccgcctctacctgcccgacccatcctccgcgccagccgccaagcttcccgtcgtcctctacttccacggcggcggcttcgtgatcctctccgccgccaccgtattctaccacggccactgcgaggcgatggccgccgcggtgcccgccatcgtggcgtccctcgagtaccgcctcgcgccggagcaccgcctgcccgcggcctacgaggacgccgccgcggccgtggcgtggctccgcgacggcgcgccgggggacccctgggtcgcggcgcacggcgacctctcccgctgcttcctcatgggcagcagctcgggcggcaacatggctttcttcgcggcgctccggaccggaggcctcgacctgggccccgccacggtgcgcggcctcctgctgcaccagccctacctcggcggcgtcgaccggacgccctcggaggccaggtccgtcgacgacgccatgctgccgctggaggccaacgacaggctctggagcctcgcgctgcccgtgggcgccgaccgggaccacgagttctgcaaccccgtcaaggccatggcgccggaagcccttgccggcctgccgcgctgcctggtcaccgcaacttgggcgacccgctgatcgacaggcagcgggagttcgctcggtggctgcaggaccgcggcggcgcggaggcggaggtcgtcgtgaagttggacgtcgcggggttccacgcgtcggagctgttcgtgccggagatcgccgaggtgctgttcgccgcgatgcgcgagttcgtgtacaccggcgacgcttgacacgttgaatttcgtgccggccggtgacaagtggacatacgtgttgcatcgttgtggattgtgtgaccgtgcgcaataattctcggccgtgttgaatttgaatcttgacaaactggcaccagccaccaggcggcgactactatgtaacacgtgagcactgtagcagctaccgcaacgcacctgacgtccggacgtgtagttttcgcgacgcgtgcagctatcggccacggcaacgaaaataggagatgttttgttcggatttttttttggcccgcgaccattcacagcgctatctgaaactatcttcatcacatctcttatcaaatcatctatctcatcctctatttc

SEQ ID NO: 936 - protein, 1413 aa, Zea mays
  misc_feature: PFam Name: Abhydrolase_3; PFam Description: alpha/beta
  misc_feature: PFam Name: Pyr_redox_2; PFam Description: Pyridine
  misc_feature: PFam Name: COesterase; PFam Description: Carboxylesterase
  misc_feature: PFam Name: Pkinase; PFam Description: Protein kinase domain
  misc_feature: PFam Name: FH2; PFam Description: Formin Homology 2 Domain
  misc_feature: GI Number: 50948247; NR Description: putative pepper esterase [Oryza sativa (japonica cultivar-group)] >gi|42407543|dbj|BAD10748.1| putative pepper esterase [Oryza sativa (japonica cultivar-group)] >gi|42408724|dbj|BAD09942.1|
  misc_feature: GI Number: 21593183; NR Description: unknown [Arabidopsis thaliana]
  misc_feature: GI Number: 48714603; NR Description: putative esterase [Cicer
  misc_feature: GI Number: 5487873; NR Description: PrMC3 [Pinus radiata]
  misc_feature: GI Number: 8574455; NR Description: pepper esterase [Capsicum
ACGACTTTATACATCCGCTTCCTCCAGTCATCAAAGAAACAGAGCGAGCCTAGACTGTGAGGAAGAAAGGACTACCATGGGCGACGTCGCTGCCGGCGCTGCCGCCCTGAGTCCACCCCCGATGACCAAGGAGACCAACCTCTTCATGCAAATCGTCGGCAACCCGGACGGCACGGTCACGCGCCCCGAGGTCCCCCTCGTCCCGGCCTCAGCCGAAGCCACTGGCGGCGTCATCTCCAGGGACGTGCCCCTCGACGCCTCCGCCGGCACGTACCTCCGCCTCTACCTGCCCGACCCATCCTCCGCGCCAGCCGCCAAGCTTCCCGTCGTCCTCTACTTCCACGGCGGCGGCTTCGTGATCCTCTCCGCCGCCACCGTATTCTACCACGGCCACTGCGAGGCGATGGCCGCCGCGGTGCCCGCCATCGTGGCGTCCCTCGAGTACCGCCTCGCGCCGGAGCACCGCCTGCCCGCGGCCTACGAGGACGCCGCCGCGGCCGTGGCGTGGCTCCGCGACGGCGCGCCGGGGGACCCCTGGGTCGCGGCGCACGGCGACCTCTCCCGCTGCTTCCTCATGGGCAGCAGCTCGGGCGGCAACATGGCTTTCTTCGCGGCGCTCCGGACCGGAGGCCTCGACCTGGGCCCCGCCACGGTGCGCGGCCTCCTGCTGCACCAGCCCTACCTCGGCGGCGTCGACCGGACGCCCTCGGAGGCCAGGTCCGTCGACGACGCCATGCTGCCGCTGGAGGCCAACGACAGGCTCTGGAGCCTCGCGCTGCCCGTGGGCGCCGACCGGGACCACGAGTTCTGCAACCCCGTCAAGGCCATGGCGCCGGAAGCCCTTGCCGGCCTGCCGCGCTGCCTGGTCACCGCAACTTGGGCGACCCGCTGATCGACAGGCAGCGGGAGTTCGCTCGGTGGCTGCAGGACCGCGGCGGCGCGGAGGCGGAGGTCGTCGTGAAGTTGGACGTCGCGGGGTTCCACGCGTCGGAGCTGTTCGTGCCGGAGATCGCCGAGGTGCTGTTCGCCGCGATGCGCGAGTTCGTGTACACCGGCGACGCTTGACACGTTGAATTTCGTGCCGGCCGGTGACAAGTGGACATACGTGTTGCATCGTTGTGGATTGTGTGACCGTGCGCAATAATTCTCGGCCGTGTTGAATTTGAATCTTGACAAACTGGCACCAGCCACCAGGCGGCGACTACTATGTAACACGTGAGCACTGTAGCAGCTACCGCAACGCACCTGACGTCCGGACGTGTAGTTTTCGCGACGCGTGCAGCTATCGGCCACGGCAACGAAAATAGGAGATGTTTTGTTCGGATTTTTTTTTGGCCCGCGACCATTCACAGCGCTATCTGAAACTATCTTCATCACATCTCTTATCAAATCATCTATCTCATCCTCTATTTC

SEQ ID NO: 937 - DNA, 1663 bp, Zea mays
  misc_feature (1)..(1663): Ceres cDNA ID no. 12381819
  misc_feature (1)..(1663): Ceres CLONE  ID no. 396870
  misc_feature (1)..(1663): Also known as  Ceres CDNA ID no. 23810265
actactggtagaactagagcttagaagtgccggttttccacgaggcgagcgcgcggtcatggggtcactgtcgacggcggaggggcagcggccgcacgccgtgtgcatgccgtacccggcgcagggccacgtgacgcccatgctcaagctcgccaagctcctccacgcgcggggcttccagatcaccttcgtcaacaccgagttcaaccaccgccgcctgctccactcgcgcgggcccgacgcgctcgaccgcgtgcccgggttccgcttcgacgccattcccgacggcctcccgccgtccgacgccgacgccacgcaggacatccccgcgctctgctactccaccatgaccacctgcctcccgcacctcctcgcgctcctcgccagggtcgacgccgacgccgggtccccgccggtcacctgcctcgtcgtggacgccgtcatgtcgttcggcttcgacgccgccaggcagatcggcgtgcccgtcgccgcgctctggaccgccagcgcctgcgggttcatgggctaccggaactacagaaacctcatcgactggggcctcgtgccattcaagagcgccgcggacctccaggacaacgtcggcggcggccacctcgccaccgtggtcaccggcgcgcgcggcatgtgcgacggcgtgcagctgcgcgacttccccaacttcatccgcaccacggaccgcgcggacttcatgttcaacttcctcatgcgcgagtccgagcggctgtcgctccccgacggcgtcatcgtcaacaccttcgaggacctcgagggagccacgctggacgccatgcgcgctatcctcccgacggtgtaccccgtcggcccgctcctcctccgcgagcgcctggagatccccgctagcagcccgctcgcggtcctcggctccaacctctggaaggaggaggaaggcctcctggagtggctcgctggccgcgcgccgcgatccgtggtgtacgtgaactacggcagcatcacggtgatgaccaactcgcagctgctcgagttcgcgtggggcctggccaacagcgggtacccgttcgtgtggaacatccggccggacctggtgaagggcgactccgccgtgctgccgccggagttcgcgtccgccgtcgagggccgcgcgttgctgacgacgtggtgcccgcaggaggcggcgatccagcatgaggcggtcggggtgttcctgactcactccggctggaactccaccctggagagcctctgcgcgggggtgcccatgctgagctggcccttcttcgcggagcagcagaccaactgccggtacaagcgcacggagtggggagtcgggatggagatcggcggcgaggtgcggcgcgacgaggtgacggtcgttctaaaggaggccatggacggggagaaggggagggagatgcgccggcgcgcagaggagtggaaggagaaggccgtgaaggtgacgctgccgggtgggcctgcggagactaacctcgagagggtcatccacgaggtgctgctctcccagaaaaagggatagactgccaacgcgtgatcgtcgtgggagtatcatgttcgggagcatcatgccttgcccctcgctttgctgtgttttcttatttacgtgtgttagctttgaataattaattatctcaactttcagctctcg

SEQ ID NO: 938 - protein, 1663 aa, Zea mays
  misc_feature: PFam Name: UDPGT; PFam Description: UDP-glucoronosyl and
  misc_feature: PFam Name: Peptidase_S8; PFam Description: Subtilase family
  misc_feature: PFam Name: Pkinase; PFam Description: Protein kinase domain
  misc_feature: PFam Name: Podocalyxin; PFam Description: Podocalyxin
  misc_feature: PFam Name: Cation_efflux; PFam Description: Cation efflux family
  misc_feature: GI Number: 62241065; NR Description: glycosyltransferase
  misc_feature: GI Number: 62241067; NR Description: glycosyltransferase
  misc_feature: GI Number: 50945531; NR Description: putative glucosyltransferase [Oryza sativa (japonica cultivar-group)] >gi|37805944|dbj|BAC99360.1| putative glucosyltransferase [Oryza sativa (japonica cultivar-group)] >gi|37806122|dbj|BAC99571.1|
  misc_feature: GI Number: 50909841; NR Description: putative glucosyltransferase-10 [Oryza sativa (japonica cultivar-group)] >gi|50725260|dbj|BAD34262.1| putative glucosyltransferase-10 [Oryza
  misc_feature: GI Number: 37993655; NR Description: UDP-glycosyltransferase
ACTACTGGTAGAACTAGAGCTTAGAAGTGCCGGTTTTCCACGAGGCGAGCGCGCGGTCATGGGGTCACTGTCGACGGCGGAGGGGCAGCGGCCGCACGCCGTGTGCATGCCGTACCCGGCGCAGGGCCACGTGACGCCCATGCTCAAGCTCGCCAAGCTCCTCCACGCGCGGGGCTTCCAGATCACCTTCGTCAACACCGAGTTCAACCACCGCCGCCTGCTCCACTCGCGCGGGCCCGACGCGCTCGACCGCGTGCCCGGGTTCCGCTTCGACGCCATTCCCGACGGCCTCCCGCCGTCCGACGCCGACGCCACGCAGGACATCCCCGCGCTCTGCTACTCCACCATGACCACCTGCCTCCCGCACCTCCTCGCGCTCCTCGCCAGGGTCGACGCCGACGCCGGGTCCCCGCCGGTCACCTGCCTCGTCGTGGACGCCGTCATGTCGTTCGGCTTCGACGCCGCCAGGCAGATCGGCGTGCCCGTCGCCGCGCTCTGGACCGCCAGCGCCTGCGGGTTCATGGGCTACCGGAACTACAGAAACCTCATCGACTGGGGCCTCGTGCCATTCAAGAGCGCCGCGGACCTCCAGGACAACGTCGGCGGCGGCCACCTCGCCACCGTGGTCACCGGCGCGCGCGGCATGTGCGACGGCGTGCAGCTGCGCGACTTCCCCAACTTCATCCGCACCACGGACCGCGCGGACTTCATGTTCAACTTCCTCATGCGCGAGTCCGAGCGGCTGTCGCTCCCCGACGGCGTCATCGTCAACACCTTCGAGGACCTCGAGGGAGCCACGCTGGACGCCATGCGCGCTATCCTCCCGACGGTGTACCCCGTCGGCCCGCTCCTCCTCCGCGAGCGCCTGGAGATCCCCGCTAGCAGCCCGCTCGCGGTCCTCGGCTCCAACCTCTGGAAGGAGGAGGAAGGCCTCCTGGAGTGGCTCGCTGGCCGCGCGCCGCGATCCGTGGTGTACGTGAACTACGGCAGCATCACGGTGATGACCAACTCGCAGCTGCTCGAGTTCGCGTGGGGCCTGGCCAACAGCGGGTACCCGTTCGTGTGGAACATCCGGCCGGACCTGGTGAAGGGCGACTCCGCCGTGCTGCCGCCGGAGTTCGCGTCCGCCGTCGAGGGCCGCGCGTTGCTGACGACGTGGTGCCCGCAGGAGGCGGCGATCCAGCATGAGGCGGTCGGGGTGTTCCTGACTCACTCCGGCTGGAACTCCACCCTGGAGAGCCTCTGCGCGGGGGTGCCCATGCTGAGCTGGCCCTTCTTCGCGGAGCAGCAGACCAACTGCCGGTACAAGCGCACGGAGTGGGGAGTCGGGATGGAGATCGGCGGCGAGGTGCGGCGCGACGAGGTGACGGTCGTTCTAAAGGAGGCCATGGACGGGGAGAAGGGGAGGGAGATGCGCCGGCGCGCAGAGGAGTGGAAGGAGAAGGCCGTGAAGGTGACGCTGCCGGGTGGGCCTGCGGAGACTAACCTCGAGAGGGTCATCCACGAGGTGCTGCTCTCCCAGAAAAAGGGATAGACTGCCAACGCGTGATCGTCGTGGGAGTATCATGTTCGGGAGCATCATGCCTTGCCCCTCGCTTTGCTGTGTTTTCTTATTTACGTGTGTTAGCTTTGAATAATTAATTATCTCAACTTTCAGCTCTCG

SEQ ID NO: 939 - DNA, 1859 bp, Zea mays
  misc_feature (1)..(1859): Ceres cDNA ID no. 12381855
  misc_feature (1)..(1859): Ceres CLONE  ID no. 390971
  misc_feature (1)..(1859): Also known as  Ceres CDNA ID no. 23810619
gatgatgatcgatggcgctttagctgaggcggggagtactacaaaattccatcggttctagttccggcggccgattgaattcctcgtcgaggcccccccgccctccgcaataaattggtgcggggatttcctcccttacctaaccggccagccagcaggtcgcggtcgaggttctcttgtcggcttgatttcctcccgcggcggagggccggccgggcggagcatgcgtcgcgtgcgggtgtcctcgcaccaggcgcccgtccacaagctcggcgacggccagatgaagctgacgccgaggttccgcctggcggcgacccccgcgccgccggggtccggactcgtacccggacccggacccgcagcaggcgtcgtgggaggcggcggaggcgctgatcccggggctccccgacgacgcgggcgctgaactgccctgctgcggctggccgtggagtcccacggcgcgtgcaggctggtgtgccggcgctggcgccatctgttggcagacaaggcccggttcttcgcgcagcggcgggcgctggggctgcgcgcgccgtggctgttcacgctggcgttccaccgctgcacgggcgagatccagtggaaggtgctggacctggggcagcgcagctggcacgccatcccggccatgccgtgccgcgaccgcgcctgcccgcgcgggttcggctgcgtggccgtccctgctgccggcaacggcgacggcggcggcggcggggacgcgctcgtggtctgcggcgggctggtctccgacatggactgcccgctgcacctcgtgctccggtacgacgtgtgccggaacaggtgggccgtgatggcgcggatgctggcggcgcggtccttcttcgccggcggcgtcatcgacggccgcgtgtacgtcgcgggagggtacagcgcggaccagttcgagctgagctccgccgaggtgctcgaccctgctggcgccggcgcgtggcggccggtcgccagcatgggggccaacatggcgtcggccgactccgccgtcctcggcggcaggctgtacgtgaccgaggggtgcgcgtggcccttcttctcggcgccgaggggccaggtgtacgacccgagggcggaccggtgggaggcgatgccggcggggatgcgggaagggtggacggggctgagcgtcgtcgtcgcgggacgcctgttcgtcgtctcggagtacgagaggatgaaggtcaaggtgtacgacccggagacggactcgtgggacgcggtcggtggcgcccccatgcccgagcgcatcatgaagcccttctcggtcagctgcgtcgacagtaggatcgtcgtcgttgggcgaggcctccacgtcgcgattgggcatgtgcgggaggagcccgctggcggcggtcctggtagcaggggagcgccaggctactccgtttgctggcaggacgtggacgctcctaaggagttcagcgacctgacaccttcgagcagccagattctgcatgcttagctgctcgttgagccagccagccatctgcccactggtaatccgcacaaggacttcaacctggttgggttggttactacgagcggtcagcggtcaactattgcagctgcctgcttccagcgcttttgcctttgatgagatgcgcaatcgagtaggatcttttcgagtctctattatctggagggagccggagatgtaaaaagaaataaaccgaggcttttcaaatcggggagagacgaattgaggctcttctgcctggttgtaagtagatttgcttgtccagtttctccaacatatctgttgctgtgtttcgctctttggtgtttcattggtcagaaaaaagaactgttgctgtcgtgctgaatcc

SEQ ID NO: 940 - protein, 1859 aa, Zea mays
  misc_feature: PFam Name: Kelch_1; PFam Description: Kelch motif
  misc_feature: PFam Name: F-box; PFam Description: F-box domain
  misc_feature: PFam Name: Pkinase; PFam Description: Protein kinase domain
  misc_feature: PFam Name: HlyD; PFam Description: HlyD family secretion protein
  misc_feature: GI Number: 50508810; NR Description: kelch repeat containing
  misc_feature: GI Number: 21593163; NR Description: unknown [Arabidopsis thaliana]
  misc_feature: GI Number: 51536380; NR Description: kelch repeat containing F-box protein-like [Oryza sativa (japonica cultivar-group)] >gi|51535613|dbj|BAD37556.1| kelch repeat containing F-box
  misc_feature: GI Number: 50906089; NR Description: putative kelch repeat-containing F-box family protein [Oryza sativa (japonica cultivar-group)] >gi|46390085|dbj|BAD15502.1| putative kelch repeat-containing F-box family protein [Oryza sativa (japonica
  misc_feature: GI Number: 12324173; NR Description: hypohetical protein;
GATGATGATCGATGGCGCTTTAGCTGAGGCGGGGAGTACTACAAAATTCCATCGGTTCTAGTTCCGGCGGCCGATTGAATTCCTCGTCGAGGCCCCCCCGCCCTCCGCAATAAATTGGTGCGGGGATTTCCTCCCTTACCTAACCGGCCAGCCAGCAGGTCGCGGTCGAGGTTCTCTTGTCGGCTTGATTTCCTCCCGCGGCGGAGGGCCGGCCGGGCGGAGCATGCGTCGCGTGCGGGTGTCCTCGCACCAGGCGCCCGTCCACAAGCTCGGCGACGGCCAGATGAAGCTGACGCCGAGGTTCCGCCTGGCGGCGACCCCCGCGCCGCCGGGGTCCGGACTCGTACCCGGACCCGGACCCGCAGCAGGCGTCGTGGGAGGCGGCGGAGGCGCTGATCCCGGGGCTCCCCGACGACGCGGGCGCTGAACTGCCCTGCTGCGGCTGGCCGTGGAGTCCCACGGCGCGTGCAGGCTGGTGTGCCGGCGCTGGCGCCATCTGTTGGCAGACAAGGCCCGGTTCTTCGCGCAGCGGCGGGCGCTGGGGCTGCGCGCGCCGTGGCTGTTCACGCTGGCGTTCCACCGCTGCACGGGCGAGATCCAGTGGAAGGTGCTGGACCTGGGGCAGCGCAGCTGGCACGCCATCCCGGCCATGCCGTGCCGCGACCGCGCCTGCCCGCGCGGGTTCGGCTGCGTGGCCGTCCCTGCTGCCGGCAACGGCGACGGCGGCGGCGGCGGGGACGCGCTCGTGGTCTGCGGCGGGCTGGTCTCCGACATGGACTGCCCGCTGCACCTCGTGCTCCGGTACGACGTGTGCCGGAACAGGTGGGCCGTGATGGCGCGGATGCTGGCGGCGCGGTCCTTCTTCGCCGGCGGCGTCATCGACGGCCGCGTGTACGTCGCGGGAGGGTACAGCGCGGACCAGTTCGAGCTGAGCTCCGCCGAGGTGCTCGACCCTGCTGGCGCCGGCGCGTGGCGGCCGGTCGCCAGCATGGGGGCCAACATGGCGTCGGCCGACTCCGCCGTCCTCGGCGGCAGGCTGTACGTGACCGAGGGGTGCGCGTGGCCCTTCTTCTCGGCGCCGAGGGGCCAGGTGTACGACCCGAGGGCGGACCGGTGGGAGGCGATGCCGGCGGGGATGCGGGAAGGGTGGACGGGGCTGAGCGTCGTCGTCGCGGGACGCCTGTTCGTCGTCTCGGAGTACGAGAGGATGAAGGTCAAGGTGTACGACCCGGAGACGGACTCGTGGGACGCGGTCGGTGGCGCCCCCATGCCCGAGCGCATCATGAAGCCCTTCTCGGTCAGCTGCGTCGACAGTAGGATCGTCGTCGTTGGGCGAGGCCTCCACGTCGCGATTGGGCATGTGCGGGAGGAGCCCGCTGGCGGCGGTCCTGGTAGCAGGGGAGCGCCAGGCTACTCCGTTTGCTGGCAGGACGTGGACGCTCCTAAGGAGTTCAGCGACCTGACACCTTCGAGCAGCCAGATTCTGCATGCTTAGCTGCTCGTTGAGCCAGCCAGCCATCTGCCCACTGGTAATCCGCACAAGGACTTCAACCTGGTTGGGTTGGTTACTACGAGCGGTCAGCGGTCAACTATTGCAGCTGCCTGCTTCCAGCGCTTTTGCCTTTGATGAGATGCGCAATCGAGTAGGATCTTTTCGAGTCTCTATTATCTGGAGGGAGCCGGAGATGTAAAAAGAAATAAACCGAGGCTTTTCAAATCGGGGAGAGACGAATTGAGGCTCTTCTGCCTGGTTGTAAGTAGATTTGCTTGTCCAGTTTCTCCAACATATCTGTTGCTGTGTTTCGCTCTTTGGTGTTTCATTGGTCAGAAAAAAGAACTGTTGCTGTCGTGCTGAATCC

SEQ ID NO: 941 - DNA, 1759 bp, Zea mays
  misc_feature (1)..(1759): Ceres cDNA ID no. 12382113
  misc_feature (1)..(1759): Ceres CLONE  ID no. 312402
  misc_feature (1)..(1759): Also known as  Ceres CDNA ID no. 24373502
atcatctacaccgccgaggcgccgacaaccacttggcgaccatgagcacgggcacggacgccgtcccggtcgccgtggcgccggcgaagcgcccgcccatcaacaagtacgccttcgcctgcgccctgctcgcctccatgaactccgtcctcctcggctatgacatctcggtgatgagcggcgcgcagctgttcatgaaggaggacctcaagatcacggacacgcagatcgagatcctcgccggcgtcatcaacatctactcgctcttcggctccctcgccgcgggcctcacctccgactggctcggccgccgctacaccatggtgctggcggccgccatcttcttcacgggcgcgctcctcatgggcctcgccccggactacgggttcctcatggcgggccgcttcgtggccggcatcggcgtcggcttcgcgctcatgatcgcccccgtgtacaccgccgaggtggcgcccacctccgcgcgcggcttcctcacctccttcccggaggtcttcaacaacttcggcatcctcctcggctacgtctccaacttcgccttcgcgcgcctgcccgtccacctcagctggcgcgccatgttcctggtcggcgccgtgccgcccgtcttcctcggcgtcgccgtcctcgccatgccggagtcgccgcgctggctcgtcatgcggggccgcatcgacgacgcgcgccgcgtgctgcagaagacctccgactcccccgccgaggccgaggagcgtctgctcgacatcaagaaggtggtcggcatccccgagggcgtgaccgacgccgacgacgtggccgccatcgtccgcgccagcagcaaggcatcgtcgtcgtcgtcgtcgtcgcgccacgacggggtgtggaaggagctgctcatcaacccttcccgccccgtgcgccgcatgctcgtggcggggctcggcctcatgttcatccagcaggccacgggcgtggactgcgtggtgatgtacagcccgcgggtgttcgagcgggcgggcatcaagtccaagaccaactcgctgggcgcgtccatggcggtgggcgcgtgcaagaccttcttcatacccatctccacgctgctcctggaccgcatcggccgccgcccgctgctgctggccagcggcggcgggatgaccatcttcctcttcacgctggccacgtccttgcacatgatggaccggcgccccgagggggaggccgcggcactgggcgcggtgagcatcgcggccatgctgtcgttcgtggcgtcgttcgcgtccggcctgggccccgtcgcctgggtctactgctccgagatctacccgctgcggctgcgcgcgcaggctgctgccatcggcacggggctcaaccggatcatgagcggcgccaccaccatgtccttcctctcgctctccaacgccatcaccatcgccggcagcttctacctctacgcgtgcatcgccgccgcaggctgggtgttcatgtacttcttcctgccggagaccatgggcaggagcctggaggacaccgtgaagctcttcggcaaggacgcggacgacgaggacgtcggcgacagccgtcgtcacgcgcccagtaagaagccctccacttccactgagcttgagctcagtgctcagcactgagtgatgtgccatgcaacacgtgtcctcccgagtgtgaccgaagcttatgtctaaagcttcgatgatacagtctactcctagtatcttgtgtgctcgaactgtggtgaatcttttgtagatcc

SEQ ID NO: 942 - protein, 1759 aa, Zea mays
  misc_feature: PFam Name: Sugar_tr; PFam Description: Sugar (and other)
  misc_feature: PFam Name: MFS_1; PFam Description: Major Facilitator Superfamily
  misc_feature: GI Number: 12004316; NR Description: mannitol transporter
  misc_feature: GI Number: 34392081; NR Description: polyol transporter
  misc_feature: GI Number: 30025133; NR Description: putative sorbitol
  misc_feature: GI Number: 4678208; NR Description: putative sugar transporter [Arabidopsis thaliana] >gi|15226682|ref|NP_179209.1| mannitol transporter, putative [Arabidopsis thaliana] >gi|25308957|pir||H84536 probable sugar transporter [imported] -
  misc_feature: GI Number: 4678209; NR Description: putative sugar transporter [Arabidopsis thaliana] >gi|15226696|ref|NP_179210.1| mannitol transporter, putative [Arabidopsis thaliana] >gi|25308959|pir||A84537 probable sugar transporter [imported] -
ATCATCTACACCGCCGAGGCGCCGACAACCACTTGGCGACCATGAGCACGGGCACGGACGCCGTCCCGGTCGCCGTGGCGCCGGCGAAGCGCCCGCCCATCAACAAGTACGCCTTCGCCTGCGCCCTGCTCGCCTCCATGAACTCCGTCCTCCTCGGCTATGACATCTCGGTGATGAGCGGCGCGCAGCTGTTCATGAAGGAGGACCTCAAGATCACGGACACGCAGATCGAGATCCTCGCCGGCGTCATCAACATCTACTCGCTCTTCGGCTCCCTCGCCGCGGGCCTCACCTCCGACTGGCTCGGCCGCCGCTACACCATGGTGCTGGCGGCCGCCATCTTCTTCACGGGCGCGCTCCTCATGGGCCTCGCCCCGGACTACGGGTTCCTCATGGCGGGCCGCTTCGTGGCCGGCATCGGCGTCGGCTTCGCGCTCATGATCGCCCCCGTGTACACCGCCGAGGTGGCGCCCACCTCCGCGCGCGGCTTCCTCACCTCCTTCCCGGAGGTCTTCAACAACTTCGGCATCCTCCTCGGCTACGTCTCCAACTTCGCCTTCGCGCGCCTGCCCGTCCACCTCAGCTGGCGCGCCATGTTCCTGGTCGGCGCCGTGCCGCCCGTCTTCCTCGGCGTCGCCGTCCTCGCCATGCCGGAGTCGCCGCGCTGGCTCGTCATGCGGGGCCGCATCGACGACGCGCGCCGCGTGCTGCAGAAGACCTCCGACTCCCCCGCCGAGGCCGAGGAGCGTCTGCTCGACATCAAGAAGGTGGTCGGCATCCCCGAGGGCGTGACCGACGCCGACGACGTGGCCGCCATCGTCCGCGCCAGCAGCAAGGCATCGTCGTCGTCGTCGTCGTCGCGCCACGACGGGGTGTGGAAGGAGCTGCTCATCAACCCTTCCCGCCCCGTGCGCCGCATGCTCGTGGCGGGGCTCGGCCTCATGTTCATCCAGCAGGCCACGGGCGTGGACTGCGTGGTGATGTACAGCCCGCGGGTGTTCGAGCGGGCGGGCATCAAGTCCAAGACCAACTCGCTGGGCGCGTCCATGGCGGTGGGCGCGTGCAAGACCTTCTTCATACCCATCTCCACGCTGCTCCTGGACCGCATCGGCCGCCGCCCGCTGCTGCTGGCCAGCGGCGGCGGGATGACCATCTTCCTCTTCACGCTGGCCACGTCCTTGCACATGATGGACCGGCGCCCCGAGGGGGAGGCCGCGGCACTGGGCGCGGTGAGCATCGCGGCCATGCTGTCGTTCGTGGCGTCGTTCGCGTCCGGCCTGGGCCCCGTCGCCTGGGTCTACTGCTCCGAGATCTACCCGCTGCGGCTGCGCGCGCAGGCTGCTGCCATCGGCACGGGGCTCAACCGGATCATGAGCGGCGCCACCACCATGTCCTTCCTCTCGCTCTCCAACGCCATCACCATCGCCGGCAGCTTCTACCTCTACGCGTGCATCGCCGCCGCAGGCTGGGTGTTCATGTACTTCTTCCTGCCGGAGACCATGGGCAGGAGCCTGGAGGACACCGTGAAGCTCTTCGGCAAGGACGCGGACGACGAGGACGTCGGCGACAGCCGTCGTCACGCGCCCAGTAAGAAGCCCTCCACTTCCACTGAGCTTGAGCTCAGTGCTCAGCACTGAGTGATGTGCCATGCAACACGTGTCCTCCCGAGTGTGACCGAAGCTTATGTCTAAAGCTTCGATGATACAGTCTACTCCTAGTATCTTGTGTGCTCGAACTGTGGTGAATCTTTTGTAGATCC

SEQ ID NO: 943 - DNA, 1535 bp, Zea mays
  misc_feature (1)..(1535): Ceres cDNA ID no. 12382136
  misc_feature (1)..(1535): Ceres CLONE  ID no. 324528
  misc_feature (1)..(1535): Also known as  Ceres CDNA ID no. 23790482
atgaagctcacatttctcaatggcattccattcttgcacaatcattccagccagccaccatagctccatgtcgtcgtcgacctcacaaatggcgtcgctcgccgtgctcgtcttcctggtggtctgcgcaacgcttgcgtccggcgccgccagcgtccgcgttgggctcacgcgcatccactccgacccggacaccaccgcgccccagttcgtgcgcgacgcgctgcgccgcgacatgcaccggcagcggtcccggtcgttcggccgcgaccgcgaccgcgagctcgcggagtccgacgggcgcaccagcaccacggtgtccgcgcgcacccgcaaggacctgcccaacggcggggagtacctcatgacgctggccatcggcacgccgccgctgccgtacgcggccgtcgccgacacgggcagcgacctcatctggacgcagtgcgcgccctgcggcacccagtgcttcgagcagccggcgccgctgtacaacccagcgagctcgaccacgttcagcgtgctcccgtgcaacagctccctgagcatgtgcgcgggggcgctggcgggggccgcgccgccgcccgggtgcgcctgcatgtactaccagacgtacggcaccgggtggacggcgggcgtgcagggctccgagaccttcaccttcggctcgtccgccgccgaccaggcccgcgtccccggcgtcgccttcggctgcagcaacgccagcagcagcgactggaacgggtcggcggggctggtggggctgggcaggggcagcctgtcgctcgtctcgcagctcggcgccggcaggttctcctactgcctgacgccgttccaggacaccaacagcaccagcaccctcctcctcggcccgtcggcggcgctcaacggcaccggcgtccgctccacgccgttcgtcgctagcccggccagggcgcccatgagcacctactactacctcaacctgacgggcatatccctgggcgcgaaggcgctgcccatctctcccggcgcattctccctgaagcccgacggcacgggcggcctcatcatcgactccggcacgaccatcacctcgctggccaacgcggcgtaccagcaggtccgcgccgcggtaaagtcccagctggtcacgacgctgccaacggtcgacgggtcggactccacggggctcgacctgtgcttcgcgctgccggccccgacgtcggcgccgccggccgtgctgccgagcatgacgctccacttcgacggcgccgacatggtgctccccgcggacagctacatgatctcggggtccggcgtgtggtgcctggccatgcggaaccagacggacggcgcgatgagcacgttcgggaactaccagcagcagaacatgcacatcctctacgacgtccgggaggagacgctgtcgttcgctccggccaagtgcagcactctttgacgatgcgatagttgtacatatgtatatgtgtgcatatataggattcgtgatttttttgtatacagtggattgttaaccgaacacgctaattaattcc

SEQ ID NO: 944 - protein, 1535 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: APC_basic; PFam Description: APC basic domain
  misc_feature: GI Number: 34898762; NR Description: putative nucleoid DNA-binding protein cnd41 [Oryza sativa (japonica cultivar-group)] >gi|22831049|dbj|BAC15912.1| putative nucleoid DNA-binding protein
  misc_feature: GI Number: 50946685; NR Description: putative nucleoid DNA-binding protein [Oryza sativa (japonica cultivar-group)] >gi|42407407|dbj|BAD09565.1| putative nucleoid DNA-binding protein
  misc_feature: GI Number: 51535935; NR Description: putative aspartic
  misc_feature: GI Number: 34898756; NR Description: putative nucleoid DNA-binding protein cnd41 [Oryza sativa (japonica cultivar-group)] >gi|22831047|dbj|BAC15910.1| putative nucleoid DNA-binding protein
  misc_feature: GI Number: 41016421; NR Description: aspartic proteinase
ATGAAGCTCACATTTCTCAATGGCATTCCATTCTTGCACAATCATTCCAGCCAGCCACCATAGCTCCATGTCGTCGTCGACCTCACAAATGGCGTCGCTCGCCGTGCTCGTCTTCCTGGTGGTCTGCGCAACGCTTGCGTCCGGCGCCGCCAGCGTCCGCGTTGGGCTCACGCGCATCCACTCCGACCCGGACACCACCGCGCCCCAGTTCGTGCGCGACGCGCTGCGCCGCGACATGCACCGGCAGCGGTCCCGGTCGTTCGGCCGCGACCGCGACCGCGAGCTCGCGGAGTCCGACGGGCGCACCAGCACCACGGTGTCCGCGCGCACCCGCAAGGACCTGCCCAACGGCGGGGAGTACCTCATGACGCTGGCCATCGGCACGCCGCCGCTGCCGTACGCGGCCGTCGCCGACACGGGCAGCGACCTCATCTGGACGCAGTGCGCGCCCTGCGGCACCCAGTGCTTCGAGCAGCCGGCGCCGCTGTACAACCCAGCGAGCTCGACCACGTTCAGCGTGCTCCCGTGCAACAGCTCCCTGAGCATGTGCGCGGGGGCGCTGGCGGGGGCCGCGCCGCCGCCCGGGTGCGCCTGCATGTACTACCAGACGTACGGCACCGGGTGGACGGCGGGCGTGCAGGGCTCCGAGACCTTCACCTTCGGCTCGTCCGCCGCCGACCAGGCCCGCGTCCCCGGCGTCGCCTTCGGCTGCAGCAACGCCAGCAGCAGCGACTGGAACGGGTCGGCGGGGCTGGTGGGGCTGGGCAGGGGCAGCCTGTCGCTCGTCTCGCAGCTCGGCGCCGGCAGGTTCTCCTACTGCCTGACGCCGTTCCAGGACACCAACAGCACCAGCACCCTCCTCCTCGGCCCGTCGGCGGCGCTCAACGGCACCGGCGTCCGCTCCACGCCGTTCGTCGCTAGCCCGGCCAGGGCGCCCATGAGCACCTACTACTACCTCAACCTGACGGGCATATCCCTGGGCGCGAAGGCGCTGCCCATCTCTCCCGGCGCATTCTCCCTGAAGCCCGACGGCACGGGCGGCCTCATCATCGACTCCGGCACGACCATCACCTCGCTGGCCAACGCGGCGTACCAGCAGGTCCGCGCCGCGGTAAAGTCCCAGCTGGTCACGACGCTGCCAACGGTCGACGGGTCGGACTCCACGGGGCTCGACCTGTGCTTCGCGCTGCCGGCCCCGACGTCGGCGCCGCCGGCCGTGCTGCCGAGCATGACGCTCCACTTCGACGGCGCCGACATGGTGCTCCCCGCGGACAGCTACATGATCTCGGGGTCCGGCGTGTGGTGCCTGGCCATGCGGAACCAGACGGACGGCGCGATGAGCACGTTCGGGAACTACCAGCAGCAGAACATGCACATCCTCTACGACGTCCGGGAGGAGACGCTGTCGTTCGCTCCGGCCAAGTGCAGCACTCTTTGACGATGCGATAGTTGTACATATGTATATGTGTGCATATATAGGATTCGTGATTTTTTTGTATACAGTGGATTGTTAACCGAACACGCTAATTAATTCC

SEQ ID NO: 945 - DNA, 1432 bp, Zea mays
  misc_feature (1)..(1432): Ceres cDNA ID no. 12382187
  misc_feature (1)..(1432): Ceres CLONE  ID no. 325990
  misc_feature (1)..(1432): Also known as  Ceres CDNA ID no. 23790771
atgacaagtaaattagagattgatgcacgcagtagtaattaagacaggaatcgtaatccccccttgtttttggtttagtagtaaatctgcctgctgctccaagtagtagttaaaaaaacccagagaagcgcggtgggctgcgtataaatagccggccggccggaaagggggaaacgggcaggcaaacaaacaacacacactcgcgaggagcaggagcaggagcgatcaggacaacgctttggactcctggactggacctaccccgatggcgccagcctcctctccgatgagacagtaatccagcgagcgcgagtgagaggcaaccagcaaccatgaggccagacacggcggcctccgcctctccgactccgaagaagaaacccgacagtaaagccgcgctggacctcgcgtcgtggagcttcaacgtcaccacgtccgtcgggctcatcatggtcaacaaggctctaatggcgacgtacgggttcacgttcgccacgacgttaacggggctgcatttcgcgaccaccaccgtgatgaccctcgtgttccggtgggtcggcctgagccagccgtcgcagcttccgttaccggacctagccaagttcgtggtgttctccaacctgtccatcgtggggatgaacgtcagcctgatgtggaactccgtcggcttctaccaggtagccaagctgtgcatgatcccggcgtcgtgcctcctggaggtggtcttggaccgcgtgcactactcccgggacaccaggctcagcatcgcggtcgtgctcgctggagtggcggtgtgcaccgtcactgacgtgagcgtcaacgccagaggcctggtcgcggccgtcgtggctgtctggagcacggctctgcagcagtattatgttcatttcctccagcgcaagcactctctcaactcgttcagcctgctgggccacacggcgccggcgcaggcagggtcgctgctgctggcagggccgttcgttgactacctgctgacagggcaaagggtggaccacttcagcttctcgtctctcgctctgttgttcctcgcgctgtcgtgcttcatcgcgatcggggtcaacctgagccagttcatctgcatcggccgcttctccgccgtgtccttccaggtcctgggccacatgaagaccgtgctcgtcctctccctcggcttcctcttcttcggcaaggaaggcctcagcctccaggtcgtcgtcgggatggccctcgccgtcctcgggatggtgtggtacgggaacgcgtccgctaaaccgggcggcaaggagcgccgcggcaaagacctgccggtgagcctcaaacaagacaaggacgacactgacaaataatcatttgttatagttacaggtatacgtgtaatcgtttaatcacatggtgcaattgtttgccaaatcattgaacaatttcctgtggt

SEQ ID NO: 946 - protein, 1432 aa, Zea mays
  misc_feature: GI Number: 21593003; NR Description: unknown [Arabidopsis thaliana]
  misc_feature: GI Number: 30313364; NR Description: putative transmembrane
  misc_feature: GI Number: 50933293; NR Description: putative transmembrane protein [Oryza sativa (japonica cultivar-group)] >gi|48843759|gb|AAT47018.1| putative transmembrane protein [Oryza
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
  misc_feature: GI Number: 21595054; NR Description: unknown [Arabidopsis thaliana]
ATGACAAGTAAATTAGAGATTGATGCACGCAGTAGTAATTAAGACAGGAATCGTAATCCCCCCTTGTTTTTGGTTTAGTAGTAAATCTGCCTGCTGCTCCAAGTAGTAGTTAAAAAAACCCAGAGAAGCGCGGTGGGCTGCGTATAAATAGCCGGCCGGCCGGAAAGGGGGAAACGGGCAGGCAAACAAACAACACACACTCGCGAGGAGCAGGAGCAGGAGCGATCAGGACAACGCTTTGGACTCCTGGACTGGACCTACCCCGATGGCGCCAGCCTCCTCTCCGATGAGACAGTAATCCAGCGAGCGCGAGTGAGAGGCAACCAGCAACCATGAGGCCAGACACGGCGGCCTCCGCCTCTCCGACTCCGAAGAAGAAACCCGACAGTAAAGCCGCGCTGGACCTCGCGTCGTGGAGCTTCAACGTCACCACGTCCGTCGGGCTCATCATGGTCAACAAGGCTCTAATGGCGACGTACGGGTTCACGTTCGCCACGACGTTAACGGGGCTGCATTTCGCGACCACCACCGTGATGACCCTCGTGTTCCGGTGGGTCGGCCTGAGCCAGCCGTCGCAGCTTCCGTTACCGGACCTAGCCAAGTTCGTGGTGTTCTCCAACCTGTCCATCGTGGGGATGAACGTCAGCCTGATGTGGAACTCCGTCGGCTTCTACCAGGTAGCCAAGCTGTGCATGATCCCGGCGTCGTGCCTCCTGGAGGTGGTCTTGGACCGCGTGCACTACTCCCGGGACACCAGGCTCAGCATCGCGGTCGTGCTCGCTGGAGTGGCGGTGTGCACCGTCACTGACGTGAGCGTCAACGCCAGAGGCCTGGTCGCGGCCGTCGTGGCTGTCTGGAGCACGGCTCTGCAGCAGTATTATGTTCATTTCCTCCAGCGCAAGCACTCTCTCAACTCGTTCAGCCTGCTGGGCCACACGGCGCCGGCGCAGGCAGGGTCGCTGCTGCTGGCAGGGCCGTTCGTTGACTACCTGCTGACAGGGCAAAGGGTGGACCACTTCAGCTTCTCGTCTCTCGCTCTGTTGTTCCTCGCGCTGTCGTGCTTCATCGCGATCGGGGTCAACCTGAGCCAGTTCATCTGCATCGGCCGCTTCTCCGCCGTGTCCTTCCAGGTCCTGGGCCACATGAAGACCGTGCTCGTCCTCTCCCTCGGCTTCCTCTTCTTCGGCAAGGAAGGCCTCAGCCTCCAGGTCGTCGTCGGGATGGCCCTCGCCGTCCTCGGGATGGTGTGGTACGGGAACGCGTCCGCTAAACCGGGCGGCAAGGAGCGCCGCGGCAAAGACCTGCCGGTGAGCCTCAAACAAGACAAGGACGACACTGACAAATAATCATTTGTTATAGTTACAGGTATACGTGTAATCGTTTAATCACATGGTGCAATTGTTTGCCAAATCATTGAACAATTTCCTGTGGT

SEQ ID NO: 947 - DNA, 916 bp, Zea mays
  misc_feature (1)..(916): Ceres cDNA ID no. 12382210
  misc_feature (1)..(916): Ceres CLONE  ID no. 337472
  misc_feature (1)..(916): Also known as  Ceres CDNA ID no. 23778979
  misc_feature (519)..(519): n is a, c, t, g, unknown, or other
  misc_feature (528)..(528): n is a, c, t, g, unknown, or other
  misc_feature (540)..(540): n is a, c, t, g, unknown, or other
  misc_feature (642)..(642): n is a, c, t, g, unknown, or other
  misc_feature (654)..(654): n is a, c, t, g, unknown, or other
  misc_feature (660)..(660): n is a, c, t, g, unknown, or other
  misc_feature (666)..(666): n is a, c, t, g, unknown, or other
aacacagcacgcaagcacacacaacaaccacacttgcaccgagctagcagccaagatggcgaccaaacacttggctctttgcctccttgttctccttagcataggcatgggcatggccaccgctgctgcaaaccgcaaactgggttatggccccgggggaggaggtggcggtggtggtagcggtggaggcggtggttacggaggaccaggctatgggtccggatcagggtatggtgagggcggtggcagcggaggtgctgctggagggtatggacatggtggcggcggcggtggcggtggtggtgagggcgcgggagctggtggctctgggtacgggtccgggcaaggatctggctacggagctggcagcggtgctgccggtggatatgggagtggcggaggtggtggaggtggaggtggcggtggccagggtggtggttccggatatggccatggaggtggtgaaggatacggctctgggtctggctttggtggtggtgctgctggcggcggcggtgnacatggtgncggtggtggcgncggccaaggtgggtctggctatggctctggctctggctctggctcgggatatggatcaggtgaaggatacggacaaggtggtgctcatggaggaggctatgnaagcggtggtgncggtgnaggtgncggtggtcaaggtggtggtggctctggctatgggtctggatccggctccggttatggaggtggcaacgacaacggacattactaggctctttttcagagctaggaacatgttatacaaatatgtcaccagacatgagtaggtcttgctgcatgggatgctagttgtgtccatcgtgtgtgtaacaccgcaaggcttgtaatttgtcctgtaaactgcttgctgctttacattactggcaacaactaagtg

SEQ ID NO: 948 - protein, 916 aa, Zea mays
  misc_feature: PFam Name: Dehydrin; PFam Description: Dehydrin
  misc_feature: PFam Name: GRP; PFam Description: Glycine rich protein family
  misc_feature: PFam Name: S-antigen; PFam Description: S-antigen protein
  misc_feature: PFam Name: Secretin_N; PFam Description: Bacterial type
  misc_feature: PFam Name: COesterase; PFam Description: Carboxylesterase
  misc_feature: GI Number: 20245; NR Description: Glycine-rich protein [Oryza sativa] >gi|232183|sp|P29834|GRP2_ORYSA Glycine-rich cell wall structural protein 2 precursor >gi|72322|pir||KNRZG2 glycine-rich cell wall structural protein 2 precursor - rice
  misc_feature: GI Number: 51091828; NR Description: putative glycine rich
  misc_feature: GI Number: 17821; NR Description: glycine-rich_protein_(aa1-291) [Brassica napus]
  misc_feature: GI Number: 51090508; NR Description: putative glycine rich
  misc_feature: GI Number: 7636182; NR Description: glycine-rich protein
AACACAGCACGCAAGCACACACAACAACCACACTTGCACCGAGCTAGCAGCCAAGATGGCGACCAAACACTTGGCTCTTTGCCTCCTTGTTCTCCTTAGCATAGGCATGGGCATGGCCACCGCTGCTGCAAACCGCAAACTGGGTTATGGCCCCGGGGGAGGAGGTGGCGGTGGTGGTAGCGGTGGAGGCGGTGGTTACGGAGGACCAGGCTATGGGTCCGGATCAGGGTATGGTGAGGGCGGTGGCAGCGGAGGTGCTGCTGGAGGGTATGGACATGGTGGCGGCGGCGGTGGCGGTGGTGGTGAGGGCGCGGGAGCTGGTGGCTCTGGGTACGGGTCCGGGCAAGGATCTGGCTACGGAGCTGGCAGCGGTGCTGCCGGTGGATATGGGAGTGGCGGAGGTGGTGGAGGTGGAGGTGGCGGTGGCCAGGGTGGTGGTTCCGGATATGGCCATGGAGGTGGTGAAGGATACGGCTCTGGGTCTGGCTTTGGTGGTGGTGCTGCTGGCGGCGGCGGTGNACATGGTGNCGGTGGTGGCGNCGGCCAAGGTGGGTCTGGCTATGGCTCTGGCTCTGGCTCTGGCTCGGGATATGGATCAGGTGAAGGATACGGACAAGGTGGTGCTCATGGAGGAGGCTATGNAAGCGGTGGTGNCGGTGNAGGTGNCGGTGGTCAAGGTGGTGGTGGCTCTGGCTATGGGTCTGGATCCGGCTCCGGTTATGGAGGTGGCAACGACAACGGACATTACTAGGCTCTTTTTCAGAGCTAGGAACATGTTATACAAATATGTCACCAGACATGAGTAGGTCTTGCTGCATGGGATGCTAGTTGTGTCCATCGTGTGTGTAACACCGCAAGGCTTGTAATTTGTCCTGTAAACTGCTTGCTGCTTTACATTACTGGCAACAACTAAGTG

SEQ ID NO: 949 - DNA, 1418 bp, Zea mays
  misc_feature (1)..(1418): Ceres cDNA ID no. 12382218
  misc_feature (1)..(1418): Ceres CLONE  ID no. 280031
  misc_feature (1)..(1418): Also known as  Ceres CDNA ID no. 23779378
gcacgagaccattacctagaacatcctaatcgaaaaaaagagctcgagaccgacaggacgagactcgcagctagctgacacggccgagaagcagcttcattgcaggcgtagtacgtacccagcagcagctagcactagcagtccatcggagcgacgatggtgagaaggacggtgctggcggcgctgctggtggccgccgccctcgccggcggcgcgcgggcgcagctcaaggaggggttctacgactactcctgcccacaggcggagaagatcgtcaaggactacgtgaaggcgcacatcccccacgcgcccgacgtcgcctccaccctgctccgcacccacttccacgactgcttcgtcaggggctgcgacgcgtcagtgctgctcaacgcgacgggcggcagcgaggcggagaaggacgcggcgcccaacctgacgctgcgcggcttcggcttcatcgaccgcatcaaggcgctgctcgagaaggagtgccccggcgtggtgtcctgcgccgacatcgtcgcgctcgccgcccgcgactccgtcggcgtcatcggcggtccgttctggagcgtgccgacggggaggcgcgacggcaccgtgtccatcaagcaggaggcgctggaccagatccccgcgcccaccatgaacttcacccaactcctccagtccttccagaacaagagcctcaacctcgccgacctcgtctggctctcaggggctcacacgatcggcatctcccaatgcaactccttcagcgagcgcctgtacaacttcacggggcgcggcgggcccgacgacgcggacccgtcgctggacccgctgtacgccgcgaagttgcggctcaagtgcaagacgctgacggacaacacgacgatcgtggagatggaccccggcagcttccgcaccttcgacctgagctactaccgcggcgtgctcaagcggcggggcctgttccagtccgacgccgcgctcatcaccgacgccgcctccaaggccgacatcctcagcgtgatcaacgcgccgcccgaggtgttcttccaggtcttcgcgggctccatggtcaagatgggcgccatcgaggtcaagaccggctccgagggcgagatcaggaagcactgcgccctcgtcaacaagcactaggcggcggaattcatgcgggagatggctccattgctcgcaaaaaatccttgtgagacacacaacatgctctgcatctgcaggcgttgtcgtcaccttggtggacgtagtacatcggtgcatggattatctgttgtttaatttgtacgttcagttcattctgtttcttgtattcttttggttcctttcctcttgtttattcatggatgatgaggtgtttctgttttattctctggttcagctgtaaccatgtaacatgtaaggtgcgcgttttgtcc

SEQ ID NO: 950 - protein, 1418 aa, Zea mays
  misc_feature: PFam Name: peroxidase; PFam Description: Peroxidase
  misc_feature: GI Number: 52076880; NR Description: putative peroxidase
  misc_feature: GI Number: 55701045; NR Description: TPA: class III
  misc_feature: GI Number: 50905409; NR Description: putative peroxidase [Oryza sativa (japonica cultivar-group)] >gi|49389250|dbj|BAD25212.1| putative peroxidase [Oryza sativa
  misc_feature: GI Number: 55700915; NR Description: TPA: class III
  misc_feature: GI Number: 678547; NR Description: peroxidase
GCACGAGACCATTACCTAGAACATCCTAATCGAAAAAAAGAGCTCGAGACCGACAGGACGAGACTCGCAGCTAGCTGACACGGCCGAGAAGCAGCTTCATTGCAGGCGTAGTACGTACCCAGCAGCAGCTAGCACTAGCAGTCCATCGGAGCGACGATGGTGAGAAGGACGGTGCTGGCGGCGCTGCTGGTGGCCGCCGCCCTCGCCGGCGGCGCGCGGGCGCAGCTCAAGGAGGGGTTCTACGACTACTCCTGCCCACAGGCGGAGAAGATCGTCAAGGACTACGTGAAGGCGCACATCCCCCACGCGCCCGACGTCGCCTCCACCCTGCTCCGCACCCACTTCCACGACTGCTTCGTCAGGGGCTGCGACGCGTCAGTGCTGCTCAACGCGACGGGCGGCAGCGAGGCGGAGAAGGACGCGGCGCCCAACCTGACGCTGCGCGGCTTCGGCTTCATCGACCGCATCAAGGCGCTGCTCGAGAAGGAGTGCCCCGGCGTGGTGTCCTGCGCCGACATCGTCGCGCTCGCCGCCCGCGACTCCGTCGGCGTCATCGGCGGTCCGTTCTGGAGCGTGCCGACGGGGAGGCGCGACGGCACCGTGTCCATCAAGCAGGAGGCGCTGGACCAGATCCCCGCGCCCACCATGAACTTCACCCAACTCCTCCAGTCCTTCCAGAACAAGAGCCTCAACCTCGCCGACCTCGTCTGGCTCTCAGGGGCTCACACGATCGGCATCTCCCAATGCAACTCCTTCAGCGAGCGCCTGTACAACTTCACGGGGCGCGGCGGGCCCGACGACGCGGACCCGTCGCTGGACCCGCTGTACGCCGCGAAGTTGCGGCTCAAGTGCAAGACGCTGACGGACAACACGACGATCGTGGAGATGGACCCCGGCAGCTTCCGCACCTTCGACCTGAGCTACTACCGCGGCGTGCTCAAGCGGCGGGGCCTGTTCCAGTCCGACGCCGCGCTCATCACCGACGCCGCCTCCAAGGCCGACATCCTCAGCGTGATCAACGCGCCGCCCGAGGTGTTCTTCCAGGTCTTCGCGGGCTCCATGGTCAAGATGGGCGCCATCGAGGTCAAGACCGGCTCCGAGGGCGAGATCAGGAAGCACTGCGCCCTCGTCAACAAGCACTAGGCGGCGGAATTCATGCGGGAGATGGCTCCATTGCTCGCAAAAAATCCTTGTGAGACACACAACATGCTCTGCATCTGCAGGCGTTGTCGTCACCTTGGTGGACGTAGTACATCGGTGCATGGATTATCTGTTGTTTAATTTGTACGTTCAGTTCATTCTGTTTCTTGTATTCTTTTGGTTCCTTTCCTCTTGTTTATTCATGGATGATGAGGTGTTTCTGTTTTATTCTCTGGTTCAGCTGTAACCATGTAACATGTAAGGTGCGCGTTTTGTCC

SEQ ID NO: 951 - DNA, 1697 bp, Zea mays
  misc_feature (1)..(1697): Ceres cDNA ID no. 12382234
  misc_feature (1)..(1697): Ceres CLONE  ID no. 284441
  misc_feature (1)..(1697): Also known as  Ceres CDNA ID no. 23759323
  misc_feature (1691)..(1691): n is a, c, t, g, unknown, or other
gcacgagaccattacctagaacatcctaatcgaaaagtcctgcgaatccagtccgtcgacttccccgacgccgccgtggcagcagtcgccgccgacgaagtcggcaccagcagcggcggcgttaccacctctcgtccgctctccagccaccctcccccctctaccaccacatcgtccatacttactctcgagctccccggcgcaaaccccgtcgcgcccagccgaagccctaggatcctccacacccgcggcgtcatccacctctaccactcgtcgtcctccacttccacctcctcctcctacgcctcggcggtcgcagccacctcttcctcctcatccgggccggccaccccgcagcccgcctccgactcgcacctgcccctatgtcgcggcacgcgcctcctggtgctcgccgttccgacgcgcgtttcgccggaggactttgttcgcttctgcggcccccacctcgagtgtgcagccgacattcgtttcatcagggatgatggagtggaggaccggtacagcgttctagtggagtttgaggaccagagtagcgctgaatggttctacgccgatctcaatggctggaggttctcaacctctgagaaagattggatcaggacatcagtgggattttggcaactacttgtgatcactctttccgttgctcatgtgtttcagtgtggaccaattcatcctgtccggtatgccagttttgtcagaagcagtctgaaaattctacatgttctgtttgccaaaccactggaaacctctggatatgtgtgatatgtggttttgttggatgcggacggtatcaagaaggacatgcgaaacagcactggaaagatactcagcattgctattcgctagatttggaaacacaacgtgtttgggactatgttggtgacagttttgtacatcggctgaatcaatccaagagtgacgcaaagcatgctaagttcaaatcaaaaagtaaatattctggggatgaatgtgtaaactgctcgtgcaatgatgactctgatatgggtggagctatgttcagcagcaaagctgaaacaattgtggacgagtacaatcgtctcctggcaagccaacttgaaactcagagagaggtgcagacgtgcagttcattcctgctaagttttctatgtcactattgaaagcaaatattatgagggcctgttgtctgaggctaaaagaaacaaggagcaccagatttctgaagctgctgataaagctgtaagtgataagcttgaagagatgcaacttaagctcgagaatcttattgtggagaaaaagaaagttgcagatatgaacgaaaaactcactaggagccaagacatgtggcgccagacactaagagatatagaggaaagggaaagagcacagttgaagtcgaaggatgaaatgattctcgatctggaagaacagataaaggatttcaaattttccatcaaactgcagaagtcaatagagaagaacgatggtgtcaagggtggtacgctggttccactccctacggtttcagattctggaggcaagggtaaaaggtcatcaagaacaagcaagaggaggaattagtatcctttgctgagtagcaattagtcttgactggaacagacgtatacgaaccttattggcatgtatttactagcctgttatgatgaactacagcgtgatgtttgatngtcacg

SEQ ID NO: 952 - protein, 1697 aa, Zea mays
  misc_feature: PFam Name: zf-UBP; PFam Description: Zn-finger in
  misc_feature: PFam Name: BRAP2; PFam Description: BRCA1-associated protein 2
  misc_feature: PFam Name: Extensin_2; PFam Description: Extensin-like region
  misc_feature: PFam Name: zf-C3HC4; PFam Description: Zinc finger, C3HC4
  misc_feature: PFam Name: FH2; PFam Description: Formin Homology 2 Domain
  misc_feature: GI Number: 42569859; NR Description: zinc finger (ubiquitin-hydrolase) domain-containing protein [Arabidopsis
  misc_feature: GI Number: 42569332; NR Description: zinc finger (C3HC4-type
  misc_feature: GI Number: 50905721; NR Description: BRAP2-like protein [Oryza sativa (japonica cultivar-group)] >gi|49387526|dbj|BAD25059.1| BRAP2-like protein [Oryza sativa
  misc_feature: GI Number: 42560359; NR Description: IMP protein [Xenopus laevis]
  misc_feature: GI Number: 38014686; NR Description: MGC68778 protein
GCACGAGACCATTACCTAGAACATCCTAATCGAAAAGTCCTGCGAATCCAGTCCGTCGACTTCCCCGACGCCGCCGTGGCAGCAGTCGCCGCCGACGAAGTCGGCACCAGCAGCGGCGGCGTTACCACCTCTCGTCCGCTCTCCAGCCACCCTCCCCCCTCTACCACCACATCGTCCATACTTACTCTCGAGCTCCCCGGCGCAAACCCCGTCGCGCCCAGCCGAAGCCCTAGGATCCTCCACACCCGCGGCGTCATCCACCTCTACCACTCGTCGTCCTCCACTTCCACCTCCTCCTCCTACGCCTCGGCGGTCGCAGCCACCTCTTCCTCCTCATCCGGGCCGGCCACCCCGCAGCCCGCCTCCGACTCGCACCTGCCCCTATGTCGCGGCACGCGCCTCCTGGTGCTCGCCGTTCCGACGCGCGTTTCGCCGGAGGACTTTGTTCGCTTCTGCGGCCCCCACCTCGAGTGTGCAGCCGACATTCGTTTCATCAGGGATGATGGAGTGGAGGACCGGTACAGCGTTCTAGTGGAGTTTGAGGACCAGAGTAGCGCTGAATGGTTCTACGCCGATCTCAATGGCTGGAGGTTCTCAACCTCTGAGAAAGATTGGATCAGGACATCAGTGGGATTTTGGCAACTACTTGTGATCACTCTTTCCGTTGCTCATGTGTTTCAGTGTGGACCAATTCATCCTGTCCGGTATGCCAGTTTTGTCAGAAGCAGTCTGAAAATTCTACATGTTCTGTTTGCCAAACCACTGGAAACCTCTGGATATGTGTGATATGTGGTTTTGTTGGATGCGGACGGTATCAAGAAGGACATGCGAAACAGCACTGGAAAGATACTCAGCATTGCTATTCGCTAGATTTGGAAACACAACGTGTTTGGGACTATGTTGGTGACAGTTTTGTACATCGGCTGAATCAATCCAAGAGTGACGCAAAGCATGCTAAGTTCAAATCAAAAAGTAAATATTCTGGGGATGAATGTGTAAACTGCTCGTGCAATGATGACTCTGATATGGGTGGAGCTATGTTCAGCAGCAAAGCTGAAACAATTGTGGACGAGTACAATCGTCTCCTGGCAAGCCAACTTGAAACTCAGAGAGAGGTGCAGACGTGCAGTTCATTCCTGCTAAGTTTTCTATGTCACTATTGAAAGCAAATATTATGAGGGCCTGTTGTCTGAGGCTAAAAGAAACAAGGAGCACCAGATTTCTGAAGCTGCTGATAAAGCTGTAAGTGATAAGCTTGAAGAGATGCAACTTAAGCTCGAGAATCTTATTGTGGAGAAAAAGAAAGTTGCAGATATGAACGAAAAACTCACTAGGAGCCAAGACATGTGGCGCCAGACACTAAGAGATATAGAGGAAAGGGAAAGAGCACAGTTGAAGTCGAAGGATGAAATGATTCTCGATCTGGAAGAACAGATAAAGGATTTCAAATTTTCCATCAAACTGCAGAAGTCAATAGAGAAGAACGATGGTGTCAAGGGTGGTACGCTGGTTCCACTCCCTACGGTTTCAGATTCTGGAGGCAAGGGTAAAAGGTCATCAAGAACAAGCAAGAGGAGGAATTAGTATCCTTTGCTGAGTAGCAATTAGTCTTGACTGGAACAGACGTATACGAACCTTATTGGCATGTATTTACTAGCCTGTTATGATGAACTACAGCGTGATGTTTGATNGTCACG

SEQ ID NO: 953 - DNA, 2085 bp, Zea mays
  misc_feature (1)..(2085): Ceres cDNA ID no. 12382290
  misc_feature (1)..(2085): Ceres CLONE  ID no. 357292
  misc_feature (1)..(2085): Also known as  Ceres CDNA ID no. 23796997
  misc_feature (1171)..(1171): n is a, c, t, g, unknown, or other
  misc_feature (1215)..(1215): n is a, c, t, g, unknown, or other
gcacgagaccattacctagaacatcctaatcgaaatatcctccctccatcagttctcgtcctgttctttgctacgtacggctctgtgcctagctagcaatagcatagcaatgagggcgcttggaacggttgcttgggcatggctgctgctcctgcagcagctcgccggggcctctcatgtcgtctacgagaaccttgaggtggaggcgacgacagccgccgtgcggccctccattgtcgaccccctgctgaggaccgggtaccatttccagcctcgcaagaactggatcaatgatcccaacgctccactgtactacaaggggtggtaccatctcttctaccaatacaacccgaagggcgcggtgtggggcaacatcgtgtggggccactcggtgtcgcgagacctgatcaactgggtggccctgcaaccggcgatcgagccgagcatcccgtccgacaggtacgggtgctggtctgggtcggcgacgacgctggccgacggcacgccggcgatcatgtacacgggcgtgaaccggccggacgtgaactaccaggtgcagaacgtggcgtacccgcggaacaggtcggacccgctgctgcgggagtgggtgaagccgtcgcacaaccccatcatcgtgcccgggggcggcatcaacgcgacgcagttccgggacccgaccacggcctggcgcggcgcgggagacggccgctggcgcctgctcatcggcagcgtcaccgaggcgcgccacggcgtggcgtacgtgtaccggagccgcgacttcaggcgctggacgcgggcgcggcggccgctccactcggcggccacggggatgtgggagtgccccgacttctacccggtcggcgcgcccggccggcgcgcgggcgtcgagacggagacgtcggcggcgtccgacggcgacggcggctctcctcgtcgtcgtgagcagtccaagtacgtgctgaagaacagcctcgacctgcggcggtacgactactacaccgtcggcacgtacgaccgggcggccgagcggtacgtgccggacgaccccgcgggagacgagcgccacctgcggtacgactacggcaacttctacgcgtccaagacgttcttcgaccccgtgaagcggcggcgggtgctctggggctgggccaacgagtccgacaccgccgcngacgacgtggccaaagggtgggctgggatccaggcgattcctangacggtgtggctagaccccagcgggaagcagctgctgcagtggccaatcgaggaggtggaggctctgagaggcaggtcggtcgctctcaagaacagggtgatcaagccaggacagcacgtcgaggtcaccgggatacaaacggcacaggccgacgtggaggtgagcttcgaggtgtcgagcctggcgggcgccgaggcgctgctggacccggcgctggccagcgacgcgcagcggctgtgcggcgccaggggcgcggccgtggagggcggcgtgggcccgttcgggctgtgggtgctcgcctccggcgaccgcgaggagaggaccgccgtgttcttcagggtgtttcgcggcggcggcggccacgacgacaagcccgtggtgctcatgtgcaccgaccccaccaagtcatctctggacgcgaacctgtaccagccgacgttcgcaggttttgtcgacacagacatttcgaacgggaagatatctctcagaactctgatcgaccggtcggtggtggagagctttggaggcgggggcaggacctgcatcctgtcgagggtgtacccgtcgctcgccatcggcagcaaggctcgcctctacgtgttcaacaacgggagggcggacgtcagggtgtcccgtctcaccgcgtgggagatgaagaagccactcatgaacggcgcttgaaatgtttttattgcgtgatatggaatggtgctcgcctttgtacaatatggtatggctagatacatatatatgagagcttccacgctcggtcgtcgtgtggaaaaaacctatgatgagtgtgtacgatcttagggatgttcgattcagatgccactaggggcaataactatattctaattcatgatttc

SEQ ID NO: 954 - protein, 2085 aa, Zea mays
  misc_feature: PFam Name: Glyco_hydro_32; PFam Description: Glycosyl
  misc_feature: PFam Name: Transferase; PFam Description: Transferase family
  misc_feature: PFam Name: Cupin_1; PFam Description: Cupin
  misc_feature: GI Number: 26986190; NR Description: apoplastic invertase 1
  misc_feature: GI Number: 51971547; NR Description: beta-fructofuranosidase
  misc_feature: GI Number: 4886267; NR Description: beta-fructofuranosidase [Arabidopsis thaliana] gi|7435478|pir||T08439
  misc_feature: GI Number: 1020101; NR Description: cell wall beta-fructosidase(Inv2) [Daucus carota] >gi|2500928|sp|Q39692|INV2_DAUCA Beta-fructofuranosidase, insoluble isoenzyme 2 precursor (Sucrose-6-phosphate hydrolase 2)
  misc_feature: GI Number: 1020102; NR Description: cell wall beta-fructosidase(Inv3) [Daucus carota] gi|1362080|pir||S56680 beta-fructofuranosidase (EC 3.2.1.26) 3 precursor, cell wall - carrot gi|2500929|sp|Q39693|INV3_DAUCA Beta-fructofuranosidase,
GCACGAGACCATTACCTAGAACATCCTAATCGAAATATCCTCCCTCCATCAGTTCTCGTCCTGTTCTTTGCTACGTACGGCTCTGTGCCTAGCTAGCAATAGCATAGCAATGAGGGCGCTTGGAACGGTTGCTTGGGCATGGCTGCTGCTCCTGCAGCAGCTCGCCGGGGCCTCTCATGTCGTCTACGAGAACCTTGAGGTGGAGGCGACGACAGCCGCCGTGCGGCCCTCCATTGTCGACCCCCTGCTGAGGACCGGGTACCATTTCCAGCCTCGCAAGAACTGGATCAATGATCCCAACGCTCCACTGTACTACAAGGGGTGGTACCATCTCTTCTACCAATACAACCCGAAGGGCGCGGTGTGGGGCAACATCGTGTGGGGCCACTCGGTGTCGCGAGACCTGATCAACTGGGTGGCCCTGCAACCGGCGATCGAGCCGAGCATCCCGTCCGACAGGTACGGGTGCTGGTCTGGGTCGGCGACGACGCTGGCCGACGGCACGCCGGCGATCATGTACACGGGCGTGAACCGGCCGGACGTGAACTACCAGGTGCAGAACGTGGCGTACCCGCGGAACAGGTCGGACCCGCTGCTGCGGGAGTGGGTGAAGCCGTCGCACAACCCCATCATCGTGCCCGGGGGCGGCATCAACGCGACGCAGTTCCGGGACCCGACCACGGCCTGGCGCGGCGCGGGAGACGGCCGCTGGCGCCTGCTCATCGGCAGCGTCACCGAGGCGCGCCACGGCGTGGCGTACGTGTACCGGAGCCGCGACTTCAGGCGCTGGACGCGGGCGCGGCGGCCGCTCCACTCGGCGGCCACGGGGATGTGGGAGTGCCCCGACTTCTACCCGGTCGGCGCGCCCGGCCGGCGCGCGGGCGTCGAGACGGAGACGTCGGCGGCGTCCGACGGCGACGGCGGCTCTCCTCGTCGTCGTGAGCAGTCCAAGTACGTGCTGAAGAACAGCCTCGACCTGCGGCGGTACGACTACTACACCGTCGGCACGTACGACCGGGCGGCCGAGCGGTACGTGCCGGACGACCCCGCGGGAGACGAGCGCCACCTGCGGTACGACTACGGCAACTTCTACGCGTCCAAGACGTTCTTCGACCCCGTGAAGCGGCGGCGGGTGCTCTGGGGCTGGGCCAACGAGTCCGACACCGCCGCNGACGACGTGGCCAAAGGGTGGGCTGGGATCCAGGCGATTCCTANGACGGTGTGGCTAGACCCCAGCGGGAAGCAGCTGCTGCAGTGGCCAATCGAGGAGGTGGAGGCTCTGAGAGGCAGGTCGGTCGCTCTCAAGAACAGGGTGATCAAGCCAGGACAGCACGTCGAGGTCACCGGGATACAAACGGCACAGGCCGACGTGGAGGTGAGCTTCGAGGTGTCGAGCCTGGCGGGCGCCGAGGCGCTGCTGGACCCGGCGCTGGCCAGCGACGCGCAGCGGCTGTGCGGCGCCAGGGGCGCGGCCGTGGAGGGCGGCGTGGGCCCGTTCGGGCTGTGGGTGCTCGCCTCCGGCGACCGCGAGGAGAGGACCGCCGTGTTCTTCAGGGTGTTTCGCGGCGGCGGCGGCCACGACGACAAGCCCGTGGTGCTCATGTGCACCGACCCCACCAAGTCATCTCTGGACGCGAACCTGTACCAGCCGACGTTCGCAGGTTTTGTCGACACAGACATTTCGAACGGGAAGATATCTCTCAGAACTCTGATCGACCGGTCGGTGGTGGAGAGCTTTGGAGGCGGGGGCAGGACCTGCATCCTGTCGAGGGTGTACCCGTCGCTCGCCATCGGCAGCAAGGCTCGCCTCTACGTGTTCAACAACGGGAGGGCGGACGTCAGGGTGTCCCGTCTCACCGCGTGGGAGATGAAGAAGCCACTCATGAACGGCGCTTGAAATGTTTTTATTGCGTGATATGGAATGGTGCTCGCCTTTGTACAATATGGTATGGCTAGATACATATATATGAGAGCTTCCACGCTCGGTCGTCGTGTGGAAAAAACCTATGATGAGTGTGTACGATCTTAGGGATGTTCGATTCAGATGCCACTAGGGGCAATAACTATATTCTAATTCATGATTTC

SEQ ID NO: 955 - DNA, 1017 bp, Zea mays
  misc_feature (1)..(1017): Ceres cDNA ID no. 12382656
  misc_feature (1)..(1017): Ceres CLONE  ID no. 484808
  misc_feature (1)..(1017): Also known as  Ceres CDNA ID no. 23814893
  misc_feature (701)..(701): n is a, c, t, g, unknown, or other
  misc_feature (819)..(819): n is a, c, t, g, unknown, or other
  misc_feature (859)..(859): n is a, c, t, g, unknown, or other
atccatccatccatagatccctcacctcactcactcgtgaagaaccagagaacccacccaccctccttcatctcctacatccacatctatccaagaaggtccgttctctcctccccgctcccctcagcaataatctccgcacggcaacctcgctcctccgttttggttttcctctgtgtgccatgggcgacgccgtggagcacctcaagagcgggttccagaagttcaagaccgaggtgtatgacaagaagccggagctgttcgagcctctcaaggccggtcaggcccccaagtacatggttttcgcctgctccgactcccgcgtgtgcccgtcggtgaccctgggcctgcagcccggcgaggccttcaccgtgcgcaacatcgccgccatggtcccggcctacgacaagaccaagtacaccggcatcgggtccgccatcgagtacgccgtgtgcgccctcaaggtggaggtcctcgtggtcatcggccacagctgctgcggtggcatccgggcgctgctctccctccaggacggtgcacccgacaacttccacttcgtcgagaactgggtcaagatcggcttccctgccaaggtcaaggtgaagaaagagcacgcctccgtgcccttcgatgaccagtgctccatcctggagaaggaggccgtgaacgtgtccctggagaacctcaagacctaccccttngtccaggaagggctggccaaggggaccctcaagctggtcggcgcccactacgacttcgtgtccgggaacttcctcgtatgggaaacttagccacacccgccgctcagcgcgcggcttngtcgtcacaactcctatatcttcataaatatatatatccnctacctatatatacctaccgatatgtgaatgcgaggagtactattacctgcatgttttcagcagtatgcagctacgtacatatatatgtaccggatcgcctaacgacgtgaatgtaataagcaataatattttctaccgcttttttttatttctttcc

SEQ ID NO: 956 - protein, 1017 aa, Zea mays
  misc_feature: PFam Name: Pro_CA; PFam Description: Carbonic anhydrase
  misc_feature: GI Number: 5917783; NR Description: carbonic anhydrase 3 [Oryza sativa] >gi|7436816|pir||T03254 probable carbonate dehydratase (EC 4.2.1.1), chloroplast - rice
  misc_feature: GI Number: 34911604; NR Description: carbonic anhydrase [Oryza sativa (japonica cultivar-group)] >gi|3345477|dbj|BAA31953.1| carbonic anhydrase [Oryza sativa] >gi|15290096|dbj|BAB63789.1| carbonic anhydrase [Oryza sativa
  misc_feature: GI Number: 729003; NR Description: CARBONIC ANHYDRASE, CHLOROPLAST PRECURSOR (CARBONATE DEHYDRATASE) >gi|7436817|pir||T04478 probable carbonate dehydratase (EC 4.2.1.1)
  misc_feature: GI Number: 882248; NR Description: carbonic anhydrase 1
  misc_feature: GI Number: 882246; NR Description: carbonic anhydrase 2
ATCCATCCATCCATAGATCCCTCACCTCACTCACTCGTGAAGAACCAGAGAACCCACCCACCCTCCTTCATCTCCTACATCCACATCTATCCAAGAAGGTCCGTTCTCTCCTCCCCGCTCCCCTCAGCAATAATCTCCGCACGGCAACCTCGCTCCTCCGTTTTGGTTTTCCTCTGTGTGCCATGGGCGACGCCGTGGAGCACCTCAAGAGCGGGTTCCAGAAGTTCAAGACCGAGGTGTATGACAAGAAGCCGGAGCTGTTCGAGCCTCTCAAGGCCGGTCAGGCCCCCAAGTACATGGTTTTCGCCTGCTCCGACTCCCGCGTGTGCCCGTCGGTGACCCTGGGCCTGCAGCCCGGCGAGGCCTTCACCGTGCGCAACATCGCCGCCATGGTCCCGGCCTACGACAAGACCAAGTACACCGGCATCGGGTCCGCCATCGAGTACGCCGTGTGCGCCCTCAAGGTGGAGGTCCTCGTGGTCATCGGCCACAGCTGCTGCGGTGGCATCCGGGCGCTGCTCTCCCTCCAGGACGGTGCACCCGACAACTTCCACTTCGTCGAGAACTGGGTCAAGATCGGCTTCCCTGCCAAGGTCAAGGTGAAGAAAGAGCACGCCTCCGTGCCCTTCGATGACCAGTGCTCCATCCTGGAGAAGGAGGCCGTGAACGTGTCCCTGGAGAACCTCAAGACCTACCCCTTNGTCCAGGAAGGGCTGGCCAAGGGGACCCTCAAGCTGGTCGGCGCCCACTACGACTTCGTGTCCGGGAACTTCCTCGTATGGGAAACTTAGCCACACCCGCCGCTCAGCGCGCGGCTTNGTCGTCACAACTCCTATATCTTCATAAATATATATATCCNCTACCTATATATACCTACCGATATGTGAATGCGAGGAGTACTATTACCTGCATGTTTTCAGCAGTATGCAGCTACGTACATATATATGTACCGGATCGCCTAACGACGTGAATGTAATAAGCAATAATATTTTCTACCGCTTTTTTTTATTTCTTTCC

SEQ ID NO: 957 - DNA, 1436 bp, Zea mays
  misc_feature (1)..(1436): Ceres cDNA ID no. 12382811
  misc_feature (1)..(1436): Ceres CLONE  ID no. 369312
  misc_feature (1)..(1436): Also known as  Ceres CDNA ID no. 24396869
acgccaagcgcgcaattaaccctcactaaagggaacaaaagctggagctccaccgcggtggcggccgctctagaactagtggatcccccgggctgcaggaattcgcacgagaccattacctagaacatcctaatcgaaaaaccgggctgaggaggccatcggacgcacaaggacagcagagtgcaggaccggagcggagcgaccgagagtgtgtgggagagagatggcgtccagcgcctcgtctaccctgccgctgccaacgctctcgctcgccgtgatcctgctcgcgctgtgcgcccgcggcggcgaggccaggccgccaccgccgctccacggcgtgcgcccgctcgccttcgacgaggggtacacccagatcttcggcagcgccaacctcgcgctcctccgcgacggtaggcgcgtccgcctcacgctcgacgagtccaccggagccgggttcgcgtcgcaggacgtcttcctccacggtttcttcagcgccgccatcaagctgcccgccgactacgcggcgggcgtcgtcgtcgcgttctacctgtcgaacggcgacgtgtacgagaagacgcacgacgagctggacttcgagttcctgggcaacgtgcggggccgcgagtggcgggtgcagaccaacgtgtacggcaacggcagcaccgacgccggccgggaggagcgctacgacctcccattcgaccccaccgacgacttccaccactactccatcctctggaccagcgaccgcatcactttctacgtcgacgagaccccgatccaggaggtggtgcggacggcggccatgggcgcggcgttcccgtccaagcccatgtccctgtacgccacgatctgggacggctccgcgtgggccacgctgggcggccggtaccgcgtcaactacaagtacgcgccgttcgtggccgagttcgccgacctcgccatccagggcttcgccgtcgaccccgccgccgaccacgccgtggcgtcgtgcggcgcgggcctgggcctgggcctgggcccgggcccgctcgccgtgtccgcggagcagcgctcggccatggcggcgttccggcgcgcccacacctcctactcctactgccacgaccggcggcggtaccccgtcgcgctgtcggagtgcggggccggcgcggggctcctccccggccgcatgtttggccccgacgggatgaagcagcaccggcgccacctggggcgcggcgcgcggccaccgcggcggcgcccaggacgacgacgtcatgtgatcgccggtccctggcccctcgccacgtcgcggcggcggggcggggatggttgcacgctgtggattggattggattggattgggttgggggggttgggcggggattgtccgggatggaaaagctcgcctcattgtaccattcgcgccatggaagtaggtcgtgtttattgcc

SEQ ID NO: 958 - protein, 1436 aa, Zea mays
  misc_feature: PFam Name: Glyco_hydro_16; PFam Description: Glycosyl
  misc_feature: PFam Name: Mucin; PFam Description: Mucin-like glycoprotein
  misc_feature: PFam Name: SerH; PFam Description: Cell surface
  misc_feature: PFam Name: MAGE; PFam Description: MAGE family
  misc_feature: PFam Name: Podocalyxin; PFam Description: Podocalyxin
  misc_feature: GI Number: 21553987; NR Description: xyloglucan endo-transglycosylase, putative [Arabidopsis thaliana] >gi|2154611|dbj|BAA20290.1| endoxyloglucan transferase related protein [Arabidopsis thaliana] >gi|8778237|gb|AAF79246.1|
  misc_feature: GI Number: 31711806; NR Description: At2g01850 [Arabidopsis thaliana] >gi|2154609|dbj|BAA20289.1| endoxyloglucan transferase related protein [Arabidopsis thaliana] >gi|4522010|gb|AAD21783.1| xyloglucan endotransglycosylase >gi|38605340|sp|Q8LDS2|XT27_ARATH
  misc_feature: GI Number: 5533313; NR Description: endoxyloglucan
  misc_feature: GI Number: 21553969; NR Description: putative
  misc_feature: GI Number: 13560781; NR Description: endoxyloglucan
ACGCCAAGCGCGCAATTAACCCTCACTAAAGGGAACAAAAGCTGGAGCTCCACCGCGGTGGCGGCCGCTCTAGAACTAGTGGATCCCCCGGGCTGCAGGAATTCGCACGAGACCATTACCTAGAACATCCTAATCGAAAAACCGGGCTGAGGAGGCCATCGGACGCACAAGGACAGCAGAGTGCAGGACCGGAGCGGAGCGACCGAGAGTGTGTGGGAGAGAGATGGCGTCCAGCGCCTCGTCTACCCTGCCGCTGCCAACGCTCTCGCTCGCCGTGATCCTGCTCGCGCTGTGCGCCCGCGGCGGCGAGGCCAGGCCGCCACCGCCGCTCCACGGCGTGCGCCCGCTCGCCTTCGACGAGGGGTACACCCAGATCTTCGGCAGCGCCAACCTCGCGCTCCTCCGCGACGGTAGGCGCGTCCGCCTCACGCTCGACGAGTCCACCGGAGCCGGGTTCGCGTCGCAGGACGTCTTCCTCCACGGTTTCTTCAGCGCCGCCATCAAGCTGCCCGCCGACTACGCGGCGGGCGTCGTCGTCGCGTTCTACCTGTCGAACGGCGACGTGTACGAGAAGACGCACGACGAGCTGGACTTCGAGTTCCTGGGCAACGTGCGGGGCCGCGAGTGGCGGGTGCAGACCAACGTGTACGGCAACGGCAGCACCGACGCCGGCCGGGAGGAGCGCTACGACCTCCCATTCGACCCCACCGACGACTTCCACCACTACTCCATCCTCTGGACCAGCGACCGCATCACTTTCTACGTCGACGAGACCCCGATCCAGGAGGTGGTGCGGACGGCGGCCATGGGCGCGGCGTTCCCGTCCAAGCCCATGTCCCTGTACGCCACGATCTGGGACGGCTCCGCGTGGGCCACGCTGGGCGGCCGGTACCGCGTCAACTACAAGTACGCGCCGTTCGTGGCCGAGTTCGCCGACCTCGCCATCCAGGGCTTCGCCGTCGACCCCGCCGCCGACCACGCCGTGGCGTCGTGCGGCGCGGGCCTGGGCCTGGGCCTGGGCCCGGGCCCGCTCGCCGTGTCCGCGGAGCAGCGCTCGGCCATGGCGGCGTTCCGGCGCGCCCACACCTCCTACTCCTACTGCCACGACCGGCGGCGGTACCCCGTCGCGCTGTCGGAGTGCGGGGCCGGCGCGGGGCTCCTCCCCGGCCGCATGTTTGGCCCCGACGGGATGAAGCAGCACCGGCGCCACCTGGGGCGCGGCGCGCGGCCACCGCGGCGGCGCCCAGGACGACGACGTCATGTGATCGCCGGTCCCTGGCCCCTCGCCACGTCGCGGCGGCGGGGCGGGGATGGTTGCACGCTGTGGATTGGATTGGATTGGATTGGGTTGGGGGGGTTGGGCGGGGATTGTCCGGGATGGAAAAGCTCGCCTCATTGTACCATTCGCGCCATGGAAGTAGGTCGTGTTTATTGCC

SEQ ID NO: 959 - DNA, 1745 bp, Zea mays
  misc_feature (1)..(1745): Ceres cDNA ID no. 12383093
  misc_feature (1)..(1745): Ceres CLONE  ID no. 335638
  misc_feature (1)..(1745): Also known as  Ceres CDNA ID no. 23767235
gcaattaaccctcactaaagggaacaaaagctggagctccaccgcggtggcggccgctctagaactagtggatcccccgggctgcaggaattcgcacgagaccattacctagaacatcctaatcgaaaaatttccgcaccacgcccagtcgcccacgcagccggcccaagcccaaaaacctttctccatcctctactctcatccccacgatggccgccgccgccaccacgccgcactccctcctcctccagcgcgccgcgatcccggccgcgccgtcgagggcgtccgccgccgcctctcccgtccgcctcccggtccgcgccgccaggatctcgtgcgcggcggtggcggcgccgtccccggccgcagccgccgcggcggacgaggtggagcgcggcgtctacaacttcgcggcgggtcccgcgacgctccctctctccgtgctcaagcgggcgcaggcggagctggtggactaccacggctccgggatgagcatcatggagatgagccaccgcgggaaggagttcgacgccgccatcaagaaggccgagtccgacctgcgcgcgctcctcgcggtgcccgacacccacgccgtgctcttcctccagggcggcgccaccacgcagttcgccgccgtcccgctcaacctctgcacggggccctccgacccggccgacttcgtcgtgtccggatcctggagcgacaaggccttcaaggaggccaagaagttctccgccgcctccgtcgcctggtcgggtaaagacggcaagtacacggccctcccgccgttcgacgccatcgcccagaaccccgaggccaggttcctccacatctgctccaacgagaccatccacggcgtggagttcaaggactacccggagccccgcaacaggtcgggcatcctcgtcgccgacatgtcctccaacttctgctccaagcccgtcgacgtctcccgcttcggcgtcatctacgccggcgcacagaagaacgtcgggccctccggcgtcaccatcgccatcgtgcgcaaggacctcatcggcgccgctcagcccttcacgcccgtcatgctcgacttcaagacgcacgccgacaacgcctccctctacaacaccccgccctgcttcgccatctacgtctgcggtctcgtcttcgaggacctgctcgcgcagggcggcctcgccgaggtcgagaagaagaacgcgcgcaaggccggcgccctctacgacaccatcgacgccagcggagggtactacgtctgccccgtcgacaagtccgtgcggtcgcacatgaacgtgcccttcaccctggccaagggcccggatttcgagaagcagttcatcgccgaggcggccaaggagggcatggtgcagctcaaggggcacaggtctgtcggcggtgtccgcgcctctatctacaatgccatgccgctcgccggcgtggagaagctcgtcgccttcatgaaggacttccaagccaggaacccttgattgccttgtgcttatggtcatttggtattgctactcagtctttcttcctagcataagtgggctcgtgcaagagctgtctcgcgttgcgcactgggatctatctgtagtattagtaccataacgtaacggctactgtattttgcaatgttttttttctctctctcgcttttgttaggtgttcatggaatttcatttctatggatcaccattgcagttgtaatgtgtttttgctggaaataaggaataaggtagagatcc

SEQ ID NO: 960 - protein, 1745 aa, Zea mays
  misc_feature: PFam Name: Aminotran_5; PFam Description: Aminotransferase class-V
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: GATase_2; PFam Description: Glutamine
  misc_feature: GI Number: 50919785; NR Description: Putative phosphoserine aminotransferase [Oryza sativa (japonica cultivar-group)] >gi|21397263|gb|AAM51827.1| Putative phosphoserine aminotransferase [Oryza sativa (japonica cultivar-group)] [Oryza
  misc_feature: GI Number: 7434195; NR Description: phosphoserine aminotransferase - spinach >gi|1256204|dbj|BAA12206.1| phosphoserine aminotransferase [Spinacia oleracea] >gi|1711381|sp|P52877|SERC_SPIOL Phosphoserine aminotransferase,
  misc_feature: GI Number: 21592931; NR Description: phosphoserine
  misc_feature: GI Number: 22135922; NR Description: phosphoserine
  misc_feature: GI Number: 7270514; NR Description: phosphoserine aminotransferase [Arabidopsis thaliana] >gi|3367581|emb|CAA20033.1| phosphoserine aminotransferase [Arabidopsis thaliana] >gi|3914996|sp|Q96255|SERC_ARATH
GCAATTAACCCTCACTAAAGGGAACAAAAGCTGGAGCTCCACCGCGGTGGCGGCCGCTCTAGAACTAGTGGATCCCCCGGGCTGCAGGAATTCGCACGAGACCATTACCTAGAACATCCTAATCGAAAAATTTCCGCACCACGCCCAGTCGCCCACGCAGCCGGCCCAAGCCCAAAAACCTTTCTCCATCCTCTACTCTCATCCCCACGATGGCCGCCGCCGCCACCACGCCGCACTCCCTCCTCCTCCAGCGCGCCGCGATCCCGGCCGCGCCGTCGAGGGCGTCCGCCGCCGCCTCTCCCGTCCGCCTCCCGGTCCGCGCCGCCAGGATCTCGTGCGCGGCGGTGGCGGCGCCGTCCCCGGCCGCAGCCGCCGCGGCGGACGAGGTGGAGCGCGGCGTCTACAACTTCGCGGCGGGTCCCGCGACGCTCCCTCTCTCCGTGCTCAAGCGGGCGCAGGCGGAGCTGGTGGACTACCACGGCTCCGGGATGAGCATCATGGAGATGAGCCACCGCGGGAAGGAGTTCGACGCCGCCATCAAGAAGGCCGAGTCCGACCTGCGCGCGCTCCTCGCGGTGCCCGACACCCACGCCGTGCTCTTCCTCCAGGGCGGCGCCACCACGCAGTTCGCCGCCGTCCCGCTCAACCTCTGCACGGGGCCCTCCGACCCGGCCGACTTCGTCGTGTCCGGATCCTGGAGCGACAAGGCCTTCAAGGAGGCCAAGAAGTTCTCCGCCGCCTCCGTCGCCTGGTCGGGTAAAGACGGCAAGTACACGGCCCTCCCGCCGTTCGACGCCATCGCCCAGAACCCCGAGGCCAGGTTCCTCCACATCTGCTCCAACGAGACCATCCACGGCGTGGAGTTCAAGGACTACCCGGAGCCCCGCAACAGGTCGGGCATCCTCGTCGCCGACATGTCCTCCAACTTCTGCTCCAAGCCCGTCGACGTCTCCCGCTTCGGCGTCATCTACGCCGGCGCACAGAAGAACGTCGGGCCCTCCGGCGTCACCATCGCCATCGTGCGCAAGGACCTCATCGGCGCCGCTCAGCCCTTCACGCCCGTCATGCTCGACTTCAAGACGCACGCCGACAACGCCTCCCTCTACAACACCCCGCCCTGCTTCGCCATCTACGTCTGCGGTCTCGTCTTCGAGGACCTGCTCGCGCAGGGCGGCCTCGCCGAGGTCGAGAAGAAGAACGCGCGCAAGGCCGGCGCCCTCTACGACACCATCGACGCCAGCGGAGGGTACTACGTCTGCCCCGTCGACAAGTCCGTGCGGTCGCACATGAACGTGCCCTTCACCCTGGCCAAGGGCCCGGATTTCGAGAAGCAGTTCATCGCCGAGGCGGCCAAGGAGGGCATGGTGCAGCTCAAGGGGCACAGGTCTGTCGGCGGTGTCCGCGCCTCTATCTACAATGCCATGCCGCTCGCCGGCGTGGAGAAGCTCGTCGCCTTCATGAAGGACTTCCAAGCCAGGAACCCTTGATTGCCTTGTGCTTATGGTCATTTGGTATTGCTACTCAGTCTTTCTTCCTAGCATAAGTGGGCTCGTGCAAGAGCTGTCTCGCGTTGCGCACTGGGATCTATCTGTAGTATTAGTACCATAACGTAACGGCTACTGTATTTTGCAATGTTTTTTTTCTCTCTCTCGCTTTTGTTAGGTGTTCATGGAATTTCATTTCTATGGATCACCATTGCAGTTGTAATGTGTTTTTGCTGGAAATAAGGAATAAGGTAGAGATCC

SEQ ID NO: 961 - DNA, 1655 bp, Zea mays
  misc_feature (1)..(1655): Ceres cDNA ID no. 12383201
  misc_feature (1)..(1655): Ceres CLONE  ID no. 324649
  misc_feature (1)..(1655): Also known as  Ceres CDNA ID no. 23793868
gttttcaggtctgttggcccctagctcctcgtctgcttgccggaccgccgctttttggtgcgacttccacatcttgtcctgacggggatcgctggtttcttcctccagagatcgcatccctggtccgcgggatccgatgagatgcgtgggtactcccgcagtccgaactcgtagcaggcatggctgaagcggccgcatcttcgtcttcgtccggatcctgcgccccgcgccgcctccatggcgccggcatcgtcagggacgcgctcacgtacaatggcctcgccgcactcccgccgcctctgccgccggcgcaggtgcaggttacggcttacggcagcggcggcggcggaggaggaggaggaggaggaggagggaagattagccccgcggtgcttttcatcatcgtgattctcgcggtggttttcttcatctccggcctgctccacctcctggtgcgtgtcctcatgaagaagcagcgccgccgagggggcacggcgtcagcagcggcgcgggggtctggaggggagggcggcggggcggacgctgcgttgcagcggcagctgcagcagctgttccacctccacgactccgggctggaccaggccttcatcgacgcgctgccggtcttcgcctaccgcgagatcgtcgtgggcggcggcggcgacggggacaaggagccgttcgactgcgcggtgtgcctgtgcgagttcgatgccgaggaccggctccggttgctgccgctgtgcgggcacgccttccacctcaattgcatcgacacgtggctgctctccaactcgacctgcccgctctgccgcggggtgctcttcgtcccggggctcatgggcgaggacagcccgatgttcgatttcgaggagggcctggaggaagggcggttgtccgaggactgtgacgacggatttggattgcctgggcggaaggcttcagggttggcacagacaccggtggccgagaagaaggtattccctgtgaggttggggaagttcaagaacgtcggaacccatggtgcggtggaaggtggcaatgccaatgccaatgctaatcccagggtgttgactagggatgaaggggagagtagcagcagcaggttggatggaaggagatgcttctccatgggcacctatcagtatgttcttggcacatctgagctccgggtagctctccagcctggctgtatccggaatgacactggtggtgcaatgaggggaatgcctcctggtttaagttcaatcaatgctgatattatggaggggaagaagatctgtgcacgcaacaaaggggagagtttctccgtgtctaaaatttggcaatggtctaatcttaagggcaagctacctgctggttctgatgaatgttcggatgctgggagccttccatggatgaagaaaggaggtgctgtggatacatcgaacttatgactctctgtactggtataatgtgatagtggcctttctttagttagtgttgctcaccgaagttcttacctgtagtcatttttcttatctagttttcatgtgctgattttgattggagtgccaacctcattggggggcttaacttttggtgatcttgccatgttagtatgttgcgccatgtacattgtgatgacctagaatgatctgattctggtctgcctt

SEQ ID NO: 962 - protein, 1655 aa, Zea mays
  misc_feature: PFam Name: zf-C3HC4; PFam Description: Zinc finger, C3HC4
  misc_feature: GI Number: 51535192; NR Description: putative RING finger 1
  misc_feature: GI Number: 50912659; NR Description: putative RING finger 1 [Oryza sativa (japonica cultivar-group)] >gi|46390292|dbj|BAD15742.1| putative RING finger 1 [Oryza sativa
  misc_feature: GI Number: 10177512; NR Description: RING zinc finger protein-like [Arabidopsis thaliana] >gi|51970768|dbj|BAD44076.1| RING finger -like protein [Arabidopsis thaliana] >gi|15242616|ref|NP_198841.1| zinc finger (C3HC4-type RING
  misc_feature: GI Number: 34898398; NR Description: Similar to Arabidopsis thaliana RING-H2 finger protein RHX1a mRNA, partial cds.(AF079184) [Oryza sativa (japonica cultivar-group)] >gi|5091511|dbj|BAA78746.1| Similar to Arabidopsis [Oryza sativa
  misc_feature: GI Number: 51091716; NR Description: RING finger 1-like
GTTTTCAGGTCTGTTGGCCCCTAGCTCCTCGTCTGCTTGCCGGACCGCCGCTTTTTGGTGCGACTTCCACATCTTGTCCTGACGGGGATCGCTGGTTTCTTCCTCCAGAGATCGCATCCCTGGTCCGCGGGATCCGATGAGATGCGTGGGTACTCCCGCAGTCCGAACTCGTAGCAGGCATGGCTGAAGCGGCCGCATCTTCGTCTTCGTCCGGATCCTGCGCCCCGCGCCGCCTCCATGGCGCCGGCATCGTCAGGGACGCGCTCACGTACAATGGCCTCGCCGCACTCCCGCCGCCTCTGCCGCCGGCGCAGGTGCAGGTTACGGCTTACGGCAGCGGCGGCGGCGGAGGAGGAGGAGGAGGAGGAGGAGGGAAGATTAGCCCCGCGGTGCTTTTCATCATCGTGATTCTCGCGGTGGTTTTCTTCATCTCCGGCCTGCTCCACCTCCTGGTGCGTGTCCTCATGAAGAAGCAGCGCCGCCGAGGGGGCACGGCGTCAGCAGCGGCGCGGGGGTCTGGAGGGGAGGGCGGCGGGGCGGACGCTGCGTTGCAGCGGCAGCTGCAGCAGCTGTTCCACCTCCACGACTCCGGGCTGGACCAGGCCTTCATCGACGCGCTGCCGGTCTTCGCCTACCGCGAGATCGTCGTGGGCGGCGGCGGCGACGGGGACAAGGAGCCGTTCGACTGCGCGGTGTGCCTGTGCGAGTTCGATGCCGAGGACCGGCTCCGGTTGCTGCCGCTGTGCGGGCACGCCTTCCACCTCAATTGCATCGACACGTGGCTGCTCTCCAACTCGACCTGCCCGCTCTGCCGCGGGGTGCTCTTCGTCCCGGGGCTCATGGGCGAGGACAGCCCGATGTTCGATTTCGAGGAGGGCCTGGAGGAAGGGCGGTTGTCCGAGGACTGTGACGACGGATTTGGATTGCCTGGGCGGAAGGCTTCAGGGTTGGCACAGACACCGGTGGCCGAGAAGAAGGTATTCCCTGTGAGGTTGGGGAAGTTCAAGAACGTCGGAACCCATGGTGCGGTGGAAGGTGGCAATGCCAATGCCAATGCTAATCCCAGGGTGTTGACTAGGGATGAAGGGGAGAGTAGCAGCAGCAGGTTGGATGGAAGGAGATGCTTCTCCATGGGCACCTATCAGTATGTTCTTGGCACATCTGAGCTCCGGGTAGCTCTCCAGCCTGGCTGTATCCGGAATGACACTGGTGGTGCAATGAGGGGAATGCCTCCTGGTTTAAGTTCAATCAATGCTGATATTATGGAGGGGAAGAAGATCTGTGCACGCAACAAAGGGGAGAGTTTCTCCGTGTCTAAAATTTGGCAATGGTCTAATCTTAAGGGCAAGCTACCTGCTGGTTCTGATGAATGTTCGGATGCTGGGAGCCTTCCATGGATGAAGAAAGGAGGTGCTGTGGATACATCGAACTTATGACTCTCTGTACTGGTATAATGTGATAGTGGCCTTTCTTTAGTTAGTGTTGCTCACCGAAGTTCTTACCTGTAGTCATTTTTCTTATCTAGTTTTCATGTGCTGATTTTGATTGGAGTGCCAACCTCATTGGGGGGCTTAACTTTTGGTGATCTTGCCATGTTAGTATGTTGCGCCATGTACATTGTGATGACCTAGAATGATCTGATTCTGGTCTGCCTT

SEQ ID NO: 963 - DNA, 1410 bp, Zea mays
  misc_feature (1)..(1410): Ceres cDNA ID no. 12383255
  misc_feature (1)..(1410): Ceres CLONE  ID no. 349067
  misc_feature (1)..(1410): Also known as  Ceres CDNA ID no. 23787701
gcacgagaccattacctagaacatcctaatcgaaaaaataatctagcaacagaaaataatgcacagagaagtaatccgagtggcgatcacaccacagagcgagagtgaggagagaactctcactgagaggggagtggatggtcggacggatgacaggagaaatgggagggctcagatcgaggatcctcaggaccttgcagtccttccccaccgccgctcccgcgcagtcgcccaacctcatcctcgcgccgctccctcccggcgccggcccctcgcctcagccgcccgcggcgccgtgcgtccgcctccaggaaccggcgccgctgggcgatgaagcgcgggccgcgcccgaggtgcccggcggcggaggcgatgacgacaaggagaacgtctcgccaggcgccaccccgcgcaaggccaagaagatgaagctcagctcggaccaccacgacagaagcccgggcctcggggaggagcagcgcgccgatggcgccacgcgctaccgccggccggacctcgcctcggcgacgctcttcgacccggacctcctcgccgccttccgccgcgccgtcgacgcctacgcgcaggccctggacgcggccaggcgccgcgacgtcgacgtcgacgacggggacggcgtccctggcggcggaggtgggccgggcgtcgcggaccccctggatgcgttcgagcggcggtgcccgcccggcggcgagcgcgcggtggtgctgtacaccacgtcgatccgcggcgtgcgcaggacgttcgaggactgcgcccgcgtgcgccgcctgctcggcggcctccgcgtcgcgttcctggagcgcgacgtctccatgcacgcgccctacagggaggagctccgggcgctgcttctctgcgagcggggggaggacggcggcggcgcgttccccgtgccgccgcggctgttcgtggacggccggtacctcggcggcgccgacgaggtcgtggcgctgcacgagcggtcccagctccggcccgtgctccggcgcgcggcgtggcgcggcgcaggggagggcccgtgcgcggtctgcggcggcgcgtggttcgtggtgtgcggcgcgtgcggcggcagtcattggctccatgacgccagcgccggcgccggccgcgtgccgtgctccgcgtgcaacgagaacggactcgtgccctgccctctctgcagctaagatcgaacgcgcggggaccgggatggttttggtttgggaggcgttctcttgattatttggtcatgtcatcgctacgatccttcccatggtcgctggaacgaaggattgatctctgtccgtccatcaaattgaacagactgtatttattaagatcattgtatgtccctgtttaagctcagctctcgatgagacgatttttactatttccagccaattctcc

SEQ ID NO: 964 - protein, 1410 aa, Zea mays
  misc_feature: PFam Name: Glutaredoxin; PFam Description: Glutaredoxin
  misc_feature: PFam Name: Peptidase_S8; PFam Description: Subtilase family
  misc_feature: PFam Name: Pkinase; PFam Description: Protein kinase domain
  misc_feature: PFam Name: APC_basic; PFam Description: APC basic domain
  misc_feature: PFam Name: Mucin; PFam Description: Mucin-like glycoprotein
  misc_feature: GI Number: 53370707; NR Description: glutaredoxin domain
  misc_feature: GI Number: 34899868; NR Description: peptide transporter-like [Oryza sativa (japonica cultivar-group)] >gi|22831078|dbj|BAC15940.1| peptide transporter-like [Oryza sativa (japonica cultivar-group)] >gi|50509619|dbj|BAD31449.1|
  misc_feature: GI Number: 15810443; NR Description: putative peptide transporter protein [Arabidopsis thaliana] >gi|27754251|gb|AAO22579.1| putative peptide transporter protein [Arabidopsis thaliana] >gi|15217659|ref|NP_176631.1| glutaredoxin
  misc_feature: GI Number: 17381052; NR Description: putative peptide
  misc_feature: GI Number: 10241626; NR Description: Contains similarity to
GCACGAGACCATTACCTAGAACATCCTAATCGAAAAAATAATCTAGCAACAGAAAATAATGCACAGAGAAGTAATCCGAGTGGCGATCACACCACAGAGCGAGAGTGAGGAGAGAACTCTCACTGAGAGGGGAGTGGATGGTCGGACGGATGACAGGAGAAATGGGAGGGCTCAGATCGAGGATCCTCAGGACCTTGCAGTCCTTCCCCACCGCCGCTCCCGCGCAGTCGCCCAACCTCATCCTCGCGCCGCTCCCTCCCGGCGCCGGCCCCTCGCCTCAGCCGCCCGCGGCGCCGTGCGTCCGCCTCCAGGAACCGGCGCCGCTGGGCGATGAAGCGCGGGCCGCGCCCGAGGTGCCCGGCGGCGGAGGCGATGACGACAAGGAGAACGTCTCGCCAGGCGCCACCCCGCGCAAGGCCAAGAAGATGAAGCTCAGCTCGGACCACCACGACAGAAGCCCGGGCCTCGGGGAGGAGCAGCGCGCCGATGGCGCCACGCGCTACCGCCGGCCGGACCTCGCCTCGGCGACGCTCTTCGACCCGGACCTCCTCGCCGCCTTCCGCCGCGCCGTCGACGCCTACGCGCAGGCCCTGGACGCGGCCAGGCGCCGCGACGTCGACGTCGACGACGGGGACGGCGTCCCTGGCGGCGGAGGTGGGCCGGGCGTCGCGGACCCCCTGGATGCGTTCGAGCGGCGGTGCCCGCCCGGCGGCGAGCGCGCGGTGGTGCTGTACACCACGTCGATCCGCGGCGTGCGCAGGACGTTCGAGGACTGCGCCCGCGTGCGCCGCCTGCTCGGCGGCCTCCGCGTCGCGTTCCTGGAGCGCGACGTCTCCATGCACGCGCCCTACAGGGAGGAGCTCCGGGCGCTGCTTCTCTGCGAGCGGGGGGAGGACGGCGGCGGCGCGTTCCCCGTGCCGCCGCGGCTGTTCGTGGACGGCCGGTACCTCGGCGGCGCCGACGAGGTCGTGGCGCTGCACGAGCGGTCCCAGCTCCGGCCCGTGCTCCGGCGCGCGGCGTGGCGCGGCGCAGGGGAGGGCCCGTGCGCGGTCTGCGGCGGCGCGTGGTTCGTGGTGTGCGGCGCGTGCGGCGGCAGTCATTGGCTCCATGACGCCAGCGCCGGCGCCGGCCGCGTGCCGTGCTCCGCGTGCAACGAGAACGGACTCGTGCCCTGCCCTCTCTGCAGCTAAGATCGAACGCGCGGGGACCGGGATGGTTTTGGTTTGGGAGGCGTTCTCTTGATTATTTGGTCATGTCATCGCTACGATCCTTCCCATGGTCGCTGGAACGAAGGATTGATCTCTGTCCGTCCATCAAATTGAACAGACTGTATTTATTAAGATCATTGTATGTCCCTGTTTAAGCTCAGCTCTCGATGAGACGATTTTTACTATTTCCAGCCAATTCTCC

SEQ ID NO: 965 - DNA, 1252 bp, Zea mays
  misc_feature (1)..(1252): Ceres cDNA ID no. 12383283
  misc_feature (1)..(1252): Ceres CLONE  ID no. 370089
  misc_feature (1)..(1252): Also known as  Ceres CDNA ID no. 23793567
gcacgagaccattacctagaacatcctaatcaaaaaaatctggttcgggctcctggatcggacccgaaaaactggtgagatttgacctacagcggagatggccaccggcgacctgcgcagcctcgccaccgtcgcggccgcggtgatcgcgtgcatgggctacgcccgcttcgccgcgcggcgactccgcccgggcctgtcccgccttgcagcgttcctcccggtgctcgccgtcttgcctttcctcccgctcgccttccgtgcgctccacccgcgcggcatctccggcttcttcctcgcctgggccgccgaattcaaactcctgctcctcgcatgcggccagcgcccgctcgatccgagcctcccgctgccctccttcaccgccatcgccaccttccccgtcacactacgggatcccaagagctccgcctcgaggccgggcctggggctcgtggagtccgcctccatggccgcgctgctcgcggccatcgtgtcgctgtactggtacgaggagcggatgaacggttacgtcctgctcacgctctactccgtgcacgtgtacctcgcgctcgagctcgtcctggcggcggccgcggtggcgtcgcgcgcgctgatgggcctggaactggagccccagttcgaccggccctacctctcgtcctcgctgcgggacttctggggccggaggtggaacctctccgttccggcgctgctccgccagtgcgtgttccgccccgtgcgcgcgcgcctcggcgccgccgcgggtgtgctagctgcgttcgtcgtctcgggcctcatgcacgaggccatgttctcctacctcacgctgctgcggccgacgggggaggcggccgcgttcttcacgctgcacggggcgtgcgcggtggcggaggggtggtgggccgcgcacgaggggtggccgcggccgccgcgcgccatggccacgccgctgacactggcgttcgtgggcgtgacggccttctggctcttctttcctccgctcacaaggcccggcgcggacaagcaggccatcgcggagtgcgaggccatggtcgcttttctgcgggacaccgcagcttgggcggtcgactccgcctggtcagtcttgtcaagctggtcgtaaattgtggtccgccgtccgcaacaggcgtgcgctgcgcctgcgcctgcgcctgcgcgtgccgtgtgctttgtcgccgtggcatctgtttgcacttttgttttgggatggtgataatttcagaaatattct

SEQ ID NO: 966 - protein, 1252 aa, Zea mays
  misc_feature: PFam Name: MBOAT; PFam Description: MBOAT family
  misc_feature: PFam Name: Keratin_B2; PFam Description: Keratin, high
  misc_feature: PFam Name: Pyr_redox_2; PFam Description: Pyridine
  misc_feature: GI Number: 50907895; NR Description: putative wax synthase [Oryza sativa (japonica cultivar-group)] >gi|47497822|dbj|BAD19919.1| putative wax synthase [Oryza sativa
  misc_feature: GI Number: 50938097; NR Description: putative wax synthase isoform protein [Oryza sativa (japonica cultivar-group)] >gi|28812087|dbj|BAC65039.1| putative wax synthase isoform protein [Oryza sativa (japonica cultivar-group)] [Oryza sativa
  misc_feature: GI Number: 38347115; NR Description: OSJNBa0009K15.12 [Oryza
  misc_feature: GI Number: 58532043; NR Description: OSJNBa0009K15.16 [Oryza
  misc_feature: GI Number: 27728716; NR Description: wax synthase isoform 2
GCACGAGACCATTACCTAGAACATCCTAATCAAAAAAATCTGGTTCGGGCTCCTGGATCGGACCCGAAAAACTGGTGAGATTTGACCTACAGCGGAGATGGCCACCGGCGACCTGCGCAGCCTCGCCACCGTCGCGGCCGCGGTGATCGCGTGCATGGGCTACGCCCGCTTCGCCGCGCGGCGACTCCGCCCGGGCCTGTCCCGCCTTGCAGCGTTCCTCCCGGTGCTCGCCGTCTTGCCTTTCCTCCCGCTCGCCTTCCGTGCGCTCCACCCGCGCGGCATCTCCGGCTTCTTCCTCGCCTGGGCCGCCGAATTCAAACTCCTGCTCCTCGCATGCGGCCAGCGCCCGCTCGATCCGAGCCTCCCGCTGCCCTCCTTCACCGCCATCGCCACCTTCCCCGTCACACTACGGGATCCCAAGAGCTCCGCCTCGAGGCCGGGCCTGGGGCTCGTGGAGTCCGCCTCCATGGCCGCGCTGCTCGCGGCCATCGTGTCGCTGTACTGGTACGAGGAGCGGATGAACGGTTACGTCCTGCTCACGCTCTACTCCGTGCACGTGTACCTCGCGCTCGAGCTCGTCCTGGCGGCGGCCGCGGTGGCGTCGCGCGCGCTGATGGGCCTGGAACTGGAGCCCCAGTTCGACCGGCCCTACCTCTCGTCCTCGCTGCGGGACTTCTGGGGCCGGAGGTGGAACCTCTCCGTTCCGGCGCTGCTCCGCCAGTGCGTGTTCCGCCCCGTGCGCGCGCGCCTCGGCGCCGCCGCGGGTGTGCTAGCTGCGTTCGTCGTCTCGGGCCTCATGCACGAGGCCATGTTCTCCTACCTCACGCTGCTGCGGCCGACGGGGGAGGCGGCCGCGTTCTTCACGCTGCACGGGGCGTGCGCGGTGGCGGAGGGGTGGTGGGCCGCGCACGAGGGGTGGCCGCGGCCGCCGCGCGCCATGGCCACGCCGCTGACACTGGCGTTCGTGGGCGTGACGGCCTTCTGGCTCTTCTTTCCTCCGCTCACAAGGCCCGGCGCGGACAAGCAGGCCATCGCGGAGTGCGAGGCCATGGTCGCTTTTCTGCGGGACACCGCAGCTTGGGCGGTCGACTCCGCCTGGTCAGTCTTGTCAAGCTGGTCGTAAATTGTGGTCCGCCGTCCGCAACAGGCGTGCGCTGCGCCTGCGCCTGCGCCTGCGCGTGCCGTGTGCTTTGTCGCCGTGGCATCTGTTTGCACTTTTGTTTTGGGATGGTGATAATTTCAGAAATATTCT

SEQ ID NO: 967 - DNA, 1721 bp, Zea mays
  misc_feature (1)..(1721): Ceres cDNA ID no. 12383403
  misc_feature (1)..(1721): Ceres CLONE  ID no. 347099
  misc_feature (1)..(1721): Also known as  Ceres CDNA ID no. 23789234
cgccaagcccgcaattaaccctcactaaagggaacaaaagctggagctccaccgcggtggcggccgctctagaactagtggatcccccgggctgcaggaattcgcacgagaccattacctagaacatcctaatcgaaaaattattaccatgggagaagagaagcaacgtcgggatggccatggcggaaagaacaagtacgccgtggcgtgctccattattggctccatcatctccattctcatgggctatgacacgggcgtcatgaccggcgcgatgctgttcatcaaggaggacctcaagaccaacgacacgcaggtccaggtcctcgccggcatcctcaacgtctgcgcccttgtcggctccctcacggccggccgcgtctccgactgggtcggcccccgccgcaccatctccctcgcggcctgcatcttcctcgcggggtcagtcctcatgggcctctcgcccaacttcggtacgctcctggcaggacgctgcgtggccggcgtcggcgtcggatacgcgctcatgatcgcgcccgtctacgcggccgagatttcgtccgcccacatccgcggctccgtcacctcgctgcccgagatctgcatcagcttcggcatcctgattgggtacgtggccaactacctgctagctaagctcccgctggtctacggctggcgcgccatgctggggctcggcgcgctgccgagcgccgtgctcgcagtcgccgtgctcgcgatgccggagtcgccccggtggctcgtcatgcagggccgcgtcgagcaggcccacgccgtgctcaggcgcgtgtccgacactgcaggcgaggccgatgtgcgcctcgcggaaatcaagaccgcggcggggctggcagacgacgatgacggctcaccgagaggtgtcggcaagggcgtgtggaaggagatgttcctgcacccgacgccccccgtccggcgtatcctcgtcgctgccttcggagtccacttcttccagcatctcacgggaatcgaagccgtggtcctctacagcccacgcatctttaaggcagccggcatcgccacccgcagcgagatccttgcagcgaccatcggcgtgggcgtcaccaagacggtgttcatcatgacagccatcctgctggtggaccgcatcggccggaggccgctctacctctcgagcctggcgggcatcatcgcctcgcttgcctgcctcggtcttggcctcaccgtcgtggagcgctcggtgccgcgccactcgccgacgtgggctatggcattgtccatcgcaacggtcttcaccttcatagcgtccttctccatcggtgtggggcccatcacgtgggcgtacagcaccgaggtgtacccgctccggctgcgcgcgcagggcgccagcgtcggcgtggccatcaaccgtgtcatgaacgccggggtctctatgacgttcgtgtcgctgtacaatgcggtgaccatcggcggtgcctttttcctgttcgcagggctggccgtgttggcggccatgttcttctacttcctctgcccggagacgcaaggacggccactggaggagatcgaagaggtgttcggccgtgggtggcgcgcgcgcctcctgtcatgggacgaagctgttgtggagcttccaatgtccaacaccaccgacggcaacaccaaggcgcgcccgtgatgcaaatgcgattgcaaaaattatggatagacattcatatatggtc

SEQ ID NO: 968 - protein, 1721 aa, Zea mays
  misc_feature: PFam Name: Sugar_tr; PFam Description: Sugar (and other)
  misc_feature: PFam Name: MFS_1; PFam Description: Major Facilitator Superfamily
  misc_feature: GI Number: 13129489; NR Description: Putative sugar
  misc_feature: GI Number: 30025133; NR Description: putative sorbitol
  misc_feature: GI Number: 20197812; NR Description: putative sugar transporter [Arabidopsis thaliana] >gi|4218010|gb|AAD12218.1| putative sugar transporter [Arabidopsis thaliana] >gi|15224183|ref|NP_179438.1| mannitol transporter, sugar
  misc_feature: GI Number: 16118827; NR Description: putative sugar
  misc_feature: GI Number: 29691878; NR Description: sorbitol transporter
CGCCAAGCCCGCAATTAACCCTCACTAAAGGGAACAAAAGCTGGAGCTCCACCGCGGTGGCGGCCGCTCTAGAACTAGTGGATCCCCCGGGCTGCAGGAATTCGCACGAGACCATTACCTAGAACATCCTAATCGAAAAATTATTACCATGGGAGAAGAGAAGCAACGTCGGGATGGCCATGGCGGAAAGAACAAGTACGCCGTGGCGTGCTCCATTATTGGCTCCATCATCTCCATTCTCATGGGCTATGACACGGGCGTCATGACCGGCGCGATGCTGTTCATCAAGGAGGACCTCAAGACCAACGACACGCAGGTCCAGGTCCTCGCCGGCATCCTCAACGTCTGCGCCCTTGTCGGCTCCCTCACGGCCGGCCGCGTCTCCGACTGGGTCGGCCCCCGCCGCACCATCTCCCTCGCGGCCTGCATCTTCCTCGCGGGGTCAGTCCTCATGGGCCTCTCGCCCAACTTCGGTACGCTCCTGGCAGGACGCTGCGTGGCCGGCGTCGGCGTCGGATACGCGCTCATGATCGCGCCCGTCTACGCGGCCGAGATTTCGTCCGCCCACATCCGCGGCTCCGTCACCTCGCTGCCCGAGATCTGCATCAGCTTCGGCATCCTGATTGGGTACGTGGCCAACTACCTGCTAGCTAAGCTCCCGCTGGTCTACGGCTGGCGCGCCATGCTGGGGCTCGGCGCGCTGCCGAGCGCCGTGCTCGCAGTCGCCGTGCTCGCGATGCCGGAGTCGCCCCGGTGGCTCGTCATGCAGGGCCGCGTCGAGCAGGCCCACGCCGTGCTCAGGCGCGTGTCCGACACTGCAGGCGAGGCCGATGTGCGCCTCGCGGAAATCAAGACCGCGGCGGGGCTGGCAGACGACGATGACGGCTCACCGAGAGGTGTCGGCAAGGGCGTGTGGAAGGAGATGTTCCTGCACCCGACGCCCCCCGTCCGGCGTATCCTCGTCGCTGCCTTCGGAGTCCACTTCTTCCAGCATCTCACGGGAATCGAAGCCGTGGTCCTCTACAGCCCACGCATCTTTAAGGCAGCCGGCATCGCCACCCGCAGCGAGATCCTTGCAGCGACCATCGGCGTGGGCGTCACCAAGACGGTGTTCATCATGACAGCCATCCTGCTGGTGGACCGCATCGGCCGGAGGCCGCTCTACCTCTCGAGCCTGGCGGGCATCATCGCCTCGCTTGCCTGCCTCGGTCTTGGCCTCACCGTCGTGGAGCGCTCGGTGCCGCGCCACTCGCCGACGTGGGCTATGGCATTGTCCATCGCAACGGTCTTCACCTTCATAGCGTCCTTCTCCATCGGTGTGGGGCCCATCACGTGGGCGTACAGCACCGAGGTGTACCCGCTCCGGCTGCGCGCGCAGGGCGCCAGCGTCGGCGTGGCCATCAACCGTGTCATGAACGCCGGGGTCTCTATGACGTTCGTGTCGCTGTACAATGCGGTGACCATCGGCGGTGCCTTTTTCCTGTTCGCAGGGCTGGCCGTGTTGGCGGCCATGTTCTTCTACTTCCTCTGCCCGGAGACGCAAGGACGGCCACTGGAGGAGATCGAAGAGGTGTTCGGCCGTGGGTGGCGCGCGCGCCTCCTGTCATGGGACGAAGCTGTTGTGGAGCTTCCAATGTCCAACACCACCGACGGCAACACCAAGGCGCGCCCGTGATGCAAATGCGATTGCAAAAATTATGGATAGACATTCATATATGGTC

SEQ ID NO: 969 - DNA, 1298 bp, Zea mays
  misc_feature (1)..(1298): Ceres cDNA ID no. 12384330
  misc_feature (1)..(1298): Ceres CLONE  ID no. 391021
  misc_feature (1)..(1298): Also known as  Ceres CDNA ID no. 23808374
gcacgagaccattacctagaacatcctaatcaaaaatctcattctacagggaagacgaaaacacactgcagctggagcagcactgatatcgaccatggctccagcagcacctgcatctgcgacaaaatgcagcagcggcatcgtcatctctgtgctcttgcccctcgcgctgctaatggcggccgccggcacctcgtcggcgcagctgtccacgggcttctactcttcctcgtgtcccggcgtgtacgacgccgtcaagtcggtggtgcagtccgccgtcgccagcgagcagcgcatgggcgcctccatcgtccgcctcttcttccacgactgcttcgtccagggctgcgacgcgtcgctgctgctggacgacacgcctagcttccagggagagaagatggccaaccctaacaacggctccgtgaggggattcgaggtcatcgacgccgtcaagtccgccgtcgagaaggtgtgccccggcgtcgtctcctgcgccgacatcctcgccatcgccgccagggacagcgtcgtcatcctgggtggtccgacctgggacgtgaaggtcgggcggcgggactccacgacggcgagcttcagcggcgccaacaacaacatcccgccgccgacgtcgggcctcgccaacctcacgtcgctcttcgccgcccaaggcctctcccaaaaggacatggtcgcgctctccggagctcacaccatcggccaagcacgctgcaccaacttcagagcccacgtgtacaacgacaccaacatcgacggcagcttcgcaagaacaaggcagtcaggctgccctagatcgtcctcaggctcatcaggcgacaacaacctggcgccattggaccttcaaaccccgaccgtcttcgacaacaactactacaagaaccttgtctgcaagaaggggctcctgcactccgaccaggagctcttcaatggcggagccaccgacgcgctggtccagtcctacgccagtggccagagcgagttcttctcggactttgtgacgggcatggtgaagatgggtgacatcactccgttaactggctcccggtgggcagattaggaagaactgcagaagggtcaattaattaaccaattaataacaaggtcggccggcggtgcacactatctaacagggggcttgctttcagtcgttaattaagtttgtaatctttctacttcgtccacaaaattgtgagatcatcatgcatgttgtaccagccaaccaaggtgttgagacgatgttgttcgtcgtttgaataagtaatccatcatttgttcttctt

SEQ ID NO: 970 - protein, 1298 aa, Zea mays
  misc_feature: PFam Name: peroxidase; PFam Description: Peroxidase
  misc_feature: PFam Name: Podocalyxin; PFam Description: Podocalyxin
  misc_feature: PFam Name: Cation_efflux; PFam Description: Cation efflux family
  misc_feature: GI Number: 55701127; NR Description: TPA: class III
  misc_feature: GI Number: 55701137; NR Description: TPA: class III
  misc_feature: GI Number: 28400798; NR Description: peroxidase [Asparagus
  misc_feature: GI Number: 28400794; NR Description: peroxidase [Asparagus
  misc_feature: GI Number: 5381253; NR Description: peroxidase [Nicotiana tabacum]
GCACGAGACCATTACCTAGAACATCCTAATCAAAAATCTCATTCTACAGGGAAGACGAAAACACACTGCAGCTGGAGCAGCACTGATATCGACCATGGCTCCAGCAGCACCTGCATCTGCGACAAAATGCAGCAGCGGCATCGTCATCTCTGTGCTCTTGCCCCTCGCGCTGCTAATGGCGGCCGCCGGCACCTCGTCGGCGCAGCTGTCCACGGGCTTCTACTCTTCCTCGTGTCCCGGCGTGTACGACGCCGTCAAGTCGGTGGTGCAGTCCGCCGTCGCCAGCGAGCAGCGCATGGGCGCCTCCATCGTCCGCCTCTTCTTCCACGACTGCTTCGTCCAGGGCTGCGACGCGTCGCTGCTGCTGGACGACACGCCTAGCTTCCAGGGAGAGAAGATGGCCAACCCTAACAACGGCTCCGTGAGGGGATTCGAGGTCATCGACGCCGTCAAGTCCGCCGTCGAGAAGGTGTGCCCCGGCGTCGTCTCCTGCGCCGACATCCTCGCCATCGCCGCCAGGGACAGCGTCGTCATCCTGGGTGGTCCGACCTGGGACGTGAAGGTCGGGCGGCGGGACTCCACGACGGCGAGCTTCAGCGGCGCCAACAACAACATCCCGCCGCCGACGTCGGGCCTCGCCAACCTCACGTCGCTCTTCGCCGCCCAAGGCCTCTCCCAAAAGGACATGGTCGCGCTCTCCGGAGCTCACACCATCGGCCAAGCACGCTGCACCAACTTCAGAGCCCACGTGTACAACGACACCAACATCGACGGCAGCTTCGCAAGAACAAGGCAGTCAGGCTGCCCTAGATCGTCCTCAGGCTCATCAGGCGACAACAACCTGGCGCCATTGGACCTTCAAACCCCGACCGTCTTCGACAACAACTACTACAAGAACCTTGTCTGCAAGAAGGGGCTCCTGCACTCCGACCAGGAGCTCTTCAATGGCGGAGCCACCGACGCGCTGGTCCAGTCCTACGCCAGTGGCCAGAGCGAGTTCTTCTCGGACTTTGTGACGGGCATGGTGAAGATGGGTGACATCACTCCGTTAACTGGCTCCCGGTGGGCAGATTAGGAAGAACTGCAGAAGGGTCAATTAATTAACCAATTAATAACAAGGTCGGCCGGCGGTGCACACTATCTAACAGGGGGCTTGCTTTCAGTCGTTAATTAAGTTTGTAATCTTTCTACTTCGTCCACAAAATTGTGAGATCATCATGCATGTTGTACCAGCCAACCAAGGTGTTGAGACGATGTTGTTCGTCGTTTGAATAAGTAATCCATCATTTGTTCTTCTT

SEQ ID NO: 971 - DNA, 1476 bp, Arabidopsis thaliana
  misc_feature (1)..(1476): Ceres cDNA ID no. 12384697
  misc_feature (1)..(1476): Ceres CLONE  ID no. 3035
  misc_feature (1)..(1476): Also known as  Ceres CDNA ID no. 23380404
aattgaaatcatttcgttgtgttttagaacaacaacaaaaaaacagtgccctttcgctcacgctttgagtcgtatctgctctcttcttaatccgccgtctctcactttttcgccggcgtggttagatcgtacaaagctcagagagaatgttgggaatcttgaggcaaagagccatcgatggagcttcgactcttaggaggacgcgattcgcattggtttctgctaggagctatgcagctggtgcaaaagagatgacagtcagagatgctctaaattctgcaattgatgaggaaatgtctgctgatcctaaagtatttgtcatgggtgaagaggttggccaatatcaaggtgcctacaagatcactaaaggccttttggagaaatatggtcctgagagagtttacgatacccctattactgaggctggatttactggaattggagttggtgctgcctatgctggcttaaagcccgttgtagaatttatgacgtttaacttctctatgcaggcaattgatcatatcatcaattccgctgcaaagtcaaattacatgtctgctggacagataaatgtacccatcgtctttagaggacccaatggtgctgctgctggtgttggagctcaacattctcagtgctatgcagcgtggtatgcctcagttcctggtttgaaagtccttgctccgtattcagctgaagatgctcgtggtcttcttaaagctgccattagagaccctgaccctgttgtcttccttgaaaacgagttactatatggtgaatcattccctatttcagaagaagcccttgattcaagtttctgtcttcccataggcaaagccaagattgaacgagaaggaaaggacgtaacgatagtaactttctcgaagatggtcggtttcgccctcaaggcagctgagaagctcgcagaagagggaataagtgctgaggtaataaatcttcgatcaatccgtccgcttgaccgagccaccatcaatgcttcagtgaggaaaacgagtagattggtaacagttgaagaaggtttcccacaacatggagtctgtgcagaaatttgtgcgtcggttgtagaagagagcttttcgtacttggatgcaccggtcgagaggattgcaggagctgatgttccaatgccgtatgcagctaacctagagagattggctcttcctcagatagaggacatcgttcgtgcatcaaagagagcttgttacagatcgaaataaaatcgtcaacatcaacacatttcttctttgatctttaaagggaaaggaaaataagaaaaaaggagaaaaatgatctctctgtctctcacttttgctataagaaaccaccattcctcgtgatttatttcatcttttgctattattctttactgcagcggttttcgtttttctttttgtcccttcccaaattgataattctaatctttggggttaattgataaaaattgatcgagaatgc

SEQ ID NO: 972 - protein, 1476 aa, Arabidopsis thaliana
  misc_feature: PFam Name: Transket_pyr; PFam Description: Transketolase,
  misc_feature: PFam Name: Transketolase_C; PFam Description: Transketolase,
  misc_feature: GI Number: 23507745; NR Description: At5g50850/K16E14_1 [Arabidopsis thaliana] >gi|8953766|dbj|BAA98121.1| pyruvate dehydrogenase E1 component beta subunit, mitochondrial precursor (PDHE1-B) [Arabidopsis thaliana] >gi|17979466|gb|AAL50070.1|
  misc_feature: GI Number: 520478; NR Description: pyruvate dehydrogenase E1
  misc_feature: GI Number: 3850999; NR Description: pyruvate dehydrogenase E1
  misc_feature: GI Number: 3851001; NR Description: pyruvate dehydrogenase E1
  misc_feature: GI Number: 3851003; NR Description: pyruvate dehydrogenase E1
AATTGAAATCATTTCGTTGTGTTTTAGAACAACAACAAAAAAACAGTGCCCTTTCGCTCACGCTTTGAGTCGTATCTGCTCTCTTCTTAATCCGCCGTCTCTCACTTTTTCGCCGGCGTGGTTAGATCGTACAAAGCTCAGAGAGAATGTTGGGAATCTTGAGGCAAAGAGCCATCGATGGAGCTTCGACTCTTAGGAGGACGCGATTCGCATTGGTTTCTGCTAGGAGCTATGCAGCTGGTGCAAAAGAGATGACAGTCAGAGATGCTCTAAATTCTGCAATTGATGAGGAAATGTCTGCTGATCCTAAAGTATTTGTCATGGGTGAAGAGGTTGGCCAATATCAAGGTGCCTACAAGATCACTAAAGGCCTTTTGGAGAAATATGGTCCTGAGAGAGTTTACGATACCCCTATTACTGAGGCTGGATTTACTGGAATTGGAGTTGGTGCTGCCTATGCTGGCTTAAAGCCCGTTGTAGAATTTATGACGTTTAACTTCTCTATGCAGGCAATTGATCATATCATCAATTCCGCTGCAAAGTCAAATTACATGTCTGCTGGACAGATAAATGTACCCATCGTCTTTAGAGGACCCAATGGTGCTGCTGCTGGTGTTGGAGCTCAACATTCTCAGTGCTATGCAGCGTGGTATGCCTCAGTTCCTGGTTTGAAAGTCCTTGCTCCGTATTCAGCTGAAGATGCTCGTGGTCTTCTTAAAGCTGCCATTAGAGACCCTGACCCTGTTGTCTTCCTTGAAAACGAGTTACTATATGGTGAATCATTCCCTATTTCAGAAGAAGCCCTTGATTCAAGTTTCTGTCTTCCCATAGGCAAAGCCAAGATTGAACGAGAAGGAAAGGACGTAACGATAGTAACTTTCTCGAAGATGGTCGGTTTCGCCCTCAAGGCAGCTGAGAAGCTCGCAGAAGAGGGAATAAGTGCTGAGGTAATAAATCTTCGATCAATCCGTCCGCTTGACCGAGCCACCATCAATGCTTCAGTGAGGAAAACGAGTAGATTGGTAACAGTTGAAGAAGGTTTCCCACAACATGGAGTCTGTGCAGAAATTTGTGCGTCGGTTGTAGAAGAGAGCTTTTCGTACTTGGATGCACCGGTCGAGAGGATTGCAGGAGCTGATGTTCCAATGCCGTATGCAGCTAACCTAGAGAGATTGGCTCTTCCTCAGATAGAGGACATCGTTCGTGCATCAAAGAGAGCTTGTTACAGATCGAAATAAAATCGTCAACATCAACACATTTCTTCTTTGATCTTTAAAGGGAAAGGAAAATAAGAAAAAAGGAGAAAAATGATCTCTCTGTCTCTCACTTTTGCTATAAGAAACCACCATTCCTCGTGATTTATTTCATCTTTTGCTATTATTCTTTACTGCAGCGGTTTTCGTTTTTCTTTTTGTCCCTTCCCAAATTGATAATTCTAATCTTTGGGGTTAATTGATAAAAATTGATCGAGAATGC

SEQ ID NO: 973 - DNA, 1359 bp, Arabidopsis thaliana
  misc_feature (1)..(1359): Ceres cDNA ID no. 12384828
  misc_feature (1)..(1359): Ceres CLONE  ID no. 18876
  misc_feature (1)..(1359): Also known as  Ceres CDNA ID no. 23380529
atattcactctctcttcttcattagcctttcgtctccttcttctcttctctatctctctttagcttctctacgcaagcttattatctctttctcttaaagctttttctatatacaaacagaagcgtttgatactgtaaaaaagatttagaaatggagactctgagtcgtttattggttttcatgtctctgttttccggtttagtttctggatttgctctgcaaaatcttccaatcacatcttttgaagaaagttacactcaactttttggtgacaagaacttatttgttcatcaagatggcaaatctgtccggttaacgctcgatgaaagaaccggttccggttttgtttcaaatgattattacttgcatggattcttcagtgcttcaattaaattaccttctgattatacagctggagttgttgttgccttttatatgtctaatggagatatgtatgagaagaatcatgatgagatagattttgagtttcttggtaacattagagaaaaagaatggagagttcagacaaacatttacggtaatggaagtactcattcaggaagagaagagagatataatctctggtttgatcctactgaagattttcatcaatacagtatcctctggtctgattctcacatcatattctttgtagacaatgttcctattagagaggtcaaacgtactgcggaaatgggtggtcactttccatcaaagccgatgtctctctacacaacaatatgggacggttctaaatgggcaactaacggtggaaagtacggtgtaaactacaaatatgcgccttacattgcgcggttctcggatctagtcctgcacggctgccccgtggaccctatcgagcagtttccgaggtgcgatgaaggcgcggctgaggatatgcgtgcggcgcaagagattactccttcacaaaggagtaaaatggatgttttcagacggagactcatgacatattcatattgctatgatcgggctaggtacaatgttgctttatcggagtgtgtggtgaatcccgctgaggctcaaaggcttagggtttatgatccggtcagatttggcggcattccgaggcgccaccgcaatggaaagcaccggagcaagagaagccgggttgatggaaccgagtcgatatgataacatatataggcaaaatagtatgggtgagatttgggggttctataataagtccattattttggttatttatgattcaatgcattttcacatatagaggaggcatttttgtcatttgttagttgtatatcattataagaaaagaaaaaataattaatttatttatttgtgatattttttttatatatgataaattgtttcttgct

SEQ ID NO: 974 - protein, 1359 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 31711806; NR Description: At2g01850 [Arabidopsis thaliana] >gi|2154609|dbj|BAA20289.1| endoxyloglucan transferase related protein [Arabidopsis thaliana] >gi|4522010|gb|AAD21783.1| xyloglucan endotransglycosylase >gi|38605340|sp|Q8LDS2|XT27_ARATH
  misc_feature: GI Number: 5533313; NR Description: endoxyloglucan
  misc_feature: GI Number: 21553969; NR Description: putative
  misc_feature: GI Number: 21553987; NR Description: xyloglucan endo-transglycosylase, putative [Arabidopsis thaliana] >gi|2154611|dbj|BAA20290.1| endoxyloglucan transferase related protein [Arabidopsis thaliana] >gi|8778237|gb|AAF79246.1|
  misc_feature: GI Number: 6681351; NR Description: ETAG-A3 [Lycopersicon
ATATTCACTCTCTCTTCTTCATTAGCCTTTCGTCTCCTTCTTCTCTTCTCTATCTCTCTTTAGCTTCTCTACGCAAGCTTATTATCTCTTTCTCTTAAAGCTTTTTCTATATACAAACAGAAGCGTTTGATACTGTAAAAAAGATTTAGAAATGGAGACTCTGAGTCGTTTATTGGTTTTCATGTCTCTGTTTTCCGGTTTAGTTTCTGGATTTGCTCTGCAAAATCTTCCAATCACATCTTTTGAAGAAAGTTACACTCAACTTTTTGGTGACAAGAACTTATTTGTTCATCAAGATGGCAAATCTGTCCGGTTAACGCTCGATGAAAGAACCGGTTCCGGTTTTGTTTCAAATGATTATTACTTGCATGGATTCTTCAGTGCTTCAATTAAATTACCTTCTGATTATACAGCTGGAGTTGTTGTTGCCTTTTATATGTCTAATGGAGATATGTATGAGAAGAATCATGATGAGATAGATTTTGAGTTTCTTGGTAACATTAGAGAAAAAGAATGGAGAGTTCAGACAAACATTTACGGTAATGGAAGTACTCATTCAGGAAGAGAAGAGAGATATAATCTCTGGTTTGATCCTACTGAAGATTTTCATCAATACAGTATCCTCTGGTCTGATTCTCACATCATATTCTTTGTAGACAATGTTCCTATTAGAGAGGTCAAACGTACTGCGGAAATGGGTGGTCACTTTCCATCAAAGCCGATGTCTCTCTACACAACAATATGGGACGGTTCTAAATGGGCAACTAACGGTGGAAAGTACGGTGTAAACTACAAATATGCGCCTTACATTGCGCGGTTCTCGGATCTAGTCCTGCACGGCTGCCCCGTGGACCCTATCGAGCAGTTTCCGAGGTGCGATGAAGGCGCGGCTGAGGATATGCGTGCGGCGCAAGAGATTACTCCTTCACAAAGGAGTAAAATGGATGTTTTCAGACGGAGACTCATGACATATTCATATTGCTATGATCGGGCTAGGTACAATGTTGCTTTATCGGAGTGTGTGGTGAATCCCGCTGAGGCTCAAAGGCTTAGGGTTTATGATCCGGTCAGATTTGGCGGCATTCCGAGGCGCCACCGCAATGGAAAGCACCGGAGCAAGAGAAGCCGGGTTGATGGAACCGAGTCGATATGATAACATATATAGGCAAAATAGTATGGGTGAGATTTGGGGGTTCTATAATAAGTCCATTATTTTGGTTATTTATGATTCAATGCATTTTCACATATAGAGGAGGCATTTTTGTCATTTGTTAGTTGTATATCATTATAAGAAAAGAAAAAATAATTAATTTATTTATTTGTGATATTTTTTTTATATATGATAAATTGTTTCTTGCT

SEQ ID NO: 975 - DNA, 838 bp, Arabidopsis thaliana
  misc_feature (1)..(838): Ceres cDNA ID no. 12385195
  misc_feature (1)..(838): Ceres CLONE  ID no. 154050
  misc_feature (1)..(838): Also known as  Ceres CDNA ID no. 23380829
aaagcaaaattaataaattatcgtcttgacgaaaaatcgtagaggaaaaaaaatccccaaattgtgtgaccggaattagggtttcgacaatgtcgtccgggaagccaaagcaaggcgacacacgattggtggttgctgccactacggcgtcggcattgatggaagcgaagaaggctgatcacggaggatcttcgtctatcgttgagtataaaccgccggtgatgcttgaagatgaagaagatctagaagtaaagctccgacgtatccttgagaacgttcctgttcgtgttagtaatacttctggaagttccgctggttctggttctggagatttccatcagtaccggcaaatgaggcggagagaacaagaccgactaacaaggatggatattgactataacaagcggttaaaaatggcagagtttactataagaagagaagagaaacagaaagctgcagaggaaaaaacatcgaagaagcgtttgaaacgccaaaagaagaagcagaagaaacaggagaagaagcaaaaaccaaacactactgaggaagaagtaaagcaaccgagagtaggagaaatatcatctgacgaaggtgaagatgaagtagaagaagagtctgtgctagaacctttacgtccaatgtttaatatcaagttccaagagaaccgttcatagcttttattgtgacatgttacatgattccaaaactatctttgtgagattcgtttctttctttccttttgttttcaacaatgtacgggaaaaagaaatggagcaggttttaatcggcttttgtattggattagggttcatcaaatcaaccaccaatgtatattgac

SEQ ID NO: 976 - protein, 838 aa, Arabidopsis thaliana
AAAGCAAAATTAATAAATTATCGTCTTGACGAAAAATCGTAGAGGAAAAAAAATCCCCAAATTGTGTGACCGGAATTAGGGTTTCGACAATGTCGTCCGGGAAGCCAAAGCAAGGCGACACACGATTGGTGGTTGCTGCCACTACGGCGTCGGCATTGATGGAAGCGAAGAAGGCTGATCACGGAGGATCTTCGTCTATCGTTGAGTATAAACCGCCGGTGATGCTTGAAGATGAAGAAGATCTAGAAGTAAAGCTCCGACGTATCCTTGAGAACGTTCCTGTTCGTGTTAGTAATACTTCTGGAAGTTCCGCTGGTTCTGGTTCTGGAGATTTCCATCAGTACCGGCAAATGAGGCGGAGAGAACAAGACCGACTAACAAGGATGGATATTGACTATAACAAGCGGTTAAAAATGGCAGAGTTTACTATAAGAAGAGAAGAGAAACAGAAAGCTGCAGAGGAAAAAACATCGAAGAAGCGTTTGAAACGCCAAAAGAAGAAGCAGAAGAAACAGGAGAAGAAGCAAAAACCAAACACTACTGAGGAAGAAGTAAAGCAACCGAGAGTAGGAGAAATATCATCTGACGAAGGTGAAGATGAAGTAGAAGAAGAGTCTGTGCTAGAACCTTTACGTCCAATGTTTAATATCAAGTTCCAAGAGAACCGTTCATAGCTTTTATTGTGACATGTTACATGATTCCAAAACTATCTTTGTGAGATTCGTTTCTTTCTTTCCTTTTGTTTTCAACAATGTACGGGAAAAAGAAATGGAGCAGGTTTTAATCGGCTTTTGTATTGGATTAGGGTTCATCAAATCAACCACCAATGTATATTGAC

SEQ ID NO: 977 - DNA, 1919 bp, Zea mays
  misc_feature (1)..(1919): Ceres cDNA ID no. 12386452
  misc_feature (1)..(1919): Ceres CLONE  ID no. 209779
  misc_feature (1)..(1919): Also known as  Ceres CDNA ID no. 23741007
gcacgagaccattacctagaacatcctaatcgaaaactgcccaccgggctcgtctcctcccctggtttctttttcatcactcgtcaccggctcaccgctagttcctttagagaaggtgtacccccaatattccattaccggcccactgacgagagagagagagagagattttggcgtgactatccagagtccccaatcttacacctaaaaactcttctcagctaccggtgcggcatatcgcccctatcggcggcgaacatttgagttctcgcgacgtgtcctcgaggattctgtggtggaagatcggatcttttgctgcgggttccagttgccaaccagagatgtcggctctcctcgatctactgatggggatctttcgccagcagaccctcggcggcgccgccctggagctcgccgcgctggcggcgccgctctcgctcgccgccctcgtcggccttctcatcgggtgggcatggcgcccgaggtgggcgggggtcgtcgtcgtcgacaacgcccaacagatggcgcagctccccgcggcggcggcgcctccggaccgcgccaccgccaccaccaccgcggtggtatctcgcaacgaggcggccgccgtcgtaccgagaactgtggtggctcatgcggcggccgaggacgagcagcagcagctggcggtcaacaccggtgacttgatgcacctctggcggctcgtcgacgagaaggacggtggcccgtcgtggattcacatgatggaccgcaccttaccaaccatgaggtaccaagcctggcggagagacccaccgagtggtccaccacagtaccgcagcagcacaatcttggaagatgcgtcaccagaggttgtgagagatttcttctgggacgacgagttccggatgaacaacagctgggacgacatgcttcttcagcacgagacgctggaggagtgcaccgagactggaaccatggttgtccggtgggtcaggaagttcccgttcttctgcagcgacagggagtacatcataggccgcaggatatgggcgtctgggaagacattttactgtgtgaccaagggtgttcctcgtccctccgttccaagacaaaacaaacctcgccgtgtggacttgtactactctagctggtgcatccgtccagttgagtcgagaaaaggcgacggtgcaatgagtgcatgcgaggtgctcttgttccaccacgaggacatggggattccatgggagatcgcgaagcttggcgtccggcaggggatgtggggctgcgtcaagaggatagagcctggccttcgggcgtaccaggttgggaggaccgccggagaggctgtttccaagtgtgctgccatggcacaggtcaccaccaggttcagtgccgacgagctcgtcatcgcagggccggggcaacacggaggccagttcttcttcgtccggcgacggcgcagaggttgacaaggcgacgaagcactgggcgaacagcatacccaaggttctcatggtcggtggcgctgtggccctggcctgctgcaccttcgacggtgggttgttgaccaaggccgtcatcttcggcactgccaggaggtttgcaggagggccaggaaggcggtaggtacggtgtaacggtggacggaaagatccagcggcacaacacaaaacaagtgttgctgcactgcagcccgctgcgggttaataggttagaaatatagcatttgttacgaggaaacatagaagtattatgcaagaaaaccgctgttagataagaaatacactgctgtgtattagtagttaataacaagagttcttggtttttgtatgtaaccatattgtggatcggatccattgttcttccccatggacactactactaccagtctaccagatcgatgttgaccttgtggcagttgctgcagtttttttttc

SEQ ID NO: 978 - protein, 1919 aa, Zea mays
  misc_feature: PFam Name: START; PFam Description: START domain
  misc_feature: GI Number: 46798907; NR Description: membrane related protein
  misc_feature: GI Number: 23197608; NR Description: membrane related protein CP5, putative [Arabidopsis thaliana] >gi|22135902|gb|AAM91533.1|
  misc_feature: GI Number: 50904921; NR Description: putative membrane related protein CP5 [Oryza sativa (japonica cultivar-group)] >gi|41053035|dbj|BAD07966.1| putative membrane related protein CP5
  misc_feature: GI Number: 4741929; NR Description: membrane related protein
  misc_feature: GI Number: 18033654; NR Description: putative nodule membrane
GCACGAGACCATTACCTAGAACATCCTAATCGAAAACTGCCCACCGGGCTCGTCTCCTCCCCTGGTTTCTTTTTCATCACTCGTCACCGGCTCACCGCTAGTTCCTTTAGAGAAGGTGTACCCCCAATATTCCATTACCGGCCCACTGACGAGAGAGAGAGAGAGAGATTTTGGCGTGACTATCCAGAGTCCCCAATCTTACACCTAAAAACTCTTCTCAGCTACCGGTGCGGCATATCGCCCCTATCGGCGGCGAACATTTGAGTTCTCGCGACGTGTCCTCGAGGATTCTGTGGTGGAAGATCGGATCTTTTGCTGCGGGTTCCAGTTGCCAACCAGAGATGTCGGCTCTCCTCGATCTACTGATGGGGATCTTTCGCCAGCAGACCCTCGGCGGCGCCGCCCTGGAGCTCGCCGCGCTGGCGGCGCCGCTCTCGCTCGCCGCCCTCGTCGGCCTTCTCATCGGGTGGGCATGGCGCCCGAGGTGGGCGGGGGTCGTCGTCGTCGACAACGCCCAACAGATGGCGCAGCTCCCCGCGGCGGCGGCGCCTCCGGACCGCGCCACCGCCACCACCACCGCGGTGGTATCTCGCAACGAGGCGGCCGCCGTCGTACCGAGAACTGTGGTGGCTCATGCGGCGGCCGAGGACGAGCAGCAGCAGCTGGCGGTCAACACCGGTGACTTGATGCACCTCTGGCGGCTCGTCGACGAGAAGGACGGTGGCCCGTCGTGGATTCACATGATGGACCGCACCTTACCAACCATGAGGTACCAAGCCTGGCGGAGAGACCCACCGAGTGGTCCACCACAGTACCGCAGCAGCACAATCTTGGAAGATGCGTCACCAGAGGTTGTGAGAGATTTCTTCTGGGACGACGAGTTCCGGATGAACAACAGCTGGGACGACATGCTTCTTCAGCACGAGACGCTGGAGGAGTGCACCGAGACTGGAACCATGGTTGTCCGGTGGGTCAGGAAGTTCCCGTTCTTCTGCAGCGACAGGGAGTACATCATAGGCCGCAGGATATGGGCGTCTGGGAAGACATTTTACTGTGTGACCAAGGGTGTTCCTCGTCCCTCCGTTCCAAGACAAAACAAACCTCGCCGTGTGGACTTGTACTACTCTAGCTGGTGCATCCGTCCAGTTGAGTCGAGAAAAGGCGACGGTGCAATGAGTGCATGCGAGGTGCTCTTGTTCCACCACGAGGACATGGGGATTCCATGGGAGATCGCGAAGCTTGGCGTCCGGCAGGGGATGTGGGGCTGCGTCAAGAGGATAGAGCCTGGCCTTCGGGCGTACCAGGTTGGGAGGACCGCCGGAGAGGCTGTTTCCAAGTGTGCTGCCATGGCACAGGTCACCACCAGGTTCAGTGCCGACGAGCTCGTCATCGCAGGGCCGGGGCAACACGGAGGCCAGTTCTTCTTCGTCCGGCGACGGCGCAGAGGTTGACAAGGCGACGAAGCACTGGGCGAACAGCATACCCAAGGTTCTCATGGTCGGTGGCGCTGTGGCCCTGGCCTGCTGCACCTTCGACGGTGGGTTGTTGACCAAGGCCGTCATCTTCGGCACTGCCAGGAGGTTTGCAGGAGGGCCAGGAAGGCGGTAGGTACGGTGTAACGGTGGACGGAAAGATCCAGCGGCACAACACAAAACAAGTGTTGCTGCACTGCAGCCCGCTGCGGGTTAATAGGTTAGAAATATAGCATTTGTTACGAGGAAACATAGAAGTATTATGCAAGAAAACCGCTGTTAGATAAGAAATACACTGCTGTGTATTAGTAGTTAATAACAAGAGTTCTTGGTTTTTGTATGTAACCATATTGTGGATCGGATCCATTGTTCTTCCCCATGGACACTACTACTACCAGTCTACCAGATCGATGTTGACCTTGTGGCAGTTGCTGCAGTTTTTTTTTC

SEQ ID NO: 979 - DNA, 1228 bp, Zea mays
  misc_feature (1)..(1228): Ceres cDNA ID no. 12386860
  misc_feature (1)..(1228): Ceres CLONE  ID no. 337717
  misc_feature (1)..(1228): Also known as  Ceres CDNA ID no. 23762330
aaatctccatcaccatcgccttcaactcaagcgactacagcaaacttgctgagactgcagctgatcatggggtcgacgacatggttggcggccgtgctggcggcactcgtggtcgccgcctcctcaacggtggcatcacacgcctcgctgccggggaaacttgaggtcggtttctacgagcactcgtgcccacaggcggaggacatcgtgcgcaacgccgtccgccgcggcatagcccgcgagcccggcgtcggcgcggggctcatccgcatgcacttccacgactgcttcgtccggggctgcgacggctccatcctcatcaactccacgccgggcaacaaggccgagaaggactccgtggccaacaaccccagcatgcgcggcttcgacgtcatcgacgacgccaaggccgtcctcgaggcgcactgcccgcgcaccgtctcctgcgctgatatcgtcgcgctcgcggcccgtgacagcacctacctcgccggcggcctggactacaaggtcccgtcgggccgccgtgacggccgcgtgtccaaagaggaggaggtgctcgacaacaatgtccccgccccgactgacgaggtcgacgagctcatcgagagcttcaagcgcaaggggctcaacgccgacgacatggtcacgctctctggcgcgcacaccatcggccgctcccactgctcctccttcacgcagcggctctacaacttcagcgggcagctggggcagacagacccgtccctcgaccccgcctacgccgggcacctcaaggcgcggtgcccttggccgtccagcgacgaccagatggatcccacggtggttccgcttgacccagtcacgccggcgaccttcgacaaccagtactacaagaacgtgctggcgcacaaggtcctgttcatctccgacaacacactgctcgacaacccatggacggccggaatggtccacttcaacgccgcagtcgagaaggcatggcaggtcaagttcgccaaggccatggttaagatgggcaaggtccaggtgctcaccggcgaggagggagagatcagggagaagtgcttcgccgtcaacccacactactagtcaagtttaattatctaattaccccgcgcgtgttatgtttgtttatacgttccatacatcaacattatgtagagtgtttttcgttctcttcaaggctgtgaaatcaaacaagtttatcaagtaaaatggtgttatttgc

SEQ ID NO: 980 - protein, 1228 aa, Zea mays
  misc_feature: PFam Name: peroxidase; PFam Description: Peroxidase
  misc_feature: PFam Name: Mucin; PFam Description: Mucin-like glycoprotein
  misc_feature: GI Number: 55701007; NR Description: TPA: class III
  misc_feature: GI Number: 51038249; NR Description: putative peroxidase
  misc_feature: GI Number: 55701009; NR Description: TPA: class III
  misc_feature: GI Number: 34902236; NR Description: Putative peroxidase [Oryza sativa (japonica cultivar-group)] >gi|21426123|gb|AAM52320.1| Putative peroxidase [Oryza sativa
  misc_feature: GI Number: 4760700; NR Description: peroxidase 1 [Scutellaria
AAATCTCCATCACCATCGCCTTCAACTCAAGCGACTACAGCAAACTTGCTGAGACTGCAGCTGATCATGGGGTCGACGACATGGTTGGCGGCCGTGCTGGCGGCACTCGTGGTCGCCGCCTCCTCAACGGTGGCATCACACGCCTCGCTGCCGGGGAAACTTGAGGTCGGTTTCTACGAGCACTCGTGCCCACAGGCGGAGGACATCGTGCGCAACGCCGTCCGCCGCGGCATAGCCCGCGAGCCCGGCGTCGGCGCGGGGCTCATCCGCATGCACTTCCACGACTGCTTCGTCCGGGGCTGCGACGGCTCCATCCTCATCAACTCCACGCCGGGCAACAAGGCCGAGAAGGACTCCGTGGCCAACAACCCCAGCATGCGCGGCTTCGACGTCATCGACGACGCCAAGGCCGTCCTCGAGGCGCACTGCCCGCGCACCGTCTCCTGCGCTGATATCGTCGCGCTCGCGGCCCGTGACAGCACCTACCTCGCCGGCGGCCTGGACTACAAGGTCCCGTCGGGCCGCCGTGACGGCCGCGTGTCCAAAGAGGAGGAGGTGCTCGACAACAATGTCCCCGCCCCGACTGACGAGGTCGACGAGCTCATCGAGAGCTTCAAGCGCAAGGGGCTCAACGCCGACGACATGGTCACGCTCTCTGGCGCGCACACCATCGGCCGCTCCCACTGCTCCTCCTTCACGCAGCGGCTCTACAACTTCAGCGGGCAGCTGGGGCAGACAGACCCGTCCCTCGACCCCGCCTACGCCGGGCACCTCAAGGCGCGGTGCCCTTGGCCGTCCAGCGACGACCAGATGGATCCCACGGTGGTTCCGCTTGACCCAGTCACGCCGGCGACCTTCGACAACCAGTACTACAAGAACGTGCTGGCGCACAAGGTCCTGTTCATCTCCGACAACACACTGCTCGACAACCCATGGACGGCCGGAATGGTCCACTTCAACGCCGCAGTCGAGAAGGCATGGCAGGTCAAGTTCGCCAAGGCCATGGTTAAGATGGGCAAGGTCCAGGTGCTCACCGGCGAGGAGGGAGAGATCAGGGAGAAGTGCTTCGCCGTCAACCCACACTACTAGTCAAGTTTAATTATCTAATTACCCCGCGCGTGTTATGTTTGTTTATACGTTCCATACATCAACATTATGTAGAGTGTTTTTCGTTCTCTTCAAGGCTGTGAAATCAAACAAGTTTATCAAGTAAAATGGTGTTATTTGC

SEQ ID NO: 981 - DNA, 1430 bp, Zea mays
  misc_feature (1)..(1430): Ceres cDNA ID no. 12386925
  misc_feature (1)..(1430): Ceres CLONE  ID no. 279047
  misc_feature (1)..(1430): Also known as  Ceres CDNA ID no. 23769557
gctctaaaaagtccaactccaaacctagactagaggcccctcaccgaggcgacgacgcacgcagccgagcgccactccgccgccgccgcctcctcctcgtccccgtcccgcgccgcaacggcctcccccaccctgcgcccgccggccgcccctcgacgggtcgagcggagcggggaacccatccgtccggccgttggtcgctctcgctcgtctggtgttggttgtaatgagaagctggacctgttaggccgaagagttctcgttgcaagtctgtgcctcagcgatgggttcaggcaacttgatcgtgaagaaggtggtaaagcacagctcctttgatctggacatacagcttgataagagttggatggaggatgttacctgcccgatctgccttgattaccctcacaatgcagtgctactgaggtgcacgtcttatgagaagggatgcaggccgtttgtttgcgatacagaccagacccgctcaaactgtcttgagaggtttaaatctgcatatgaactgccttccaatgtgaaagtttcatctttagccgtgcctcctcttgatagcattattcatattgtgccgtctaacgcaaacaaccgccccagctgccctttgtgtagaggtgatgttattgggtgggttgttattggtgaggctcggctgcatcttaatcagaagaaaaggtgctgtgaagaggattgctgctcgtttgttggcaacttcaatgagcttcagaagcacacgcaacaaaagcatcctgattcacgcccttcagagatcgatcctgctaggcaagttgattgggagaatttccagcaatcttctgatatcgtagatgtcttgagcacaatacatgcacaagttccaaacgggattgttctgggagactatgtgattgagtatggggatgatgacactggtgaggactatgaagttttccgcagggtcaggacgaactggtggtcatgtattttctgcagggcgttttcaagatcttcaagaagtcgtagaagatccagagcaagggaaagaataggcagtggaaggaggaatggcaaccaggttaatctagaaaattttaacctcgtggttccgacacaacctgttgaattaagggaaattaggtttgatgaaattgatgatgaatacatagtcacaggggccattcctagtatcgcagcaccgggaagaatggctagtttccattacagggatacaagatatggacgttgatgcatagggtctgcagtaaaaaaaggaatagatgttatgcaatttaccgatcaacgtaacgttgtaactccgctcatttggattccttccacctgccctcggtaggtgctgccgcagttcaaacttatctgtgcataaaaagtagcaacagaacctcgctgttcgtttgaatcaggcctcgtcattctagttc

SEQ ID NO: 982 - protein, 1430 aa, Zea mays
  misc_feature: GI Number: 34912600; NR Description: P0046B10.17 [Oryza sativa (japonica cultivar-group)] >gi|11034559|dbj|BAB17083.1| P0410E01.4 [Oryza sativa (japonica cultivar-group)] >gi|21104687|dbj|BAB93277.1| P0046B10.17 [Oryza sativa (japonica
  misc_feature: GI Number: 5103842; NR Description: F9L1.39 [Arabidopsis thaliana]
GCTCTAAAAAGTCCAACTCCAAACCTAGACTAGAGGCCCCTCACCGAGGCGACGACGCACGCAGCCGAGCGCCACTCCGCCGCCGCCGCCTCCTCCTCGTCCCCGTCCCGCGCCGCAACGGCCTCCCCCACCCTGCGCCCGCCGGCCGCCCCTCGACGGGTCGAGCGGAGCGGGGAACCCATCCGTCCGGCCGTTGGTCGCTCTCGCTCGTCTGGTGTTGGTTGTAATGAGAAGCTGGACCTGTTAGGCCGAAGAGTTCTCGTTGCAAGTCTGTGCCTCAGCGATGGGTTCAGGCAACTTGATCGTGAAGAAGGTGGTAAAGCACAGCTCCTTTGATCTGGACATACAGCTTGATAAGAGTTGGATGGAGGATGTTACCTGCCCGATCTGCCTTGATTACCCTCACAATGCAGTGCTACTGAGGTGCACGTCTTATGAGAAGGGATGCAGGCCGTTTGTTTGCGATACAGACCAGACCCGCTCAAACTGTCTTGAGAGGTTTAAATCTGCATATGAACTGCCTTCCAATGTGAAAGTTTCATCTTTAGCCGTGCCTCCTCTTGATAGCATTATTCATATTGTGCCGTCTAACGCAAACAACCGCCCCAGCTGCCCTTTGTGTAGAGGTGATGTTATTGGGTGGGTTGTTATTGGTGAGGCTCGGCTGCATCTTAATCAGAAGAAAAGGTGCTGTGAAGAGGATTGCTGCTCGTTTGTTGGCAACTTCAATGAGCTTCAGAAGCACACGCAACAAAAGCATCCTGATTCACGCCCTTCAGAGATCGATCCTGCTAGGCAAGTTGATTGGGAGAATTTCCAGCAATCTTCTGATATCGTAGATGTCTTGAGCACAATACATGCACAAGTTCCAAACGGGATTGTTCTGGGAGACTATGTGATTGAGTATGGGGATGATGACACTGGTGAGGACTATGAAGTTTTCCGCAGGGTCAGGACGAACTGGTGGTCATGTATTTTCTGCAGGGCGTTTTCAAGATCTTCAAGAAGTCGTAGAAGATCCAGAGCAAGGGAAAGAATAGGCAGTGGAAGGAGGAATGGCAACCAGGTTAATCTAGAAAATTTTAACCTCGTGGTTCCGACACAACCTGTTGAATTAAGGGAAATTAGGTTTGATGAAATTGATGATGAATACATAGTCACAGGGGCCATTCCTAGTATCGCAGCACCGGGAAGAATGGCTAGTTTCCATTACAGGGATACAAGATATGGACGTTGATGCATAGGGTCTGCAGTAAAAAAAGGAATAGATGTTATGCAATTTACCGATCAACGTAACGTTGTAACTCCGCTCATTTGGATTCCTTCCACCTGCCCTCGGTAGGTGCTGCCGCAGTTCAAACTTATCTGTGCATAAAAAGTAGCAACAGAACCTCGCTGTTCGTTTGAATCAGGCCTCGTCATTCTAGTTC

SEQ ID NO: 983 - DNA, 1659 bp, Zea mays
  misc_feature (1)..(1659): Ceres cDNA ID no. 12387042
  misc_feature (1)..(1659): Ceres CLONE  ID no. 294138
  misc_feature (1)..(1659): Also known as  Ceres CDNA ID no. 23761153
aaagaacccgagcaccgcctcagctcatcctcgcagatacgtttcagttccggagcgactagcgcgagcgttcagggattatttactgaaagagagagtgttcagggattttagcacttgttcatggctgctgcgtgcatcagccatcgctttcgccactccaagctcccggtactggtcctggcgctggcgacggtggtggccgccgcacgggctcagctgtcgccgccgacgttctacgcctcgtcgtgccctgccgcgctcgtcaccatcaacgccgccgtgagggctgccgtgctgctggaccgccgcatgggcgcctccctgctccggctccacttccacgactgcttcgtgcagggctgcgacgcgtccgttctgctggacgacacgggcaacttcaccggggagaagggcgcgggccccaacgcgggctcgctcagggggttcggcgtcatcgacaccgtcaaggccctgctggaggcgctgtgcccgcggaccgtgtcgtgcgccgacatcctcgccgtcgccgcccgtgactctgtcgtcgcgctcggaggcccatcgtggaccgtgcagctcggcaggagggactccaccacggcgagcctctccaccgcgaacaccgacctcccctcgccggcgtccagcctgagcaccctgctcgccgcattcgccaggaaaggcggtcagcagcaccgacatggtcgctctgtctggtgcgtccctcaccgatcaatcaaccacggaccacgctttcatcagtgaccagtcatcaccgcagcgcctggcttcacatcacagtgatgttatggcatggtcaccgacgtgaccatgcaactaccagttcccctgtgcctctactctaacagcggtggcagcttggcagttagcaccagcgcggcagcgccaccgccacgtactggtcaccactgacacgtgagcggttgcgtatgcatgatgcaggagcccacacggtggggcaagcgcagtgccagaactaccaggccaggatctacaacgacgccaacatcaacgcggccttcgcggcgtcgctgagggccggctgcccggcgtccggagggggcggcgccaacgcgccgctggacgcgtccacgccgaacgcgttcgacaacgcgtactacggcgatctggtcgcgcagcagggcctgctgcactccgatcaagagctcttcaacggtggctccacggacgcactggtcaggagctacgcggccagctcggcgcggtttagtagcgacttcgccgcagccatggtcaggatgggcgccattggtgtcctgaccgggagcagcggacaggtgcggcgcaactgccggaaggtgaactagccagctcgcagaatactgcattgtatgcatcacactggtggaagaaattgtgtgtgctgagttatccaaccatggttgaacgaagttgtaaagattaaagggcaacgaagtcatatagcttgcattgatgttgtcattaaagaagtacaccctccatttttttctgcaaatacctagaacatttaggtatcactgtagctcaactttgagtataaatgtagcatataattatctctttcatatggccaacaataatatacaaatgtattctgtataagttacaattattataataaaattcaattcc

SEQ ID NO: 984 - protein, 1659 aa, Zea mays
  misc_feature: PFam Name: peroxidase; PFam Description: Peroxidase
  misc_feature: GI Number: 50939965; NR Description: putative peroxidase precursor [Oryza sativa (japonica cultivar-group)] >gi|34393249|dbj|BAC83101.1| putative peroxidase precursor [Oryza
  misc_feature: GI Number: 732976; NR Description: peroxidase [Triticum aestivum] >gi|2117619|pir||S61408 peroxidase (EC 1.11.1.7) 4
  misc_feature: GI Number: 55701085; NR Description: TPA: class III
  misc_feature: GI Number: 50939971; NR Description: peroxidase [Oryza sativa (japonica cultivar-group)] >gi|585662|sp|P37835|PER2_ORYSA Peroxidase 2 precursor >gi|7433040|pir||T03929 peroxidase (EC 1.11.1.7) - rice >gi|303851|dbj|BAA03911.1| peroxidase [Oryza
  misc_feature: GI Number: 50939967; NR Description: peroxidase [Oryza sativa (japonica cultivar-group)] >gi|34393250|dbj|BAC83102.1| peroxidase
AAAGAACCCGAGCACCGCCTCAGCTCATCCTCGCAGATACGTTTCAGTTCCGGAGCGACTAGCGCGAGCGTTCAGGGATTATTTACTGAAAGAGAGAGTGTTCAGGGATTTTAGCACTTGTTCATGGCTGCTGCGTGCATCAGCCATCGCTTTCGCCACTCCAAGCTCCCGGTACTGGTCCTGGCGCTGGCGACGGTGGTGGCCGCCGCACGGGCTCAGCTGTCGCCGCCGACGTTCTACGCCTCGTCGTGCCCTGCCGCGCTCGTCACCATCAACGCCGCCGTGAGGGCTGCCGTGCTGCTGGACCGCCGCATGGGCGCCTCCCTGCTCCGGCTCCACTTCCACGACTGCTTCGTGCAGGGCTGCGACGCGTCCGTTCTGCTGGACGACACGGGCAACTTCACCGGGGAGAAGGGCGCGGGCCCCAACGCGGGCTCGCTCAGGGGGTTCGGCGTCATCGACACCGTCAAGGCCCTGCTGGAGGCGCTGTGCCCGCGGACCGTGTCGTGCGCCGACATCCTCGCCGTCGCCGCCCGTGACTCTGTCGTCGCGCTCGGAGGCCCATCGTGGACCGTGCAGCTCGGCAGGAGGGACTCCACCACGGCGAGCCTCTCCACCGCGAACACCGACCTCCCCTCGCCGGCGTCCAGCCTGAGCACCCTGCTCGCCGCATTCGCCAGGAAAGGCGGTCAGCAGCACCGACATGGTCGCTCTGTCTGGTGCGTCCCTCACCGATCAATCAACCACGGACCACGCTTTCATCAGTGACCAGTCATCACCGCAGCGCCTGGCTTCACATCACAGTGATGTTATGGCATGGTCACCGACGTGACCATGCAACTACCAGTTCCCCTGTGCCTCTACTCTAACAGCGGTGGCAGCTTGGCAGTTAGCACCAGCGCGGCAGCGCCACCGCCACGTACTGGTCACCACTGACACGTGAGCGGTTGCGTATGCATGATGCAGGAGCCCACACGGTGGGGCAAGCGCAGTGCCAGAACTACCAGGCCAGGATCTACAACGACGCCAACATCAACGCGGCCTTCGCGGCGTCGCTGAGGGCCGGCTGCCCGGCGTCCGGAGGGGGCGGCGCCAACGCGCCGCTGGACGCGTCCACGCCGAACGCGTTCGACAACGCGTACTACGGCGATCTGGTCGCGCAGCAGGGCCTGCTGCACTCCGATCAAGAGCTCTTCAACGGTGGCTCCACGGACGCACTGGTCAGGAGCTACGCGGCCAGCTCGGCGCGGTTTAGTAGCGACTTCGCCGCAGCCATGGTCAGGATGGGCGCCATTGGTGTCCTGACCGGGAGCAGCGGACAGGTGCGGCGCAACTGCCGGAAGGTGAACTAGCCAGCTCGCAGAATACTGCATTGTATGCATCACACTGGTGGAAGAAATTGTGTGTGCTGAGTTATCCAACCATGGTTGAACGAAGTTGTAAAGATTAAAGGGCAACGAAGTCATATAGCTTGCATTGATGTTGTCATTAAAGAAGTACACCCTCCATTTTTTTCTGCAAATACCTAGAACATTTAGGTATCACTGTAGCTCAACTTTGAGTATAAATGTAGCATATAATTATCTCTTTCATATGGCCAACAATAATATACAAATGTATTCTGTATAAGTTACAATTATTATAATAAAATTCAATTCC

SEQ ID NO: 985 - DNA, 1214 bp, Zea mays
  misc_feature (1)..(1214): Ceres cDNA ID no. 12387065
  misc_feature (1)..(1214): Ceres CLONE  ID no. 285850
  misc_feature (1)..(1214): Also known as  Ceres CDNA ID no. 23759726
aaactgcatcagagcacgaccacactacccacccacctccactactgacgaccgattcccagaaagctcgatctagcgcgcgcggctgcagagtgcagacgacgacgtacaccatggcgcggcggtccctggccctgctgctcgcgtcgtcgctcgccctgatggcggccgccgtcgcatcggcggactcgtggctctacgacaagttcaacacggacggcaccgtccgcacccagtacgacgcgtcggggcaggaggtggcgatgctcagcctggaccgcagctccggcgccggcttcaactccaagaagcagtacctgtacggcgagttcagcgtccagatgaagctcatccccggcaactccgccggcaccgtctcgtgcttctacctctcgtcgggcgacggcgacgggcacgacgagatcgacatggagttcatgggcaacgcgagcgggcagccggtggtgctgaacacgaacgtgtgggccagcggcgacggcaagaaggagcaccagttcgacctctggttcgacccctccgccgactaccacacctacaccatcatctggaacccgaccaacatcctgttcaaggtggacggcgacgtgatccggtgcttcaagcgctacgccgacctgccgtacccgagcgcgaggcccatggcgctgcacgccacgctgtgggacggcagctactgggccaccgagaagggcaaggtgccggtggactggtccgccgcgcccttcgtcgtctcctaccggggctactcggccaacgcctgcgtcagcggcggggcctgcggcggcggcggcgacgacgggtggatgagcaagcagcccgacgacgccgagtggggcaccgtccggtgggccgagagcaactacatgcgctacaactactgcgacgacggctggcggttcccccagggcctcccgcccgagtgcagccgcagctaagctagctgattccgccggttttcgtacgctcggcggcgtccgctgacgacacacgccttgttggtttgttcttgctggacatcatacatctctatatgcatgattcttgttctgttattgttaaatcgtgattacaatacttgtaattgtaaagaagtgtgtgggcacgggagtatatcactgtagttttaatttgcttgtaaagaaaagaagggtttttttacttgtgacgcgggagctagcgactgcgtcctgttc

SEQ ID NO: 986 - protein, 1214 aa, Zea mays
  misc_feature: PFam Name: Glyco_hydro_16; PFam Description: Glycosyl
  misc_feature: PFam Name: XET_C; PFam Description: Xyloglucan
  misc_feature: PFam Name: Podocalyxin; PFam Description: Podocalyxin
  misc_feature: PFam Name: Mucin; PFam Description: Mucin-like glycoprotein
  misc_feature: GI Number: 57753593; NR Description: xyloglucan
  misc_feature: GI Number: 51039056; NR Description:
  misc_feature: GI Number: 51039058; NR Description:
  misc_feature: GI Number: 1890573; NR Description: xyloglucan endotransglycosylase (XET) [Hordeum vulgare subsp. vulgare] >gi|7447410|pir||T06200 xyloglucan endo-1,4-beta-D-glucanase (EC
  misc_feature: GI Number: 51039060; NR Description:
AAACTGCATCAGAGCACGACCACACTACCCACCCACCTCCACTACTGACGACCGATTCCCAGAAAGCTCGATCTAGCGCGCGCGGCTGCAGAGTGCAGACGACGACGTACACCATGGCGCGGCGGTCCCTGGCCCTGCTGCTCGCGTCGTCGCTCGCCCTGATGGCGGCCGCCGTCGCATCGGCGGACTCGTGGCTCTACGACAAGTTCAACACGGACGGCACCGTCCGCACCCAGTACGACGCGTCGGGGCAGGAGGTGGCGATGCTCAGCCTGGACCGCAGCTCCGGCGCCGGCTTCAACTCCAAGAAGCAGTACCTGTACGGCGAGTTCAGCGTCCAGATGAAGCTCATCCCCGGCAACTCCGCCGGCACCGTCTCGTGCTTCTACCTCTCGTCGGGCGACGGCGACGGGCACGACGAGATCGACATGGAGTTCATGGGCAACGCGAGCGGGCAGCCGGTGGTGCTGAACACGAACGTGTGGGCCAGCGGCGACGGCAAGAAGGAGCACCAGTTCGACCTCTGGTTCGACCCCTCCGCCGACTACCACACCTACACCATCATCTGGAACCCGACCAACATCCTGTTCAAGGTGGACGGCGACGTGATCCGGTGCTTCAAGCGCTACGCCGACCTGCCGTACCCGAGCGCGAGGCCCATGGCGCTGCACGCCACGCTGTGGGACGGCAGCTACTGGGCCACCGAGAAGGGCAAGGTGCCGGTGGACTGGTCCGCCGCGCCCTTCGTCGTCTCCTACCGGGGCTACTCGGCCAACGCCTGCGTCAGCGGCGGGGCCTGCGGCGGCGGCGGCGACGACGGGTGGATGAGCAAGCAGCCCGACGACGCCGAGTGGGGCACCGTCCGGTGGGCCGAGAGCAACTACATGCGCTACAACTACTGCGACGACGGCTGGCGGTTCCCCCAGGGCCTCCCGCCCGAGTGCAGCCGCAGCTAAGCTAGCTGATTCCGCCGGTTTTCGTACGCTCGGCGGCGTCCGCTGACGACACACGCCTTGTTGGTTTGTTCTTGCTGGACATCATACATCTCTATATGCATGATTCTTGTTCTGTTATTGTTAAATCGTGATTACAATACTTGTAATTGTAAAGAAGTGTGTGGGCACGGGAGTATATCACTGTAGTTTTAATTTGCTTGTAAAGAAAAGAAGGGTTTTTTTACTTGTGACGCGGGAGCTAGCGACTGCGTCCTGTTC

SEQ ID NO: 987 - DNA, 1863 bp, Zea mays
  misc_feature (1)..(1863): Ceres cDNA ID no. 12387583
  misc_feature (1)..(1863): Ceres CLONE  ID no. 356899
  misc_feature (1)..(1863): Also known as  Ceres CDNA ID no. 23797696
gcacgagaccattacctagaacatcctaatcgaaaaaccatttcgtttcggcttgagcagccggggagctgagcagcgcggcgcccatgtcggactccgagctgtcccagggcacgctagtgttcggcctccacctctgggagctcgtcggcatcggtgtcggtgccgcattcgtgctcctcctcgtcctcctctccctgctctgcctcctcgcctcccgccgccgccgacgccgccgtgctgcccccgtcctccacctccccgccgtcgtgcccaatgcccagcccaagcaccccgccaagccccccaaggacatccaagaggtgccctcccgcggcaccgcggcccccgccgccccggccaaggcgccgctcgcccaggtgctgcaggcgccgccgccggactccatccagatcgagacggggaaggagcaccgtatcacgttcccggagcagccgccgcccccgcaccaccagcggagcggggggccgtcgtctcggggcgccagcggggagagccgtggcggtggtggggaaccgggggtcccggaggtgtcgcacctggggtggggccactggtacacactcaaggagctggaggacgccacgtgcatgttcgccgacgagaaggtgatcggcgagggcggctacggcatagtgtaccacggcgtgctggagggcggagtgcaggtcgccgtcaaaaacttgctcaacaacagggggcaggcagaacgggaattcaaggttgaggtggaagctatcgggcgagtgcgacacaagaaccttgttcggttgttaggatactgcgctgaaggcaaccaaaggatgcttgtgtatgagtacgttaataatggaaacttggagcaatggctccatggggatgttggccctgtgagccctcttacatgggatatcagaatgaagattattctgggaacagcaaaagggttaatgtatttgcacgagggacttgagccaaaggttgttcaccgtgatgtcaagtcgagcaatattcttcttgacaagcattggaatgcaaagctttctgattttgggctagcgaaacttttgggttcagaaaggagttatgtcacaaccagggtcatggggacatttgggtatgttgcgccagagtatgcgggcactggcatgttgaatgaaactagcgatgtctatagtttcggaattcttatcatggaaataatatctggccgtgtacctgttgattacaacaggccgccaggggagattaatctagttgagtggctgaagacgatggtcagcaacagaaattctgaaggggttttggatccaaagatgaccgagaagcctacttctagggcattgaagaaggctttgctagtggctctgcggtgcgtagaccccgaagctcgcaagaggccaaagattgggcatgtcattcacatgcttgaggttgacgatttcccgtacagagatgagcgccggggtggcaaagctccagcccaagcaagatcggtggaaacgccacctgcaagcgaacctggcgatagcagcggaaacaacactccaaaggacgcgcctaatggagaacctttcaagtggagaaactaagaggactagccaccaggaaaacggtggttgcttgagtttgtgcctgataaagaagctggatatggttggttggttggttggttggttggtcgggcatgcaaactccacaagcaccagtgtcggtcgtcgtcgtgacagtatatgtacattgttgaatcgatatgttagccatagcgattttttttccagttggttttcttggggccgtatatttatgcgaaggatgattttgtgtgataaaggcgcgcgctctcgtgtgtattcctgaggc

SEQ ID NO: 988 - protein, 1863 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 20334728; NR Description: At1g01540/F22L4_6 [Arabidopsis thaliana] >gi|14194119|gb|AAK56254.1|
  misc_feature: GI Number: 50909307; NR Description: putative receptor protein kinase PERK1 [Oryza sativa (japonica cultivar-group)] >gi|46390691|dbj|BAD16192.1| putative receptor protein kinase PERK1
  misc_feature: GI Number: 28973357; NR Description: putative serine/threonine protein kinase [Arabidopsis thaliana] >gi|7269023|emb|CAB80756.1| putative serine/threonine protein kinase [Arabidopsis thaliana] >gi|28393613|gb|AAO42226.1| putative
  misc_feature: GI Number: 37535714; NR Description: putative kinase [Oryza sativa (japonica cultivar-group)] >gi|18071420|gb|AAL58279.1| putative kinase [Oryza sativa (japonica cultivar-group)] >gi|31432870|gb|AAP54446.1| putative kinase [Oryza sativa
  misc_feature: GI Number: 46518413; NR Description: At4g34500 [Arabidopsis thaliana] >gi|30690058|ref|NP_195176.2| protein kinase family protein [Arabidopsis thaliana] >gi|40823320|gb|AAR92275.1|
GCACGAGACCATTACCTAGAACATCCTAATCGAAAAACCATTTCGTTTCGGCTTGAGCAGCCGGGGAGCTGAGCAGCGCGGCGCCCATGTCGGACTCCGAGCTGTCCCAGGGCACGCTAGTGTTCGGCCTCCACCTCTGGGAGCTCGTCGGCATCGGTGTCGGTGCCGCATTCGTGCTCCTCCTCGTCCTCCTCTCCCTGCTCTGCCTCCTCGCCTCCCGCCGCCGCCGACGCCGCCGTGCTGCCCCCGTCCTCCACCTCCCCGCCGTCGTGCCCAATGCCCAGCCCAAGCACCCCGCCAAGCCCCCCAAGGACATCCAAGAGGTGCCCTCCCGCGGCACCGCGGCCCCCGCCGCCCCGGCCAAGGCGCCGCTCGCCCAGGTGCTGCAGGCGCCGCCGCCGGACTCCATCCAGATCGAGACGGGGAAGGAGCACCGTATCACGTTCCCGGAGCAGCCGCCGCCCCCGCACCACCAGCGGAGCGGGGGGCCGTCGTCTCGGGGCGCCAGCGGGGAGAGCCGTGGCGGTGGTGGGGAACCGGGGGTCCCGGAGGTGTCGCACCTGGGGTGGGGCCACTGGTACACACTCAAGGAGCTGGAGGACGCCACGTGCATGTTCGCCGACGAGAAGGTGATCGGCGAGGGCGGCTACGGCATAGTGTACCACGGCGTGCTGGAGGGCGGAGTGCAGGTCGCCGTCAAAAACTTGCTCAACAACAGGGGGCAGGCAGAACGGGAATTCAAGGTTGAGGTGGAAGCTATCGGGCGAGTGCGACACAAGAACCTTGTTCGGTTGTTAGGATACTGCGCTGAAGGCAACCAAAGGATGCTTGTGTATGAGTACGTTAATAATGGAAACTTGGAGCAATGGCTCCATGGGGATGTTGGCCCTGTGAGCCCTCTTACATGGGATATCAGAATGAAGATTATTCTGGGAACAGCAAAAGGGTTAATGTATTTGCACGAGGGACTTGAGCCAAAGGTTGTTCACCGTGATGTCAAGTCGAGCAATATTCTTCTTGACAAGCATTGGAATGCAAAGCTTTCTGATTTTGGGCTAGCGAAACTTTTGGGTTCAGAAAGGAGTTATGTCACAACCAGGGTCATGGGGACATTTGGGTATGTTGCGCCAGAGTATGCGGGCACTGGCATGTTGAATGAAACTAGCGATGTCTATAGTTTCGGAATTCTTATCATGGAAATAATATCTGGCCGTGTACCTGTTGATTACAACAGGCCGCCAGGGGAGATTAATCTAGTTGAGTGGCTGAAGACGATGGTCAGCAACAGAAATTCTGAAGGGGTTTTGGATCCAAAGATGACCGAGAAGCCTACTTCTAGGGCATTGAAGAAGGCTTTGCTAGTGGCTCTGCGGTGCGTAGACCCCGAAGCTCGCAAGAGGCCAAAGATTGGGCATGTCATTCACATGCTTGAGGTTGACGATTTCCCGTACAGAGATGAGCGCCGGGGTGGCAAAGCTCCAGCCCAAGCAAGATCGGTGGAAACGCCACCTGCAAGCGAACCTGGCGATAGCAGCGGAAACAACACTCCAAAGGACGCGCCTAATGGAGAACCTTTCAAGTGGAGAAACTAAGAGGACTAGCCACCAGGAAAACGGTGGTTGCTTGAGTTTGTGCCTGATAAAGAAGCTGGATATGGTTGGTTGGTTGGTTGGTTGGTTGGTCGGGCATGCAAACTCCACAAGCACCAGTGTCGGTCGTCGTCGTGACAGTATATGTACATTGTTGAATCGATATGTTAGCCATAGCGATTTTTTTTCCAGTTGGTTTTCTTGGGGCCGTATATTTATGCGAAGGATGATTTTGTGTGATAAAGGCGCGCGCTCTCGTGTGTATTCCTGAGGC

SEQ ID NO: 989 - DNA, 630 bp, Arabidopsis thaliana
  misc_feature (1)..(630): Ceres cDNA ID no. 12389130
  misc_feature (1)..(630): Ceres CLONE  ID no. 1553
  misc_feature (1)..(630): Also known as  Ceres CDNA ID no. 23382152
agatcaaaatcagaatcagaatcaaatttctcgtcgtgtcggagtaaatcaagccatggattccggaaccaaagtgaagaaaggagccgctggaagaagaagtggtggaggtcctaagaagaaaccggtttcccgttcggttaaatccggtctacagtttcctgtcggtaggatcggtcggtatcttaagaaaggtcgttattcgaagcgtgtcggaaccggagctccggtctatctcgccgccgtcctcgagtatcttgctgctgaggttctcgagcttgctggtaacgctgcaagagataacaaaaagaaccgtattataccacgccatgttctattagcggtgaggaacgacgaggagctagggacactactcaaaggcgtaaccattgcacacggcggtgttttaccaaacataaacccaatactcctcccaaagaagtctgagaaagcagcttcaactacaaaaacacccaaatcaccatcaaaggcaaccaaatcccctaagaaatcttagttcttctttcttcattcctctgtataacctactgtttctatctctctgtacgtttctctgtaaagacagaacagaatatctctttgttgttgtgagaaagcttagtttctctg

SEQ ID NO: 990 - protein, 630 aa, Arabidopsis thaliana
  misc_feature: PFam Name: Histone; PFam Description: Core histone H2A/H2B/H3/H4
  misc_feature: GI Number: 7649159; NR Description: histone H2A [Euphorbia esula]
  misc_feature: GI Number: 50931693; NR Description: putative histone H2A [Oryza sativa (japonica cultivar-group)] >gi|47900327|gb|AAT39174.1| putative histone H2A [Oryza sativa (japonica cultivar-group)] >gi|47900351|gb|AAT39181.1| putative
  misc_feature: GI Number: 122006; NR Description: HISTONE H2A
  misc_feature: GI Number: 34914498; NR Description: putative histone H2A [Oryza sativa (japonica cultivar-group)] >gi|13873032|dbj|BAB44136.1| putative histone H2A [Oryza sativa
  misc_feature: GI Number: 729669; NR Description: Histone H2A >gi|2118992|pir||S60474 histone H2A - garden pea
AGATCAAAATCAGAATCAGAATCAAATTTCTCGTCGTGTCGGAGTAAATCAAGCCATGGATTCCGGAACCAAAGTGAAGAAAGGAGCCGCTGGAAGAAGAAGTGGTGGAGGTCCTAAGAAGAAACCGGTTTCCCGTTCGGTTAAATCCGGTCTACAGTTTCCTGTCGGTAGGATCGGTCGGTATCTTAAGAAAGGTCGTTATTCGAAGCGTGTCGGAACCGGAGCTCCGGTCTATCTCGCCGCCGTCCTCGAGTATCTTGCTGCTGAGGTTCTCGAGCTTGCTGGTAACGCTGCAAGAGATAACAAAAAGAACCGTATTATACCACGCCATGTTCTATTAGCGGTGAGGAACGACGAGGAGCTAGGGACACTACTCAAAGGCGTAACCATTGCACACGGCGGTGTTTTACCAAACATAAACCCAATACTCCTCCCAAAGAAGTCTGAGAAAGCAGCTTCAACTACAAAAACACCCAAATCACCATCAAAGGCAACCAAATCCCCTAAGAAATCTTAGTTCTTCTTTCTTCATTCCTCTGTATAACCTACTGTTTCTATCTCTCTGTACGTTTCTCTGTAAAGACAGAACAGAATATCTCTTTGTTGTTGTGAGAAAGCTTAGTTTCTCTG

SEQ ID NO: 991 - DNA, 642 bp, Zea mays
  misc_feature (1)..(642): Ceres cDNA ID no. 12390118
  misc_feature (1)..(642): Ceres CLONE  ID no. 328612
  misc_feature (1)..(642): Also known as  Ceres CDNA ID no. 23767362
ctttcggaggaggcggaccaggtaagcagcagcaggaaccctagcaccgccgcatccgcagccatgggtatcgacctcgttgccggtggggaggagaagaaggatgatggcaaggaggaaaagaaagatgaagacaagaaagaagcggataaacagaaggatgatggcaatgctggtgatgaagggaaagacaaagaccctggcgccgttgctaacatgtatatgcactacccgaggtccaatcatctgagcgaatacggatatgcctaccagtacccacctcagctcttcagcgacgagaacccgaatgcctgttctctgatgtgagaaagccagaaccaagtgaccttaagcgcgaaaataagaggggattgagttatcccctgattttggaggttcaggaagtttagaacttttcttttctatttctaaggttgaactttctgtctggtacaaagtgaactctgggctggtttgtggacatcatattgtgtatgctactggttagtaggattttgtgttgcacctttcacctttggcttttatttttgtacaaagatgtattatatatgctagttttgaaatagcttgctgctagtactctgtagtctgttgtccggaatagacggagctttctcagtt

SEQ ID NO: 992 - protein, 642 aa, Zea mays
  misc_feature: PFam Name: HSP90; PFam Description: Hsp90 protein
  misc_feature: GI Number: 50908877; NR Description: putative farnesylated protein [Oryza sativa (japonica cultivar-group)] >gi|48716470|dbj|BAD23076.1| putative farnesylated protein [Oryza
  misc_feature: GI Number: 50908879; NR Description: putative farnesylated protein [Oryza sativa (japonica cultivar-group)] >gi|48716472|dbj|BAD23078.1| putative farnesylated protein [Oryza
  misc_feature: GI Number: 4097547; NR Description: ATFP3 [Arabidopsis thaliana]
  misc_feature: GI Number: 6469127; NR Description: farnesylated protein
CTTTCGGAGGAGGCGGACCAGGTAAGCAGCAGCAGGAACCCTAGCACCGCCGCATCCGCAGCCATGGGTATCGACCTCGTTGCCGGTGGGGAGGAGAAGAAGGATGATGGCAAGGAGGAAAAGAAAGATGAAGACAAGAAAGAAGCGGATAAACAGAAGGATGATGGCAATGCTGGTGATGAAGGGAAAGACAAAGACCCTGGCGCCGTTGCTAACATGTATATGCACTACCCGAGGTCCAATCATCTGAGCGAATACGGATATGCCTACCAGTACCCACCTCAGCTCTTCAGCGACGAGAACCCGAATGCCTGTTCTCTGATGTGAGAAAGCCAGAACCAAGTGACCTTAAGCGCGAAAATAAGAGGGGATTGAGTTATCCCCTGATTTTGGAGGTTCAGGAAGTTTAGAACTTTTCTTTTCTATTTCTAAGGTTGAACTTTCTGTCTGGTACAAAGTGAACTCTGGGCTGGTTTGTGGACATCATATTGTGTATGCTACTGGTTAGTAGGATTTTGTGTTGCACCTTTCACCTTTGGCTTTTATTTTTGTACAAAGATGTATTATATATGCTAGTTTTGAAATAGCTTGCTGCTAGTACTCTGTAGTCTGTTGTCCGGAATAGACGGAGCTTTCTCAGTT

SEQ ID NO: 993 - DNA, 1351 bp, Zea mays
  misc_feature (1)..(1351): Ceres cDNA ID no. 12390172
  misc_feature (1)..(1351): Ceres CLONE  ID no. 438996
  misc_feature (1)..(1351): Also known as  Ceres CDNA ID no. 23805779
accacggggtcctcgtggtacgtctctgttcgtcatgtgcctggcaccctacgtacgtacatactggttctatggcccaaccgtttcatgtgccggaggtcctgcaggacggcatgtcatggttgctggcctcgccggaggagtcgctgccgttcatcctcgccgaccgcggcttcgacgtctggatcgccaacaacaggggcacgcgctggagccgccgccacgtctcgctcgacccctccagccggctctactggaactggtcctgggatgacctggtagtcaacgacctgccggccatggtcgacttcgtcgtcaaacagaccggccagaagcctcactacgtcggacactccatggggacgctggtggcgctggcggccttctcggagggccgggtggtgagccagctgaaatccgcggcgctgctcacgccggtggcctacctcgcccacatcaccacccccatcggcatcctgctggccaaggcgttcgtcggcgaggtgctctcggacttcctcggcatggccgagttcgacccgctagcgccgccggtgacgaacctcatcagggcgttctgccgccgcccgggcatgagctgctacgacctcgtcggctccatcaccggcaagaactactgcctcaacagctccgccgtcgacgtcttcctcaagtacgagccccagccgacctccaccaaaaccatggtccacttcgctcaaaccgtgcgcgacggcgtgctgaccaagtacgactacgtgctgccggagcggaacatcgccagctacggccaggccgagccgccggtgtaccggatgtccggcatcccgccgagcttcccgctcttcctcagctacggcggccgggactcgctcgccgaccccgccgacgtgcgcctcctcctgcaggacctcccgggccacgaccaggacaagctcacggtgcagtacctggacaagttcgcgcacctcgacttcatcatcggcgtctgcgccaaggactacgtctacaaggacatgatcgacttcctaaaccgcttcaactagtactagcatatatatttgcttcaatcggtgtcgtcttcagccccagcaggattagacaaaaaaagggggggacactgcagctcgtaaacgttgtccatacagattatcagaggtgaaaaccatacatgatgtaatttagcattagatagttaaaacatggagctgcctcagtatggaggattgtcaactactctccatcacagcagtaggtgtgatgtagaagagtgattgtcacactgtgtgtgttgcaaatttgcaacacagtgattactaatataaaaaatactcttgagttaacctttggc

SEQ ID NO: 994 - protein, 1351 aa, Zea mays
  misc_feature: PFam Name: Abhydrolase_1; PFam Description: alpha/beta
  misc_feature: PFam Name: Mucin; PFam Description: Mucin-like glycoprotein
  misc_feature: PFam Name: Cation_efflux; PFam Description: Cation efflux family
  misc_feature: GI Number: 50947883; NR Description: putative gastric lipase precursor [Oryza sativa (japonica cultivar-group)] >gi|42407876|dbj|BAD09017.1| putative gastric lipase precursor [Oryza sativa (japonica cultivar-group)]
  misc_feature: GI Number: 39636476; NR Description: triacylglycerol/steryl
  misc_feature: GI Number: 35395931; NR Description: lysosomal acid
  misc_feature: GI Number: 38344633; NR Description: OSJNBa0094P09.4 [Oryza
  misc_feature: GI Number: 30679362; NR Description: lipase family protein [Arabidopsis thaliana] >gi|25992524|gb|AAN77143.1| putative
ACCACGGGGTCCTCGTGGTACGTCTCTGTTCGTCATGTGCCTGGCACCCTACGTACGTACATACTGGTTCTATGGCCCAACCGTTTCATGTGCCGGAGGTCCTGCAGGACGGCATGTCATGGTTGCTGGCCTCGCCGGAGGAGTCGCTGCCGTTCATCCTCGCCGACCGCGGCTTCGACGTCTGGATCGCCAACAACAGGGGCACGCGCTGGAGCCGCCGCCACGTCTCGCTCGACCCCTCCAGCCGGCTCTACTGGAACTGGTCCTGGGATGACCTGGTAGTCAACGACCTGCCGGCCATGGTCGACTTCGTCGTCAAACAGACCGGCCAGAAGCCTCACTACGTCGGACACTCCATGGGGACGCTGGTGGCGCTGGCGGCCTTCTCGGAGGGCCGGGTGGTGAGCCAGCTGAAATCCGCGGCGCTGCTCACGCCGGTGGCCTACCTCGCCCACATCACCACCCCCATCGGCATCCTGCTGGCCAAGGCGTTCGTCGGCGAGGTGCTCTCGGACTTCCTCGGCATGGCCGAGTTCGACCCGCTAGCGCCGCCGGTGACGAACCTCATCAGGGCGTTCTGCCGCCGCCCGGGCATGAGCTGCTACGACCTCGTCGGCTCCATCACCGGCAAGAACTACTGCCTCAACAGCTCCGCCGTCGACGTCTTCCTCAAGTACGAGCCCCAGCCGACCTCCACCAAAACCATGGTCCACTTCGCTCAAACCGTGCGCGACGGCGTGCTGACCAAGTACGACTACGTGCTGCCGGAGCGGAACATCGCCAGCTACGGCCAGGCCGAGCCGCCGGTGTACCGGATGTCCGGCATCCCGCCGAGCTTCCCGCTCTTCCTCAGCTACGGCGGCCGGGACTCGCTCGCCGACCCCGCCGACGTGCGCCTCCTCCTGCAGGACCTCCCGGGCCACGACCAGGACAAGCTCACGGTGCAGTACCTGGACAAGTTCGCGCACCTCGACTTCATCATCGGCGTCTGCGCCAAGGACTACGTCTACAAGGACATGATCGACTTCCTAAACCGCTTCAACTAGTACTAGCATATATATTTGCTTCAATCGGTGTCGTCTTCAGCCCCAGCAGGATTAGACAAAAAAAGGGGGGGACACTGCAGCTCGTAAACGTTGTCCATACAGATTATCAGAGGTGAAAACCATACATGATGTAATTTAGCATTAGATAGTTAAAACATGGAGCTGCCTCAGTATGGAGGATTGTCAACTACTCTCCATCACAGCAGTAGGTGTGATGTAGAAGAGTGATTGTCACACTGTGTGTGTTGCAAATTTGCAACACAGTGATTACTAATATAAAAAATACTCTTGAGTTAACCTTTGGC

SEQ ID NO: 995 - DNA, 1938 bp, Zea mays
  misc_feature (1)..(1938): Ceres cDNA ID no. 12391333
  misc_feature (1)..(1938): Ceres CLONE  ID no. 339822
  misc_feature (1)..(1938): Also known as  Ceres CDNA ID no. 23767278
gcacgagaccattacctagaacatcctaatcgaaaatgcctcgcctcagtcctcctctccggccgcttgctgttgctgctcccacccatctcctcaaccacctgagctcctcgccctctctgccctctctggtcttcaattcgttcgagctgaactcgagggcaacaattcgctccgatccattccatccaccccgtcgatccatccagcggtcctcctccccgtcccagtcccagaaatgggcaagaacggcctggtctccatcttctcccggctcgtggactccgccgcccccacctccacgtccgccgccgccgccgccacgccgtggcagtggtcggcctgcggtaccaaccctcagacgacctccttccgcgcaggcgcaggcggcggcgacgacgagccctgctgcacggcgacgccgcccacggcagcagcagcagcagcagcagccagtcgatccgtccaccggaagccggctgcgatgggccgcggcgcgccgcccggcgaaatgtacaagacggtcaactcggtcttcctggacgaccccgccgcggacgacttcttcttctccctcgccggcgacggcgacgacgaggaggaggtggcggggctctacctcgacgacgacgacgacgacgacgggttctcgaccaccacggcgtccgaggagtggtcggaggaggccgtgatccgcagcctgggccgcacgtccaccgaccgcttcttcttcgacccgcagcctggcccgctgccggcgtccaactccatcctcgccaccacggccgcggccgccgccgagacgccggcgaggaagaagacggtcccggtcccagtcccagggccgacagaggaggaagacgcaacggcaacgcacgcggacgagggcgacggcgtcaagaagcagcggcaaccgacgacgacgacgacggcagcggcggcggtcgtcgtcgtctctggcggagcgcagcgtggcggtggcggtggactcgggcgacccgtacggcgacttccgggcgtccatggaggagatggtgtcggcgcacgggctccgcgactgggcgcagctggaggagctcctggcgtggtacctccggatcaacgggaagcagcaccaccacctgatcgtgggcgccttcgtggacctgctcctcggcctgtccacgtcctcgccctcctcctcctcctcctcctcctcctcctccgcgccctgcagcaccgccgccgagaccagcaccaccaccaccaccaccacgagcagcaccagcaccggctgcagctgcagctgcgcgtgcgcctgctgcacggccgccgccgctacgaccatcagtggcagcgtcgccggcgacgccgtcacagcctccgccgccaccgccgccggccgacgttcaggtggacgtggtggaggatgaggatgaggaggaggcatgcaaagcgctggtcctgtagacctgtgctgctggcagcgacgacggtgatcggtcgtgcccgcagtccgcgccaccaccagtagcgctggtcctgtagacctgtgctgctggcagcgacgacggtgatcggtcgtgcccgcagtccgcgccaccaccagtagtgctccacccactgcgcgcggcctgagtggatgacctgctaatctccatacctttacctcctggctcctgcttgctgctgatggttagtgttctaacgacatgatgattaaattaactggacgctgtcactaacactctctcgccatgtagtactggtgcgcgtagcaatagtagactagtagtaggagcagttggttggtgcggatcgaatcgaaggatccaatgcaatgtaaagtaactgtacctgtacgtgtagtgtaggtagagggtttcgagagagagaaaaatcaacggtttttatttccagtacgggtataaatgtataaagaccttcatttctactccc

SEQ ID NO: 996 - protein, 1938 aa, Zea mays
  misc_feature: PFam Name: GATase_2; PFam Description: Glutamine
  misc_feature: PFam Name: LMBR1; PFam Description: LMBR1-like membrane protein
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: GI Number: 15145795; NR Description: basic proline-rich
  misc_feature: GI Number: 15145793; NR Description: basic proline-rich
  misc_feature: GI Number: 6523547; NR Description: hydroxyproline-rich
  misc_feature: GI Number: 5821151; NR Description: RNA binding protein [Homo
  misc_feature: GI Number: 15145797; NR Description: basic proline-rich
GCACGAGACCATTACCTAGAACATCCTAATCGAAAATGCCTCGCCTCAGTCCTCCTCTCCGGCCGCTTGCTGTTGCTGCTCCCACCCATCTCCTCAACCACCTGAGCTCCTCGCCCTCTCTGCCCTCTCTGGTCTTCAATTCGTTCGAGCTGAACTCGAGGGCAACAATTCGCTCCGATCCATTCCATCCACCCCGTCGATCCATCCAGCGGTCCTCCTCCCCGTCCCAGTCCCAGAAATGGGCAAGAACGGCCTGGTCTCCATCTTCTCCCGGCTCGTGGACTCCGCCGCCCCCACCTCCACGTCCGCCGCCGCCGCCGCCACGCCGTGGCAGTGGTCGGCCTGCGGTACCAACCCTCAGACGACCTCCTTCCGCGCAGGCGCAGGCGGCGGCGACGACGAGCCCTGCTGCACGGCGACGCCGCCCACGGCAGCAGCAGCAGCAGCAGCAGCCAGTCGATCCGTCCACCGGAAGCCGGCTGCGATGGGCCGCGGCGCGCCGCCCGGCGAAATGTACAAGACGGTCAACTCGGTCTTCCTGGACGACCCCGCCGCGGACGACTTCTTCTTCTCCCTCGCCGGCGACGGCGACGACGAGGAGGAGGTGGCGGGGCTCTACCTCGACGACGACGACGACGACGACGGGTTCTCGACCACCACGGCGTCCGAGGAGTGGTCGGAGGAGGCCGTGATCCGCAGCCTGGGCCGCACGTCCACCGACCGCTTCTTCTTCGACCCGCAGCCTGGCCCGCTGCCGGCGTCCAACTCCATCCTCGCCACCACGGCCGCGGCCGCCGCCGAGACGCCGGCGAGGAAGAAGACGGTCCCGGTCCCAGTCCCAGGGCCGACAGAGGAGGAAGACGCAACGGCAACGCACGCGGACGAGGGCGACGGCGTCAAGAAGCAGCGGCAACCGACGACGACGACGACGGCAGCGGCGGCGGTCGTCGTCGTCTCTGGCGGAGCGCAGCGTGGCGGTGGCGGTGGACTCGGGCGACCCGTACGGCGACTTCCGGGCGTCCATGGAGGAGATGGTGTCGGCGCACGGGCTCCGCGACTGGGCGCAGCTGGAGGAGCTCCTGGCGTGGTACCTCCGGATCAACGGGAAGCAGCACCACCACCTGATCGTGGGCGCCTTCGTGGACCTGCTCCTCGGCCTGTCCACGTCCTCGCCCTCCTCCTCCTCCTCCTCCTCCTCCTCCTCCGCGCCCTGCAGCACCGCCGCCGAGACCAGCACCACCACCACCACCACCACGAGCAGCACCAGCACCGGCTGCAGCTGCAGCTGCGCGTGCGCCTGCTGCACGGCCGCCGCCGCTACGACCATCAGTGGCAGCGTCGCCGGCGACGCCGTCACAGCCTCCGCCGCCACCGCCGCCGGCCGACGTTCAGGTGGACGTGGTGGAGGATGAGGATGAGGAGGAGGCATGCAAAGCGCTGGTCCTGTAGACCTGTGCTGCTGGCAGCGACGACGGTGATCGGTCGTGCCCGCAGTCCGCGCCACCACCAGTAGCGCTGGTCCTGTAGACCTGTGCTGCTGGCAGCGACGACGGTGATCGGTCGTGCCCGCAGTCCGCGCCACCACCAGTAGTGCTCCACCCACTGCGCGCGGCCTGAGTGGATGACCTGCTAATCTCCATACCTTTACCTCCTGGCTCCTGCTTGCTGCTGATGGTTAGTGTTCTAACGACATGATGATTAAATTAACTGGACGCTGTCACTAACACTCTCTCGCCATGTAGTACTGGTGCGCGTAGCAATAGTAGACTAGTAGTAGGAGCAGTTGGTTGGTGCGGATCGAATCGAAGGATCCAATGCAATGTAAAGTAACTGTACCTGTACGTGTAGTGTAGGTAGAGGGTTTCGAGAGAGAGAAAAATCAACGGTTTTTATTTCCAGTACGGGTATAAATGTATAAAGACCTTCATTTCTACTCCC

SEQ ID NO: 997 - DNA, 1962 bp, Zea mays
  misc_feature (1)..(1962): Ceres cDNA ID no. 12391483
  misc_feature (1)..(1962): Ceres CLONE  ID no. 454481
  misc_feature (1)..(1962): Also known as  Ceres CDNA ID no. 23807928
cgccttcgccatttctccgctcctccgcctcgcctcgcctcgcccatcgttccatgtctttctcctccggcggtcaccacccctcccggccggaccaaccccggatcccatttccagttagatgcttccccttcaccaccaccccgccgccgcgccggagtcggcggccccggcgacagaccctccgcccccgccggtcctcgatccgtcctccctccgcatccacatcccgtcaagcccgcaccacgcactgccctccaccccgcacaagcgccccgtcgtcatgacctcgtcgtcctcctcgtccacccccacccgcccctcaccgttgcccttcaccccgcctcggaggcgcaaggtccccgcgcccgctgctcccgcggggacagcggcggccaggcatctccttcgctgcctgcacctccgcctgcgtgtcctcctcctcatctcgcttccctccctctactttctctccccgacccctgccatttttccgcgctccctcctcgccgacttcctttccgcggcggccttctcctgcgcgctcctccttctcctctgcctctccctgccgcggcttcccttcgcgctgacgctgccgctccccctccgccgcgcgcgccgatcccccatcctttggtccatcggttcctcgccatccgcatctgcgaccacccccacaaccggccatttcgtccaggtttatagcaacggtgacgtctacgagggccagttccaccgcggccgctgcactggcagcggcgtctactactactacatgagcgggaggtacgagggagattgggtcgacggcaagtacagcggcttcggcgtcgagacatgggccagaggtagccggtaccggggccagtaccggcagggactcaggcatggctacggcgtgtacaggttctacactggggatgtgtatgccggggagtggtcaaacggccagagccatgggtatggtgtgcacacctgtgaggacggtagccggtatataggggagtttaagaggggcgtcaagcatggtctcggccactaccatttcaggaatggtgacacctacgctggagagtactttgctgataggatgcacggctttggaatctacagctttgccaatggccatagatatgagggagcatggcatgagggtagaaggcagggtttaggcatgtatagtttcaggaatggagagacacaagctgggcactggcaaaatggagttcttgatactttaagcacccagaacttcatccctggatcacctattgctgtgaaccattccaaggtcctcaatgcagtgcaggaagcgagaagagctgcagagaaggcctatgacatcccaagagttgatgataaggtgaacagggcggttgcagcagctaataaagcagccaatgcagccagggtggctgccgtgaaggctgcacaaaagcgcatccccagtaatggtgacgatctaccactgtcagtagtgtgacaatgaagccaatatatgttggcatggagctgcttcgcgatgccatcgcatcaccaattgcccgacataaccttcaacttcccagtaggtgaagccactgctcgtccatcaggccatggcgtgttggcgacacctgagtcattgccagcagcattcaagcttgcgggagaagaccaagttttcagccatcccttccatacatctttgtgatgtcttttgcgatgcagcagaaccactgctctgaggactttccattgtccaaggcagccggtcgaggtcagcagtaggttttatcctgccttttctgcagtgtaatactcacccgatgttagtagagatatgatgaatgtacaccccaacatcagtcgataaaaaactgtgtttattttctctcttggactatgtacagaacctacaaatttagcggttgttggccgtgctggttggagaaacgacaggtgccttcgggttcggtc

SEQ ID NO: 998 - protein, 1962 aa, Zea mays
  misc_feature: PFam Name: Pyr_redox_2; PFam Description: Pyridine
  misc_feature: PFam Name: FH2; PFam Description: Formin Homology 2 Domain
  misc_feature: PFam Name: MORN; PFam Description: MORN repeat
  misc_feature: PFam Name: Extensin_2; PFam Description: Extensin-like region
  misc_feature: PFam Name: Atrophin-1; PFam Description: Atrophin-1 family
  misc_feature: GI Number: 37536922; NR Description: putative phosphatidylinositol-4-phosphate 5-kinase [Oryza sativa (japonica cultivar-group)] >gi|12597886|gb|AAG60194.1| putative phosphatidylinositol-4-phosphate 5-kinase [Oryza sativa]
  misc_feature: GI Number: 21928129; NR Description: AT4g17080/dl4570w [Arabidopsis thaliana] >gi|27764944|gb|AAO23593.1|
  misc_feature: GI Number: 23297433; NR Description: putative phosphatidylinositol-4-phosphate 5-kinase [Arabidopsis thaliana] >gi|13878045|gb|AAK44100.1| putative phosphatidylinositol-4-phosphate 5-kinase [Arabidopsis thaliana]
  misc_feature: GI Number: 21593251; NR Description: phosphatidylinositol-4-phosphate 5-kinase, putative [Arabidopsis
  misc_feature: GI Number: 51535948; NR Description: 1-phosphatidylinositol-4-phosphate 5-kinase-like protein [Oryza
CGCCTTCGCCATTTCTCCGCTCCTCCGCCTCGCCTCGCCTCGCCCATCGTTCCATGTCTTTCTCCTCCGGCGGTCACCACCCCTCCCGGCCGGACCAACCCCGGATCCCATTTCCAGTTAGATGCTTCCCCTTCACCACCACCCCGCCGCCGCGCCGGAGTCGGCGGCCCCGGCGACAGACCCTCCGCCCCCGCCGGTCCTCGATCCGTCCTCCCTCCGCATCCACATCCCGTCAAGCCCGCACCACGCACTGCCCTCCACCCCGCACAAGCGCCCCGTCGTCATGACCTCGTCGTCCTCCTCGTCCACCCCCACCCGCCCCTCACCGTTGCCCTTCACCCCGCCTCGGAGGCGCAAGGTCCCCGCGCCCGCTGCTCCCGCGGGGACAGCGGCGGCCAGGCATCTCCTTCGCTGCCTGCACCTCCGCCTGCGTGTCCTCCTCCTCATCTCGCTTCCCTCCCTCTACTTTCTCTCCCCGACCCCTGCCATTTTTCCGCGCTCCCTCCTCGCCGACTTCCTTTCCGCGGCGGCCTTCTCCTGCGCGCTCCTCCTTCTCCTCTGCCTCTCCCTGCCGCGGCTTCCCTTCGCGCTGACGCTGCCGCTCCCCCTCCGCCGCGCGCGCCGATCCCCCATCCTTTGGTCCATCGGTTCCTCGCCATCCGCATCTGCGACCACCCCCACAACCGGCCATTTCGTCCAGGTTTATAGCAACGGTGACGTCTACGAGGGCCAGTTCCACCGCGGCCGCTGCACTGGCAGCGGCGTCTACTACTACTACATGAGCGGGAGGTACGAGGGAGATTGGGTCGACGGCAAGTACAGCGGCTTCGGCGTCGAGACATGGGCCAGAGGTAGCCGGTACCGGGGCCAGTACCGGCAGGGACTCAGGCATGGCTACGGCGTGTACAGGTTCTACACTGGGGATGTGTATGCCGGGGAGTGGTCAAACGGCCAGAGCCATGGGTATGGTGTGCACACCTGTGAGGACGGTAGCCGGTATATAGGGGAGTTTAAGAGGGGCGTCAAGCATGGTCTCGGCCACTACCATTTCAGGAATGGTGACACCTACGCTGGAGAGTACTTTGCTGATAGGATGCACGGCTTTGGAATCTACAGCTTTGCCAATGGCCATAGATATGAGGGAGCATGGCATGAGGGTAGAAGGCAGGGTTTAGGCATGTATAGTTTCAGGAATGGAGAGACACAAGCTGGGCACTGGCAAAATGGAGTTCTTGATACTTTAAGCACCCAGAACTTCATCCCTGGATCACCTATTGCTGTGAACCATTCCAAGGTCCTCAATGCAGTGCAGGAAGCGAGAAGAGCTGCAGAGAAGGCCTATGACATCCCAAGAGTTGATGATAAGGTGAACAGGGCGGTTGCAGCAGCTAATAAAGCAGCCAATGCAGCCAGGGTGGCTGCCGTGAAGGCTGCACAAAAGCGCATCCCCAGTAATGGTGACGATCTACCACTGTCAGTAGTGTGACAATGAAGCCAATATATGTTGGCATGGAGCTGCTTCGCGATGCCATCGCATCACCAATTGCCCGACATAACCTTCAACTTCCCAGTAGGTGAAGCCACTGCTCGTCCATCAGGCCATGGCGTGTTGGCGACACCTGAGTCATTGCCAGCAGCATTCAAGCTTGCGGGAGAAGACCAAGTTTTCAGCCATCCCTTCCATACATCTTTGTGATGTCTTTTGCGATGCAGCAGAACCACTGCTCTGAGGACTTTCCATTGTCCAAGGCAGCCGGTCGAGGTCAGCAGTAGGTTTTATCCTGCCTTTTCTGCAGTGTAATACTCACCCGATGTTAGTAGAGATATGATGAATGTACACCCCAACATCAGTCGATAAAAAACTGTGTTTATTTTCTCTCTTGGACTATGTACAGAACCTACAAATTTAGCGGTTGTTGGCCGTGCTGGTTGGAGAAACGACAGGTGCCTTCGGGTTCGGTC

SEQ ID NO: 999 - DNA, 1431 bp, Arabidopsis thaliana
  misc_feature (1)..(1431): Ceres cDNA ID no. 12391663
  misc_feature (1)..(1431): Ceres CLONE  ID no. 37799
  misc_feature (1)..(1431): Also known as  Ceres CDNA ID no. 23382758
aaatatcacattcaaagctttgatttttattttctctttcgacgaaaatctcaaaactttaagatcctttatttctgatctctcttcgaagtttcggtttttgttttcttaattgtcaagtcatttcatcgatgtcaggatatcctccgactagccaaggttacggttacggttacggcggcggtaatcaacctccaccacctcaaccaccttactcttccggcggaaacaatcctccctacggatcatcaacaacctcttctccttacgctgtaccctacggcgcatctaaaccacaatcatcatcctcttctgcgccgacgtacggatcttcatcatacggagcaccgcctccttcagctccgtacgcgccttctccaggagactacaacaagccgccaaaggagaaaccatacggaggaggctacggagctccaccaccgtctggatcttcagattacggaagttacggtgctggacctcgtccgtcgcagccgtctgggcacggtggaggatacggagctactccaccgcatggggtttctgactatggaagttacggtggtgctccacctcgtccagcgtcttctggtcacggtggcggatacggaggttatcctccgcaagcctcttatggaagtccttttgcttctctgattccgtcaggttttgctccggggacagatccgaatatagtggcttgctttcaggctgcagatcaagatggtagtggctttattgatgataaggagcttcaaggagctctctcttcttatcaacagagattcagtatgagaactgttcatcttcttatgtatctattcaccaatagcaatgctatgaaaatcggacctaaggagtttactgcacttttctacagtcttcagaactggaggtccatttttgagaggtctgataaggacaggagtggaagaatagatgtgaatgagctgagagatgcgcttttgagccttgggttttcggtttctcctgtggttttggatctgctggtttccaagtttgacaaaagcggaggcaagaacagggctatcgaatatgacaatttcattgagtgctgtctcactgttaaggggctgacagagaagttcaaggagaaggacacagcatactcaggctcagctactttcaactacgaaagcttcatgctcaccgtcctccccttcctcatcgcataagttttttttacggtaacccgtttgcacatcttctgtttttttgtatgttctttgttgtgtgaatgctattgtcaatggaagcttttccggtttagttgaactcaagagtttataaaaaaaatgtgaaatgtatagtgagagatcttgtgttataaaataatcaaacaactcattatggttggatattattacatcttgtttattggaatacatgtataaaagaaaaactttatgc

SEQ ID NO: 1000 - protein, 1431 aa, Arabidopsis thaliana
  misc_feature: PFam Name: Drf_FH1; PFam Description: Formin Homology Region 1
  misc_feature: PFam Name: efhand; PFam Description: EF hand
  misc_feature: PFam Name: FH2; PFam Description: Formin Homology 2 Domain
  misc_feature: PFam Name: GRP; PFam Description: Glycine rich protein family
  misc_feature: PFam Name: Extensin_2; PFam Description: Extensin-like region
  misc_feature: GI Number: 31711842; NR Description: At5g04170 [Arabidopsis thaliana] >gi|9955572|emb|CAC05499.1| EF-hand Calcium binding protein-like [Arabidopsis thaliana] >gi|19698991|gb|AAL91231.1| EF-hand calcium binding protein-like [Arabidopsis thaliana]
  misc_feature: GI Number: 30681239; NR Description: calcium-binding EF-hand
  misc_feature: GI Number: 6624721; NR Description: putative cysteine
  misc_feature: GI Number: 30681234; NR Description: calcium-binding EF-hand
  misc_feature: GI Number: 17512472; NR Description: RIKEN cDNA 2600002E23
AAATATCACATTCAAAGCTTTGATTTTTATTTTCTCTTTCGACGAAAATCTCAAAACTTTAAGATCCTTTATTTCTGATCTCTCTTCGAAGTTTCGGTTTTTGTTTTCTTAATTGTCAAGTCATTTCATCGATGTCAGGATATCCTCCGACTAGCCAAGGTTACGGTTACGGTTACGGCGGCGGTAATCAACCTCCACCACCTCAACCACCTTACTCTTCCGGCGGAAACAATCCTCCCTACGGATCATCAACAACCTCTTCTCCTTACGCTGTACCCTACGGCGCATCTAAACCACAATCATCATCCTCTTCTGCGCCGACGTACGGATCTTCATCATACGGAGCACCGCCTCCTTCAGCTCCGTACGCGCCTTCTCCAGGAGACTACAACAAGCCGCCAAAGGAGAAACCATACGGAGGAGGCTACGGAGCTCCACCACCGTCTGGATCTTCAGATTACGGAAGTTACGGTGCTGGACCTCGTCCGTCGCAGCCGTCTGGGCACGGTGGAGGATACGGAGCTACTCCACCGCATGGGGTTTCTGACTATGGAAGTTACGGTGGTGCTCCACCTCGTCCAGCGTCTTCTGGTCACGGTGGCGGATACGGAGGTTATCCTCCGCAAGCCTCTTATGGAAGTCCTTTTGCTTCTCTGATTCCGTCAGGTTTTGCTCCGGGGACAGATCCGAATATAGTGGCTTGCTTTCAGGCTGCAGATCAAGATGGTAGTGGCTTTATTGATGATAAGGAGCTTCAAGGAGCTCTCTCTTCTTATCAACAGAGATTCAGTATGAGAACTGTTCATCTTCTTATGTATCTATTCACCAATAGCAATGCTATGAAAATCGGACCTAAGGAGTTTACTGCACTTTTCTACAGTCTTCAGAACTGGAGGTCCATTTTTGAGAGGTCTGATAAGGACAGGAGTGGAAGAATAGATGTGAATGAGCTGAGAGATGCGCTTTTGAGCCTTGGGTTTTCGGTTTCTCCTGTGGTTTTGGATCTGCTGGTTTCCAAGTTTGACAAAAGCGGAGGCAAGAACAGGGCTATCGAATATGACAATTTCATTGAGTGCTGTCTCACTGTTAAGGGGCTGACAGAGAAGTTCAAGGAGAAGGACACAGCATACTCAGGCTCAGCTACTTTCAACTACGAAAGCTTCATGCTCACCGTCCTCCCCTTCCTCATCGCATAAGTTTTTTTTACGGTAACCCGTTTGCACATCTTCTGTTTTTTTGTATGTTCTTTGTTGTGTGAATGCTATTGTCAATGGAAGCTTTTCCGGTTTAGTTGAACTCAAGAGTTTATAAAAAAAATGTGAAATGTATAGTGAGAGATCTTGTGTTATAAAATAATCAAACAACTCATTATGGTTGGATATTATTACATCTTGTTTATTGGAATACATGTATAAAAGAAAAACTTTATGC

SEQ ID NO: 1001 - DNA, 1521 bp, Arabidopsis thaliana
  misc_feature (1)..(1521): Ceres cDNA ID no. 12394809
  misc_feature (1)..(1521): Ceres CLONE  ID no. 8599
  misc_feature (1)..(1521): Also known as  Ceres CDNA ID no. 23384559
agctcctttctactaaaacccttttactataaattctacgtacacgtaccacttcttctcctcaaattcatcaaacccatttctattccaactcccaaaaatggcgattcgtcttcctctgatctgtcttcttggttcattcatggtagtggcgattgcggctgatttaacaccggagcgttattggagcactgctttaccaaacactcccattcccaactctctccataatcttttgactttcgattttaccgacgagaaaagtaccaacgtccaagtaggtaaaggcggagtaaacgttaacacccataaaggtaaaaccggtagcggaaccgccgtgaacgttggaaagggaggtgtacgcgtggacacaggcaagggcaagcccggaggagggacacacgtgagcgttggcagcggaaaaggtcacggaggtggcgtcgcagtccacacgggtaaacccggtaaaagaaccgacgtaggagtcggtaaaggcggtgtgacggtgcacacgcgccacaagggaagaccgatttacgttggtgtgaaaccaggagcaaaccctttcgtgtataactatgcagcgaaggagactcagctccacgacgatcctaacgcggctctcttcttcttggagaaggacttggttcgcgggaaagaaatgaatgtccggtttaacgctgaggatggttacggaggcaaaactgcgttcttgccacgtggagaggctgaaacggtgccttttggatcggagaagttttcggagacgttgaaacgtttctcggtggaagctggttcggaagaagcggagatgatgaagaagaccattgaggagtgtgaagccagaaaagttagtggagaggagaagtattgtgcgacgtctttggagtcgatggtcgactttagtgtttcgaaacttggtaaatatcacgtcagggctgtttccactgaggtggctaagaagaacgcaccgatgcagaagtacaaaatcgcggcggctggggtaaagaagttgtctgacgataaatctgtggtgtgtcacaaacagaagtacccattcgcggtgttctactgccacaaggcgatgatgacgaccgtctacgcggttccgctcgagggagagaacgggatgcgagctaaagcagttgcggtatgccacaagaacacctcagcttggaacccaaaccacttggccttcaaagtcttaaaggtgaagccagggaccgttccggtctgccacttcctcccggagactcatgttgtgtggttcagctactagatagatctgttttctatcttattgtgggttatgtataattacgtttcagataatctatcttttgggatgttttggttatgaatatacatacatatacatatagtaatgcgtggtttccatataagagtgaaggcatctatatgtttttttttttattaacctacgtagctgtcttttgtggtctgtatcttgtggttttgcaaaaacctataataaaattagagctgaaatgttaccatttc

SEQ ID NO: 1002 - protein, 1521 aa, Arabidopsis thaliana
  misc_feature: PFam Name: BURP; PFam Description: BURP domain
  misc_feature: PFam Name: Protamine_P1; PFam Description: Protamine P1
  misc_feature: GI Number: 32815851; NR Description: At5g25610/T14C9_150 [Arabidopsis thaliana] >gi|391608|dbj|BAA01546.1| rd22 [Arabidopsis thaliana] >gi|19699081|gb|AAL90908.1| AT5g25610/T14C9_150 [Arabidopsis thaliana]
  misc_feature: GI Number: 34100944; NR Description: BURP domain-containing
  misc_feature: GI Number: 49615303; NR Description: dehydration-induced
  misc_feature: GI Number: 16588826; NR Description: dehydration-responsive
  misc_feature: GI Number: 54645911; NR Description: RD22-like protein [Vitis
AGCTCCTTTCTACTAAAACCCTTTTACTATAAATTCTACGTACACGTACCACTTCTTCTCCTCAAATTCATCAAACCCATTTCTATTCCAACTCCCAAAAATGGCGATTCGTCTTCCTCTGATCTGTCTTCTTGGTTCATTCATGGTAGTGGCGATTGCGGCTGATTTAACACCGGAGCGTTATTGGAGCACTGCTTTACCAAACACTCCCATTCCCAACTCTCTCCATAATCTTTTGACTTTCGATTTTACCGACGAGAAAAGTACCAACGTCCAAGTAGGTAAAGGCGGAGTAAACGTTAACACCCATAAAGGTAAAACCGGTAGCGGAACCGCCGTGAACGTTGGAAAGGGAGGTGTACGCGTGGACACAGGCAAGGGCAAGCCCGGAGGAGGGACACACGTGAGCGTTGGCAGCGGAAAAGGTCACGGAGGTGGCGTCGCAGTCCACACGGGTAAACCCGGTAAAAGAACCGACGTAGGAGTCGGTAAAGGCGGTGTGACGGTGCACACGCGCCACAAGGGAAGACCGATTTACGTTGGTGTGAAACCAGGAGCAAACCCTTTCGTGTATAACTATGCAGCGAAGGAGACTCAGCTCCACGACGATCCTAACGCGGCTCTCTTCTTCTTGGAGAAGGACTTGGTTCGCGGGAAAGAAATGAATGTCCGGTTTAACGCTGAGGATGGTTACGGAGGCAAAACTGCGTTCTTGCCACGTGGAGAGGCTGAAACGGTGCCTTTTGGATCGGAGAAGTTTTCGGAGACGTTGAAACGTTTCTCGGTGGAAGCTGGTTCGGAAGAAGCGGAGATGATGAAGAAGACCATTGAGGAGTGTGAAGCCAGAAAAGTTAGTGGAGAGGAGAAGTATTGTGCGACGTCTTTGGAGTCGATGGTCGACTTTAGTGTTTCGAAACTTGGTAAATATCACGTCAGGGCTGTTTCCACTGAGGTGGCTAAGAAGAACGCACCGATGCAGAAGTACAAAATCGCGGCGGCTGGGGTAAAGAAGTTGTCTGACGATAAATCTGTGGTGTGTCACAAACAGAAGTACCCATTCGCGGTGTTCTACTGCCACAAGGCGATGATGACGACCGTCTACGCGGTTCCGCTCGAGGGAGAGAACGGGATGCGAGCTAAAGCAGTTGCGGTATGCCACAAGAACACCTCAGCTTGGAACCCAAACCACTTGGCCTTCAAAGTCTTAAAGGTGAAGCCAGGGACCGTTCCGGTCTGCCACTTCCTCCCGGAGACTCATGTTGTGTGGTTCAGCTACTAGATAGATCTGTTTTCTATCTTATTGTGGGTTATGTATAATTACGTTTCAGATAATCTATCTTTTGGGATGTTTTGGTTATGAATATACATACATATACATATAGTAATGCGTGGTTTCCATATAAGAGTGAAGGCATCTATATGTTTTTTTTTTTATTAACCTACGTAGCTGTCTTTTGTGGTCTGTATCTTGTGGTTTTGCAAAAACCTATAATAAAATTAGAGCTGAAATGTTACCATTTC

SEQ ID NO: 1003 - DNA, 1704 bp, Arabidopsis thaliana
  misc_feature (1)..(1704): Ceres cDNA ID no. 12395036
  misc_feature (1)..(1704): Ceres CLONE  ID no. 147543
  misc_feature (1)..(1704): Also known as  Ceres CDNA ID no. 23384772
accatcgaaacagtgtcgtcgtagtctctctctctctccgcaaaatatcatcggagaaaagaaacagagacacgaaacagagaaaaccatgcagagattcgcggcgaaaagatcggtgcaaaacatttccgtctctctatggcgtcgatgtatctcatcgacgtctcaggcagcgacagcttccgttaaggattccgacgagtttcaggcgaggcttcctccttttgcttacactcctccgccgtatactggtccttccgccgatgttatccttagcaaaaggaaggagtttctcagtccttccatgttctgtctctatcggaaaccgttaaacattgtggatgggaaaatgcagtatctatttgatgagagtggtcggagatatttagatgcatttgctgggattgctgttgtgaattgtggacattgtcatccagatgtggttgagccagtgattaatcaaatcaagaggcttcagcatcctactgttctttaccttaaccatgccattgctgatttctctgaggctcttgcttctaaacttcccggtgatctaaaggtggtgtttttcactaactcagggacagaggctaatgaattggcgcttatgatggctaagttgtatactggatgtcaagatattgtggcggttcgaaacgggtatcatggtaatgcagctgcaactatgggggctactggtcagagtatgtggaagtttaatgtggttcagaatagtgttcatcatgctttgaaccctgatccttatagaggtgtgtttggttctgatggagagaagtatgcaaaggatttgcaagatcttattcaatatggtacgactggtcacattgccggttttatttgtgaagctattcagggagttggagggatcgtggaactagcaccgggatatttgtcagcggcttacgatactgttaagaaagctggtggattgttcattgcggatgaagttcagtctggtttcgcacgtactggtaacttttggggatttgaggcacacaatgttgtccctgacatagtaaccatggcaaagggaattgggaatgggtttcctttgggagctgttgtgacaactccagagatagcaggagtgttgactcgccgtagctacttcaatacatttggtggaaattctgtgtctactacagctggtctcgctgttctgaatgtgattgagaaagagaagcttcaggaaaatgctgcaatggttggatcctatctgaaagaaaaactcacacagctgaaagaaaaacacgagattatcggggatgtccggggaagaggactgatgcttggagtggagctggtgagtgatcgcaagcttaagactcctgcaaccgccgagactctgcacattatggatcaaatgaaagaattgggtgtgttgattggaaaaggaggctactttggaaatgtctttagaatcacaccacctctctgcttcaccaaggacgatgcagattttctcgtggaagcgatggactactcaatgtcgaagatgtgaagaaatggaaaatgatagatgatggttttatgaaatatggtttactaagttgtggtgaagaatgcttgtaattatgctatgaacgactacaagattgatgagccaacatctcgttgcttctcaatcactatgttttcttaatgttcacaactttgcttgtgtcaaaataaagtcacatcatt

SEQ ID NO: 1004 - protein, 1704 aa, Arabidopsis thaliana
  misc_feature: PFam Name: Aminotran_3; PFam Description: Aminotransferase
  misc_feature: GI Number: 25141217; NR Description: At4g39660/T19P19_50 [Arabidopsis thaliana] >gi|15809992|gb|AAL06923.1| AT4g39660/T19P19_50 [Arabidopsis thaliana] >gi|18420498|ref|NP_568064.1| alanine--glyoxylate
  misc_feature: GI Number: 5731259; NR Description: alanine:glyoxylate
  misc_feature: GI Number: 6403506; NR Description: putative aminotransferase [Arabidopsis thaliana] >gi|20466700|gb|AAM20667.1| putative aminotransferase [Arabidopsis thaliana] >gi|15231974|ref|NP_187498.1| alanine--glyoxylate
  misc_feature: GI Number: 52353685; NR Description: putative aminotransferase [Oryza sativa (japonica cultivar-group)] >gi|52353616|gb|AAU44182.1| putative aminotransferase class-III
  misc_feature: GI Number: 15028237; NR Description: putative
ACCATCGAAACAGTGTCGTCGTAGTCTCTCTCTCTCTCCGCAAAATATCATCGGAGAAAAGAAACAGAGACACGAAACAGAGAAAACCATGCAGAGATTCGCGGCGAAAAGATCGGTGCAAAACATTTCCGTCTCTCTATGGCGTCGATGTATCTCATCGACGTCTCAGGCAGCGACAGCTTCCGTTAAGGATTCCGACGAGTTTCAGGCGAGGCTTCCTCCTTTTGCTTACACTCCTCCGCCGTATACTGGTCCTTCCGCCGATGTTATCCTTAGCAAAAGGAAGGAGTTTCTCAGTCCTTCCATGTTCTGTCTCTATCGGAAACCGTTAAACATTGTGGATGGGAAAATGCAGTATCTATTTGATGAGAGTGGTCGGAGATATTTAGATGCATTTGCTGGGATTGCTGTTGTGAATTGTGGACATTGTCATCCAGATGTGGTTGAGCCAGTGATTAATCAAATCAAGAGGCTTCAGCATCCTACTGTTCTTTACCTTAACCATGCCATTGCTGATTTCTCTGAGGCTCTTGCTTCTAAACTTCCCGGTGATCTAAAGGTGGTGTTTTTCACTAACTCAGGGACAGAGGCTAATGAATTGGCGCTTATGATGGCTAAGTTGTATACTGGATGTCAAGATATTGTGGCGGTTCGAAACGGGTATCATGGTAATGCAGCTGCAACTATGGGGGCTACTGGTCAGAGTATGTGGAAGTTTAATGTGGTTCAGAATAGTGTTCATCATGCTTTGAACCCTGATCCTTATAGAGGTGTGTTTGGTTCTGATGGAGAGAAGTATGCAAAGGATTTGCAAGATCTTATTCAATATGGTACGACTGGTCACATTGCCGGTTTTATTTGTGAAGCTATTCAGGGAGTTGGAGGGATCGTGGAACTAGCACCGGGATATTTGTCAGCGGCTTACGATACTGTTAAGAAAGCTGGTGGATTGTTCATTGCGGATGAAGTTCAGTCTGGTTTCGCACGTACTGGTAACTTTTGGGGATTTGAGGCACACAATGTTGTCCCTGACATAGTAACCATGGCAAAGGGAATTGGGAATGGGTTTCCTTTGGGAGCTGTTGTGACAACTCCAGAGATAGCAGGAGTGTTGACTCGCCGTAGCTACTTCAATACATTTGGTGGAAATTCTGTGTCTACTACAGCTGGTCTCGCTGTTCTGAATGTGATTGAGAAAGAGAAGCTTCAGGAAAATGCTGCAATGGTTGGATCCTATCTGAAAGAAAAACTCACACAGCTGAAAGAAAAACACGAGATTATCGGGGATGTCCGGGGAAGAGGACTGATGCTTGGAGTGGAGCTGGTGAGTGATCGCAAGCTTAAGACTCCTGCAACCGCCGAGACTCTGCACATTATGGATCAAATGAAAGAATTGGGTGTGTTGATTGGAAAAGGAGGCTACTTTGGAAATGTCTTTAGAATCACACCACCTCTCTGCTTCACCAAGGACGATGCAGATTTTCTCGTGGAAGCGATGGACTACTCAATGTCGAAGATGTGAAGAAATGGAAAATGATAGATGATGGTTTTATGAAATATGGTTTACTAAGTTGTGGTGAAGAATGCTTGTAATTATGCTATGAACGACTACAAGATTGATGAGCCAACATCTCGTTGCTTCTCAATCACTATGTTTTCTTAATGTTCACAACTTTGCTTGTGTCAAAATAAAGTCACATCATT

SEQ ID NO: 1005 - DNA, 1670 bp, Arabidopsis thaliana
  misc_feature (1)..(1670): Ceres cDNA ID no. 12395089
  misc_feature (1)..(1670): Ceres CLONE  ID no. 99039
  misc_feature (1)..(1670): Also known as  Ceres CDNA ID no. 23384817
gttcttcttcgaacttctgcaactttgtttctcccaaatctgtgaatctcaagtgttcgtcttcaccatcatgctctctcgtttattccttagacattcgaatctccgtttcgtaaccctagtttcatcgaaatcaaattctcagatcttctcttcgtttattcgtccgctttcgactaacagtagcggcggcggaggaaatggtgacgggaatggtcgtaatcggaatgatgttccgtggagtttcactggagtaaacgatgataagtctggacctttctcttccgatgattcttttggttcttctggagttgcaggatctggtttacctggtggagaggggaaatggccggaggagcctaagagatggaatataaaggaggaagaggaaaaagttgtgtttgatactggtggtgaagtaggtcaagggattgagactagtcgcgagaggaggggtaatgaatgggaggagactaagagatgggatatgaaggagggagaggagaaagttgtgtttggtggcggaggagatgaggtggatgggtttggaatcaggggagaggtgaaatctaatgaatgggatgtgtcaaagccatggaatttgaaagaggaagaggagggagttgtgtttgatactggtggtgaagtgccgtttagctttgagaatagcttggaaatggcggaggaagagcgtgtgaagaaggagttgattgagaaggaagagaaggagcttcttgaggttatcaagggtcctgatcgagcatttggagaccttattgctaagtcaggtataacagatgaaatgctagatagtttaatagccttgaaagatttccaaggggtcgaaggattacctcctctgactgagattgaaaacctgcgtcgtgagaaaagttcaaagaagtcatcaagagctgagatagaactccagatgcaagaggacattgccaaagcacgggtgagacaagttgacgaaacaggtagagcctatggaactggaagaagaaaatgtagcattgcacgtgtttggattcaacctggggaaggaaaatttcaagttaatgaaaaagaatttgatgtctatttccctatgcttgatcatcgcgctgctcttctacgcccacttgctgaaaccaaaaccttgggtcgttgggatattaagtgcactgttaaaggcggtggtactacaggtcaagtcggagctattcaattgggtatcagcagggcactgcaaaactgggaaccagatatgcggacatcacttcgagctgctggtttcttgacaagagactctcgagttgtggaaagaaagaaacctggaaaagccaaggcaagaaagagcttccaatgggtcaaacgttgaatccgaaaatgcgtactatatcttctcctttttgtctctgtcattttcattagttcgtctacttatcccgggtttagaagaatcaccggcaaataacttgttcttttggttcaatcccgtagttatctttttgtaccaacacattcttctcttacggctctactcttggaaacttgagtttcgttggtttctgagtcggacacatatttttgtatgtttttttccggcaaattgtcatgtttcttcaaaaggttcattgatgtttaaacataatgatcaactccttatatggattatattattaggt

SEQ ID NO: 1006 - protein, 1670 aa, Arabidopsis thaliana
  misc_feature: PFam Name: Ribosomal_S9; PFam Description: Ribosomal protein
  misc_feature: GI Number: 50939755; NR Description: putative 30S ribosomal protein S9 [Oryza sativa (japonica cultivar-group)] >gi|33354201|dbj|BAC81159.1| putative 30S ribosomal protein S9 [Oryza sativa (japonica cultivar-group)]
  misc_feature: GI Number: 50939753; NR Description: putative 30S ribosomal protein S9 [Oryza sativa (japonica cultivar-group)] >gi|33354200|dbj|BAC81158.1| putative 30S ribosomal protein S9 [Oryza sativa (japonica cultivar-group)]
  misc_feature: GI Number: 49475551; NR Description: 30S ribosomal protein s9 [Bartonella henselae str. Houston-1] >gi|49238357|emb|CAF27581.1|
  misc_feature: GI Number: 61099742; NR Description: ribosomal protein S9 [Erythrobacter litoralis HTCC2594] gi|60738383|gb|EAL76637.1|
GTTCTTCTTCGAACTTCTGCAACTTTGTTTCTCCCAAATCTGTGAATCTCAAGTGTTCGTCTTCACCATCATGCTCTCTCGTTTATTCCTTAGACATTCGAATCTCCGTTTCGTAACCCTAGTTTCATCGAAATCAAATTCTCAGATCTTCTCTTCGTTTATTCGTCCGCTTTCGACTAACAGTAGCGGCGGCGGAGGAAATGGTGACGGGAATGGTCGTAATCGGAATGATGTTCCGTGGAGTTTCACTGGAGTAAACGATGATAAGTCTGGACCTTTCTCTTCCGATGATTCTTTTGGTTCTTCTGGAGTTGCAGGATCTGGTTTACCTGGTGGAGAGGGGAAATGGCCGGAGGAGCCTAAGAGATGGAATATAAAGGAGGAAGAGGAAAAAGTTGTGTTTGATACTGGTGGTGAAGTAGGTCAAGGGATTGAGACTAGTCGCGAGAGGAGGGGTAATGAATGGGAGGAGACTAAGAGATGGGATATGAAGGAGGGAGAGGAGAAAGTTGTGTTTGGTGGCGGAGGAGATGAGGTGGATGGGTTTGGAATCAGGGGAGAGGTGAAATCTAATGAATGGGATGTGTCAAAGCCATGGAATTTGAAAGAGGAAGAGGAGGGAGTTGTGTTTGATACTGGTGGTGAAGTGCCGTTTAGCTTTGAGAATAGCTTGGAAATGGCGGAGGAAGAGCGTGTGAAGAAGGAGTTGATTGAGAAGGAAGAGAAGGAGCTTCTTGAGGTTATCAAGGGTCCTGATCGAGCATTTGGAGACCTTATTGCTAAGTCAGGTATAACAGATGAAATGCTAGATAGTTTAATAGCCTTGAAAGATTTCCAAGGGGTCGAAGGATTACCTCCTCTGACTGAGATTGAAAACCTGCGTCGTGAGAAAAGTTCAAAGAAGTCATCAAGAGCTGAGATAGAACTCCAGATGCAAGAGGACATTGCCAAAGCACGGGTGAGACAAGTTGACGAAACAGGTAGAGCCTATGGAACTGGAAGAAGAAAATGTAGCATTGCACGTGTTTGGATTCAACCTGGGGAAGGAAAATTTCAAGTTAATGAAAAAGAATTTGATGTCTATTTCCCTATGCTTGATCATCGCGCTGCTCTTCTACGCCCACTTGCTGAAACCAAAACCTTGGGTCGTTGGGATATTAAGTGCACTGTTAAAGGCGGTGGTACTACAGGTCAAGTCGGAGCTATTCAATTGGGTATCAGCAGGGCACTGCAAAACTGGGAACCAGATATGCGGACATCACTTCGAGCTGCTGGTTTCTTGACAAGAGACTCTCGAGTTGTGGAAAGAAAGAAACCTGGAAAAGCCAAGGCAAGAAAGAGCTTCCAATGGGTCAAACGTTGAATCCGAAAATGCGTACTATATCTTCTCCTTTTTGTCTCTGTCATTTTCATTAGTTCGTCTACTTATCCCGGGTTTAGAAGAATCACCGGCAAATAACTTGTTCTTTTGGTTCAATCCCGTAGTTATCTTTTTGTACCAACACATTCTTCTCTTACGGCTCTACTCTTGGAAACTTGAGTTTCGTTGGTTTCTGAGTCGGACACATATTTTTGTATGTTTTTTTCCGGCAAATTGTCATGTTTCTTCAAAAGGTTCATTGATGTTTAAACATAATGATCAACTCCTTATATGGATTATATTATTAGGT

SEQ ID NO: 1007 - DNA, 2262 bp, Arabidopsis thaliana
  misc_feature (1)..(2262): Ceres cDNA ID no. 12395141
  misc_feature (1)..(2262): Ceres CLONE  ID no. 120626
  misc_feature (1)..(2262): Also known as  Ceres CDNA ID no. 23384869
agtttctcagcctcctcctccttctcttccttcttatatataaatatatccacaaaatcatctcttttgcttcgctgtttctctcattattccatctctcttatcgccgctacaaacgtttcttcttcaacctcgttcagagattatcctcccttcttttctcatcttacaaggaagttgggcagttaaagctgctgggatcaccagttttgtcaaaagtggagtgtgaagaatcttttatgtctgaacaggcttctctctttcaatcatctatccggcttttaggagagtactgtcctatatctaggaaaaagtccactcataaagttggtggtttgcgttttgaggaggacatcacgagctgtattggatttcagtttatgcaactgagtgattatcactgcctcttctgacatcccttgtttgtttacgtttgttgaatcaagatggctttgcaaaacattggtgcctccaaccgcgatgatgccttttataggtataagatgccgaggatgatgaccaagattgaaggtagaggtaacggtatcaagactaatgtggttaacatggttgagattgctaaggccttggggagacctgctgcttatactactaagtattttggttgtgagcttggtgcacagtctaagtttgatgagaagaatgggacctcgcttgtgaatggggctcatgacacttccaaacttgcaggattattggagaactttattaagaagtatgttcagtgttatggatgtgggaatcctgaaactgagatacttatcactaagacgcagatgcttcagctgaaatgtgcggcttgtgggtttctctcggatgttgatatgagggacaagctaacgtcgtttattttgaagaatcctccagagcagaagaagtcgtctaaggacaagaagtcgatgaggagagctgagaaggaaagactcagagaaggtgaagcagctgatgaagagatgaggaagctcaagaaggaggctgctagtaagaagaaagcagcgaccacgggtacttcgaaagacaaagtgtcgaagaagaaagatcattctccacctcgaagcctgtctgatgaaaatgaccaagcagacagtgaagaagatgatgacgatgtccagtggcaaacagatacttccagggaggctgctgagaaacgtatgaaagaacagctcagcgcggtaacagctgaaatggtgatgctgtctacagttgaagaaaaaaagccagtagctgaggtgaagaaggcaccagaacaagtgcatgagaatggcaatagcaagatccctgaaaatgctcatgaaaagcttgtgaatgagataaaggagcttctgagcagtggttcatctcctacccaactcaaaacagccctagcttcaaactcagcaaacccccaggagaaaatggacgccttattctctgccctctttggaggcacaggcaagggattcgcaaaagaggtgatcaagaagaagaaatatctcttggccttgatgatgatgcaagaagaagcaggagctcctgcgcagatgggtttgcttaatggaattgaatccttttgcatgaaggcaagcgcagaggctgccaaagaagttgctcttgttatcaaaggtctttacgatgaagacattttggatgaggatgtgattgttgaatggtacaataaaggtgtcaaaagctccccggttttgaagaacgtgactccgttcatcgagtggctccagaatgctgagtctgagtccgaggaagagtgatgctgtgtttctttttctttgtgtggttcaaaatttggtctgcgtcttgtgtgtgtctttctgtctggttcagtgtgcgtcttgaataaggtaagaggacactggcaaaggttacttctacttgttaagtaacactagtcactggtctctctgttgatggtttgtttatgttttgtccctttgtatttgtcatgacttagacaacttatgttgtataagttgtatgctttggttttatggttactacttttcttagaactactgtgacgattcctttgtgtttaattcgattaaacatattaggtattgttgagggttaccaaaacagatctttgtttcaagttgatccagggttctgtttgaaagtctctaacatatgaggatctggatcgacaatttcacgatcttgtttctttcttcgactacgatctctgatttaaactgtaaattttggctatatctctcgattgatcgccataacttaggcctaaacttt

SEQ ID NO: 1008 - protein, 2262 aa, Arabidopsis thaliana
  misc_feature: PFam Name: eIF-5_eIF-2B; PFam Description: Domain found in
  misc_feature: PFam Name: W2; PFam Description: eIF4-gamma/eIF5/eIF2-epsilon
  misc_feature: PFam Name: Caldesmon; PFam Description: Caldesmon
  misc_feature: GI Number: 1806575; NR Description: Eukaryotic initiation factor-5 [Zea mays] >gi|2494320|sp|P55876|IF5_MAIZE Eukaryotic translation initiation factor 5 (eIF-5) >gi|7489730|pir||JC5595
  misc_feature: GI Number: 4160402; NR Description: eukaryotic translation
  misc_feature: GI Number: 15810339; NR Description: putative eukaryotic
  misc_feature: GI Number: 21387159; NR Description: putative eukaryotic translation initiation factor 5 [Arabidopsis thaliana] >gi|17473619|gb|AAL38273.1| putative eukaryotic translation initiation factor 5 [Arabidopsis thaliana]
  misc_feature: GI Number: 53792080; NR Description: putative eukaryotic translation initiation factor 5 [Oryza sativa (japonica
AGTTTCTCAGCCTCCTCCTCCTTCTCTTCCTTCTTATATATAAATATATCCACAAAATCATCTCTTTTGCTTCGCTGTTTCTCTCATTATTCCATCTCTCTTATCGCCGCTACAAACGTTTCTTCTTCAACCTCGTTCAGAGATTATCCTCCCTTCTTTTCTCATCTTACAAGGAAGTTGGGCAGTTAAAGCTGCTGGGATCACCAGTTTTGTCAAAAGTGGAGTGTGAAGAATCTTTTATGTCTGAACAGGCTTCTCTCTTTCAATCATCTATCCGGCTTTTAGGAGAGTACTGTCCTATATCTAGGAAAAAGTCCACTCATAAAGTTGGTGGTTTGCGTTTTGAGGAGGACATCACGAGCTGTATTGGATTTCAGTTTATGCAACTGAGTGATTATCACTGCCTCTTCTGACATCCCTTGTTTGTTTACGTTTGTTGAATCAAGATGGCTTTGCAAAACATTGGTGCCTCCAACCGCGATGATGCCTTTTATAGGTATAAGATGCCGAGGATGATGACCAAGATTGAAGGTAGAGGTAACGGTATCAAGACTAATGTGGTTAACATGGTTGAGATTGCTAAGGCCTTGGGGAGACCTGCTGCTTATACTACTAAGTATTTTGGTTGTGAGCTTGGTGCACAGTCTAAGTTTGATGAGAAGAATGGGACCTCGCTTGTGAATGGGGCTCATGACACTTCCAAACTTGCAGGATTATTGGAGAACTTTATTAAGAAGTATGTTCAGTGTTATGGATGTGGGAATCCTGAAACTGAGATACTTATCACTAAGACGCAGATGCTTCAGCTGAAATGTGCGGCTTGTGGGTTTCTCTCGGATGTTGATATGAGGGACAAGCTAACGTCGTTTATTTTGAAGAATCCTCCAGAGCAGAAGAAGTCGTCTAAGGACAAGAAGTCGATGAGGAGAGCTGAGAAGGAAAGACTCAGAGAAGGTGAAGCAGCTGATGAAGAGATGAGGAAGCTCAAGAAGGAGGCTGCTAGTAAGAAGAAAGCAGCGACCACGGGTACTTCGAAAGACAAAGTGTCGAAGAAGAAAGATCATTCTCCACCTCGAAGCCTGTCTGATGAAAATGACCAAGCAGACAGTGAAGAAGATGATGACGATGTCCAGTGGCAAACAGATACTTCCAGGGAGGCTGCTGAGAAACGTATGAAAGAACAGCTCAGCGCGGTAACAGCTGAAATGGTGATGCTGTCTACAGTTGAAGAAAAAAAGCCAGTAGCTGAGGTGAAGAAGGCACCAGAACAAGTGCATGAGAATGGCAATAGCAAGATCCCTGAAAATGCTCATGAAAAGCTTGTGAATGAGATAAAGGAGCTTCTGAGCAGTGGTTCATCTCCTACCCAACTCAAAACAGCCCTAGCTTCAAACTCAGCAAACCCCCAGGAGAAAATGGACGCCTTATTCTCTGCCCTCTTTGGAGGCACAGGCAAGGGATTCGCAAAAGAGGTGATCAAGAAGAAGAAATATCTCTTGGCCTTGATGATGATGCAAGAAGAAGCAGGAGCTCCTGCGCAGATGGGTTTGCTTAATGGAATTGAATCCTTTTGCATGAAGGCAAGCGCAGAGGCTGCCAAAGAAGTTGCTCTTGTTATCAAAGGTCTTTACGATGAAGACATTTTGGATGAGGATGTGATTGTTGAATGGTACAATAAAGGTGTCAAAAGCTCCCCGGTTTTGAAGAACGTGACTCCGTTCATCGAGTGGCTCCAGAATGCTGAGTCTGAGTCCGAGGAAGAGTGATGCTGTGTTTCTTTTTCTTTGTGTGGTTCAAAATTTGGTCTGCGTCTTGTGTGTGTCTTTCTGTCTGGTTCAGTGTGCGTCTTGAATAAGGTAAGAGGACACTGGCAAAGGTTACTTCTACTTGTTAAGTAACACTAGTCACTGGTCTCTCTGTTGATGGTTTGTTTATGTTTTGTCCCTTTGTATTTGTCATGACTTAGACAACTTATGTTGTATAAGTTGTATGCTTTGGTTTTATGGTTACTACTTTTCTTAGAACTACTGTGACGATTCCTTTGTGTTTAATTCGATTAAACATATTAGGTATTGTTGAGGGTTACCAAAACAGATCTTTGTTTCAAGTTGATCCAGGGTTCTGTTTGAAAGTCTCTAACATATGAGGATCTGGATCGACAATTTCACGATCTTGTTTCTTTCTTCGACTACGATCTCTGATTTAAACTGTAAATTTTGGCTATATCTCTCGATTGATCGCCATAACTTAGGCCTAAACTTT

SEQ ID NO: 1009 - DNA, 1700 bp, Arabidopsis thaliana
  misc_feature (1)..(1700): Ceres cDNA ID no. 12395249
  misc_feature (1)..(1700): Ceres CLONE  ID no. 114877
  misc_feature (1)..(1700): Also known as  Ceres CDNA ID no. 23384973
aagacacgaaaaagaattttaccgactggaagaagaaaaaacatcaaccagacaaaagaaaagaaaacaaaaacacatcttcgagatcaaacaaaccctaattatcatccatcgtcgccttctcaatatatattgccggaagagcagcgatgctcgttaacgtcgggacggttataatgaccgttttgaccctggctagtttggtcggaggcttcggtgtgaattggggcaatatcgcatcacatccgttgaatcccaacattgttgttcagatgcttaaggacaataagatcaataaagtgaagctttttgacgctgattcatggacgatgaatgctttggctggtacgggcatggaggttatggttggaatccctaataaccttcttgagtctctcgcagatgattacgataatgctaaagattgggttaaagaaaacgtgacccagtatattcgtaagggtggcgtcgacatcaagtacgtagccgtggggaacgagccgtttttgtctgcatacaacggatcgttcttgaagacaacatttccagcgttaaagaacattcacaaggcgttaaaagaagctggacacaccaatataatgaaagccacgatcccacaaaacgcagaagtttaccaatcagccaacgacaagccatcagaaggtgatttccgcaaggatgtcaaacaaacgatgcttgatatcgtcaatttcttccacgaaaacgacttacctttcaccgtcaacatttaccctttccttagtctttacctaaacgagcattttcccgttgagttcgcttttcttgacggtgatggtcagacaatgactgacaaaggaaagaattatgataacgtgtttgacgccaattacgacacacttgtttacgcgttgaagaaggctgggattcacgatatgaagattatcgttggagaggttggatggccaacggatggtcacaaatatgcatcgccgaagctagcggagaaattctatgcagggcttatgaaaagacttgctaaggacggtgggactccaacgaggcctgaaagattagaggtctatctcttcggtttcctcgacgaagacatgaagagtattcttccagggccttttgagagacattggggaatctttagatacgatgggacaccaaagtttatgctagatttcacgggacaaggacgccaaatggtgcccgttgcagctaaaggtgtgcagtacttggaaaaacaatggtgcgtagtgaacaaagacacggtcaatctagacgaagttggtcctgatctagactatgcgtgttaccacggggactgcaccgcgatggaagccgggtcaacttgtagtaagctaaccaaagtccaaaacatatcatacgcatttaacatgtatttccagatacaagaccaagacgttagggcttgcgatttcaaaggagctgcaatgatcaccaaggtcaatgcatccgtgggaagttgcttgttccctgttcagatcgttagtggaagtgatgatttcaggatcaactttgtgttcggaagattcgtcgtctttggacttgttcttcttggattgctcacggttatataatttgtttttctgttgttgtttggttttctttttgcaatttggagggatttattcgacacgattaattgttatttgttattcgttttaaaaatgtttactttgagttagttc

SEQ ID NO: 1010 - protein, 1700 aa, Arabidopsis thaliana
  misc_feature: PFam Name: Glyco_hydro_17; PFam Description: Glycosyl
  misc_feature: PFam Name: X8; PFam Description: X8 domain
  misc_feature: GI Number: 46518473; NR Description: At1g64760 [Arabidopsis
  misc_feature: GI Number: 8843743; NR Description: beta-1,3-glucanase [Arabidopsis thaliana] >gi|15238256|ref|NP_201284.1| glycosyl
  misc_feature: GI Number: 37223500; NR Description: beta-1,3-glucanase,
  misc_feature: GI Number: 48374979; NR Description: putative 3-glucanase
  misc_feature: GI Number: 50919115; NR Description: putative beta-1,3 glucanase [Oryza sativa (japonica cultivar-group)] >gi|28269434|gb|AAO37977.1| putative beta-1,3 glucanase [Oryza
AAGACACGAAAAAGAATTTTACCGACTGGAAGAAGAAAAAACATCAACCAGACAAAAGAAAAGAAAACAAAAACACATCTTCGAGATCAAACAAACCCTAATTATCATCCATCGTCGCCTTCTCAATATATATTGCCGGAAGAGCAGCGATGCTCGTTAACGTCGGGACGGTTATAATGACCGTTTTGACCCTGGCTAGTTTGGTCGGAGGCTTCGGTGTGAATTGGGGCAATATCGCATCACATCCGTTGAATCCCAACATTGTTGTTCAGATGCTTAAGGACAATAAGATCAATAAAGTGAAGCTTTTTGACGCTGATTCATGGACGATGAATGCTTTGGCTGGTACGGGCATGGAGGTTATGGTTGGAATCCCTAATAACCTTCTTGAGTCTCTCGCAGATGATTACGATAATGCTAAAGATTGGGTTAAAGAAAACGTGACCCAGTATATTCGTAAGGGTGGCGTCGACATCAAGTACGTAGCCGTGGGGAACGAGCCGTTTTTGTCTGCATACAACGGATCGTTCTTGAAGACAACATTTCCAGCGTTAAAGAACATTCACAAGGCGTTAAAAGAAGCTGGACACACCAATATAATGAAAGCCACGATCCCACAAAACGCAGAAGTTTACCAATCAGCCAACGACAAGCCATCAGAAGGTGATTTCCGCAAGGATGTCAAACAAACGATGCTTGATATCGTCAATTTCTTCCACGAAAACGACTTACCTTTCACCGTCAACATTTACCCTTTCCTTAGTCTTTACCTAAACGAGCATTTTCCCGTTGAGTTCGCTTTTCTTGACGGTGATGGTCAGACAATGACTGACAAAGGAAAGAATTATGATAACGTGTTTGACGCCAATTACGACACACTTGTTTACGCGTTGAAGAAGGCTGGGATTCACGATATGAAGATTATCGTTGGAGAGGTTGGATGGCCAACGGATGGTCACAAATATGCATCGCCGAAGCTAGCGGAGAAATTCTATGCAGGGCTTATGAAAAGACTTGCTAAGGACGGTGGGACTCCAACGAGGCCTGAAAGATTAGAGGTCTATCTCTTCGGTTTCCTCGACGAAGACATGAAGAGTATTCTTCCAGGGCCTTTTGAGAGACATTGGGGAATCTTTAGATACGATGGGACACCAAAGTTTATGCTAGATTTCACGGGACAAGGACGCCAAATGGTGCCCGTTGCAGCTAAAGGTGTGCAGTACTTGGAAAAACAATGGTGCGTAGTGAACAAAGACACGGTCAATCTAGACGAAGTTGGTCCTGATCTAGACTATGCGTGTTACCACGGGGACTGCACCGCGATGGAAGCCGGGTCAACTTGTAGTAAGCTAACCAAAGTCCAAAACATATCATACGCATTTAACATGTATTTCCAGATACAAGACCAAGACGTTAGGGCTTGCGATTTCAAAGGAGCTGCAATGATCACCAAGGTCAATGCATCCGTGGGAAGTTGCTTGTTCCCTGTTCAGATCGTTAGTGGAAGTGATGATTTCAGGATCAACTTTGTGTTCGGAAGATTCGTCGTCTTTGGACTTGTTCTTCTTGGATTGCTCACGGTTATATAATTTGTTTTTCTGTTGTTGTTTGGTTTTCTTTTTGCAATTTGGAGGGATTTATTCGACACGATTAATTGTTATTTGTTATTCGTTTTAAAAATGTTTACTTTGAGTTAGTTC

SEQ ID NO: 1011 - DNA, 1449 bp, Arabidopsis thaliana
  misc_feature (1)..(1449): Ceres cDNA ID no. 12395555
  misc_feature (1)..(1449): Ceres CLONE  ID no. 112834
  misc_feature (1)..(1449): Also known as  Ceres CDNA ID no. 23385238
  misc_feature (1353)..(1353): n is a, c, t, g, unknown, or other
aaccactcatctcaatttctcccacggtctagattctctccgcttctatgtctttcccgagaaaattcgggacagcgattcacgccgctctatcttttatcgtcttcttcttcttcgacctcattgacgcgattctctgtgtcgtttacgagttcgtcgatgagattttggaagaaaactcaacaggctgttactgcacggcggcggctcctcaaagtctaaccaccgacgaaaatgagttgtcgtcggagactttattcgggaggagaaacagtttccgggaaatgtggtttctgggattcgcgagagaattcaaatccaagctttcccggaaactgagaaaatctaagattcatcaagagtcagtgaatcgatggtcagattgtggatgcaaatcttgcaagtcatggactaagaacgaagatgggaatcttcacgtcgtggtcaaagattctacttctcgagaaacagagtactctgttcaagaaccgtccgagaatgtaatattcatacacggttttatggggtcatcacatttttggacagaaactgtatttgaacacattcaaaaagatgattataggctcctcgcgatcgatcttttgggattcggggagagtcctaagccaagggatagtctctatacattgaaagatcatgtggatacgatagagagatctgtcattaagccataccaattagattcttttcatgtggttgcacattcaatgggttgcttaattgctcttgctttggctgctaaacattccaacattgttaaatccgttactcttgttgcaccgccttattttccttcatcggtagatggatcggtcttgaaccgaatcgctagaaagcggttgtggccaccgcttgcgtttgggacagcggtgatgtcttggtatgaacatattggtagatgcgtatgtttcataatctgcaagcatcataagatatgggagtggctaatcaagctatgtataggtaaaagggagattcattggaagatcaaggacataacaaggcacacacatcactctgcatggcatagtatgcacaatgtgatatgtggtggctccaaagtcgctgatgaacatcttgaaaccctaataaagtctggcgttaagattcacttgatgcaaggcgactgtgaccaaatcgttccttcacattgctctggcaacatgaagaggacttttccggcggtggaagttgatatcattactggtgctgatcatgatagtatgataagcggaagaggagaagagtttgctgagaaattggagagcatttggtgttcatttaaagagtctggttagttttttcaaactttataggtaggaggcactgtantcgatgtcgactgactacaagtttgagtccgattgtaagatcaagtctattgttaatgagccatctaatggacgcctatatggagtccaattatcg

SEQ ID NO: 1012 - protein, 1449 aa, Arabidopsis thaliana
  misc_feature: PFam Name: Abhydrolase_1; PFam Description: alpha/beta
  misc_feature: GI Number: 6633825; NR Description: F1N19.24 [Arabidopsis thaliana]
AACCACTCATCTCAATTTCTCCCACGGTCTAGATTCTCTCCGCTTCTATGTCTTTCCCGAGAAAATTCGGGACAGCGATTCACGCCGCTCTATCTTTTATCGTCTTCTTCTTCTTCGACCTCATTGACGCGATTCTCTGTGTCGTTTACGAGTTCGTCGATGAGATTTTGGAAGAAAACTCAACAGGCTGTTACTGCACGGCGGCGGCTCCTCAAAGTCTAACCACCGACGAAAATGAGTTGTCGTCGGAGACTTTATTCGGGAGGAGAAACAGTTTCCGGGAAATGTGGTTTCTGGGATTCGCGAGAGAATTCAAATCCAAGCTTTCCCGGAAACTGAGAAAATCTAAGATTCATCAAGAGTCAGTGAATCGATGGTCAGATTGTGGATGCAAATCTTGCAAGTCATGGACTAAGAACGAAGATGGGAATCTTCACGTCGTGGTCAAAGATTCTACTTCTCGAGAAACAGAGTACTCTGTTCAAGAACCGTCCGAGAATGTAATATTCATACACGGTTTTATGGGGTCATCACATTTTTGGACAGAAACTGTATTTGAACACATTCAAAAAGATGATTATAGGCTCCTCGCGATCGATCTTTTGGGATTCGGGGAGAGTCCTAAGCCAAGGGATAGTCTCTATACATTGAAAGATCATGTGGATACGATAGAGAGATCTGTCATTAAGCCATACCAATTAGATTCTTTTCATGTGGTTGCACATTCAATGGGTTGCTTAATTGCTCTTGCTTTGGCTGCTAAACATTCCAACATTGTTAAATCCGTTACTCTTGTTGCACCGCCTTATTTTCCTTCATCGGTAGATGGATCGGTCTTGAACCGAATCGCTAGAAAGCGGTTGTGGCCACCGCTTGCGTTTGGGACAGCGGTGATGTCTTGGTATGAACATATTGGTAGATGCGTATGTTTCATAATCTGCAAGCATCATAAGATATGGGAGTGGCTAATCAAGCTATGTATAGGTAAAAGGGAGATTCATTGGAAGATCAAGGACATAACAAGGCACACACATCACTCTGCATGGCATAGTATGCACAATGTGATATGTGGTGGCTCCAAAGTCGCTGATGAACATCTTGAAACCCTAATAAAGTCTGGCGTTAAGATTCACTTGATGCAAGGCGACTGTGACCAAATCGTTCCTTCACATTGCTCTGGCAACATGAAGAGGACTTTTCCGGCGGTGGAAGTTGATATCATTACTGGTGCTGATCATGATAGTATGATAAGCGGAAGAGGAGAAGAGTTTGCTGAGAAATTGGAGAGCATTTGGTGTTCATTTAAAGAGTCTGGTTAGTTTTTTCAAACTTTATAGGTAGGAGGCACTGTANTCGATGTCGACTGACTACAAGTTTGAGTCCGATTGTAAGATCAAGTCTATTGTTAATGAGCCATCTAATGGACGCCTATATGGAGTCCAATTATCG

SEQ ID NO: 1013 - DNA, 1132 bp, Arabidopsis thaliana
  misc_feature (1)..(1132): Ceres cDNA ID no. 12396005
  misc_feature (1)..(1132): Ceres CLONE  ID no. 35989
  misc_feature (1)..(1132): Also known as  Ceres CDNA ID no. 23385637
acattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacgtgagtttatatattttctttaggagttttaagtgattttggatttggtttttatattgagacttcatcttgacatttttgtgtatttgcagctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttctagcttgtctattatgtccgagaatttctttttctgtttttgattcttttcgttgtatatctttgtccaataaaggaaatgatgtgtctttacc

SEQ ID NO: 1014 - protein, 1132 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 17104625; NR Description: putative xyloglucan endo-1,4-beta-D-glucanase precursor [Arabidopsis thaliana] >gi|14334966|gb|AAK59660.1| putative xyloglucan endo-1,4-beta-D-glucanase precursor [Arabidopsis thaliana]
  misc_feature: GI Number: 21553999; NR Description: xyloglucan
  misc_feature: GI Number: 29500899; NR Description: putative xyloglucan endotransglycosylase [Cucumis sativus] >gi|29500891|emb|CAD87535.1|
  misc_feature: GI Number: 29500901; NR Description: putative xyloglucan endotransglycosylase [Cucumis sativus] >gi|29500893|emb|CAD87536.1|
  misc_feature: GI Number: 19911573; NR Description: syringolide-induced
ACATTCCTCACCAAACCCTCTCCAAAACACACCCACACGTACGCACACACACAAAGACAATGTCTCCTTTCAAAATATTCTTCTTCACGACTCTTCTCGTGGCGGCGTTTTCAGTGTCGGCTGCTGATTTCAACACTGACGTCAACGTAGCTTGGGGAAATGGCCGTGGGAAGATACTCAACAACGGCCAGCTTCTTACTCTCTCCTTAGACAAATCCTCTGGTTCCGGTTTTCAATCCAAAACAGAGTATTTGTTTGGAAAGATTGATATGCAGATTAAGCTTGTTCCTGGTAACTCTGCAGGAACAGTCACAACTTTTTACGTGAGTTTATATATTTTCTTTAGGAGTTTTAAGTGATTTTGGATTTGGTTTTTATATTGAGACTTCATCTTGACATTTTTGTGTATTTGCAGCTAAAATCCGAAGGATCCACTTGGGATGAGATTGATTTTGAGTTCTTGGGTAATATGAGTGGAGATCCTTATACTTTACACACTAATGTTTACACTCAAGGTAAAGGTGACAAAGAGCAACAATTCCATCTCTGGTTCGACCCAACCGCCAATTTCCACACTTACTCAATCCTCTGGAACCCTCAAAGAATCATATTGACCGTCGATGACACACCCATTAGAGAGTTTAAAAACTATGAGTCTCTCGGTGTCTTGTTTCCAAAGAACAAGCCGATGAGGATGTACGCGAGTTTATGGAACGCAGACGATTGGGCAACAAGAGGCGGTCTTGTTAAAACTGATTGGTCTAAAGCTCCATTCATGGCTTCTTACAGAAACATTAAGATTGACTCGAAACCAAACTCCAATTGGTACACTCAAGAAATGGATTCAACAAGCCAAGCTAGACTCAAATGGGTTCAGAAGAATTACATGATCTACAATTATTGTACTGACCATAGGAGGTTTCCACAGGGAGCTCCTAAGGAATGCACAACAAGCTCATAGAATCTCAAATTATATTCTATTTATTTATCTACACTTCCTCTCTTTCTTTTATGTGAAAATTGTGAATGCTCTGTTTCTAGCTTGTCTATTATGTCCGAGAATTTCTTTTTCTGTTTTTGATTCTTTTCGTTGTATATCTTTGTCCAATAAAGGAAATGATGTGTCTTTACC

SEQ ID NO: 1015 - DNA, 1168 bp, Arabidopsis thaliana
  misc_feature (1)..(1168): Ceres cDNA ID no. 12396040
  misc_feature (1)..(1168): Ceres CLONE  ID no. 15295
  misc_feature (1)..(1168): Also known as  Ceres CDNA ID no. 23385668
attcaataaattctcttttcttgcattttcaactcaatctttatctcatgctttcgtcttcgtcttcgtcaacggtagagcaaccatcacgtggcggaagtccgggaatcaacgccgtgtcctccgatgttttacggtctaacatcctaacccgcctcgacggttcctctctcgccgccctaagctgcacgtgctccaacctaaactctttttgctccgacgagtccctctggaggcaacaatgttccgctacatggccttctaccttggacagacgtgtacagagcatcatctcaacgttcccagacggtcaccggacgtttttctccgattcctttccgtttcttgaacatgatgttgtgatcaatctcccaccgtcctttgatacctcggagttaatctcagccgttgatatattctacaaagatgatgtgattttctcaagggttcatgtgacagagacagtctctggttggttcctttgctcacctatgcgtgtcgatcttgtcgaaccgaaagaactaattccgaccagagttttggttacggaccaatgtaaggatgacacgtggaaaagtgacttggaagagaatctctccttgagctggatactcattgacccgacatgtaaacgtgcggcaaatgtatcaacccgtaaacctgtctcggtgcaccgtcattggttaaccggagaagtccacgtaaaattctcctctatttttgtcgtgggcaacaagaaaaggtcggagcaagtggagttcactgtaacggtggtgctggcggcgtttaaccggagggaagaggagacagcagtgatgcagataagagaggtgagcctagtagcagaggacaaggatgggaggaatctaggagggaaggttagtttggaaattttggtggcggccatggggatgaaacgtaggtttagggcgggaggggaagaagaagggaaagagaagtacatagaatatatagagaggaagaccgcgaaggcggagatgaagtggcggcgagggaaagaaacggctatggagacggcggcgtgctggatcgccgtcctcttacttggtttccttttgtgtttttatctgtttatgcataaaaatttagtagctattatgaaaaaactaataaaatagttaaataatatgttttgattcaaaacttc

SEQ ID NO: 1016 - protein, 1168 aa, Arabidopsis thaliana
  misc_feature: PFam Name: F-box; PFam Description: F-box domain
  misc_feature: GI Number: 50253058; NR Description: F-box protein-like [Oryza sativa (japonica cultivar-group)] >gi|50251878|dbj|BAD27806.1| F-box protein-like [Oryza sativa
ATTCAATAAATTCTCTTTTCTTGCATTTTCAACTCAATCTTTATCTCATGCTTTCGTCTTCGTCTTCGTCAACGGTAGAGCAACCATCACGTGGCGGAAGTCCGGGAATCAACGCCGTGTCCTCCGATGTTTTACGGTCTAACATCCTAACCCGCCTCGACGGTTCCTCTCTCGCCGCCCTAAGCTGCACGTGCTCCAACCTAAACTCTTTTTGCTCCGACGAGTCCCTCTGGAGGCAACAATGTTCCGCTACATGGCCTTCTACCTTGGACAGACGTGTACAGAGCATCATCTCAACGTTCCCAGACGGTCACCGGACGTTTTTCTCCGATTCCTTTCCGTTTCTTGAACATGATGTTGTGATCAATCTCCCACCGTCCTTTGATACCTCGGAGTTAATCTCAGCCGTTGATATATTCTACAAAGATGATGTGATTTTCTCAAGGGTTCATGTGACAGAGACAGTCTCTGGTTGGTTCCTTTGCTCACCTATGCGTGTCGATCTTGTCGAACCGAAAGAACTAATTCCGACCAGAGTTTTGGTTACGGACCAATGTAAGGATGACACGTGGAAAAGTGACTTGGAAGAGAATCTCTCCTTGAGCTGGATACTCATTGACCCGACATGTAAACGTGCGGCAAATGTATCAACCCGTAAACCTGTCTCGGTGCACCGTCATTGGTTAACCGGAGAAGTCCACGTAAAATTCTCCTCTATTTTTGTCGTGGGCAACAAGAAAAGGTCGGAGCAAGTGGAGTTCACTGTAACGGTGGTGCTGGCGGCGTTTAACCGGAGGGAAGAGGAGACAGCAGTGATGCAGATAAGAGAGGTGAGCCTAGTAGCAGAGGACAAGGATGGGAGGAATCTAGGAGGGAAGGTTAGTTTGGAAATTTTGGTGGCGGCCATGGGGATGAAACGTAGGTTTAGGGCGGGAGGGGAAGAAGAAGGGAAAGAGAAGTACATAGAATATATAGAGAGGAAGACCGCGAAGGCGGAGATGAAGTGGCGGCGAGGGAAAGAAACGGCTATGGAGACGGCGGCGTGCTGGATCGCCGTCCTCTTACTTGGTTTCCTTTTGTGTTTTTATCTGTTTATGCATAAAAATTTAGTAGCTATTATGAAAAAACTAATAAAATAGTTAAATAATATGTTTTGATTCAAAACTTC

SEQ ID NO: 1017 - DNA, 1156 bp, Arabidopsis thaliana
  misc_feature (1)..(1156): Ceres cDNA ID no. 12396270
  misc_feature (1)..(1156): Ceres CLONE  ID no. 6393
  misc_feature (1)..(1156): Also known as  Ceres CDNA ID no. 23385894
ataacatatatttcttcttcgtttcattcataatcgtcttataaccacagattctaaaacatgggagaagaagtaaaaccagaggcaaaggaggcagcctctgctccacaggccgtccccgctgaggaggaggagaagaagaaagatgtagcggaggagaagaaagtggcggctgaggaggagaaaccaaaggaggaagaggagccgcaaccaccaccaccgcctccacccttcatactctacgtcgacttgcattgtgttggatgcgctaagaagattgaaagatctattctaaaaattagaggtgtggaagaagtggtgatggatatgaatgagaaccaagtgacgataaagggagtgttggatccgcaagcagtgtgcaacaaaatcaagaagaagactaaaagaatggccaaagtcctctcgccgcttccggcagctgagggagagcctctgccaccaatcataacctctcaggtctccggcggcctcaccaccgtcgagctcagcgttaacatgcactgccaagcttgtgctgaccagctcaagaagaagattctcaaaatgagaggggtccaaacaactgtgacagagcacaccacgggaaaagtaatagtgactgggacaatggacgctgagaagcttgtggattacgtctaccgtcggaccaaaaagcaagcccgaatcgtaccccaacctgacccggaacctgaagcccccgcggccgcgcaggaagaaaagaaggaggagagcggtgaaggcaatgaaaaaccaccagagaccggagaggaaaaggaagaagagaagaagaaggagggagaggaaaatggagaggaaggtggtggagaagaggcggcggctacggaggaagagagacgagacaatgaaatgacggctatggcccaagaagaagggatgaagaggatgatgtattactatcaaccttcatacgtcatagagaggattcctccgccgcagctttttagcgacgagaaccctaatgcttgttgcatttcttaattaaatttggtttcgtatatgtctatggaaaatataattagaggaattaataattaggtaagaaaagaaagaaaataggtaaagaatttgtaaactatttattttttaatataatgtacgtgtgtttggtatctct

SEQ ID NO: 1018 - protein, 1156 aa, Arabidopsis thaliana
  misc_feature: PFam Name: HMA; PFam Description: Heavy-metal-associated domain
  misc_feature: PFam Name: TolA; PFam Description: TolA protein
  misc_feature: PFam Name: Prothymosin; PFam Description:
  misc_feature: PFam Name: ig; PFam Description: Immunoglobulin domain
  misc_feature: PFam Name: HSP90; PFam Description: Hsp90 protein
  misc_feature: GI Number: 42573467; NR Description: copper-binding family
  misc_feature: GI Number: 21594005; NR Description: unknown [Arabidopsis thaliana]
  misc_feature: GI Number: 50908877; NR Description: putative farnesylated protein [Oryza sativa (japonica cultivar-group)] >gi|48716470|dbj|BAD23076.1| putative farnesylated protein [Oryza
  misc_feature: GI Number: 4097547; NR Description: ATFP3 [Arabidopsis thaliana]
  misc_feature: GI Number: 20197942; NR Description: putative farnesylated protein [Arabidopsis thaliana] >gi|18404283|ref|NP_565855.1| heavy-metal-associated domain-containing protein [Arabidopsis
ATAACATATATTTCTTCTTCGTTTCATTCATAATCGTCTTATAACCACAGATTCTAAAACATGGGAGAAGAAGTAAAACCAGAGGCAAAGGAGGCAGCCTCTGCTCCACAGGCCGTCCCCGCTGAGGAGGAGGAGAAGAAGAAAGATGTAGCGGAGGAGAAGAAAGTGGCGGCTGAGGAGGAGAAACCAAAGGAGGAAGAGGAGCCGCAACCACCACCACCGCCTCCACCCTTCATACTCTACGTCGACTTGCATTGTGTTGGATGCGCTAAGAAGATTGAAAGATCTATTCTAAAAATTAGAGGTGTGGAAGAAGTGGTGATGGATATGAATGAGAACCAAGTGACGATAAAGGGAGTGTTGGATCCGCAAGCAGTGTGCAACAAAATCAAGAAGAAGACTAAAAGAATGGCCAAAGTCCTCTCGCCGCTTCCGGCAGCTGAGGGAGAGCCTCTGCCACCAATCATAACCTCTCAGGTCTCCGGCGGCCTCACCACCGTCGAGCTCAGCGTTAACATGCACTGCCAAGCTTGTGCTGACCAGCTCAAGAAGAAGATTCTCAAAATGAGAGGGGTCCAAACAACTGTGACAGAGCACACCACGGGAAAAGTAATAGTGACTGGGACAATGGACGCTGAGAAGCTTGTGGATTACGTCTACCGTCGGACCAAAAAGCAAGCCCGAATCGTACCCCAACCTGACCCGGAACCTGAAGCCCCCGCGGCCGCGCAGGAAGAAAAGAAGGAGGAGAGCGGTGAAGGCAATGAAAAACCACCAGAGACCGGAGAGGAAAAGGAAGAAGAGAAGAAGAAGGAGGGAGAGGAAAATGGAGAGGAAGGTGGTGGAGAAGAGGCGGCGGCTACGGAGGAAGAGAGACGAGACAATGAAATGACGGCTATGGCCCAAGAAGAAGGGATGAAGAGGATGATGTATTACTATCAACCTTCATACGTCATAGAGAGGATTCCTCCGCCGCAGCTTTTTAGCGACGAGAACCCTAATGCTTGTTGCATTTCTTAATTAAATTTGGTTTCGTATATGTCTATGGAAAATATAATTAGAGGAATTAATAATTAGGTAAGAAAAGAAAGAAAATAGGTAAAGAATTTGTAAACTATTTATTTTTTAATATAATGTACGTGTGTTTGGTATCTCT

SEQ ID NO: 1019 - DNA, 3259 bp, Arabidopsis thaliana
  misc_feature (1)..(3259): Ceres cDNA ID no. 12396313
  misc_feature (1)..(3259): Ceres CLONE  ID no. 116146
  misc_feature (1)..(3259): Also known as  Ceres CDNA ID no. 23385937
agaagtagatagagagaaaaataaagaagaagacagatgatacagagagagagagagagagatagttggcccagcggatcgacgtcgacgatgatgatgatgatgatcatttgattcttaagctaaaagctttcttcttcttctctctcccatcccatggagttcgtgatttagtctctcctcttagatttttctctctttccgctccttatttttagtattattatctcagcagaaaaacaaaaacacttttcatttctttatttttctttctcatttcgcataaatctttgtcgccgagacgatttgtgtctgagaaactgagaagaggaatgggagaaacagttcattgtggaagcttcttgtcctcaatgagggatctaagtgaagatatttccaatacttgtagctattcaatgtattgtggaggtgataaaactttgccttatgggcagtatcagaatggtttctcggcgagacctccaacggattcttacgagagagattttttgaaacaaacaatgcttgaacatgaagctgtatttaagaatcaggtttatgagcttcaccgtttgtatagaacacagaagagtttgatggctgaagttaggggaaagaactttgttgatcacttgaacaacaatgagcctacaccgggaagtgggattaaacgaggatttcttttcggaaactcgatatgtggcgaaggaagcacctctcaagattgcaatgttggcaaggacaacaaggtgttagaggttagacctgtcaaggttaggagaacaatgattgatcttcaacttcccgcagatgagtatctccatacagagggtgataatacgacttgtcctccttatgagcagtcaaaagaagttggtgaaaacatcttctttgaatctcatcggaacgattcttctggatcttctttgcttatgaagaactcaaatggatttactgacttgaacgagccagtccaatgccaagattcagtacctgtttcttcttcttccagggacttatattctctttatggagcaaacatttcacacgtgcaaggccagtgggtggaaaaaaatactagtcaaaatggatggatggttctagaagcagggaacggaaaaagcactccaagagacaagttatgcctgccttcccattcggtacaagttctttctaacagtgcatttcaacctctgggatacccttcaactgaccacagcaagttatcgggcgaaagagcatctttcaaatgtgaagttcgtcaaaggaatcctgaggtttcgtatgatagctatgtggaatcaagtgtggcatcaaatgttccaagcttgaatcatggatatcgcccggaatctgtcagaccttggagccattggatttcatcatgggagaaccgaagtagcagctcagttcagaaacctttgccacttcaagcgaatccattcttgacttttaatactcaagtacgagcagactcaagtgcagagatgagaagccgtgattctaacgggcttaaccaaggattctcttcattctcggaggaaagtgcctttaattttccatcagtaaactttaaccatcttaacaatggcccaaaaggggcagttactaatggttctttgtgtgagagtgtgatgcatcagagtcttaaaaaccttcaaggaccaaaaaagcaggagtgctcttctggtttgccctggataaaacctaagccccttaacaaaaatggaaaaaccaatggtggtttggatttgaatgcttctgcaaatcatcaattcatggatgaacgtgatatgggtgacagctcaaattatgtacatcctcagaatggtttgaggtctgttacatgttctaatgacgccaacttgagacatgttgaaatggccaattcacagagtcgtagaaagattcttggttttcctatctctcagaagctttctatttgcgaggagcacccttcccttataacttcttctgtgtgtatctctaatgaacccaagaaagtaaacaacttggtgaagataaacctcgatatcaacctgccatgtgaagcctcggtttctgaaggagttgttgtggacaaggaagaaggtaataaagctgccactcacaggcagcacattgacttgaatttctgtgctagcgaggatgaagattccggcttctgttctaatccaagagtggaaacaaaagcaactactttgataaatgtggaagctcccttgacgcttgagagtgaagaagaaggagggaaatttccagagaagagagatgaagctggagactctgtggatgaactcatcgaggcagcagcagaagctatagtcactatctcactgtcttatcattgccgcaatactgatgaagctgcttcctcttcgactgatgcagttgacaaggagccgctctcttggtttgtgaacacaatagcttcttgtggcaatgatttagagagcaaaattgatgcttgtttggaaaccagagactgtgaaggctgccgtgaagaatgttcttcaggtgagtttgattattttgaggcaatgaccctgaacttaacacagaccaaagaagaagactacatgccaaagcctttaatccctgaatatctgaaatttgatgggacgggttctatgggtatcacaagtaataggccaagaagaggacaagcgagacgaggaagaccaaagcgggatttccaaagggatattctccctgggctagcttctctgtctaggctcgaagtaaccgaagatcttcagatgtttgggggacttatgaaagccacaggctacaactggaactcaggaatggcccgaaggagctcaaaccgaggaagaaaacgactggtcagcaacattgacagagctccggtttgctcctctttggcacagccaatgaataacagtagtgtacaaatggtgggactggaagataggagccttacagggtggggaaatgcaaccagaagaccaaggcgacataggtgccctgcaggtactcccccaacagtgctattaacataaagcttttcgaaataaatccgatttcacaatttgaggaacattatagagggaaaagaaccagagcaagtaacaatggacaaaaactgattttcagcgatcgatgttttattattgtcaatcaaccccatgtttgtgggtgttggttgctctttgtatatcttgtcctctcttataagggccaaagaaaagaaaacacatgattggttatcattacaaaatctgcatctctgttttct

SEQ ID NO: 1020 - protein, 3259 aa, Arabidopsis thaliana
AGAAGTAGATAGAGAGAAAAATAAAGAAGAAGACAGATGATACAGAGAGAGAGAGAGAGAGATAGTTGGCCCAGCGGATCGACGTCGACGATGATGATGATGATGATCATTTGATTCTTAAGCTAAAAGCTTTCTTCTTCTTCTCTCTCCCATCCCATGGAGTTCGTGATTTAGTCTCTCCTCTTAGATTTTTCTCTCTTTCCGCTCCTTATTTTTAGTATTATTATCTCAGCAGAAAAACAAAAACACTTTTCATTTCTTTATTTTTCTTTCTCATTTCGCATAAATCTTTGTCGCCGAGACGATTTGTGTCTGAGAAACTGAGAAGAGGAATGGGAGAAACAGTTCATTGTGGAAGCTTCTTGTCCTCAATGAGGGATCTAAGTGAAGATATTTCCAATACTTGTAGCTATTCAATGTATTGTGGAGGTGATAAAACTTTGCCTTATGGGCAGTATCAGAATGGTTTCTCGGCGAGACCTCCAACGGATTCTTACGAGAGAGATTTTTTGAAACAAACAATGCTTGAACATGAAGCTGTATTTAAGAATCAGGTTTATGAGCTTCACCGTTTGTATAGAACACAGAAGAGTTTGATGGCTGAAGTTAGGGGAAAGAACTTTGTTGATCACTTGAACAACAATGAGCCTACACCGGGAAGTGGGATTAAACGAGGATTTCTTTTCGGAAACTCGATATGTGGCGAAGGAAGCACCTCTCAAGATTGCAATGTTGGCAAGGACAACAAGGTGTTAGAGGTTAGACCTGTCAAGGTTAGGAGAACAATGATTGATCTTCAACTTCCCGCAGATGAGTATCTCCATACAGAGGGTGATAATACGACTTGTCCTCCTTATGAGCAGTCAAAAGAAGTTGGTGAAAACATCTTCTTTGAATCTCATCGGAACGATTCTTCTGGATCTTCTTTGCTTATGAAGAACTCAAATGGATTTACTGACTTGAACGAGCCAGTCCAATGCCAAGATTCAGTACCTGTTTCTTCTTCTTCCAGGGACTTATATTCTCTTTATGGAGCAAACATTTCACACGTGCAAGGCCAGTGGGTGGAAAAAAATACTAGTCAAAATGGATGGATGGTTCTAGAAGCAGGGAACGGAAAAAGCACTCCAAGAGACAAGTTATGCCTGCCTTCCCATTCGGTACAAGTTCTTTCTAACAGTGCATTTCAACCTCTGGGATACCCTTCAACTGACCACAGCAAGTTATCGGGCGAAAGAGCATCTTTCAAATGTGAAGTTCGTCAAAGGAATCCTGAGGTTTCGTATGATAGCTATGTGGAATCAAGTGTGGCATCAAATGTTCCAAGCTTGAATCATGGATATCGCCCGGAATCTGTCAGACCTTGGAGCCATTGGATTTCATCATGGGAGAACCGAAGTAGCAGCTCAGTTCAGAAACCTTTGCCACTTCAAGCGAATCCATTCTTGACTTTTAATACTCAAGTACGAGCAGACTCAAGTGCAGAGATGAGAAGCCGTGATTCTAACGGGCTTAACCAAGGATTCTCTTCATTCTCGGAGGAAAGTGCCTTTAATTTTCCATCAGTAAACTTTAACCATCTTAACAATGGCCCAAAAGGGGCAGTTACTAATGGTTCTTTGTGTGAGAGTGTGATGCATCAGAGTCTTAAAAACCTTCAAGGACCAAAAAAGCAGGAGTGCTCTTCTGGTTTGCCCTGGATAAAACCTAAGCCCCTTAACAAAAATGGAAAAACCAATGGTGGTTTGGATTTGAATGCTTCTGCAAATCATCAATTCATGGATGAACGTGATATGGGTGACAGCTCAAATTATGTACATCCTCAGAATGGTTTGAGGTCTGTTACATGTTCTAATGACGCCAACTTGAGACATGTTGAAATGGCCAATTCACAGAGTCGTAGAAAGATTCTTGGTTTTCCTATCTCTCAGAAGCTTTCTATTTGCGAGGAGCACCCTTCCCTTATAACTTCTTCTGTGTGTATCTCTAATGAACCCAAGAAAGTAAACAACTTGGTGAAGATAAACCTCGATATCAACCTGCCATGTGAAGCCTCGGTTTCTGAAGGAGTTGTTGTGGACAAGGAAGAAGGTAATAAAGCTGCCACTCACAGGCAGCACATTGACTTGAATTTCTGTGCTAGCGAGGATGAAGATTCCGGCTTCTGTTCTAATCCAAGAGTGGAAACAAAAGCAACTACTTTGATAAATGTGGAAGCTCCCTTGACGCTTGAGAGTGAAGAAGAAGGAGGGAAATTTCCAGAGAAGAGAGATGAAGCTGGAGACTCTGTGGATGAACTCATCGAGGCAGCAGCAGAAGCTATAGTCACTATCTCACTGTCTTATCATTGCCGCAATACTGATGAAGCTGCTTCCTCTTCGACTGATGCAGTTGACAAGGAGCCGCTCTCTTGGTTTGTGAACACAATAGCTTCTTGTGGCAATGATTTAGAGAGCAAAATTGATGCTTGTTTGGAAACCAGAGACTGTGAAGGCTGCCGTGAAGAATGTTCTTCAGGTGAGTTTGATTATTTTGAGGCAATGACCCTGAACTTAACACAGACCAAAGAAGAAGACTACATGCCAAAGCCTTTAATCCCTGAATATCTGAAATTTGATGGGACGGGTTCTATGGGTATCACAAGTAATAGGCCAAGAAGAGGACAAGCGAGACGAGGAAGACCAAAGCGGGATTTCCAAAGGGATATTCTCCCTGGGCTAGCTTCTCTGTCTAGGCTCGAAGTAACCGAAGATCTTCAGATGTTTGGGGGACTTATGAAAGCCACAGGCTACAACTGGAACTCAGGAATGGCCCGAAGGAGCTCAAACCGAGGAAGAAAACGACTGGTCAGCAACATTGACAGAGCTCCGGTTTGCTCCTCTTTGGCACAGCCAATGAATAACAGTAGTGTACAAATGGTGGGACTGGAAGATAGGAGCCTTACAGGGTGGGGAAATGCAACCAGAAGACCAAGGCGACATAGGTGCCCTGCAGGTACTCCCCCAACAGTGCTATTAACATAAAGCTTTTCGAAATAAATCCGATTTCACAATTTGAGGAACATTATAGAGGGAAAAGAACCAGAGCAAGTAACAATGGACAAAAACTGATTTTCAGCGATCGATGTTTTATTATTGTCAATCAACCCCATGTTTGTGGGTGTTGGTTGCTCTTTGTATATCTTGTCCTCTCTTATAAGGGCCAAAGAAAAGAAAACACATGATTGGTTATCATTACAAAATCTGCATCTCTGTTTTCT

SEQ ID NO: 1021 - DNA, 1467 bp, Arabidopsis thaliana
  misc_feature (1)..(1467): Ceres cDNA ID no. 12396346
  misc_feature (1)..(1467): Ceres CLONE  ID no. 20725
  misc_feature (1)..(1467): Also known as  Ceres CDNA ID no. 23385962
aaaattcatcgatgacggatcctcccagacccgacccgtttcctgttacccgactcgattccgacgccggtgctctcttcgtcctccaatcaaaaggcgagtggtggcacgccggatttcatctaacgacggcgattgttggtccgacgatattgacattaccatatgcgtttagaggattaggatggtggttagggtttgtttgtttaacgacgatgggactcgttactttctacgcttattacctcatgtctaaggttcttgatcactgtgaaaaatccggccgccgtcacatccgtttccgggaactcgccgccgatgttcttggatctggattgatgttttatgtagtgatctttattcaaacagctatcaacactggaattggtattggcgccattctacttgcaggtcaatgtcttgatataatgtattcgagtcttttcccgcaaggaacgttgaagctttacgagttcattgctatggtgactgttgtgatgatggttctctcacagcttccaagttttcactctcttagacacattaactgtgcgtctctgcttctcagcttaggatatactttcctcgtcgttggggcttgtatcaacctaggtttgtcgaaaaacgctcctaaacgtgagtattctctagagcattcggattcagggaaagtttttagtgccttcacatcaatttcgatcatagctgctattttcggaaatggaatcttacccgaaatacaggcaactcttgctccaccagccacagggaagatgttgaaaggactattgttgtgttatagtgtgatcttcttcacgttttactctgctgcaatttcgggatattgggtttttggtaacaattcgagctctaatatcctcaagaacttaatgcctgatgaaggaccgactctggctcctatcgtggtgattggcttagctgtcatctttgtccttcttcagcttttcgccattggccttgtgtattctcaagttgcgtatgaaataatggagaagaaatcagcggatacaacaaaagggatattctcaaaacgcaaccttgtgccgcgtttgatactaagaacactatatatggcgttttgcgggttcatggcagcgatgctaccgttctttggggatataaacgcggtggtaggagcgtttgggtttatcccactcgatttcgtgctgccaatgcttctatacaacatgacctataagccaaccagacggagcttcacgtattggataaacatgacgataatggttgtgttcacttgtgcaggactcatgggagctttctcctccattaggaaacttgttcttgatgctaataagttcaagttgtttagcagtgaagttgttgattagatggttttgatagtgtgataaaaacataaacaatacttgttttgtggttacacttgtacatgaatttctcgagttgattcattatcacacaaaatgc

SEQ ID NO: 1022 - protein, 1467 aa, Arabidopsis thaliana
  misc_feature: PFam Name: Aa_trans; PFam Description: Transmembrane amino
  misc_feature: GI Number: 34912776; NR Description: P0407B12.25 [Oryza sativa (japonica cultivar-group)] >gi|11034686|dbj|BAB17188.1|
  misc_feature: GI Number: 21554158; NR Description: amino acid permease-like
  misc_feature: GI Number: 22136372; NR Description: amino acid permease-like protein [Arabidopsis thaliana] >gi|20466438|gb|AAM20536.1| amino acid permease-like protein [Arabidopsis thaliana] >gi|18422139|ref|NP_568597.1| amino acid transporter family
  misc_feature: GI Number: 10177364; NR Description: amino acid permease-like
  misc_feature: GI Number: 50932903; NR Description: putative amino acid transporter family II [Oryza sativa (japonica cultivar-group)] >gi|48475084|gb|AAT44153.1| putative amino acid transporter family
AAAATTCATCGATGACGGATCCTCCCAGACCCGACCCGTTTCCTGTTACCCGACTCGATTCCGACGCCGGTGCTCTCTTCGTCCTCCAATCAAAAGGCGAGTGGTGGCACGCCGGATTTCATCTAACGACGGCGATTGTTGGTCCGACGATATTGACATTACCATATGCGTTTAGAGGATTAGGATGGTGGTTAGGGTTTGTTTGTTTAACGACGATGGGACTCGTTACTTTCTACGCTTATTACCTCATGTCTAAGGTTCTTGATCACTGTGAAAAATCCGGCCGCCGTCACATCCGTTTCCGGGAACTCGCCGCCGATGTTCTTGGATCTGGATTGATGTTTTATGTAGTGATCTTTATTCAAACAGCTATCAACACTGGAATTGGTATTGGCGCCATTCTACTTGCAGGTCAATGTCTTGATATAATGTATTCGAGTCTTTTCCCGCAAGGAACGTTGAAGCTTTACGAGTTCATTGCTATGGTGACTGTTGTGATGATGGTTCTCTCACAGCTTCCAAGTTTTCACTCTCTTAGACACATTAACTGTGCGTCTCTGCTTCTCAGCTTAGGATATACTTTCCTCGTCGTTGGGGCTTGTATCAACCTAGGTTTGTCGAAAAACGCTCCTAAACGTGAGTATTCTCTAGAGCATTCGGATTCAGGGAAAGTTTTTAGTGCCTTCACATCAATTTCGATCATAGCTGCTATTTTCGGAAATGGAATCTTACCCGAAATACAGGCAACTCTTGCTCCACCAGCCACAGGGAAGATGTTGAAAGGACTATTGTTGTGTTATAGTGTGATCTTCTTCACGTTTTACTCTGCTGCAATTTCGGGATATTGGGTTTTTGGTAACAATTCGAGCTCTAATATCCTCAAGAACTTAATGCCTGATGAAGGACCGACTCTGGCTCCTATCGTGGTGATTGGCTTAGCTGTCATCTTTGTCCTTCTTCAGCTTTTCGCCATTGGCCTTGTGTATTCTCAAGTTGCGTATGAAATAATGGAGAAGAAATCAGCGGATACAACAAAAGGGATATTCTCAAAACGCAACCTTGTGCCGCGTTTGATACTAAGAACACTATATATGGCGTTTTGCGGGTTCATGGCAGCGATGCTACCGTTCTTTGGGGATATAAACGCGGTGGTAGGAGCGTTTGGGTTTATCCCACTCGATTTCGTGCTGCCAATGCTTCTATACAACATGACCTATAAGCCAACCAGACGGAGCTTCACGTATTGGATAAACATGACGATAATGGTTGTGTTCACTTGTGCAGGACTCATGGGAGCTTTCTCCTCCATTAGGAAACTTGTTCTTGATGCTAATAAGTTCAAGTTGTTTAGCAGTGAAGTTGTTGATTAGATGGTTTTGATAGTGTGATAAAAACATAAACAATACTTGTTTTGTGGTTACACTTGTACATGAATTTCTCGAGTTGATTCATTATCACACAAAATGC

SEQ ID NO: 1023 - DNA, 1287 bp, Arabidopsis thaliana
  misc_feature (1)..(1287): Ceres cDNA ID no. 12396405
  misc_feature (1)..(1287): Ceres CLONE  ID no. 21261
  misc_feature (1)..(1287): Also known as  Ceres CDNA ID no. 23386017
ctgtatggtattgatttgttaaatacagtttatggagcttcagatagcaggagcgtctctaaatctgctgtgtcaaaaagaaccctcgccgtattgccttgctcgtcctgtcgaattaacaaacgttgcatcgagaatggacatctacaatctgctactaacaaaacttcctttgtgtgctgagcaagttcttcaggccataggagaaataatcctgatttctcaagaaacaataagcatggtttccgaggcagaaacaggcgaaacgaagatagggatggtttagtagatggtggtcttgaagacgacatgttgtcttccaaaaacggtcctttactctctctatccagttccccaaaattccaggctacttaatcacctggaccaaaagagaaagagatagtggagcttttcaagaaagtccaagttcagctccgggctcgagctgctgctaagaaagaagaaaagaagactgaagaagcttctaaaggacagggaggaaaagagagtgagacagtggactcccttcttaagttactgaggaagcactcaggagaacaaagcaagaaacaagttagcaatttcaattctgagaagcagctccaaagagatgatgatgcttcagaaagacaaaatcacagttccagtcgtttcgattcgcgaaacaaagatcataatgcaacaccctttaccaggccagcatcaagcttcagacgtaattctcctgtaccgagacataaatctcaagccagttattctagtgaggccattttttatgaagcttcaagttacagtgtgacttggacccagaaaaaggatcaagtagagtcgcgtgatgaacctgaatacgagcttgagcctgagtctgcagctgagtatgatgaacctgaacctgaggctgagtatgaacctgaatctgaaccagaacttgctattctcgaatcagtgtcagagctgaaactagagtcgttttaccaagaggaagatgaagatgaggaggatcataacttcgttatagatgagttatcagatgatgacgagtctctcaataccgactaccgaggaagagactgcgaaagatgaagatttgagtgcactgaagttggtagaacttagagccatagcaaaatcaagaggactcaaaggaatttcaaagatgaagaaagttgagctagtgactttattgggtagtagtaataaagcatgatgatcagatttttaacatgagtcagattaaacattgcttgagtttttgatacagctaatgaatctccaaatactcgttcc

SEQ ID NO: 1024 - protein, 1287 aa, Arabidopsis thaliana
  misc_feature: PFam Name: Rho_N; PFam Description: Rho termination factor,
  misc_feature: PFam Name: Trypan_PARP; PFam Description: Procyclic acidic
  misc_feature: GI Number: 21536878; NR Description: unknown [Arabidopsis thaliana]
  misc_feature: GI Number: 21727822; NR Description: SAP-like protein [Oryza sativa] >gi|21727820|emb|CAC86222.1| SAP-like protein [Oryza
  misc_feature: GI Number: 50920397; NR Description: Putative plasma membrane proton ATPase [Oryza sativa] >gi|15217290|gb|AAK92634.1| Putative
CTGTATGGTATTGATTTGTTAAATACAGTTTATGGAGCTTCAGATAGCAGGAGCGTCTCTAAATCTGCTGTGTCAAAAAGAACCCTCGCCGTATTGCCTTGCTCGTCCTGTCGAATTAACAAACGTTGCATCGAGAATGGACATCTACAATCTGCTACTAACAAAACTTCCTTTGTGTGCTGAGCAAGTTCTTCAGGCCATAGGAGAAATAATCCTGATTTCTCAAGAAACAATAAGCATGGTTTCCGAGGCAGAAACAGGCGAAACGAAGATAGGGATGGTTTAGTAGATGGTGGTCTTGAAGACGACATGTTGTCTTCCAAAAACGGTCCTTTACTCTCTCTATCCAGTTCCCCAAAATTCCAGGCTACTTAATCACCTGGACCAAAAGAGAAAGAGATAGTGGAGCTTTTCAAGAAAGTCCAAGTTCAGCTCCGGGCTCGAGCTGCTGCTAAGAAAGAAGAAAAGAAGACTGAAGAAGCTTCTAAAGGACAGGGAGGAAAAGAGAGTGAGACAGTGGACTCCCTTCTTAAGTTACTGAGGAAGCACTCAGGAGAACAAAGCAAGAAACAAGTTAGCAATTTCAATTCTGAGAAGCAGCTCCAAAGAGATGATGATGCTTCAGAAAGACAAAATCACAGTTCCAGTCGTTTCGATTCGCGAAACAAAGATCATAATGCAACACCCTTTACCAGGCCAGCATCAAGCTTCAGACGTAATTCTCCTGTACCGAGACATAAATCTCAAGCCAGTTATTCTAGTGAGGCCATTTTTTATGAAGCTTCAAGTTACAGTGTGACTTGGACCCAGAAAAAGGATCAAGTAGAGTCGCGTGATGAACCTGAATACGAGCTTGAGCCTGAGTCTGCAGCTGAGTATGATGAACCTGAACCTGAGGCTGAGTATGAACCTGAATCTGAACCAGAACTTGCTATTCTCGAATCAGTGTCAGAGCTGAAACTAGAGTCGTTTTACCAAGAGGAAGATGAAGATGAGGAGGATCATAACTTCGTTATAGATGAGTTATCAGATGATGACGAGTCTCTCAATACCGACTACCGAGGAAGAGACTGCGAAAGATGAAGATTTGAGTGCACTGAAGTTGGTAGAACTTAGAGCCATAGCAAAATCAAGAGGACTCAAAGGAATTTCAAAGATGAAGAAAGTTGAGCTAGTGACTTTATTGGGTAGTAGTAATAAAGCATGATGATCAGATTTTTAACATGAGTCAGATTAAACATTGCTTGAGTTTTTGATACAGCTAATGAATCTCCAAATACTCGTTCC

SEQ ID NO: 1025 - DNA, 1093 bp, Arabidopsis thaliana
  misc_feature (1)..(1093): Ceres cDNA ID no. 12396629
  misc_feature (1)..(1093): Ceres CLONE  ID no. 142557
  misc_feature (1)..(1093): Also known as  Ceres CDNA ID no. 23386223
gaaagagtctctgcctctcaagctccgccgtcggggaaaaaagaatatggaagcagctactgttcagaggtttcagtactcatcatggaatgatttgagaaattttgaagggaagcctcgtggttctctgaggtataatacacagcgaattaaggaagataaaaggtttagagttgttgctttaactcttgacaaaagaagggatcatcgacttagatcagtttctgataagaactcctcagcattgttggaaactggaagtcttcttcattctccatttgatgaagaacaacagattttgaagaaaaaagctgaagaggttaaaccgtatttaaatggacgatcgatgtatcttgttggtatgatgggttccgggaaacgactgtagggaagattatggcaagatcgcttggttatacattctttgattgtgacactttgatcgagcaggctatgaagggaacttctgtagctgagatatttgagcatttcggtgagagtgtcttcagagaaaaagagactgaagcgttaaagaaactctctttgatgtaccaccaagttgttgtttcaaccgggggaggggcagttataagacccatcaattggaagtacatgcataaaggtattagtatttggcttgatgtacctctagaagccttagcgcatagaatagctgctgtaggaactggttcaagaccattgctacatgatgatgagtcaggggacacatacacagcggctttaaaccgtctttcaacgatttgggatgcacgtggtgaagcatacactaaagccagcgcaagagtttcctcggagaatattactttgaagctcggttatagaagtgtctcagatcttacaccagctgaaatcgccattgaggcctttgagcaagttcagagctatttagagaaagaagatggtatggctagaccagatggactctagttccagaaagttatgtttccccgcaacatctcatgaatttgtgcctagttttgaatgttgtatataaatgaataatactctgtttgagcacattgtcttcttttcaaattgacccaaaaaatgaaaaggagccatttgcattttt

SEQ ID NO: 1026 - protein, 1093 aa, Arabidopsis thaliana
  misc_feature: PFam Name: SKI; PFam Description: Shikimate kinase
  misc_feature: GI Number: 7270938; NR Description: shikimate kinase-like protein [Arabidopsis thaliana] >gi|5042170|emb|CAB44689.1| shikimate kinase-like protein [Arabidopsis thaliana] >gi|7434489|pir||T09370 shikimate kinase homolog F23K16.170 -
  misc_feature: GI Number: 30681570; NR Description: shikimate kinase,
  misc_feature: GI Number: 39104605; NR Description: putative shikimate
  misc_feature: GI Number: 42570867; NR Description: shikimate kinase,
  misc_feature: GI Number: 4417286; NR Description: putative shikimate kinase precursor [Arabidopsis thaliana] >gi|25288007|pir||A84607 probable shikimate kinase precursor [imported] - Arabidopsis thaliana >gi|20137565|sp|Q9SJ05|AROK_ARATH Probable shikimate
GAAAGAGTCTCTGCCTCTCAAGCTCCGCCGTCGGGGAAAAAAGAATATGGAAGCAGCTACTGTTCAGAGGTTTCAGTACTCATCATGGAATGATTTGAGAAATTTTGAAGGGAAGCCTCGTGGTTCTCTGAGGTATAATACACAGCGAATTAAGGAAGATAAAAGGTTTAGAGTTGTTGCTTTAACTCTTGACAAAAGAAGGGATCATCGACTTAGATCAGTTTCTGATAAGAACTCCTCAGCATTGTTGGAAACTGGAAGTCTTCTTCATTCTCCATTTGATGAAGAACAACAGATTTTGAAGAAAAAAGCTGAAGAGGTTAAACCGTATTTAAATGGACGATCGATGTATCTTGTTGGTATGATGGGTTCCGGGAAACGACTGTAGGGAAGATTATGGCAAGATCGCTTGGTTATACATTCTTTGATTGTGACACTTTGATCGAGCAGGCTATGAAGGGAACTTCTGTAGCTGAGATATTTGAGCATTTCGGTGAGAGTGTCTTCAGAGAAAAAGAGACTGAAGCGTTAAAGAAACTCTCTTTGATGTACCACCAAGTTGTTGTTTCAACCGGGGGAGGGGCAGTTATAAGACCCATCAATTGGAAGTACATGCATAAAGGTATTAGTATTTGGCTTGATGTACCTCTAGAAGCCTTAGCGCATAGAATAGCTGCTGTAGGAACTGGTTCAAGACCATTGCTACATGATGATGAGTCAGGGGACACATACACAGCGGCTTTAAACCGTCTTTCAACGATTTGGGATGCACGTGGTGAAGCATACACTAAAGCCAGCGCAAGAGTTTCCTCGGAGAATATTACTTTGAAGCTCGGTTATAGAAGTGTCTCAGATCTTACACCAGCTGAAATCGCCATTGAGGCCTTTGAGCAAGTTCAGAGCTATTTAGAGAAAGAAGATGGTATGGCTAGACCAGATGGACTCTAGTTCCAGAAAGTTATGTTTCCCCGCAACATCTCATGAATTTGTGCCTAGTTTTGAATGTTGTATATAAATGAATAATACTCTGTTTGAGCACATTGTCTTCTTTTCAAATTGACCCAAAAAATGAAAAGGAGCCATTTGCATTTTT

SEQ ID NO: 1027 - DNA, 1663 bp, Arabidopsis thaliana
  misc_feature (1)..(1663): Ceres cDNA ID no. 12396751
  misc_feature (1)..(1663): Ceres CLONE  ID no. 101933
  misc_feature (1)..(1663): Also known as  Ceres CDNA ID no. 23386338
aatgggctttattgggcccatatacgacaagacgaagacaatgagcaccttgctctgcctttctgttcccgtcgccgttggacctccgtcgcatgggtttccgatcatctttcacctcgccgcctaaccatctaactccattatttcgccgccatatagtttaaggtgcttaaagctgaggttttgatgggaggtttacgatgttggctgcaattctaccggaatgggaatgcacacaatgtgtttgcgataatgcctgaaagaaacgttttatacggagaatcctctttcaggcgggtatgggtcaggttcatgaccagtagcaagcgggttcaagataggagcagggaaaagagagtccaagagctcgaaatagcgacagagaaatggaagatagcttctaaagtgattttcttgatggaggtgttgaagggtgagcgagatatgataatgaccgtcaggtcgtttgaacagtataggcggcagatcaatttgcctaaaccacataagattagtgatttcatcagaaagtctccgaagttgtttgaattgtataaagatcagagaggagtcttgtggtgcgggttgacagagggaggggaagatttgttggacgagcatgacaagttacttgaagagaatggagacaaggctgcagaacatgtgactaggtgtttgatgatgtctgttgataagaagcttccattggataagattgttcatttccggagggatttcgggttgccgcttgattttaggataaactgggtctacaattttcctcagcattttaaagttgtgaaacttggggatggagaagagtatcttgagcttgtttcatggaatccagcttgggctatcacagagttggagaaaaagactttaggtataaccgaggattgcgaacacaagccaggtatgctttcactggctttccccatgaagtttcctccgtcgtacaagaaaatgtaccgatacagagggaagatcgaacattttcagaaacgatcttatctgtctccttatgccgatgcacgtggacttgaagctggttcaaaggaattcgacaagcgggcaattgctgttatgcacgaactgcttagttttacactcgagaagagattggtgacagatcacctaacccatttcaggagggagtttgtgatgccacagaagctgatgaggattttcttgaagcattgtggtatcttctatgtctctgagagagggaagagattcagtgtgttcttgactgaaggttacgaagggccagagctgattgagaaatgtcctttgatactttggaaagaaaagttactgaagtttacgggttacagaggaaggaagagagatattcaaacttatagtgatactttggacatggaagagagagaattactggagagtggttcaggagatgaagatttgagtgttggatttgagaaagatggtgattatgatgatgtggtaacagatgatgatgagatggacattggggaagtgaatgatgcatatgaagagaatagcaaagtttagacaaaagtttctaaatcatttatgtaaactttgctcttactataatgtaaacctgacatttctatattgacaagcttcataagctttctattcaaaaaatctccaagactgtagaataacattgaac

SEQ ID NO: 1028 - protein, 1663 aa, Arabidopsis thaliana
  misc_feature: GI Number: 21593983; NR Description: unknown [Arabidopsis thaliana]
  misc_feature: GI Number: 21536812; NR Description: unknown [Arabidopsis thaliana]
  misc_feature: GI Number: 53793176; NR Description: tyrosine-specific protein phosphatase-like protein [Oryza sativa (japonica
  misc_feature: GI Number: 34912696; NR Description: P0686E09.18 [Oryza sativa (japonica cultivar-group)] >gi|13365580|dbj|BAB39125.1|
AATGGGCTTTATTGGGCCCATATACGACAAGACGAAGACAATGAGCACCTTGCTCTGCCTTTCTGTTCCCGTCGCCGTTGGACCTCCGTCGCATGGGTTTCCGATCATCTTTCACCTCGCCGCCTAACCATCTAACTCCATTATTTCGCCGCCATATAGTTTAAGGTGCTTAAAGCTGAGGTTTTGATGGGAGGTTTACGATGTTGGCTGCAATTCTACCGGAATGGGAATGCACACAATGTGTTTGCGATAATGCCTGAAAGAAACGTTTTATACGGAGAATCCTCTTTCAGGCGGGTATGGGTCAGGTTCATGACCAGTAGCAAGCGGGTTCAAGATAGGAGCAGGGAAAAGAGAGTCCAAGAGCTCGAAATAGCGACAGAGAAATGGAAGATAGCTTCTAAAGTGATTTTCTTGATGGAGGTGTTGAAGGGTGAGCGAGATATGATAATGACCGTCAGGTCGTTTGAACAGTATAGGCGGCAGATCAATTTGCCTAAACCACATAAGATTAGTGATTTCATCAGAAAGTCTCCGAAGTTGTTTGAATTGTATAAAGATCAGAGAGGAGTCTTGTGGTGCGGGTTGACAGAGGGAGGGGAAGATTTGTTGGACGAGCATGACAAGTTACTTGAAGAGAATGGAGACAAGGCTGCAGAACATGTGACTAGGTGTTTGATGATGTCTGTTGATAAGAAGCTTCCATTGGATAAGATTGTTCATTTCCGGAGGGATTTCGGGTTGCCGCTTGATTTTAGGATAAACTGGGTCTACAATTTTCCTCAGCATTTTAAAGTTGTGAAACTTGGGGATGGAGAAGAGTATCTTGAGCTTGTTTCATGGAATCCAGCTTGGGCTATCACAGAGTTGGAGAAAAAGACTTTAGGTATAACCGAGGATTGCGAACACAAGCCAGGTATGCTTTCACTGGCTTTCCCCATGAAGTTTCCTCCGTCGTACAAGAAAATGTACCGATACAGAGGGAAGATCGAACATTTTCAGAAACGATCTTATCTGTCTCCTTATGCCGATGCACGTGGACTTGAAGCTGGTTCAAAGGAATTCGACAAGCGGGCAATTGCTGTTATGCACGAACTGCTTAGTTTTACACTCGAGAAGAGATTGGTGACAGATCACCTAACCCATTTCAGGAGGGAGTTTGTGATGCCACAGAAGCTGATGAGGATTTTCTTGAAGCATTGTGGTATCTTCTATGTCTCTGAGAGAGGGAAGAGATTCAGTGTGTTCTTGACTGAAGGTTACGAAGGGCCAGAGCTGATTGAGAAATGTCCTTTGATACTTTGGAAAGAAAAGTTACTGAAGTTTACGGGTTACAGAGGAAGGAAGAGAGATATTCAAACTTATAGTGATACTTTGGACATGGAAGAGAGAGAATTACTGGAGAGTGGTTCAGGAGATGAAGATTTGAGTGTTGGATTTGAGAAAGATGGTGATTATGATGATGTGGTAACAGATGATGATGAGATGGACATTGGGGAAGTGAATGATGCATATGAAGAGAATAGCAAAGTTTAGACAAAAGTTTCTAAATCATTTATGTAAACTTTGCTCTTACTATAATGTAAACCTGACATTTCTATATTGACAAGCTTCATAAGCTTTCTATTCAAAAAATCTCCAAGACTGTAGAATAACATTGAAC

SEQ ID NO: 1029 - DNA, 1045 bp, Arabidopsis thaliana
  misc_feature (1)..(1045): Ceres cDNA ID no. 12397017
  misc_feature (1)..(1045): Ceres CLONE  ID no. 39396
  misc_feature (1)..(1045): Also known as  Ceres CDNA ID no. 23386564
ctcacattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagctttgggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttctagcttgtctattatgtccgagaatttctttttctgtttttgattcttttcgttgtatatctttgtccaataaaggaaatgatgtgtctttactcc

SEQ ID NO: 1030 - protein, 1045 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 17104625; NR Description: putative xyloglucan endo-1,4-beta-D-glucanase precursor [Arabidopsis thaliana] >gi|14334966|gb|AAK59660.1| putative xyloglucan endo-1,4-beta-D-glucanase precursor [Arabidopsis thaliana]
  misc_feature: GI Number: 21553999; NR Description: xyloglucan
  misc_feature: GI Number: 29500899; NR Description: putative xyloglucan endotransglycosylase [Cucumis sativus] >gi|29500891|emb|CAD87535.1|
  misc_feature: GI Number: 29500901; NR Description: putative xyloglucan endotransglycosylase [Cucumis sativus] >gi|29500893|emb|CAD87536.1|
  misc_feature: GI Number: 19911573; NR Description: syringolide-induced
CTCACATTCCTCACCAAACCCTCTCCAAAACACACCCACACGTACGCACACACACAAAGACAATGTCTCCTTTCAAAATATTCTTCTTCACGACTCTTCTCGTGGCGGCGTTTTCAGTGTCGGCTGCTGATTTCAACACTGACGTCAACGTAGCTTTGGGAAATGGCCGTGGGAAGATACTCAACAACGGCCAGCTTCTTACTCTCTCCTTAGACAAATCCTCTGGTTCCGGTTTTCAATCCAAAACAGAGTATTTGTTTGGAAAGATTGATATGCAGATTAAGCTTGTTCCTGGTAACTCTGCAGGAACAGTCACAACTTTTTACCTAAAATCCGAAGGATCCACTTGGGATGAGATTGATTTTGAGTTCTTGGGTAATATGAGTGGAGATCCTTATACTTTACACACTAATGTTTACACTCAAGGTAAAGGTGACAAAGAGCAACAATTCCATCTCTGGTTCGACCCAACCGCCAATTTCCACACTTACTCAATCCTCTGGAACCCTCAAAGAATCATATTGACCGTCGATGACACACCCATTAGAGAGTTTAAAAACTATGAGTCTCTCGGTGTCTTGTTTCCAAAGAACAAGCCGATGAGGATGTACGCGAGTTTATGGAACGCAGACGATTGGGCAACAAGAGGCGGTCTTGTTAAAACTGATTGGTCTAAAGCTCCATTCATGGCTTCTTACAGAAACATTAAGATTGACTCGAAACCAAACTCCAATTGGTACACTCAAGAAATGGATTCAACAAGCCAAGCTAGACTCAAATGGGTTCAGAAGAATTACATGATCTACAATTATTGTACTGACCATAGGAGGTTTCCACAGGGAGCTCCTAAGGAATGCACAACAAGCTCATAGAATCTCAAATTATATTCTATTTATTTATCTACACTTCCTCTCTTTCTTTTATGTGAAAATTGTGAATGCTCTGTTTCTAGCTTGTCTATTATGTCCGAGAATTTCTTTTTCTGTTTTTGATTCTTTTCGTTGTATATCTTTGTCCAATAAAGGAAATGATGTGTCTTTACTCC

SEQ ID NO: 1031 - DNA, 2068 bp, Arabidopsis thaliana
  misc_feature (1)..(2068): Ceres cDNA ID no. 12397174
  misc_feature (1)..(2068): Ceres CLONE  ID no. 12161
  misc_feature (1)..(2068): Also known as  Ceres CDNA ID no. 23386712
atgatgcaactgggtggtggtactccgaccactacagcggcggctacaaccgtcacaactgctacagcaccaccgccacaatcaaacaacaacgattcagcggcaacagaagcagcggcagcagcggttggggcgtttgaggtgtcggaagagatgcacgaccgtgggtttggaggaaatcgttggccgcggcaggaaacgctagcgttgttgaaaatacgatctgacatgggaatagcgtttcgagacgctagcgttaaaggtcccttatgggaagaggtttctaggaaaatggcggagcatggttacataagaaacgcaaagaaatgcaaagagaaattcgagaacgtttacaaataccacaaacgaaccaaagaaggtcgtaccggaaaatccgaaggcaaaacttatcgcttctttgatcaattagaagctctcgagtctcaatctacaacctcactccaccatcatcaacaacaaacgcctcttcgaccacagcaaaacaacaacaacaacaacaacaacaacaacaacagctccatattttcaactcctcctccggtaacgacagttatgccgacgcttccttcttcatcaattcctccgtatactcagcagattaatgtaccttcgtttccaaacatctccggtgattttctatcggataattctacatcgtcttcgtcttcttattcgacttcttctgacatggagatgggtggtggaactgcgactacaaggaagaaaaggaagaggaaatggaaggtgtttttcgagcggttgatgaaacaagtagttgataaacaggaagagcttcaacgcaaattcttggaagctgttgaaaagcgagaacacgagagattggttagagaagagtcttggagagttcaagagattgccagaatcaaccgcgagcacgagatcttagctcaagaacgctctatgtccgctgcaaaagacgctgctgttatggcctttcttcaaaaactgtcagagaaacaaccgaatcagccacaaccgcagcctcagccgcaacaagttcgaccatcaatgcagcttaataacaacaatcagcagcaaccgcctcaacggtctcctccaccgcaacctcctgctccgcttccgcagccaattcaagcggttgtgtcgacgttagacacaacgaaaacggacaatggtggtgatcagaatatgactcctgcagcttcagcgagctcgtcgcggtggccgaaagtggagatagaagcattgataaagctgaggacgaatcttgattcgaaatatcaagaaaacggaccaaaaggaccattgtgggaagagatatcagcgggaatgagaaggttaggattcaacaggaactcaaagagatgcaaagagaaatgggaaaacataaacaaatacttcaagaaagtcaaagagagcaacaagaaacgtcccgaagattccaagacttgcccttactttcaccagcttgatgctttatatagagagaggaacaaattccacagcaacaacaacattgcagcttcttcttcatcttccggtcttgttaaaccggataattctgttcccttgatggtccaaccagagcagcaatggcctccggctgtaacgactgcgacaactactcccgcagcggctcagcctgatcagcaatctcagccgtcggagcagaactttgatgatgaagaaggtacagatgaagagtacgacgatgaagatgaggaagaggagaatgaagaagaggaaggaggtgagttcgagcttgtgcctagcaataacaacaacaacaagacgacgaataatctgtaatgatgatgattcgagttcgaaccggtttggtggtgaaagattagtaatctttttttaagttttgatacagaacatgagaatttaaatattggagggtttttttttttttttttttttcatctttgatttttaagttatactgaagagagatttaatatgttaaaacaaaattaaaataaactgtgatttaattattttttccttgggatatataaataaaaaatgttaagatagggggacaatgtggggttttcat

SEQ ID NO: 1032 - protein, 2068 aa, Arabidopsis thaliana
  misc_feature: PFam Name: Myb_DNA-binding; PFam Description: Myb-like
  misc_feature: GI Number: 13646986; NR Description: DNA-binding protein DF1
  misc_feature: GI Number: 18182309; NR Description: GT-2 factor [Glycine max]
  misc_feature: GI Number: 416490; NR Description: GT-2 factor [Arabidopsis thaliana] >gi|481812|pir||S39484 DNA-binding protein GT-2 - Arabidopsis thaliana >gi|12322224|gb|AAG51145.1| trihelix DNA-binding protein (GT2) [Arabidopsis thaliana]
  misc_feature: GI Number: 21592726; NR Description: trihelix DNA-binding
  misc_feature: GI Number: 37536070; NR Description: putative transcription factor [Oryza sativa (japonica cultivar-group)] >gi|13786451|gb|AAK39576.1| putative transcription factor [Oryza sativa] >gi|31433064|gb|AAP54624.1| putative transcription factor
ATGATGCAACTGGGTGGTGGTACTCCGACCACTACAGCGGCGGCTACAACCGTCACAACTGCTACAGCACCACCGCCACAATCAAACAACAACGATTCAGCGGCAACAGAAGCAGCGGCAGCAGCGGTTGGGGCGTTTGAGGTGTCGGAAGAGATGCACGACCGTGGGTTTGGAGGAAATCGTTGGCCGCGGCAGGAAACGCTAGCGTTGTTGAAAATACGATCTGACATGGGAATAGCGTTTCGAGACGCTAGCGTTAAAGGTCCCTTATGGGAAGAGGTTTCTAGGAAAATGGCGGAGCATGGTTACATAAGAAACGCAAAGAAATGCAAAGAGAAATTCGAGAACGTTTACAAATACCACAAACGAACCAAAGAAGGTCGTACCGGAAAATCCGAAGGCAAAACTTATCGCTTCTTTGATCAATTAGAAGCTCTCGAGTCTCAATCTACAACCTCACTCCACCATCATCAACAACAAACGCCTCTTCGACCACAGCAAAACAACAACAACAACAACAACAACAACAACAACAGCTCCATATTTTCAACTCCTCCTCCGGTAACGACAGTTATGCCGACGCTTCCTTCTTCATCAATTCCTCCGTATACTCAGCAGATTAATGTACCTTCGTTTCCAAACATCTCCGGTGATTTTCTATCGGATAATTCTACATCGTCTTCGTCTTCTTATTCGACTTCTTCTGACATGGAGATGGGTGGTGGAACTGCGACTACAAGGAAGAAAAGGAAGAGGAAATGGAAGGTGTTTTTCGAGCGGTTGATGAAACAAGTAGTTGATAAACAGGAAGAGCTTCAACGCAAATTCTTGGAAGCTGTTGAAAAGCGAGAACACGAGAGATTGGTTAGAGAAGAGTCTTGGAGAGTTCAAGAGATTGCCAGAATCAACCGCGAGCACGAGATCTTAGCTCAAGAACGCTCTATGTCCGCTGCAAAAGACGCTGCTGTTATGGCCTTTCTTCAAAAACTGTCAGAGAAACAACCGAATCAGCCACAACCGCAGCCTCAGCCGCAACAAGTTCGACCATCAATGCAGCTTAATAACAACAATCAGCAGCAACCGCCTCAACGGTCTCCTCCACCGCAACCTCCTGCTCCGCTTCCGCAGCCAATTCAAGCGGTTGTGTCGACGTTAGACACAACGAAAACGGACAATGGTGGTGATCAGAATATGACTCCTGCAGCTTCAGCGAGCTCGTCGCGGTGGCCGAAAGTGGAGATAGAAGCATTGATAAAGCTGAGGACGAATCTTGATTCGAAATATCAAGAAAACGGACCAAAAGGACCATTGTGGGAAGAGATATCAGCGGGAATGAGAAGGTTAGGATTCAACAGGAACTCAAAGAGATGCAAAGAGAAATGGGAAAACATAAACAAATACTTCAAGAAAGTCAAAGAGAGCAACAAGAAACGTCCCGAAGATTCCAAGACTTGCCCTTACTTTCACCAGCTTGATGCTTTATATAGAGAGAGGAACAAATTCCACAGCAACAACAACATTGCAGCTTCTTCTTCATCTTCCGGTCTTGTTAAACCGGATAATTCTGTTCCCTTGATGGTCCAACCAGAGCAGCAATGGCCTCCGGCTGTAACGACTGCGACAACTACTCCCGCAGCGGCTCAGCCTGATCAGCAATCTCAGCCGTCGGAGCAGAACTTTGATGATGAAGAAGGTACAGATGAAGAGTACGACGATGAAGATGAGGAAGAGGAGAATGAAGAAGAGGAAGGAGGTGAGTTCGAGCTTGTGCCTAGCAATAACAACAACAACAAGACGACGAATAATCTGTAATGATGATGATTCGAGTTCGAACCGGTTTGGTGGTGAAAGATTAGTAATCTTTTTTTAAGTTTTGATACAGAACATGAGAATTTAAATATTGGAGGGTTTTTTTTTTTTTTTTTTTTTCATCTTTGATTTTTAAGTTATACTGAAGAGAGATTTAATATGTTAAAACAAAATTAAAATAAACTGTGATTTAATTATTTTTTCCTTGGGATATATAAATAAAAAATGTTAAGATAGGGGGACAATGTGGGGTTTTCAT

SEQ ID NO: 1033 - DNA, 1831 bp, Arabidopsis thaliana
  misc_feature (1)..(1831): Ceres cDNA ID no. 12397190
  misc_feature (1)..(1831): Ceres CLONE  ID no. 114993
  misc_feature (1)..(1831): Also known as  Ceres CDNA ID no. 12397190
ttttcctccgacaatatatttttaagtaatgacaatgtttccgcattattgggtttaattccatttttaaattagggttcttcagatcgacaaatctttctctttctctttccccgatcggaatcatgctaaagatctgaactttttctcagatccgtgaataagtaagtacggagagacagaaacatactcagactgatctgaggaaaacaaagttgatggtcgcaaacctgtaagtgaaatctatagagagagacgttgaagaagaaaatgggtcaagatggttcgccggcgcataaaagaccatccggaagcggcggaggacttccgacgacgacgttaaccaacggtggaggaagaggtggtcgtggtggtttgttacctcgaggtagacagatgcagaagacgtttaacaacatcaagatcacaattctctgtggtttcgtcacaattctcgtcttacgtggcactatcggtgttggtaacctaggaagctcaagcgccgatgcagttaaccagaacatcattgaggagactaaccggattctagctgagatccgatctgattcggatccaaccgacttggatgagcctcaggaaggtgatatgaatcccaatgcgacgtatgttctaggtcctaagatcacggattgggatagtcaacgtaaggtatggttgaatcagaatcctgagtttcctagtactgtcaatggcaaagctcgaatcttgcttttaacaggatctcctcctaagccttgtgataaccccattggtgatcattatcttttgaaatctgtgaagaacaagattgattattgtaggcttcatggaattgagattgtgtataacatggctcatttggataaggaactcgctggctattgggcaaaattaccaatgattaggaggttgatgttgtctcatccagaagttgagtggatctggtggatggatagtgatgctttgttcactgatatactgtttcagatccctttggctaggtatcagaagcataatctagtgattcatggttatccggacttgttgttcgatcagaagtcgtggattgctttgaacacaggtagttttctgctgaggaattgtcagtggtcgttggatttgttagatgcttgggcgcctatgggacctaaagggccaattcgtgatgaggccgggaaggtattgacggcttatctgaaaggtagaccagcttttgaggcagatgatcagtcagcattgatctatctcctgctttctcagaaagatacatggatggagaaagtgtttgtggagaatcaatactatttgcacgggttttgggaaggtttggttgataggtatgaggagatgatagagaagtatcacccgggattgggtgatgagagatggccatttgtgacccatttcgttgggtgtaaaccgtgtggtagctatgctgattatgcagtcgagaggtgcttgaagagtatggagagggcctttaattttgcagacaatcaagtgctcaagctgtatggttttagccataggggattgttgagccccaagattaagaggatcagaaatgagacagtctctcctttggagtttgtagacaagtttgatattcgcagaacgccagtggaaaccaaaccacagaactagaggaacacaaggagaggataggctcagctctcatgagattgtggacacgtataggtaaattatatgacactcacaaatgcaaagcaaatttgtttgcctgtacttgctactttactgtttcttctgcttctcttttttttgtttgttgttgttgcaagaatattttagatgcaaattctttttccat

SEQ ID NO: 1034 - protein, 1831 aa, Arabidopsis thaliana
TTTTCCTCCGACAATATATTTTTAAGTAATGACAATGTTTCCGCATTATTGGGTTTAATTCCATTTTTAAATTAGGGTTCTTCAGATCGACAAATCTTTCTCTTTCTCTTTCCCCGATCGGAATCATGCTAAAGATCTGAACTTTTTCTCAGATCCGTGAATAAGTAAGTACGGAGAGACAGAAACATACTCAGACTGATCTGAGGAAAACAAAGTTGATGGTCGCAAACCTGTAAGTGAAATCTATAGAGAGAGACGTTGAAGAAGAAAATGGGTCAAGATGGTTCGCCGGCGCATAAAAGACCATCCGGAAGCGGCGGAGGACTTCCGACGACGACGTTAACCAACGGTGGAGGAAGAGGTGGTCGTGGTGGTTTGTTACCTCGAGGTAGACAGATGCAGAAGACGTTTAACAACATCAAGATCACAATTCTCTGTGGTTTCGTCACAATTCTCGTCTTACGTGGCACTATCGGTGTTGGTAACCTAGGAAGCTCAAGCGCCGATGCAGTTAACCAGAACATCATTGAGGAGACTAACCGGATTCTAGCTGAGATCCGATCTGATTCGGATCCAACCGACTTGGATGAGCCTCAGGAAGGTGATATGAATCCCAATGCGACGTATGTTCTAGGTCCTAAGATCACGGATTGGGATAGTCAACGTAAGGTATGGTTGAATCAGAATCCTGAGTTTCCTAGTACTGTCAATGGCAAAGCTCGAATCTTGCTTTTAACAGGATCTCCTCCTAAGCCTTGTGATAACCCCATTGGTGATCATTATCTTTTGAAATCTGTGAAGAACAAGATTGATTATTGTAGGCTTCATGGAATTGAGATTGTGTATAACATGGCTCATTTGGATAAGGAACTCGCTGGCTATTGGGCAAAATTACCAATGATTAGGAGGTTGATGTTGTCTCATCCAGAAGTTGAGTGGATCTGGTGGATGGATAGTGATGCTTTGTTCACTGATATACTGTTTCAGATCCCTTTGGCTAGGTATCAGAAGCATAATCTAGTGATTCATGGTTATCCGGACTTGTTGTTCGATCAGAAGTCGTGGATTGCTTTGAACACAGGTAGTTTTCTGCTGAGGAATTGTCAGTGGTCGTTGGATTTGTTAGATGCTTGGGCGCCTATGGGACCTAAAGGGCCAATTCGTGATGAGGCCGGGAAGGTATTGACGGCTTATCTGAAAGGTAGACCAGCTTTTGAGGCAGATGATCAGTCAGCATTGATCTATCTCCTGCTTTCTCAGAAAGATACATGGATGGAGAAAGTGTTTGTGGAGAATCAATACTATTTGCACGGGTTTTGGGAAGGTTTGGTTGATAGGTATGAGGAGATGATAGAGAAGTATCACCCGGGATTGGGTGATGAGAGATGGCCATTTGTGACCCATTTCGTTGGGTGTAAACCGTGTGGTAGCTATGCTGATTATGCAGTCGAGAGGTGCTTGAAGAGTATGGAGAGGGCCTTTAATTTTGCAGACAATCAAGTGCTCAAGCTGTATGGTTTTAGCCATAGGGGATTGTTGAGCCCCAAGATTAAGAGGATCAGAAATGAGACAGTCTCTCCTTTGGAGTTTGTAGACAAGTTTGATATTCGCAGAACGCCAGTGGAAACCAAACCACAGAACTAGAGGAACACAAGGAGAGGATAGGCTCAGCTCTCATGAGATTGTGGACACGTATAGGTAAATTATATGACACTCACAAATGCAAAGCAAATTTGTTTGCCTGTACTTGCTACTTTACTGTTTCTTCTGCTTCTCTTTTTTTTGTTTGTTGTTGTTGCAAGAATATTTTAGATGCAAATTCTTTTTCCAT

SEQ ID NO: 1035 - DNA, 1336 bp, Zea mays
  misc_feature (1)..(1336): Ceres cDNA ID no. 12400914
  misc_feature (1)..(1336): Ceres CLONE  ID no. 212865
  misc_feature (1)..(1336): Also known as  Ceres CDNA ID no. 23741369
atatcctataacaatttccccaacccacatggccaacgccgacgctggcgacggcgacgaggtcatcctcgacgctcccggcttcatacgagtgtacaggagcggccgcgtcgagcgctttctgccggtcgacttcgccccgccctccactgacgccgccaccggcgtttcttcaaaggacgtcgccatcctcccagacgcctgcctattggttcgcatttacctcccagcgcccccctcttccggaagttacagcggcaagctccccgtcctggtgttcttccacggcggcgggttctgcctcggttcggcgtttgatgcggcggtgcactcccacgccaaccggttagccgcggctgccggcgcaatcatcgtgtcggtggaataccgcctcgcgccagagcatccggtccccgctctctaccgggacgcgtggacggcgctccagtgggtggccgcgcactccgtgggccgggggcaggaaccctggctgactgcccacgcggacctcgggcgcgtccacgtcggtggagagagcgcgggcgcgaacattgcccaccacgccgcgatgcgcgctggcagagaggagctgggccacggcgtgaagctcagctcgctcgtgatgatccatccctacttcctgggaggcgagagctccgagacagacgacatgggcgtagcgttgctccgcgagctcgtccggctgtggccggtggtatgcccgggcacgagcgggtgcgatgacgacccgttgatcaatccgatggcagagggtgcccccaatctcgctagcttggggtgccgacgcgtagtggtgtgcgtcgggggaaaggacccgatgagaggcagaggaaggctgtattgtgagaagctgaagagaagtgggtggcgcggggaggtggatgactgggaggcggacggccagggacacggtttccatctctcgtgccccatgagcgcagaggcggaggcgcaagtccgggtcatcgctgagtttctgacctacggatgacatatctgttttcccactccttcacgcggccatggtgcattgttctcgaatctgatatacattttttgtttcgagttttggttgaggacttgcatgtttatattttatatttttatctactatttcataagcttaataaatgtttggctatgggttccagattctcaattttcatcagaagaaggggttactgagctgtattagacttacctttgggttaatatctattggtgcaagacccagattggctatacctttgtaatcgtatttgctttgcctggctaaagtttatgacaaaattgtcgcattgctgacattctctct

SEQ ID NO: 1036 - protein, 1336 aa, Zea mays
  misc_feature: PFam Name: Abhydrolase_3; PFam Description: alpha/beta
  misc_feature: PFam Name: COesterase; PFam Description: Carboxylesterase
  misc_feature: GI Number: 51535286; NR Description: putative PrMC3 [Oryza
  misc_feature: GI Number: 51535285; NR Description: putative PrMC3 [Oryza
  misc_feature: GI Number: 51091934; NR Description: putative PrMC3 [Oryza sativa (japonica cultivar-group)] >gi|51090384|dbj|BAD35306.1|
  misc_feature: GI Number: 56692178; NR Description: 2-Hydroxyisoflavanone
  misc_feature: GI Number: 51091937; NR Description: putative PrMC3 [Oryza sativa (japonica cultivar-group)] >gi|51090387|dbj|BAD35309.1|
ATATCCTATAACAATTTCCCCAACCCACATGGCCAACGCCGACGCTGGCGACGGCGACGAGGTCATCCTCGACGCTCCCGGCTTCATACGAGTGTACAGGAGCGGCCGCGTCGAGCGCTTTCTGCCGGTCGACTTCGCCCCGCCCTCCACTGACGCCGCCACCGGCGTTTCTTCAAAGGACGTCGCCATCCTCCCAGACGCCTGCCTATTGGTTCGCATTTACCTCCCAGCGCCCCCCTCTTCCGGAAGTTACAGCGGCAAGCTCCCCGTCCTGGTGTTCTTCCACGGCGGCGGGTTCTGCCTCGGTTCGGCGTTTGATGCGGCGGTGCACTCCCACGCCAACCGGTTAGCCGCGGCTGCCGGCGCAATCATCGTGTCGGTGGAATACCGCCTCGCGCCAGAGCATCCGGTCCCCGCTCTCTACCGGGACGCGTGGACGGCGCTCCAGTGGGTGGCCGCGCACTCCGTGGGCCGGGGGCAGGAACCCTGGCTGACTGCCCACGCGGACCTCGGGCGCGTCCACGTCGGTGGAGAGAGCGCGGGCGCGAACATTGCCCACCACGCCGCGATGCGCGCTGGCAGAGAGGAGCTGGGCCACGGCGTGAAGCTCAGCTCGCTCGTGATGATCCATCCCTACTTCCTGGGAGGCGAGAGCTCCGAGACAGACGACATGGGCGTAGCGTTGCTCCGCGAGCTCGTCCGGCTGTGGCCGGTGGTATGCCCGGGCACGAGCGGGTGCGATGACGACCCGTTGATCAATCCGATGGCAGAGGGTGCCCCCAATCTCGCTAGCTTGGGGTGCCGACGCGTAGTGGTGTGCGTCGGGGGAAAGGACCCGATGAGAGGCAGAGGAAGGCTGTATTGTGAGAAGCTGAAGAGAAGTGGGTGGCGCGGGGAGGTGGATGACTGGGAGGCGGACGGCCAGGGACACGGTTTCCATCTCTCGTGCCCCATGAGCGCAGAGGCGGAGGCGCAAGTCCGGGTCATCGCTGAGTTTCTGACCTACGGATGACATATCTGTTTTCCCACTCCTTCACGCGGCCATGGTGCATTGTTCTCGAATCTGATATACATTTTTTGTTTCGAGTTTTGGTTGAGGACTTGCATGTTTATATTTTATATTTTTATCTACTATTTCATAAGCTTAATAAATGTTTGGCTATGGGTTCCAGATTCTCAATTTTCATCAGAAGAAGGGGTTACTGAGCTGTATTAGACTTACCTTTGGGTTAATATCTATTGGTGCAAGACCCAGATTGGCTATACCTTTGTAATCGTATTTGCTTTGCCTGGCTAAAGTTTATGACAAAATTGTCGCATTGCTGACATTCTCTCT

SEQ ID NO: 1037 - DNA, 1254 bp, Zea mays
  misc_feature (1)..(1254): Ceres cDNA ID no. 12402364
  misc_feature (1)..(1254): Ceres CLONE  ID no. 306677
  misc_feature (1)..(1254): Also known as  Ceres CDNA ID no. 23746474
gcacgagaccattacctagaacatcctaatcaaaaataacggaacgtcgtccagatctcgatcggccggtggccgccgtggtcagtaaggcaggcatggcatccgaggtagccggcctcgccgtggtctcggccgccgcgtccgtggccctggtctacgctcgtctcgccacctcgcggctggctcccggcaccccccgcctcgcggcgctgctcccggtgctcctactcctcccagtcctccccttcgccttctcctccatccacctccgcaccgtctccgccttcttcctcgtctggctctgcggcttcaagctcctcctcctcgccgcggggcacgacgggccgctccaccccgccctcccgctcgtgcgcttcgtcgcgtgcgccgcgctgcccatcaaggtccgggacgagaacgacaagcagcagcaaactcggataccccgctcctctctcccttcgggattcctgctgtcctacgcggccaaggcggcgctcttctccgcgctcgtctccgtccggtgctacagggcgcggatgcccgcgtacgccgtgcccgtgttcgacggcgcgcacgtgtacctcatgctggagctcttcctcgcgtccgccgcggcgctcgcgcgcgcgctgctgggcgcggagctggagccgcagttcgaccggccgtacctcgcttcctccctgcgcgacttctggggccggcggtggaacctcatggtccccggcgtgctccggccctgcgtgtaccgccccgtgcgcgcccgcttcggcgccgccgcgggcgtgctcgcggcgttcctcgtgtccggggccatgcacgaggtcatgttctactacatcacgctggaggccgggaccggggaggtgaccgcgttcttcgcgctgcacggcgcgtgcgcggtggccgagcggtggatggcgcggcagggcggcatgtggcggccgccgcggcccgtcgcgacggcgctgacgctggcgttcgtgacggggacggggtcgtggctattctttgcgcccgtgatccgaagccggctggacgaggccatcatcgcagagtgcgaggggatgcttgcgttcttggagcgcgctggccggaatctagccgcgatggcacatttcatttgaacctctgtaaggtagagttatttggaaccgtgatactcccaacactgggcttctgaaaatcagtatcccgaacagagcaattgtaattttagtattataattcatagaacttcagatttctggt

SEQ ID NO: 1038 - protein, 1254 aa, Zea mays
  misc_feature: PFam Name: MBOAT; PFam Description: MBOAT family
  misc_feature: PFam Name: Pyr_redox_2; PFam Description: Pyridine
  misc_feature: PFam Name: Keratin_B2; PFam Description: Keratin, high
  misc_feature: PFam Name: IER; PFam Description: Immediate early response
  misc_feature: PFam Name: Cation_efflux; PFam Description: Cation efflux family
  misc_feature: GI Number: 50938097; NR Description: putative wax synthase isoform protein [Oryza sativa (japonica cultivar-group)] >gi|28812087|dbj|BAC65039.1| putative wax synthase isoform protein [Oryza sativa (japonica cultivar-group)] [Oryza sativa
  misc_feature: GI Number: 50907895; NR Description: putative wax synthase [Oryza sativa (japonica cultivar-group)] >gi|47497822|dbj|BAD19919.1| putative wax synthase [Oryza sativa
  misc_feature: GI Number: 38347115; NR Description: OSJNBa0009K15.12 [Oryza
  misc_feature: GI Number: 58532043; NR Description: OSJNBa0009K15.16 [Oryza
  misc_feature: GI Number: 50908115; NR Description: putative wax synthase [Oryza sativa (japonica cultivar-group)] >gi|47497319|dbj|BAD19360.1| putative wax synthase [Oryza sativa
GCACGAGACCATTACCTAGAACATCCTAATCAAAAATAACGGAACGTCGTCCAGATCTCGATCGGCCGGTGGCCGCCGTGGTCAGTAAGGCAGGCATGGCATCCGAGGTAGCCGGCCTCGCCGTGGTCTCGGCCGCCGCGTCCGTGGCCCTGGTCTACGCTCGTCTCGCCACCTCGCGGCTGGCTCCCGGCACCCCCCGCCTCGCGGCGCTGCTCCCGGTGCTCCTACTCCTCCCAGTCCTCCCCTTCGCCTTCTCCTCCATCCACCTCCGCACCGTCTCCGCCTTCTTCCTCGTCTGGCTCTGCGGCTTCAAGCTCCTCCTCCTCGCCGCGGGGCACGACGGGCCGCTCCACCCCGCCCTCCCGCTCGTGCGCTTCGTCGCGTGCGCCGCGCTGCCCATCAAGGTCCGGGACGAGAACGACAAGCAGCAGCAAACTCGGATACCCCGCTCCTCTCTCCCTTCGGGATTCCTGCTGTCCTACGCGGCCAAGGCGGCGCTCTTCTCCGCGCTCGTCTCCGTCCGGTGCTACAGGGCGCGGATGCCCGCGTACGCCGTGCCCGTGTTCGACGGCGCGCACGTGTACCTCATGCTGGAGCTCTTCCTCGCGTCCGCCGCGGCGCTCGCGCGCGCGCTGCTGGGCGCGGAGCTGGAGCCGCAGTTCGACCGGCCGTACCTCGCTTCCTCCCTGCGCGACTTCTGGGGCCGGCGGTGGAACCTCATGGTCCCCGGCGTGCTCCGGCCCTGCGTGTACCGCCCCGTGCGCGCCCGCTTCGGCGCCGCCGCGGGCGTGCTCGCGGCGTTCCTCGTGTCCGGGGCCATGCACGAGGTCATGTTCTACTACATCACGCTGGAGGCCGGGACCGGGGAGGTGACCGCGTTCTTCGCGCTGCACGGCGCGTGCGCGGTGGCCGAGCGGTGGATGGCGCGGCAGGGCGGCATGTGGCGGCCGCCGCGGCCCGTCGCGACGGCGCTGACGCTGGCGTTCGTGACGGGGACGGGGTCGTGGCTATTCTTTGCGCCCGTGATCCGAAGCCGGCTGGACGAGGCCATCATCGCAGAGTGCGAGGGGATGCTTGCGTTCTTGGAGCGCGCTGGCCGGAATCTAGCCGCGATGGCACATTTCATTTGAACCTCTGTAAGGTAGAGTTATTTGGAACCGTGATACTCCCAACACTGGGCTTCTGAAAATCAGTATCCCGAACAGAGCAATTGTAATTTTAGTATTATAATTCATAGAACTTCAGATTTCTGGT

SEQ ID NO: 1039 - DNA, 907 bp, Zea mays
  misc_feature (1)..(907): Ceres cDNA ID no. 12402718
  misc_feature (1)..(907): Ceres CLONE  ID no. 221693
  misc_feature (1)..(907): Also known as  Ceres CDNA ID no. 23749601
agaaccaccacaaaacctgctcctagctgctctcgtgtgttttgttacatccaatattaagcgagagcgggctagctataggtaagaccggaagaggatgatggtggacaggcagcgcgtgaggcaatgcgacattgaggtcatgaagatggccatgctcaagcacgaagaaaccttcaggcagcaggtccacgagctgcatcgcctgtaccgtatacagagggagctgatgatgacgacgagtgacgacctgaccggagccaagccggtgaccaccccccgccggcgcagcaagcagccgcggcgggcgctgccgctgggcctgcagctcccggccgacgagtacatagccagcgccgacgaggacgaggacgccgccgccggcacggagctggagctgacgctcgccgtcggcgggcgctgctcacccgacggccgtcgcaagagcgacaggaggaggaggaggaggcaagcagcagagcctcgcgacgacgccggcgccgtctcctcccccttcgggcccgactgctccggcgcgagcgtcctatcgtcgccttcgtcggccgagtactgctccgatgacgggcctgcggcggcgttccacgcgccgccgccgccgtgccagagggccgtggcgtttgaccttgaagaaagcatgatgatgcggcagcacgcgccgtggctgctgcagtgccggcagtacctcaccctgaggatgacatgaaaccctgcaggctgcagcagcaagctgcagctcgccgtccatgtccatcgatcaatcaatcacattgtacctggtttgcgttgtgttgtagaagcagtagtcactagtttttgttttgtttgtttttgctatgttctaggtggcgcttgtgtcctaataatcctgatccaaagatgctaattg

SEQ ID NO: 1040 - protein, 907 aa, Zea mays
AGAACCACCACAAAACCTGCTCCTAGCTGCTCTCGTGTGTTTTGTTACATCCAATATTAAGCGAGAGCGGGCTAGCTATAGGTAAGACCGGAAGAGGATGATGGTGGACAGGCAGCGCGTGAGGCAATGCGACATTGAGGTCATGAAGATGGCCATGCTCAAGCACGAAGAAACCTTCAGGCAGCAGGTCCACGAGCTGCATCGCCTGTACCGTATACAGAGGGAGCTGATGATGACGACGAGTGACGACCTGACCGGAGCCAAGCCGGTGACCACCCCCCGCCGGCGCAGCAAGCAGCCGCGGCGGGCGCTGCCGCTGGGCCTGCAGCTCCCGGCCGACGAGTACATAGCCAGCGCCGACGAGGACGAGGACGCCGCCGCCGGCACGGAGCTGGAGCTGACGCTCGCCGTCGGCGGGCGCTGCTCACCCGACGGCCGTCGCAAGAGCGACAGGAGGAGGAGGAGGAGGCAAGCAGCAGAGCCTCGCGACGACGCCGGCGCCGTCTCCTCCCCCTTCGGGCCCGACTGCTCCGGCGCGAGCGTCCTATCGTCGCCTTCGTCGGCCGAGTACTGCTCCGATGACGGGCCTGCGGCGGCGTTCCACGCGCCGCCGCCGCCGTGCCAGAGGGCCGTGGCGTTTGACCTTGAAGAAAGCATGATGATGCGGCAGCACGCGCCGTGGCTGCTGCAGTGCCGGCAGTACCTCACCCTGAGGATGACATGAAACCCTGCAGGCTGCAGCAGCAAGCTGCAGCTCGCCGTCCATGTCCATCGATCAATCAATCACATTGTACCTGGTTTGCGTTGTGTTGTAGAAGCAGTAGTCACTAGTTTTTGTTTTGTTTGTTTTTGCTATGTTCTAGGTGGCGCTTGTGTCCTAATAATCCTGATCCAAAGATGCTAATTG

SEQ ID NO: 1041 - DNA, 824 bp, Zea mays
  misc_feature (1)..(824): Ceres cDNA ID no. 12403258
  misc_feature (1)..(824): Ceres CLONE  ID no. 297032
  misc_feature (1)..(824): Also known as  Ceres CDNA ID no. 23749742
aaaagccaaaccaacaagtgcagattatctcaccgttgtttgccatgtcgtcggctgcgcctgcgagtgcgcgggcggggcaccagctccctcgccggcccgcgtcgtgctccaactccaagcagaacaggaagccgcctgtggtgatagcgcacgagtgccccagcgcgatgcgtgcccacttggtggaggtgcccgcggggcgcgacgtgctgtcgtgcgtctcggcgttcgcgcggcgtgggcggtgcggtgcgatggtgctgggcgcggccgggcacgtcacagacgtggtgctccgggagcccgcgctggtgctccgcggcaccatggagatactgagcctgtccggctgcttcttcccattcccggggcccgggtcggtggcagccacgggaacggcggtgtttatggccgggccgcggggcagcgtgctgggtggcggcgttgcgctgggagggctggtggccgcggggccggtggtggtgatggtggccacgtttgtggcggcggcgcttgacaggctgccgttggccaagggggatgaggccgggaaggatgtgcatggacaccaccgggcgtgcggctgggcggcagtgtgccggaaaaagaagcagcagcagcttggcgccaattaataccttccattccatctctggcgaatttaatcaaattgatttacataaatttccttccgtatgccagctacacagctagctagctagagtttaaacggacaagctgggggtgcccatctaaagcttagctcccgtaatatcgaatgtttcaataataattacggatattaaatatagtttaattat

SEQ ID NO: 1042 - protein, 824 aa, Zea mays
  misc_feature: PFam Name: GRP; PFam Description: Glycine rich protein family
  misc_feature: GI Number: 38604060; NR Description: At2g42940 [Arabidopsis thaliana] >gi|38454168|gb|AAR20778.1| At2g42940 [Arabidopsis thaliana] >gi|20197862|gb|AAM15286.1| putative DNA binding protein [Arabidopsis thaliana] >gi|4512661|gb|AAD21715.1|
  misc_feature: GI Number: 50941343; NR Description: DNA-binding protein-like [Oryza sativa (japonica cultivar-group)] >gi|29467557|dbj|BAC66727.1| DNA-binding protein-like [Oryza sativa (japonica cultivar-group)] >gi|37806155|dbj|BAC99660.1|
  misc_feature: GI Number: 3668079; NR Description: putative AT-hook DNA-binding protein [Arabidopsis thaliana] >gi|25348244|pir||E84766 probable AT-hook DNA-binding protein [imported] - Arabidopsis thaliana >gi|15226945|ref|NP_181070.1| DNA-binding protein-related
  misc_feature: GI Number: 7269128; NR Description: putative DNA binding protein [Arabidopsis thaliana] >gi|2827558|emb|CAA16566.1| putative DNA binding protein [Arabidopsis thaliana] >gi|15235815|ref|NP_194012.1| DNA-binding protein-related
  misc_feature: GI Number: 50948561; NR Description: putative SAP1 protein [Oryza sativa (japonica cultivar-group)] >gi|42408442|dbj|BAD09624.1| putative SAP1 protein [Oryza sativa
AAAAGCCAAACCAACAAGTGCAGATTATCTCACCGTTGTTTGCCATGTCGTCGGCTGCGCCTGCGAGTGCGCGGGCGGGGCACCAGCTCCCTCGCCGGCCCGCGTCGTGCTCCAACTCCAAGCAGAACAGGAAGCCGCCTGTGGTGATAGCGCACGAGTGCCCCAGCGCGATGCGTGCCCACTTGGTGGAGGTGCCCGCGGGGCGCGACGTGCTGTCGTGCGTCTCGGCGTTCGCGCGGCGTGGGCGGTGCGGTGCGATGGTGCTGGGCGCGGCCGGGCACGTCACAGACGTGGTGCTCCGGGAGCCCGCGCTGGTGCTCCGCGGCACCATGGAGATACTGAGCCTGTCCGGCTGCTTCTTCCCATTCCCGGGGCCCGGGTCGGTGGCAGCCACGGGAACGGCGGTGTTTATGGCCGGGCCGCGGGGCAGCGTGCTGGGTGGCGGCGTTGCGCTGGGAGGGCTGGTGGCCGCGGGGCCGGTGGTGGTGATGGTGGCCACGTTTGTGGCGGCGGCGCTTGACAGGCTGCCGTTGGCCAAGGGGGATGAGGCCGGGAAGGATGTGCATGGACACCACCGGGCGTGCGGCTGGGCGGCAGTGTGCCGGAAAAAGAAGCAGCAGCAGCTTGGCGCCAATTAATACCTTCCATTCCATCTCTGGCGAATTTAATCAAATTGATTTACATAAATTTCCTTCCGTATGCCAGCTACACAGCTAGCTAGCTAGAGTTTAAACGGACAAGCTGGGGGTGCCCATCTAAAGCTTAGCTCCCGTAATATCGAATGTTTCAATAATAATTACGGATATTAAATATAGTTTAATTAT

SEQ ID NO: 1043 - DNA, 1220 bp, Zea mays
  misc_feature (1)..(1220): Ceres cDNA ID no. 12403274
  misc_feature (1)..(1220): Ceres CLONE  ID no. 274398
  misc_feature (1)..(1220): Also known as  Ceres CDNA ID no. 23750626
aacaaagggatagagaagcggcagctgcagaggcagagcgcaagagccatcgtcctcgcctcaccgagcctcaccccgtacctagcgcagcgaagccggcacaatgccagccgccgccgtagcctcccctctcctcctctcgctctcctcgtcctcctccctcttcctctcttcctcatccacctcctttttcccaccctcctccgctgccgtcgctccacacgccgccgtcaggacgaaggcggccgtctccgtcctccgcgcgctgcgcgccgaggcggccaccctccccgtgctctcattcaccggagagaaggtcggggaggtaaccctcgacctcaaatccgcgccaccctccaccgcgcgcgctgtcgtgcaccgcgctatcatcaccgaccgccagaacgcgcgccgaggcacggcctccacgctcacccgcggcgaggtcagaggcggagggaggaagccctatcagcagaagaagacggggaaggcgcggcgggggtcgcagcgtaccccgcttcgtcccggcggtggcgtcgtgttcggccccaagccccgcgactggtccatcaagatcaaccgcaaggagaagcgccttgccatctccactgccatcgtgagcgccgccaaggacgccttcgttgtcgaggagttcgaggaggccttcgcgtcggggcccaagaccagggatttcgtggccgctttgcagcggtgggggcttgacccgaagcagaaagccatgttctttgccacggacttcgacgacaatgtgcggctcagcggcaggaacattggttccctcaagatgctcacacccaggacgctgaacctgtacgacatactcgacgcacgcaagctcttctttactcctgctgctgtagactacctcaactccaggtacggagccagtgtttccgatgactactatactgatgatgaggatgatggcgaggaggaactggtcgagcaagaagcagaagaaggcaccacagcagatgctgctccagatgcaactgaagagggcgaggcagacagcagctcctaggcgggaagtgtagatttgttgtttcgtttttgttatgttaccctcaggtgaggatggtggggaattctttcctaacggggagaccttttgtctgcttttattgtaagttgattatgttctcttactgaagcagtatactagatttccaaacctcacataagagcatgttttc

SEQ ID NO: 1044 - protein, 1220 aa, Zea mays
  misc_feature: PFam Name: Ribosomal_L4; PFam Description: Ribosomal protein
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Atrophin-1; PFam Description: Atrophin-1 family
  misc_feature: GI Number: 30680078; NR Description: 50S ribosomal protein
  misc_feature: GI Number: 8778555; NR Description: F22G5.34 [Arabidopsis thaliana] >gi|25294989|pir||D86208 protein F22G5.34 [imported] -
  misc_feature: GI Number: 21537296; NR Description: ribosomal protein L4
  misc_feature: GI Number: 2791998; NR Description: ribosomal protein L4 [Arabidopsis thaliana] >gi|2792000|emb|CAA74894.1| ribosomal
  misc_feature: GI Number: 7440645; NR Description: ribosomal protein L4, chloroplast - common tobacco >gi|3298439|dbj|BAA31510.1| chloroplast ribosomal protein L4 [Nicotiana tabacum] >gi|6919958|sp|O80361|RK4_TOBAC 50S RIBOSOMAL PROTEIN L4,
AACAAAGGGATAGAGAAGCGGCAGCTGCAGAGGCAGAGCGCAAGAGCCATCGTCCTCGCCTCACCGAGCCTCACCCCGTACCTAGCGCAGCGAAGCCGGCACAATGCCAGCCGCCGCCGTAGCCTCCCCTCTCCTCCTCTCGCTCTCCTCGTCCTCCTCCCTCTTCCTCTCTTCCTCATCCACCTCCTTTTTCCCACCCTCCTCCGCTGCCGTCGCTCCACACGCCGCCGTCAGGACGAAGGCGGCCGTCTCCGTCCTCCGCGCGCTGCGCGCCGAGGCGGCCACCCTCCCCGTGCTCTCATTCACCGGAGAGAAGGTCGGGGAGGTAACCCTCGACCTCAAATCCGCGCCACCCTCCACCGCGCGCGCTGTCGTGCACCGCGCTATCATCACCGACCGCCAGAACGCGCGCCGAGGCACGGCCTCCACGCTCACCCGCGGCGAGGTCAGAGGCGGAGGGAGGAAGCCCTATCAGCAGAAGAAGACGGGGAAGGCGCGGCGGGGGTCGCAGCGTACCCCGCTTCGTCCCGGCGGTGGCGTCGTGTTCGGCCCCAAGCCCCGCGACTGGTCCATCAAGATCAACCGCAAGGAGAAGCGCCTTGCCATCTCCACTGCCATCGTGAGCGCCGCCAAGGACGCCTTCGTTGTCGAGGAGTTCGAGGAGGCCTTCGCGTCGGGGCCCAAGACCAGGGATTTCGTGGCCGCTTTGCAGCGGTGGGGGCTTGACCCGAAGCAGAAAGCCATGTTCTTTGCCACGGACTTCGACGACAATGTGCGGCTCAGCGGCAGGAACATTGGTTCCCTCAAGATGCTCACACCCAGGACGCTGAACCTGTACGACATACTCGACGCACGCAAGCTCTTCTTTACTCCTGCTGCTGTAGACTACCTCAACTCCAGGTACGGAGCCAGTGTTTCCGATGACTACTATACTGATGATGAGGATGATGGCGAGGAGGAACTGGTCGAGCAAGAAGCAGAAGAAGGCACCACAGCAGATGCTGCTCCAGATGCAACTGAAGAGGGCGAGGCAGACAGCAGCTCCTAGGCGGGAAGTGTAGATTTGTTGTTTCGTTTTTGTTATGTTACCCTCAGGTGAGGATGGTGGGGAATTCTTTCCTAACGGGGAGACCTTTTGTCTGCTTTTATTGTAAGTTGATTATGTTCTCTTACTGAAGCAGTATACTAGATTTCCAAACCTCACATAAGAGCATGTTTTC

SEQ ID NO: 1045 - DNA, 1234 bp, Zea mays
  misc_feature (1)..(1234): Ceres cDNA ID no. 12403725
  misc_feature (1)..(1234): Ceres CLONE  ID no. 276706
  misc_feature (1)..(1234): Also known as  Ceres CDNA ID no. 23749029
caccggctaccacctgccgcctgcgccctgccctccctctgtttttctagacccccggatcgctcagagattgagtcgtagtcgcacccgactagtcgccgcgtcctcctttccccgcgcagcagcagagcaccacccggtgaccgagcaatggaggcggggggcgtgggcctggcgctgcagacgcgggcggcggccttcggctccggccagcgccggggcggcctacagtcgcccatcgggaggctgagagtcgctgaaccggcgggagctgcggttgccgtgcgggttcgcgggtccaagcccgtcgtaccgctccgtgcgaagaaatcatccggaggtcatgaaaacttgcataactccgttgacgaagctctcctgttgaagagaaaatcagaagaagttctgttctacttaaacgggaggtgtatttacttagtgggaatgatgggttctggaaaaagtactgtggggaagatcatgtctgaagtcttgggttattcgttctttgatagtgacaaattagtggagcaagctgttggaatgccttcagttgctcaaatattcaaagttcacagtgaagccttctttcgggataatgagagtagcgtcttgagggatctgtcctccatgcgacgattagttgttgccaccggaggtggtgctgtcatccgaccagttaactggaaatatatgaagaagggcctatccgtttggttagatgtgcccttggatgctcttgctaggcgcattgctaaagtgggaaccgcttctcgtcctcttctggaccaaccgtccggtgatccatacacaatggccttttctaagctcagcatgcttgcagagcaaaggggtgatgcttatgcaaatgcggatgtaagggtttctctggaagagattgcatctaaacaaggtcatggcgatgtctctaagctgatgccgactgatatcgcaattgagtcacttcataagatcgagagtttcgtcatcgagcacgctgctgataatccagctagcgactcgcaagctgagtcacagatccaaaggatacagaccttgtaatatcttaatccttctgttttgtaccgaagcgtaccccctagagcatcgttggtttatttgttcgttgaagtgtcacgagggagagaaaaaaaaaaaccctgaagtatttcttcttgtaagttgtaaaggaatggaataaaggagctaataatccgaagtgtaccgttggccg

SEQ ID NO: 1046 - protein, 1234 aa, Zea mays
  misc_feature: PFam Name: SKI; PFam Description: Shikimate kinase
  misc_feature: GI Number: 56805577; NR Description: shikimate kinase 1
  misc_feature: GI Number: 56805579; NR Description: shikimate kinase 2
  misc_feature: GI Number: 42570867; NR Description: shikimate kinase,
  misc_feature: GI Number: 30681570; NR Description: shikimate kinase,
  misc_feature: GI Number: 39104605; NR Description: putative shikimate
CACCGGCTACCACCTGCCGCCTGCGCCCTGCCCTCCCTCTGTTTTTCTAGACCCCCGGATCGCTCAGAGATTGAGTCGTAGTCGCACCCGACTAGTCGCCGCGTCCTCCTTTCCCCGCGCAGCAGCAGAGCACCACCCGGTGACCGAGCAATGGAGGCGGGGGGCGTGGGCCTGGCGCTGCAGACGCGGGCGGCGGCCTTCGGCTCCGGCCAGCGCCGGGGCGGCCTACAGTCGCCCATCGGGAGGCTGAGAGTCGCTGAACCGGCGGGAGCTGCGGTTGCCGTGCGGGTTCGCGGGTCCAAGCCCGTCGTACCGCTCCGTGCGAAGAAATCATCCGGAGGTCATGAAAACTTGCATAACTCCGTTGACGAAGCTCTCCTGTTGAAGAGAAAATCAGAAGAAGTTCTGTTCTACTTAAACGGGAGGTGTATTTACTTAGTGGGAATGATGGGTTCTGGAAAAAGTACTGTGGGGAAGATCATGTCTGAAGTCTTGGGTTATTCGTTCTTTGATAGTGACAAATTAGTGGAGCAAGCTGTTGGAATGCCTTCAGTTGCTCAAATATTCAAAGTTCACAGTGAAGCCTTCTTTCGGGATAATGAGAGTAGCGTCTTGAGGGATCTGTCCTCCATGCGACGATTAGTTGTTGCCACCGGAGGTGGTGCTGTCATCCGACCAGTTAACTGGAAATATATGAAGAAGGGCCTATCCGTTTGGTTAGATGTGCCCTTGGATGCTCTTGCTAGGCGCATTGCTAAAGTGGGAACCGCTTCTCGTCCTCTTCTGGACCAACCGTCCGGTGATCCATACACAATGGCCTTTTCTAAGCTCAGCATGCTTGCAGAGCAAAGGGGTGATGCTTATGCAAATGCGGATGTAAGGGTTTCTCTGGAAGAGATTGCATCTAAACAAGGTCATGGCGATGTCTCTAAGCTGATGCCGACTGATATCGCAATTGAGTCACTTCATAAGATCGAGAGTTTCGTCATCGAGCACGCTGCTGATAATCCAGCTAGCGACTCGCAAGCTGAGTCACAGATCCAAAGGATACAGACCTTGTAATATCTTAATCCTTCTGTTTTGTACCGAAGCGTACCCCCTAGAGCATCGTTGGTTTATTTGTTCGTTGAAGTGTCACGAGGGAGAGAAAAAAAAAAACCCTGAAGTATTTCTTCTTGTAAGTTGTAAAGGAATGGAATAAAGGAGCTAATAATCCGAAGTGTACCGTTGGCCG

SEQ ID NO: 1047 - DNA, 1220 bp, Zea mays
  misc_feature (1)..(1220): Ceres cDNA ID no. 12404052
  misc_feature (1)..(1220): Ceres CLONE  ID no. 221358
  misc_feature (1)..(1220): Also known as  Ceres CDNA ID no. 23747075
acaacagcatcatggcgctcaccacgagcactaacaaccaagccttgcttgacgctcagctagagctctggcacacatcctttgctttcatcaagtccatggctctcaagtctgcagtggaccttggcatagccgacgccatccacagccacggtggcaacgccaccctgccccagatagtttccagggccgcgctccacccgtccaagatcccctgcctgcgtcgcctcatgcgggtgctcacagccgccggcatcttcagcgccgcccaccgctcgccggacgacggcggcggcgagctcgtctatggactcacaccggcgtctcagctcttggttggcggctcttcaagcctggctcccttcatgtccctggtgttacaccaggtctacgtgtcgcctttccttggcctcggcacatggttacagcacgagcgctcagacccgaccctgtttgagatgacgcatgggctcactgcctgggacctgaatgaccacaagccagccttcggcgagctcttcaaccaaggtatggtctgcgacagcagcttcgtcatggacatcgtcgtcaaggagtgcggcgacgtcttccggggtctgagctcccttgtcgacgtcgccggagggcttggcgcggcggccctggctatctcgaccgcgttcccgcatgtccagtgcagtgtgctggatctcccgcatgtcgccgccaatgctcccgctaacaccagtgtcaagtatattgctggcgacatgtttgagagcattccaccggcagacgccgtcttccttaagtgggttttgcatgactggggcgatgctgattgcatcaagatacttaagaactgtaagaaagctataccttctagggatgcaggaggaaaggtgataatcgttgatatggttgttggaggccagtcgtcaaacaataagcacaaagagactcaggtcttgtttgatctcttcatcatgacgatcaatggcgccgagcgagacgaacatgagtggaaaaagataatttctgaagctgggtttagcgactacaaaatcatacctgttctaggtgttcgatccatcattgaggtctacccatgattatttggcgaatacgtgtttcgctttttttctgaataagttgtttgcttaactagcatgggacgagtgtccatgagatcatgtgtgatgaaaactttgtttgtgatgaagtaagcactttgcaatgtc

SEQ ID NO: 1048 - protein, 1220 aa, Zea mays
  misc_feature: PFam Name: Methyltransf_2; PFam Description: O-methyltransferase
  misc_feature: PFam Name: Dimerisation; PFam Description: Dimerisation domain
  misc_feature: GI Number: 51451359; NR Description: putative o-methyltransferase ZRP4 [Oryza sativa (japonica cultivar-group)] >gi|46575944|gb|AAT01305.1| putative o-methyltransferase ZRP4
  misc_feature: GI Number: 51451358; NR Description: putative o-methyltransferase ZRP4 [Oryza sativa (japonica cultivar-group)] >gi|46575943|gb|AAT01304.1| putative o-methyltransferase ZRP4
  misc_feature: GI Number: 50253195; NR Description: flavonoid 7-O-methyltransferase-like [Oryza sativa (japonica cultivar-group)] >gi|50252861|dbj|BAD29092.1| flavonoid 7-O-methyltransferase-like
  misc_feature: GI Number: 51535782; NR Description: putative O-methyltransferase [Oryza sativa (japonica cultivar-group)] >gi|51535174|dbj|BAD37886.1| putative O-methyltransferase [Oryza
  misc_feature: GI Number: 20514369; NR Description: orcinol O-methyltransferase [Rosa hybrid cultivar] >gi|53748112|emb|CAH05078.1| orcinol O-methyltransferase 2 [Rosa chinensis] >gi|27527924|emb|CAD29459.1| orcinol O-methyltransferase
ACAACAGCATCATGGCGCTCACCACGAGCACTAACAACCAAGCCTTGCTTGACGCTCAGCTAGAGCTCTGGCACACATCCTTTGCTTTCATCAAGTCCATGGCTCTCAAGTCTGCAGTGGACCTTGGCATAGCCGACGCCATCCACAGCCACGGTGGCAACGCCACCCTGCCCCAGATAGTTTCCAGGGCCGCGCTCCACCCGTCCAAGATCCCCTGCCTGCGTCGCCTCATGCGGGTGCTCACAGCCGCCGGCATCTTCAGCGCCGCCCACCGCTCGCCGGACGACGGCGGCGGCGAGCTCGTCTATGGACTCACACCGGCGTCTCAGCTCTTGGTTGGCGGCTCTTCAAGCCTGGCTCCCTTCATGTCCCTGGTGTTACACCAGGTCTACGTGTCGCCTTTCCTTGGCCTCGGCACATGGTTACAGCACGAGCGCTCAGACCCGACCCTGTTTGAGATGACGCATGGGCTCACTGCCTGGGACCTGAATGACCACAAGCCAGCCTTCGGCGAGCTCTTCAACCAAGGTATGGTCTGCGACAGCAGCTTCGTCATGGACATCGTCGTCAAGGAGTGCGGCGACGTCTTCCGGGGTCTGAGCTCCCTTGTCGACGTCGCCGGAGGGCTTGGCGCGGCGGCCCTGGCTATCTCGACCGCGTTCCCGCATGTCCAGTGCAGTGTGCTGGATCTCCCGCATGTCGCCGCCAATGCTCCCGCTAACACCAGTGTCAAGTATATTGCTGGCGACATGTTTGAGAGCATTCCACCGGCAGACGCCGTCTTCCTTAAGTGGGTTTTGCATGACTGGGGCGATGCTGATTGCATCAAGATACTTAAGAACTGTAAGAAAGCTATACCTTCTAGGGATGCAGGAGGAAAGGTGATAATCGTTGATATGGTTGTTGGAGGCCAGTCGTCAAACAATAAGCACAAAGAGACTCAGGTCTTGTTTGATCTCTTCATCATGACGATCAATGGCGCCGAGCGAGACGAACATGAGTGGAAAAAGATAATTTCTGAAGCTGGGTTTAGCGACTACAAAATCATACCTGTTCTAGGTGTTCGATCCATCATTGAGGTCTACCCATGATTATTTGGCGAATACGTGTTTCGCTTTTTTTCTGAATAAGTTGTTTGCTTAACTAGCATGGGACGAGTGTCCATGAGATCATGTGTGATGAAAACTTTGTTTGTGATGAAGTAAGCACTTTGCAATGTC

SEQ ID NO: 1049 - DNA, 1599 bp, Zea mays
  misc_feature (1)..(1599): Ceres cDNA ID no. 12404933
  misc_feature (1)..(1599): Ceres CLONE  ID no. 320672
  misc_feature (1)..(1599): Also known as  Ceres CDNA ID no. 23762737
aaaacccatcaagcggagcagcagaggtttatccctaccagcctaccactcccccccaacgcggcgacggcggaaatggacgccaagctgctgctccccttccccttcgcgccggccgcggccaccaggtcccccaagtcgctcttccttggcgccccgctcccgccgccgccgcggccgccgccgttcccgctgcgcctccgcccgcggcccgcggcggtggtggcgcaggccgccgtgaagcgccgcaaggaggcccccttcgacaccgtgatccagcgggacaagaagctcaagctggtgctcaagctgcgcaacatcctggtggcgcagcccgaccgcgtgatgagcctccgcgagctcggccgcttccgccgcgacctcggcctcacccgcaagcgccgcctcatcgcgctcctcaggcgcttcccgggcgtcttcgacgtcgtcgaggagggcgtctactccctccgcttccgcctcacgccggccgccgagcgcctctacctcgacgagctccgcctcaggaacgagtccgagggcctcgccgtcgccaagctccgcaagctgctcatgatgtcgcaggagaagcgcatcctcatcgagaaggtcgcgcacctcaagcacgacctcggcctcccgcccgagttccgcgacaccgtctgcctcaggtacccgcagtacttccgcgtcgtccggatggaccggggcccggcgctggagctcacgcactgggaccccgagctcgccgtctccgcggcggagctcgccgaggaggagagccgggcgagggaagctgaggagaggaacctcatcatcgaccgcccactcaagttcaaccgtgtcaggctccccaagggcctcaaattgacgcggggggaggccaggaggattgcgcggttcaaggagatgccctacatttccccatatgccgacttctcgcacctgcgctccggatcagacgagaaggaaaagcacgcttgtggagtggttcatgaaattcttagcttaacggtggagaagcgcacgttggtggaccacctcacgcacttcagggaggagttcaggttctcgcagtccctgcgcggcatgatcattcgtcacccggacatgttttacgtatcgttcaaaggggatagggactcggtcttcctccgtgaggcgtacaaggactcgcagctggtcgagaagaaccagctggtgctacttaaggagaaaatgagggctcttgtggccgtaccacgcttccccagaagggccgcagttgggactggcgaggaggctgagggaatgaatggatcattgcagtcgcgggaccaagtgagtgacgaggaatacgacgatgaagatgaggggctctctgatatggaagatctgattagtgagctttctggtggcaaatcggatgctgactacgagtggggtgatggctggtttggtgagaacgatgactcaccgccagactttggagacgacgaagtcaaggtcgccatgaaaattgctgatggttctgccaacggcagcgcacctgttcctgtatttcctgatggcagaccaagggaacggtggtaaattgaggtgtttttgaacttctgattg

SEQ ID NO: 1050 - protein, 1599 aa, Zea mays
  misc_feature: PFam Name: FH2; PFam Description: Formin Homology 2 Domain
  misc_feature: PFam Name: Pkinase; PFam Description: Protein kinase domain
  misc_feature: PFam Name: SerH; PFam Description: Cell surface
  misc_feature: PFam Name: Pyr_redox_2; PFam Description: Pyridine
  misc_feature: PFam Name: Peptidase_C1; PFam Description: Papain family
  misc_feature: GI Number: 21593983; NR Description: unknown [Arabidopsis thaliana]
  misc_feature: GI Number: 7239512; NR Description: Strong similarity to the higher plant tyrosine-specific protein phosphatases (PTPs) from A. thaliana gi|3413424 expressed during embryogenesis. [Arabidopsis
  misc_feature: GI Number: 34912696; NR Description: P0686E09.18 [Oryza sativa (japonica cultivar-group)] >gi|13365580|dbj|BAB39125.1|
  misc_feature: GI Number: 42734036; NR Description: similar to Leishmania
  misc_feature: GI Number: 11359723; NR Description: proteophosphoglycan, membrane-associated [imported] - Leishmania major (fragment)
AAAACCCATCAAGCGGAGCAGCAGAGGTTTATCCCTACCAGCCTACCACTCCCCCCCAACGCGGCGACGGCGGAAATGGACGCCAAGCTGCTGCTCCCCTTCCCCTTCGCGCCGGCCGCGGCCACCAGGTCCCCCAAGTCGCTCTTCCTTGGCGCCCCGCTCCCGCCGCCGCCGCGGCCGCCGCCGTTCCCGCTGCGCCTCCGCCCGCGGCCCGCGGCGGTGGTGGCGCAGGCCGCCGTGAAGCGCCGCAAGGAGGCCCCCTTCGACACCGTGATCCAGCGGGACAAGAAGCTCAAGCTGGTGCTCAAGCTGCGCAACATCCTGGTGGCGCAGCCCGACCGCGTGATGAGCCTCCGCGAGCTCGGCCGCTTCCGCCGCGACCTCGGCCTCACCCGCAAGCGCCGCCTCATCGCGCTCCTCAGGCGCTTCCCGGGCGTCTTCGACGTCGTCGAGGAGGGCGTCTACTCCCTCCGCTTCCGCCTCACGCCGGCCGCCGAGCGCCTCTACCTCGACGAGCTCCGCCTCAGGAACGAGTCCGAGGGCCTCGCCGTCGCCAAGCTCCGCAAGCTGCTCATGATGTCGCAGGAGAAGCGCATCCTCATCGAGAAGGTCGCGCACCTCAAGCACGACCTCGGCCTCCCGCCCGAGTTCCGCGACACCGTCTGCCTCAGGTACCCGCAGTACTTCCGCGTCGTCCGGATGGACCGGGGCCCGGCGCTGGAGCTCACGCACTGGGACCCCGAGCTCGCCGTCTCCGCGGCGGAGCTCGCCGAGGAGGAGAGCCGGGCGAGGGAAGCTGAGGAGAGGAACCTCATCATCGACCGCCCACTCAAGTTCAACCGTGTCAGGCTCCCCAAGGGCCTCAAATTGACGCGGGGGGAGGCCAGGAGGATTGCGCGGTTCAAGGAGATGCCCTACATTTCCCCATATGCCGACTTCTCGCACCTGCGCTCCGGATCAGACGAGAAGGAAAAGCACGCTTGTGGAGTGGTTCATGAAATTCTTAGCTTAACGGTGGAGAAGCGCACGTTGGTGGACCACCTCACGCACTTCAGGGAGGAGTTCAGGTTCTCGCAGTCCCTGCGCGGCATGATCATTCGTCACCCGGACATGTTTTACGTATCGTTCAAAGGGGATAGGGACTCGGTCTTCCTCCGTGAGGCGTACAAGGACTCGCAGCTGGTCGAGAAGAACCAGCTGGTGCTACTTAAGGAGAAAATGAGGGCTCTTGTGGCCGTACCACGCTTCCCCAGAAGGGCCGCAGTTGGGACTGGCGAGGAGGCTGAGGGAATGAATGGATCATTGCAGTCGCGGGACCAAGTGAGTGACGAGGAATACGACGATGAAGATGAGGGGCTCTCTGATATGGAAGATCTGATTAGTGAGCTTTCTGGTGGCAAATCGGATGCTGACTACGAGTGGGGTGATGGCTGGTTTGGTGAGAACGATGACTCACCGCCAGACTTTGGAGACGACGAAGTCAAGGTCGCCATGAAAATTGCTGATGGTTCTGCCAACGGCAGCGCACCTGTTCCTGTATTTCCTGATGGCAGACCAAGGGAACGGTGGTAAATTGAGGTGTTTTTGAACTTCTGATTG

SEQ ID NO: 1051 - DNA, 1567 bp, Zea mays
  misc_feature (1)..(1567): Ceres cDNA ID no. 12404937
  misc_feature (1)..(1567): Ceres CLONE  ID no. 320614
  misc_feature (1)..(1567): Also known as  Ceres CDNA ID no. 23762729
  misc_feature (1190)..(1190): n is a, c, t, g, unknown, or other
  misc_feature (1224)..(1224): n is a, c, t, g, unknown, or other
  misc_feature (1249)..(1249): n is a, c, t, g, unknown, or other
  misc_feature (1310)..(1310): n is a, c, t, g, unknown, or other
  misc_feature (1312)..(1312): n is a, c, t, g, unknown, or other
  misc_feature (1348)..(1348): n is a, c, t, g, unknown, or other
  misc_feature (1349)..(1349): n is a, c, t, g, unknown, or other
  misc_feature (1360)..(1360): n is a, c, t, g, unknown, or other
  misc_feature (1436)..(1436): n is a, c, t, g, unknown, or other
  misc_feature (1439)..(1439): n is a, c, t, g, unknown, or other
  misc_feature (1448)..(1448): n is a, c, t, g, unknown, or other
gcacgagaccattacctagaacatcctaatcgaaaagtaaataatatctctcgagcacgggcgggggccgcctgcctgcacgcgcctttctcactcgctcgctcgggacgtcgggtgcagtccgtgcgccccgcaccgcttttcgattcggttccgcagcggccggccggccggccgagcaatggccaccggcggggacaagcgggcggcgctgctgcggcagataacggaggagggcgggttcgcgttcgtggcctccgccgagaaggcggccgcgggggacctccgcgccgccgaggcggcgcgggagatggcgtgggagcagctgcactcggcgccccgcgccgaggtcggcgccgcgtggcgggacgcctacgcgctcgcctgcctccacgtcgccggcctccgcgccgccgtcggcgaccgccgcgcggcgctccgcgcgctcgacatgggcctcatcatgggcggcgacctcctacgcgccgagctcgacgccgccgtcgcggggctcggccacggcgacgcgggcgcaggcgcgggcgccgatggagatgtgcagaggtgggaggaagggatcgcgggcggccgagacctcgccgatgtacttcaacttctaccagtgaattccctatcttgtaagcaaattgagaggcgatcatgcatttctttggaggcatttatacgtgattactttttatgtgagtcccctgttatactcagtggatgcattgatcattggcctgcaaggaaaaagtggaaggacataaagtacctagagagtgtagctggagatcggactattcctgttcaggttggaaaaaattatgcatgtactgagttgaaacaggagcttatcacattttctcaatttcttgagaggatgtggtcaagtgattctgcaaacttggcatatattgcgcagcatcaattgtttgaccagataaaggagctccacgaagatattgctgttcctgagtactgttcagctggtggtggcaaactccagtcacttaatgcttggttcggccctcatgggacaataactcctttgcatcatgacccacatcacaacctttttgctcaggttttgggaaggaagtatgttagactctatcctgcttctacatctgtggggcctataccctaacacagaaagcgtgctaagcaatactagtgaggtagacctngacaacactgacggaaaagagtacccggagactncagctcttgagttcgtggactgcgnattggaggaaggtgacctgctttacattcccccgaaatggtggcgttacgtgagatctctntntattagcttttctgttagctttcggtggcgaacatnncagcttccttnaggggaggttcataacgatggttttgacaaatttgatcgtacgtccccgatgtcgttccaatcatcctattggtanagncttaataanaagacttcattgagctgagcccatatttcgtggtctaagtgttgtgtgcggtcacctcactagactgggattgtaaattgttttcacgacaatgattggtttcaaacatactaagcggt

SEQ ID NO: 1052 - protein, 1567 aa, Zea mays
  misc_feature: PFam Name: JmjC; PFam Description: JmjC domain
  misc_feature: PFam Name: Cupin_4; PFam Description: Cupin superfamily protein
  misc_feature: PFam Name: Peptidase_S8; PFam Description: Subtilase family
  misc_feature: PFam Name: Cupin_1; PFam Description: Cupin
  misc_feature: PFam Name: Aldedh; PFam Description: Aldehyde dehydrogenase family
  misc_feature: GI Number: 50947487; NR Description: N-acetyltransferase and Transcription factor-like protein [Oryza sativa (japonica cultivar-group)] >gi|42408989|dbj|BAD10244.1| N-acetyltransferase and Transcription factor-like protein [Oryza sativa (japonica
  misc_feature: GI Number: 21928039; NR Description: AT3g20810/MOE17_10 [Arabidopsis thaliana] >gi|20147203|gb|AAM10317.1| AT3g20810/MOE17_10 [Arabidopsis thaliana] >gi|30685945|ref|NP_850617.1| transcription factor jumonji (jmjC)
  misc_feature: GI Number: 62641259; NR Description: PREDICTED: similar to
  misc_feature: GI Number: 28317179; NR Description: GM21055p [Drosophila
  misc_feature: GI Number: 48784171; NR Description: COG2850: Uncharacterized
GCACGAGACCATTACCTAGAACATCCTAATCGAAAAGTAAATAATATCTCTCGAGCACGGGCGGGGGCCGCCTGCCTGCACGCGCCTTTCTCACTCGCTCGCTCGGGACGTCGGGTGCAGTCCGTGCGCCCCGCACCGCTTTTCGATTCGGTTCCGCAGCGGCCGGCCGGCCGGCCGAGCAATGGCCACCGGCGGGGACAAGCGGGCGGCGCTGCTGCGGCAGATAACGGAGGAGGGCGGGTTCGCGTTCGTGGCCTCCGCCGAGAAGGCGGCCGCGGGGGACCTCCGCGCCGCCGAGGCGGCGCGGGAGATGGCGTGGGAGCAGCTGCACTCGGCGCCCCGCGCCGAGGTCGGCGCCGCGTGGCGGGACGCCTACGCGCTCGCCTGCCTCCACGTCGCCGGCCTCCGCGCCGCCGTCGGCGACCGCCGCGCGGCGCTCCGCGCGCTCGACATGGGCCTCATCATGGGCGGCGACCTCCTACGCGCCGAGCTCGACGCCGCCGTCGCGGGGCTCGGCCACGGCGACGCGGGCGCAGGCGCGGGCGCCGATGGAGATGTGCAGAGGTGGGAGGAAGGGATCGCGGGCGGCCGAGACCTCGCCGATGTACTTCAACTTCTACCAGTGAATTCCCTATCTTGTAAGCAAATTGAGAGGCGATCATGCATTTCTTTGGAGGCATTTATACGTGATTACTTTTTATGTGAGTCCCCTGTTATACTCAGTGGATGCATTGATCATTGGCCTGCAAGGAAAAAGTGGAAGGACATAAAGTACCTAGAGAGTGTAGCTGGAGATCGGACTATTCCTGTTCAGGTTGGAAAAAATTATGCATGTACTGAGTTGAAACAGGAGCTTATCACATTTTCTCAATTTCTTGAGAGGATGTGGTCAAGTGATTCTGCAAACTTGGCATATATTGCGCAGCATCAATTGTTTGACCAGATAAAGGAGCTCCACGAAGATATTGCTGTTCCTGAGTACTGTTCAGCTGGTGGTGGCAAACTCCAGTCACTTAATGCTTGGTTCGGCCCTCATGGGACAATAACTCCTTTGCATCATGACCCACATCACAACCTTTTTGCTCAGGTTTTGGGAAGGAAGTATGTTAGACTCTATCCTGCTTCTACATCTGTGGGGCCTATACCCTAACACAGAAAGCGTGCTAAGCAATACTAGTGAGGTAGACCTNGACAACACTGACGGAAAAGAGTACCCGGAGACTNCAGCTCTTGAGTTCGTGGACTGCGNATTGGAGGAAGGTGACCTGCTTTACATTCCCCCGAAATGGTGGCGTTACGTGAGATCTCTNTNTATTAGCTTTTCTGTTAGCTTTCGGTGGCGAACATNNCAGCTTCCTTNAGGGGAGGTTCATAACGATGGTTTTGACAAATTTGATCGTACGTCCCCGATGTCGTTCCAATCATCCTATTGGTANAGNCTTAATAANAAGACTTCATTGAGCTGAGCCCATATTTCGTGGTCTAAGTGTTGTGTGCGGTCACCTCACTAGACTGGGATTGTAAATTGTTTTCACGACAATGATTGGTTTCAAACATACTAAGCGGT

SEQ ID NO: 1053 - DNA, 1105 bp, Zea mays
  misc_feature (1)..(1105): Ceres cDNA ID no. 12404952
  misc_feature (1)..(1105): Ceres CLONE  ID no. 304724
  misc_feature (1)..(1105): Also known as  Ceres CDNA ID no. 23760895
accagccgaaaccgaggctgacgctgcgcgagccaaccggcggtgatgcaggcggcagtcggccaccgcggcgccaaccttggctccccgtcactctcgcgcttccggtatggctcccgcctccccggccggtcccgcctcttctctgagggcgtggcggtggcgccactccgcgtcggctctctgccccagccacggacccatggcagcggcggtttcgcgcacctcggggccatggatggggaggcgccgaggctgccgcacgccctcaggagaatgcttatcgatcatcagaaaatggcatgtcccaaccttctgaaagctgctgtactttcaaccatgacattgcttgctgtacctcttgaggcgtcagcggagatgtgccagccacctagttctttcgccaatatgccaatttttattgttgtagctctaataggagctgctgttggcggattattagcacgccaaagaaaggcggaattgaagcggctcaataatcaacttcgccagatcaatgcagcacttagaaggcaggcacagattgagtcatttgcgcctggccttacttatgcgccagttgggagaacaaatgaaactgatgttattgttgacccaaggaagcagcagttggtcacaaacctgagaaatgggaagaattacatgaggaatcaagatcttgataaggctatagtggagttcagaacagctctggagcttgcagagagcataggtgatcgttttgaagaaaagaaagctgcccgaggactagaggctcgggaagtaccgagaagcaatgagacagtacagcaaggttctggagctgtccaaggagacaggtgaagattccggctgcaccgaggcctacggtgccatagcggactgctacaccgagctgggcgacctggagcgagcggcgaaggtgtatgacaagtacatatcgaggctgcagcccggcgagtaaggtagatttctttacagacgagacagcgagttccttcccgttcgttgagttttgtgttttgtcggtcttgttaaactcactgcaggtattggattgttttgagaacggttttaatattcgtatataaataactattgattt

SEQ ID NO: 1054 - protein, 1105 aa, Zea mays
  misc_feature: PFam Name: TPR_1; PFam Description: Tetratricopeptide repeat
  misc_feature: GI Number: 50909895; NR Description: putative tetratricopeptide repeat (TPR)-containing protein [Oryza sativa (japonica cultivar-group)] >gi|46806280|dbj|BAD17488.1| putative tetratricopeptide repeat (TPR)-containing protein [Oryza sativa
  misc_feature: GI Number: 34914598; NR Description: P0520B06.12 [Oryza sativa (japonica cultivar-group)] >gi|20804493|dbj|BAB92188.1|
  misc_feature: GI Number: 42572429; NR Description: tetratricopeptide repeat
  misc_feature: GI Number: 21593122; NR Description: unknown [Arabidopsis thaliana] >gi|17386154|gb|AAL38623.1| AT3g14110/MAG2_6 [Arabidopsis thaliana] >gi|15450619|gb|AAK96581.1| AT3g14110/MAG2_6 [Arabidopsis
  misc_feature: GI Number: 51950309; NR Description: chloroplast Flu-like
ACCAGCCGAAACCGAGGCTGACGCTGCGCGAGCCAACCGGCGGTGATGCAGGCGGCAGTCGGCCACCGCGGCGCCAACCTTGGCTCCCCGTCACTCTCGCGCTTCCGGTATGGCTCCCGCCTCCCCGGCCGGTCCCGCCTCTTCTCTGAGGGCGTGGCGGTGGCGCCACTCCGCGTCGGCTCTCTGCCCCAGCCACGGACCCATGGCAGCGGCGGTTTCGCGCACCTCGGGGCCATGGATGGGGAGGCGCCGAGGCTGCCGCACGCCCTCAGGAGAATGCTTATCGATCATCAGAAAATGGCATGTCCCAACCTTCTGAAAGCTGCTGTACTTTCAACCATGACATTGCTTGCTGTACCTCTTGAGGCGTCAGCGGAGATGTGCCAGCCACCTAGTTCTTTCGCCAATATGCCAATTTTTATTGTTGTAGCTCTAATAGGAGCTGCTGTTGGCGGATTATTAGCACGCCAAAGAAAGGCGGAATTGAAGCGGCTCAATAATCAACTTCGCCAGATCAATGCAGCACTTAGAAGGCAGGCACAGATTGAGTCATTTGCGCCTGGCCTTACTTATGCGCCAGTTGGGAGAACAAATGAAACTGATGTTATTGTTGACCCAAGGAAGCAGCAGTTGGTCACAAACCTGAGAAATGGGAAGAATTACATGAGGAATCAAGATCTTGATAAGGCTATAGTGGAGTTCAGAACAGCTCTGGAGCTTGCAGAGAGCATAGGTGATCGTTTTGAAGAAAAGAAAGCTGCCCGAGGACTAGAGGCTCGGGAAGTACCGAGAAGCAATGAGACAGTACAGCAAGGTTCTGGAGCTGTCCAAGGAGACAGGTGAAGATTCCGGCTGCACCGAGGCCTACGGTGCCATAGCGGACTGCTACACCGAGCTGGGCGACCTGGAGCGAGCGGCGAAGGTGTATGACAAGTACATATCGAGGCTGCAGCCCGGCGAGTAAGGTAGATTTCTTTACAGACGAGACAGCGAGTTCCTTCCCGTTCGTTGAGTTTTGTGTTTTGTCGGTCTTGTTAAACTCACTGCAGGTATTGGATTGTTTTGAGAACGGTTTTAATATTCGTATATAAATAACTATTGATTT

SEQ ID NO: 1055 - DNA, 1462 bp, Zea mays
  misc_feature (1)..(1462): Ceres cDNA ID no. 12405153
  misc_feature (1)..(1462): Ceres CLONE  ID no. 245146
  misc_feature (1)..(1462): Also known as  Ceres CDNA ID no. 23783318
aaccgagacgggacgagaccagcagccggccaccagcccatccgaaccctgctgctcccctctccgggttcgcgtgaggctgtgtgctgctgggaggagggggaagcggcggcggggcgccatggaggccgagaagaaggcgccggcggtgtcagacgtgggcgcgtgggcgatgaacgtcgtcagctccgtcagcctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtaccgctctgggagctcgtctggttctctctcgtcgccaacacctccatcaccgggatgaacctcagcctcatgctcaactccgtcggcttctaccagatctccaaactgagcatgattccggtggtctgcctcatggaatgggtgctgaacagcaagcactacaccaccaaggtcatctcggcagtggttgtcgtggccgccggtgtcgggatttgcacggtcacggatgtcgaggtcaatgccaaggggttcatctgcgcttgcgtggcagtgttctgcacgtcgcttcaacagattacaattggttcctttcaaaagaagtacaacattgggtcatttgagctgctgagcaaaactgcaccaatccaggcaatttcactcattatactgggcccctttgtggactactatctaaatggacggtcattgttgaactaccctttttcgggaggggcaactttcttcatcttgctttcctgctcccttgccgtcttctgcaacatgagccaatacctctgcatcggccggttctcagcgacctcgtttcaggtcctgggccacatgaagaccgtgtgcgtgctgatcctcggctggatcctgtttgactcggccctcaccgtgaagaacatcctcgggatgctgctcgccgtgatgggcatggtggtctacagctgggccgtggaagcggagaagaaggcggcagccccggtcccccggatcaagagcgaaatgctcgacggcgaggacgtacctctcaaggccagggtgagcggcgtgcccgcagtcgacctcgaggacggcgagatgaagagctagctgctgcggctgccgcagctgccgctgattcgttcattcttcttgttcttttgtaactgtgcgcgcgcgatcgctcgatccaaagttgcttgtccgtcagccctcagctatcgacactacactgttatttttggccccttgttggggagagtccagttcctacgtgacgacgaccacccccagttcggcgtagatgaaacacaaactagcagaatgcagattttaggatttttttttcaggcggcggggtggagccattcattgtcatggtgacaggactcataatagaaatacaggtaacatgtc

SEQ ID NO: 1056 - protein, 1462 aa, Zea mays
  misc_feature: GI Number: 51979016; NR Description: PREDICTED P0453G03.28 gene product [Oryza sativa (japonica cultivar-group)] >gi|51963502|ref|XP_506427.1| PREDICTED P0453G03.28 gene product [Oryza sativa (japonica cultivar-group)] (japonica
  misc_feature: GI Number: 50938707; NR Description: transporter-related-like
  misc_feature: GI Number: 21536703; NR Description: unknown [Arabidopsis thaliana]
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
  misc_feature: GI Number: 30313364; NR Description: putative transmembrane
AACCGAGACGGGACGAGACCAGCAGCCGGCCACCAGCCCATCCGAACCCTGCTGCTCCCCTCTCCGGGTTCGCGTGAGGCTGTGTGCTGCTGGGAGGAGGGGGAAGCGGCGGCGGGGCGCCATGGAGGCCGAGAAGAAGGCGCCGGCGGTGTCAGACGTGGGCGCGTGGGCGATGAACGTCGTCAGCTCCGTCAGCCTCATCATGGCCAACAAGCAGCTCATGTCCTCCTCCGGCTACGCCTTCGCCTTCGCCACCACGCTGACCGGGTTCCACTTCACGGTCACGGCGCTCGTCGGGTGGATCTCCAACGCCACCGGCTACTCCGTCTCCAAGCACGTACCGCTCTGGGAGCTCGTCTGGTTCTCTCTCGTCGCCAACACCTCCATCACCGGGATGAACCTCAGCCTCATGCTCAACTCCGTCGGCTTCTACCAGATCTCCAAACTGAGCATGATTCCGGTGGTCTGCCTCATGGAATGGGTGCTGAACAGCAAGCACTACACCACCAAGGTCATCTCGGCAGTGGTTGTCGTGGCCGCCGGTGTCGGGATTTGCACGGTCACGGATGTCGAGGTCAATGCCAAGGGGTTCATCTGCGCTTGCGTGGCAGTGTTCTGCACGTCGCTTCAACAGATTACAATTGGTTCCTTTCAAAAGAAGTACAACATTGGGTCATTTGAGCTGCTGAGCAAAACTGCACCAATCCAGGCAATTTCACTCATTATACTGGGCCCCTTTGTGGACTACTATCTAAATGGACGGTCATTGTTGAACTACCCTTTTTCGGGAGGGGCAACTTTCTTCATCTTGCTTTCCTGCTCCCTTGCCGTCTTCTGCAACATGAGCCAATACCTCTGCATCGGCCGGTTCTCAGCGACCTCGTTTCAGGTCCTGGGCCACATGAAGACCGTGTGCGTGCTGATCCTCGGCTGGATCCTGTTTGACTCGGCCCTCACCGTGAAGAACATCCTCGGGATGCTGCTCGCCGTGATGGGCATGGTGGTCTACAGCTGGGCCGTGGAAGCGGAGAAGAAGGCGGCAGCCCCGGTCCCCCGGATCAAGAGCGAAATGCTCGACGGCGAGGACGTACCTCTCAAGGCCAGGGTGAGCGGCGTGCCCGCAGTCGACCTCGAGGACGGCGAGATGAAGAGCTAGCTGCTGCGGCTGCCGCAGCTGCCGCTGATTCGTTCATTCTTCTTGTTCTTTTGTAACTGTGCGCGCGCGATCGCTCGATCCAAAGTTGCTTGTCCGTCAGCCCTCAGCTATCGACACTACACTGTTATTTTTGGCCCCTTGTTGGGGAGAGTCCAGTTCCTACGTGACGACGACCACCCCCAGTTCGGCGTAGATGAAACACAAACTAGCAGAATGCAGATTTTAGGATTTTTTTTTCAGGCGGCGGGGTGGAGCCATTCATTGTCATGGTGACAGGACTCATAATAGAAATACAGGTAACATGTC

SEQ ID NO: 1057 - DNA, 1242 bp, Zea mays
  misc_feature (1)..(1242): Ceres cDNA ID no. 12405303
  misc_feature (1)..(1242): Ceres CLONE  ID no. 337673
  misc_feature (1)..(1242): Also known as  Ceres CDNA ID no. 23774768
  misc_feature (775)..(775): n is a, c, t, g, unknown, or other
aactcccatatggacgccaagccgcgcaacctgggcggctcgctgccggtgcccaacgtgcaggacctggccgcgcgccccggcgacgaactcacgccgcccgtgctaagccgctacctccgcgacgacgtcgacggcgcagacgccaacggcgacgcggcctcctcggtgccggtagttgacctcgcgaggctcctggacccgtcgtcgcacggagacgaggagtccgccaaactgaaggcggcctgcgaggagtggggcttcttccaggtgatcaaccacggggtgcccgacgcggtggtcgcggacgtgaagcagacctgcaggccttcttccgcctcccgctcgccgacaagcgcgcggtggcgcaggagcccggcgggatcgaggggtacgggcaggccttcgtggtctccgaggaccagaagctggactgggccgacatgcttttcctgtccacgcagccgcccgagtaccgggccccgcgcttcttgccggcgcgcccggccacgttcggggactcgctggcgcgctactctgccgaggtgcagcgcgtggccgcccgcctgctggcgtccatggccgcgaacctgggcgtggcggacgccgcgaggctggccagggtcgccgacgcgcaggccgtgcgcgtcaactactacccggcgtgcccgcacggcaggggcagggtgctgggcctgtcgccgcactcggacgccgccggcctcacgctgctgctccaggtcagcgccgtcccggggctgcagatcaggaggcncggcgcgtggatcagcgtcgaccccatccccggagcgctggtggccaacgtcggcgacgtcgtcgaggtgctcaccaacggcaggtacaagagcatcgagcaccgggcgctggttagccccacccaccaccgggtgtccgtcgcagccttccactccgccaggttcggcgacacttacgcgccgcttgaggagacgatggtcgatggtgatgagccagcgaggtacaggagcattggcgtcgaggactacgtccgcctggtgctgtctagtaagctccaaggaaagaacataatggacgccatgaagatcaatccggtcactgaatgaatgagtgaatcagaggatttgggaacaaaagttctgatttgtgtgtgtcgttttgaatcgtctttacatttacaataagagcagcgggcggattgctcttggtcaaacttgaagtaaaccatgaacatgttccgaattg

SEQ ID NO: 1058 - protein, 1242 aa, Zea mays
  misc_feature: PFam Name: 2OG-FeII_Oxy; PFam Description: 2OG-Fe(II)
  misc_feature: GI Number: 50920219; NR Description: putative carboxylate oxidase [Oryza sativa (japonica cultivar-group)] >gi|41393249|gb|AAS01972.1| putative carboxylate oxidase [Oryza
  misc_feature: GI Number: 37536796; NR Description: putative dioxygenase [Oryza sativa (japonica cultivar-group)] >gi|14165331|gb|AAK55463.1| putative dioxygenase [Oryza sativa (japonica cultivar-group)] >gi|31433482|gb|AAP54987.1| putative
  misc_feature: GI Number: 37536792; NR Description: putative dioxygenase [Oryza sativa (japonica cultivar-group)] >gi|14165314|gb|AAK55446.1| putative dioxygenase [Oryza sativa (japonica cultivar-group)] >gi|31433480|gb|AAP54985.1| putative
  misc_feature: GI Number: 53791705; NR Description: putative
  misc_feature: GI Number: 37536820; NR Description: putative ethylene-forming enzyme [Oryza sativa (japonica cultivar-group)] >gi|18873856|gb|AAL79802.1| putative ethylene-forming enzyme [Oryza sativa] >gi|31433494|gb|AAP54999.1| putative
AACTCCCATATGGACGCCAAGCCGCGCAACCTGGGCGGCTCGCTGCCGGTGCCCAACGTGCAGGACCTGGCCGCGCGCCCCGGCGACGAACTCACGCCGCCCGTGCTAAGCCGCTACCTCCGCGACGACGTCGACGGCGCAGACGCCAACGGCGACGCGGCCTCCTCGGTGCCGGTAGTTGACCTCGCGAGGCTCCTGGACCCGTCGTCGCACGGAGACGAGGAGTCCGCCAAACTGAAGGCGGCCTGCGAGGAGTGGGGCTTCTTCCAGGTGATCAACCACGGGGTGCCCGACGCGGTGGTCGCGGACGTGAAGCAGACCTGCAGGCCTTCTTCCGCCTCCCGCTCGCCGACAAGCGCGCGGTGGCGCAGGAGCCCGGCGGGATCGAGGGGTACGGGCAGGCCTTCGTGGTCTCCGAGGACCAGAAGCTGGACTGGGCCGACATGCTTTTCCTGTCCACGCAGCCGCCCGAGTACCGGGCCCCGCGCTTCTTGCCGGCGCGCCCGGCCACGTTCGGGGACTCGCTGGCGCGCTACTCTGCCGAGGTGCAGCGCGTGGCCGCCCGCCTGCTGGCGTCCATGGCCGCGAACCTGGGCGTGGCGGACGCCGCGAGGCTGGCCAGGGTCGCCGACGCGCAGGCCGTGCGCGTCAACTACTACCCGGCGTGCCCGCACGGCAGGGGCAGGGTGCTGGGCCTGTCGCCGCACTCGGACGCCGCCGGCCTCACGCTGCTGCTCCAGGTCAGCGCCGTCCCGGGGCTGCAGATCAGGAGGCNCGGCGCGTGGATCAGCGTCGACCCCATCCCCGGAGCGCTGGTGGCCAACGTCGGCGACGTCGTCGAGGTGCTCACCAACGGCAGGTACAAGAGCATCGAGCACCGGGCGCTGGTTAGCCCCACCCACCACCGGGTGTCCGTCGCAGCCTTCCACTCCGCCAGGTTCGGCGACACTTACGCGCCGCTTGAGGAGACGATGGTCGATGGTGATGAGCCAGCGAGGTACAGGAGCATTGGCGTCGAGGACTACGTCCGCCTGGTGCTGTCTAGTAAGCTCCAAGGAAAGAACATAATGGACGCCATGAAGATCAATCCGGTCACTGAATGAATGAGTGAATCAGAGGATTTGGGAACAAAAGTTCTGATTTGTGTGTGTCGTTTTGAATCGTCTTTACATTTACAATAAGAGCAGCGGGCGGATTGCTCTTGGTCAAACTTGAAGTAAACCATGAACATGTTCCGAATTG

SEQ ID NO: 1059 - DNA, 1427 bp, Zea mays
  misc_feature (1)..(1427): Ceres cDNA ID no. 12405385
  misc_feature (1)..(1427): Ceres CLONE  ID no. 305729
  misc_feature (1)..(1427): Also known as  Ceres CDNA ID no. 23777955
agcttctccggtcatcccagagtacggccattctctatcccgtcaaccacatcagggcaacctgccaaacaccgcaaattgcgcaatccatccaaacccccggcaactccccaattccctctcccggagtcatcgacatgctttcctcctccaatagcttagctcccgccgcgctgtctcgcgggatacctctccaagaaccatgccctgcctatcgtttcttctagctctaccgcctcgcccctgtctagctgactcggtgagtcggtcgccactccccaacaaatatcggttcttcctgccccagacccggaggcggccaagtccgcggcttggcgacggcgtgcgaatggcggagatgaccagggtttggagctgcggggaaccgctcgaggttggggtttccatggagagtgacccgattgtcggaggggaggcgccttctcgctcgaggtgggaagcgagccggtgggcgcccgtggaggctgcgctgaatcggatgagtaaatggctggtggctggttgttttgcttttgcagctatttggaagcgtgatgctgaaatcatgtgggttttgctgggtgcggttggcaactctctgctttcgttggttctcaagaagatgctaaaccatgaaagacctgcaccagctttgcggtctgatcctgggatgccatcgtcccatgcacaatccatattctatgctgcgaccgtcctagctctttcattgtactactggcttgggacaaattatctgaccatgattcttgggcctgcaactctgtcgttggccgcctatcttgcagaggccaaacggggtcatgtccccctcgccctggtggtggacattttcatagaatatgatatactaggtcttggctacgtgtgtctcggggccttcatacactaaaccaggtcatggtgggagctgttgtaggatctgccgtcggtgctctttggtttgtgctctggcattggcttgtgcaggaggcctttgcttcttctgtgcttgtcagagttgctgtcatccttggatcatcagcattttgtgttagctttgtcgtctacatgattcgtcactggctcaaggatgagtaatgtacttcggagctgcaatgggagatggactgataggcatggtgcgtttggaaaagtgaatccgttccgattcttatcagaatcgcttgaaaaaaatggtgacaaatgggttttggcggagcgattcacgagtggaacaattctcttttccttcagaaactctcggattggggaaaatgaagtttcacaccgattcctaatagtcacatacgcctcgtgtcacactagtaattgtatttttttcccagttaatcatttttaagtacaaggaactaaatatgttgtatctagagcaagctcaggagatttatgtcaggaatacagttttg

SEQ ID NO: 1060 - protein, 1427 aa, Zea mays
  misc_feature: PFam Name: PAP2; PFam Description: PAP2 superfamily
  misc_feature: GI Number: 51964288; NR Description: PREDICTED P0724B10.35
  misc_feature: GI Number: 50911907; NR Description: phosphatidic acid phosphatase-like [Oryza sativa (japonica cultivar-group)] >gi|41053139|dbj|BAD08082.1| phosphatidic acid phosphatase-like
  misc_feature: GI Number: 42565815; NR Description: phosphatidic acid
AGCTTCTCCGGTCATCCCAGAGTACGGCCATTCTCTATCCCGTCAACCACATCAGGGCAACCTGCCAAACACCGCAAATTGCGCAATCCATCCAAACCCCCGGCAACTCCCCAATTCCCTCTCCCGGAGTCATCGACATGCTTTCCTCCTCCAATAGCTTAGCTCCCGCCGCGCTGTCTCGCGGGATACCTCTCCAAGAACCATGCCCTGCCTATCGTTTCTTCTAGCTCTACCGCCTCGCCCCTGTCTAGCTGACTCGGTGAGTCGGTCGCCACTCCCCAACAAATATCGGTTCTTCCTGCCCCAGACCCGGAGGCGGCCAAGTCCGCGGCTTGGCGACGGCGTGCGAATGGCGGAGATGACCAGGGTTTGGAGCTGCGGGGAACCGCTCGAGGTTGGGGTTTCCATGGAGAGTGACCCGATTGTCGGAGGGGAGGCGCCTTCTCGCTCGAGGTGGGAAGCGAGCCGGTGGGCGCCCGTGGAGGCTGCGCTGAATCGGATGAGTAAATGGCTGGTGGCTGGTTGTTTTGCTTTTGCAGCTATTTGGAAGCGTGATGCTGAAATCATGTGGGTTTTGCTGGGTGCGGTTGGCAACTCTCTGCTTTCGTTGGTTCTCAAGAAGATGCTAAACCATGAAAGACCTGCACCAGCTTTGCGGTCTGATCCTGGGATGCCATCGTCCCATGCACAATCCATATTCTATGCTGCGACCGTCCTAGCTCTTTCATTGTACTACTGGCTTGGGACAAATTATCTGACCATGATTCTTGGGCCTGCAACTCTGTCGTTGGCCGCCTATCTTGCAGAGGCCAAACGGGGTCATGTCCCCCTCGCCCTGGTGGTGGACATTTTCATAGAATATGATATACTAGGTCTTGGCTACGTGTGTCTCGGGGCCTTCATACACTAAACCAGGTCATGGTGGGAGCTGTTGTAGGATCTGCCGTCGGTGCTCTTTGGTTTGTGCTCTGGCATTGGCTTGTGCAGGAGGCCTTTGCTTCTTCTGTGCTTGTCAGAGTTGCTGTCATCCTTGGATCATCAGCATTTTGTGTTAGCTTTGTCGTCTACATGATTCGTCACTGGCTCAAGGATGAGTAATGTACTTCGGAGCTGCAATGGGAGATGGACTGATAGGCATGGTGCGTTTGGAAAAGTGAATCCGTTCCGATTCTTATCAGAATCGCTTGAAAAAAATGGTGACAAATGGGTTTTGGCGGAGCGATTCACGAGTGGAACAATTCTCTTTTCCTTCAGAAACTCTCGGATTGGGGAAAATGAAGTTTCACACCGATTCCTAATAGTCACATACGCCTCGTGTCACACTAGTAATTGTATTTTTTTCCCAGTTAATCATTTTTAAGTACAAGGAACTAAATATGTTGTATCTAGAGCAAGCTCAGGAGATTTATGTCAGGAATACAGTTTTG

SEQ ID NO: 1061 - DNA, 1410 bp, Zea mays
  misc_feature (1)..(1410): Ceres cDNA ID no. 12405518
  misc_feature (1)..(1410): Ceres CLONE  ID no. 292275
  misc_feature (1)..(1410): Also known as  Ceres CDNA ID no. 23761575
  misc_feature (623)..(623): n is a, c, t, g, unknown, or other
gtaatctcaatcgtatcgtccacctcaacaaaccttcgtccacgcttcgactcctgcaggagtgagggagagagtgatggagaggtgcgggagctgggactgcgacgcggcggcagcgcagaaggcggtaccggcgccgttcctgaccaagacgtaccagctggtggacgacccggccacggaccacatcgtctcctggggggacgaccgggtctccaccttcgtggtctggcgcccgccggagttcgcgcgcgacatcctccccaactacttcaagcacaacaacttctcctccttcgttcgacagctaaacacctacgggttccggaaggtcgtcccggagcggtgggagttcgggaacgagttcttccggaagggggagaagcagctgctgtgcgagatccaccggcggaagacgtcgacgtccgcggctccgccgtcgcctccgccattcttcggcggcgcctcacttcccgctcttccacccggacgccccgcaccaccaccaccaccaccagttcgtggggggaggagacgacggggctgtggcggccgcgcacgtcggcggcgtcggcgtcgccctcgcgttcccgcacccgcattgttggagggagccgccgcantccgccgcgccggtagccacgcggctgctagccctgggcgcggctcctccggcgccgtcgtccccgctgccggccgccgatgccggcggaggcgggcgcgcggccgtgctggtggaggagaacgagcggctgcggcgcagcaacgcggcgctgctgcaggagctggcgcacatgcgcaagctgtacaacgacatcatctacttcgtgcagaaccacgtgcgccccgcggcgcccagccctgccgcggccgcgttcctgcagggcctcggcctgcaggcgcgcaagaagcccgccgcggggccgctcaaccactccggtgggagcaccacgtccagcagctcgctcaccatcgcggaggaggagccctcgcccccgcccccgccgcagcaggccgacaagagcgccggaagcagcggcactgcgcggtctgccgccgaccgcgcgccgcccaccatgctcttcggagtgcacctcagcgccgcgcgaggcagcaagaggccggcttccccggaggaagaagacgaccagtcgcccacgtcgcctgctgggaagccacggctggcgctggagtgcgccggcttgagcctggccgtcgcggtgccctccgccggcgcctcgtcccctgctagcactagctagctaagcctcactcaccttgcgcgcaacctgacgcgcgtttgcatgctgctgcatgcaaacgcaacggcgggcgtggccgttttgttgttctagctctagtttgatcgacgtgttccatttgaaccggtagatccagatgggttctctc

SEQ ID NO: 1062 - protein, 1410 aa, Zea mays
  misc_feature: PFam Name: HSF_DNA-bind; PFam Description: HSF-type DNA-binding
  misc_feature: PFam Name: FH2; PFam Description: Formin Homology 2 Domain
  misc_feature: PFam Name: TP2; PFam Description: Nuclear transition protein 2
  misc_feature: GI Number: 51535228; NR Description: putative heat shock
  misc_feature: GI Number: 12321016; NR Description: heat shock transcription factor, putative [Arabidopsis thaliana] >gi|15220101|ref|NP_175142.1| heat shock transcription factor family protein [Arabidopsis thaliana] >gi|25296103|pir||C96511
  misc_feature: GI Number: 671868; NR Description: heat shock transcription factor 5 [Glycine max] >gi|2129832|pir||S59539 heat shock
  misc_feature: GI Number: 50946723; NR Description: putative heat shock transcription factor [Oryza sativa (japonica cultivar-group)] >gi|42408639|dbj|BAD09860.1| putative heat shock transcription
  misc_feature: GI Number: 52077316; NR Description: putative heat shock
GTAATCTCAATCGTATCGTCCACCTCAACAAACCTTCGTCCACGCTTCGACTCCTGCAGGAGTGAGGGAGAGAGTGATGGAGAGGTGCGGGAGCTGGGACTGCGACGCGGCGGCAGCGCAGAAGGCGGTACCGGCGCCGTTCCTGACCAAGACGTACCAGCTGGTGGACGACCCGGCCACGGACCACATCGTCTCCTGGGGGGACGACCGGGTCTCCACCTTCGTGGTCTGGCGCCCGCCGGAGTTCGCGCGCGACATCCTCCCCAACTACTTCAAGCACAACAACTTCTCCTCCTTCGTTCGACAGCTAAACACCTACGGGTTCCGGAAGGTCGTCCCGGAGCGGTGGGAGTTCGGGAACGAGTTCTTCCGGAAGGGGGAGAAGCAGCTGCTGTGCGAGATCCACCGGCGGAAGACGTCGACGTCCGCGGCTCCGCCGTCGCCTCCGCCATTCTTCGGCGGCGCCTCACTTCCCGCTCTTCCACCCGGACGCCCCGCACCACCACCACCACCACCAGTTCGTGGGGGGAGGAGACGACGGGGCTGTGGCGGCCGCGCACGTCGGCGGCGTCGGCGTCGCCCTCGCGTTCCCGCACCCGCATTGTTGGAGGGAGCCGCCGCANTCCGCCGCGCCGGTAGCCACGCGGCTGCTAGCCCTGGGCGCGGCTCCTCCGGCGCCGTCGTCCCCGCTGCCGGCCGCCGATGCCGGCGGAGGCGGGCGCGCGGCCGTGCTGGTGGAGGAGAACGAGCGGCTGCGGCGCAGCAACGCGGCGCTGCTGCAGGAGCTGGCGCACATGCGCAAGCTGTACAACGACATCATCTACTTCGTGCAGAACCACGTGCGCCCCGCGGCGCCCAGCCCTGCCGCGGCCGCGTTCCTGCAGGGCCTCGGCCTGCAGGCGCGCAAGAAGCCCGCCGCGGGGCCGCTCAACCACTCCGGTGGGAGCACCACGTCCAGCAGCTCGCTCACCATCGCGGAGGAGGAGCCCTCGCCCCCGCCCCCGCCGCAGCAGGCCGACAAGAGCGCCGGAAGCAGCGGCACTGCGCGGTCTGCCGCCGACCGCGCGCCGCCCACCATGCTCTTCGGAGTGCACCTCAGCGCCGCGCGAGGCAGCAAGAGGCCGGCTTCCCCGGAGGAAGAAGACGACCAGTCGCCCACGTCGCCTGCTGGGAAGCCACGGCTGGCGCTGGAGTGCGCCGGCTTGAGCCTGGCCGTCGCGGTGCCCTCCGCCGGCGCCTCGTCCCCTGCTAGCACTAGCTAGCTAAGCCTCACTCACCTTGCGCGCAACCTGACGCGCGTTTGCATGCTGCTGCATGCAAACGCAACGGCGGGCGTGGCCGTTTTGTTGTTCTAGCTCTAGTTTGATCGACGTGTTCCATTTGAACCGGTAGATCCAGATGGGTTCTCTC

SEQ ID NO: 1063 - DNA, 1572 bp, Zea mays
  misc_feature (1)..(1572): Ceres cDNA ID no. 12405776
  misc_feature (1)..(1572): Ceres CLONE  ID no. 256998
  misc_feature (1)..(1572): Also known as  Ceres CDNA ID no. 23764537
agcagtcagcacgtctccgtccccgacgatgccggggagcaatgccaatggagggcgcagcctgtacggacacggccgaccggccatcttcacccccctctccttgccgccctcggttccggactctgctcccctgccccatacccccaccgctcctcacgcctcgcctgactgccgaggcaaccccggaagctcctcccgcgcgcgaacatgatttggcctgaacaacgcagaggaagtgatcttatgtagctacaaaagatagtaatggggatatccaaggtgacaggcattgccgccacagcttttcttgtcacatctgttagtctgtgccagttgggaatgaggattattatgcttccattcctagccaccggtattgttgcttccattgtcacggttgcatcgcatgatgccatcaacctaccgtggatcttggggaagaactcggtcggaagatttcctctttggtcgattatactgtttggtcctttcttgacgcttgctcggacatatgcgatggttaagagatacatgaggaaggaggccgtgtatgacaagatcgtggaaggcctatatctcggaggatggccgtttctcttgaaacatttgccccctggaaacccatctgtcatagattgcacttgtgagcttccaagaagttcattcgttccagcagacgagtatctttgccttgcaacttgggataccagagctccaacaccgcaccagatcgaaaaggctgcacgttgggcttgtgaaaagaaatctgaggggaagccagtttatgtccattgcgcatttggtcatggaagaagtgcctgtgttgtgtgtgcaattctagtagcgctgggtactgctgagaactggaaagatgctgagaacatcatccgtgaaagaagaaagataaaaatgaacgcccttcaccgtaaaaccttggaagagtggtccaaacaacgagttcgtcagaaaaaggataagtagttgtttgaccagatgcatggagttgccctggatatggtgttattgctgcaccaatttattttaatccaatattccatagctcatgtatagtcgagtggaatgaggaatatcatagggagcccagctcgtgtgtaggatctatctatggagtacctatgacactgtcatagtaacatattgatttgagattctagatttggtgagaaccccataacctgtatcacaaagccttcaaggttggccagcttgccgagggcaagagccatttggctcatgaagctcatgttggcgtcgtcagtcagagatccaccggccatggtgtcagcaagcgactgatgcagctgctccaagccctgcgagagagcttcctctgcctgctgtgatgactgctgaaggctgcatatgccgaccacttgctgctctgtcagtggatctagctggggcagcagtgtctgcaacagaatggaatttcgtatactttattattggaactgcaaattcttcttgtactaaggggaaatctgatttacattggaacagttcttgtgatctcagtaatgaaaaagtaacatcgcctgagttccctgc

SEQ ID NO: 1064 - protein, 1572 aa, Zea mays
  misc_feature: PFam Name: DSPc; PFam Description: Dual specificity
  misc_feature: GI Number: 34908470; NR Description: P0489B03.9 [Oryza sativa (japonica cultivar-group)] >gi|20161641|dbj|BAB90560.1| P0489B03.9 [Oryza sativa (japonica cultivar-group)] >gi|20521237|dbj|BAB91753.1| P0679C12.2 [Oryza sativa (japonica
  misc_feature: GI Number: 48864307; NR Description: COG1597: Sphingosine kinase and enzymes related to eukaryotic diacylglycerol kinase
AGCAGTCAGCACGTCTCCGTCCCCGACGATGCCGGGGAGCAATGCCAATGGAGGGCGCAGCCTGTACGGACACGGCCGACCGGCCATCTTCACCCCCCTCTCCTTGCCGCCCTCGGTTCCGGACTCTGCTCCCCTGCCCCATACCCCCACCGCTCCTCACGCCTCGCCTGACTGCCGAGGCAACCCCGGAAGCTCCTCCCGCGCGCGAACATGATTTGGCCTGAACAACGCAGAGGAAGTGATCTTATGTAGCTACAAAAGATAGTAATGGGGATATCCAAGGTGACAGGCATTGCCGCCACAGCTTTTCTTGTCACATCTGTTAGTCTGTGCCAGTTGGGAATGAGGATTATTATGCTTCCATTCCTAGCCACCGGTATTGTTGCTTCCATTGTCACGGTTGCATCGCATGATGCCATCAACCTACCGTGGATCTTGGGGAAGAACTCGGTCGGAAGATTTCCTCTTTGGTCGATTATACTGTTTGGTCCTTTCTTGACGCTTGCTCGGACATATGCGATGGTTAAGAGATACATGAGGAAGGAGGCCGTGTATGACAAGATCGTGGAAGGCCTATATCTCGGAGGATGGCCGTTTCTCTTGAAACATTTGCCCCCTGGAAACCCATCTGTCATAGATTGCACTTGTGAGCTTCCAAGAAGTTCATTCGTTCCAGCAGACGAGTATCTTTGCCTTGCAACTTGGGATACCAGAGCTCCAACACCGCACCAGATCGAAAAGGCTGCACGTTGGGCTTGTGAAAAGAAATCTGAGGGGAAGCCAGTTTATGTCCATTGCGCATTTGGTCATGGAAGAAGTGCCTGTGTTGTGTGTGCAATTCTAGTAGCGCTGGGTACTGCTGAGAACTGGAAAGATGCTGAGAACATCATCCGTGAAAGAAGAAAGATAAAAATGAACGCCCTTCACCGTAAAACCTTGGAAGAGTGGTCCAAACAACGAGTTCGTCAGAAAAAGGATAAGTAGTTGTTTGACCAGATGCATGGAGTTGCCCTGGATATGGTGTTATTGCTGCACCAATTTATTTTAATCCAATATTCCATAGCTCATGTATAGTCGAGTGGAATGAGGAATATCATAGGGAGCCCAGCTCGTGTGTAGGATCTATCTATGGAGTACCTATGACACTGTCATAGTAACATATTGATTTGAGATTCTAGATTTGGTGAGAACCCCATAACCTGTATCACAAAGCCTTCAAGGTTGGCCAGCTTGCCGAGGGCAAGAGCCATTTGGCTCATGAAGCTCATGTTGGCGTCGTCAGTCAGAGATCCACCGGCCATGGTGTCAGCAAGCGACTGATGCAGCTGCTCCAAGCCCTGCGAGAGAGCTTCCTCTGCCTGCTGTGATGACTGCTGAAGGCTGCATATGCCGACCACTTGCTGCTCTGTCAGTGGATCTAGCTGGGGCAGCAGTGTCTGCAACAGAATGGAATTTCGTATACTTTATTATTGGAACTGCAAATTCTTCTTGTACTAAGGGGAAATCTGATTTACATTGGAACAGTTCTTGTGATCTCAGTAATGAAAAAGTAACATCGCCTGAGTTCCCTGC

SEQ ID NO: 1065 - DNA, 1347 bp, Zea mays
  misc_feature (1)..(1347): Ceres cDNA ID no. 12405869
  misc_feature (1)..(1347): Ceres CLONE  ID no. 238912
  misc_feature (1)..(1347): Also known as  Ceres CDNA ID no. 23755327
accaatacagcactggaccactatatatccccccgccccgcgctggggccggtccccagctagcgagcgccgccggtgccagtgcaacagaacacgcaccacacgggcgcagactgcagagacaacagatcgatcgtccaatggcgatcggcgggtcggaggccggcgggggaggcgcggggagcatgaggagcgtgctggtgacgggcggcgcggggttcatcggcacgcacacggtgctgcgcctgctggagcagggctacatcgtcaccgtcgtcgacaacttccacaactccgtccccgaggcgctcgaccgcgtccgcctcatcgccggccccgcgctctccacccgcctcgacttcatccgcggggacctgaggaacaccgatgacttggagaaggtgttcgctgccaggaggtacgacgccgtcatccacttcgctgggctgaaggccgtgggggagagcgtcgcgcacccggagatgtactacgagaacaacctcatcggcaccatcaacctctacaagagcatgaaggagcacggctgcaagaagctggttttctcgtcatccgccaccgtgtacggctggccggaggtgatcccatgcgtcgaggactccaagctgcaggccgccaacccatacggcaggaccaagcttatccttgaggatatggcgcgtgactaccaccgcgcggacacggagtggagcatcgtcctgctgcgctacttcaaccccatcggtgcgcacagctccggcgagatcggagaggaccccaaggggataccgaacaacctgctgccctacatccagcaggtcgccgtcggcaggctccccgagctcaacgtctacggccacgattaccccacccgggacggcaccgcgatcagggactacatacacgtcgtcgacctcgccgatgggcacatcgcagcgctcaagaagctcttcgactctcctgatataggttgtgtggcctacaatctgggtacagggcgcggcacatccgttctggagatggtggcggcgttcaagaaggcctccggcaaggagattcccaccaagttgtgccccaggagaccgggtgacgcgacggaggtttacgcgtccactgagaaggctgaaagagagcttgcatggagggcccaatatggaatcgaggagatgtgcagggaccaatggaactgggccaagaagaacccgtatggctactgcggcggtgcaaaaaaatagcgtaggttcgtcgcaatgaagaattgtcgatagtagttctcttctctacactaatcaatggaacatgtaataaacacggaccacctaatctctactagtttctatggtttccact

SEQ ID NO: 1066 - protein, 1347 aa, Zea mays
  misc_feature: PFam Name: Epimerase; PFam Description: NAD dependent
  misc_feature: PFam Name: 3Beta_HSD; PFam Description: 3-beta
  misc_feature: GI Number: 61658228; NR Description: UDP-D-galactose
  misc_feature: GI Number: 33186647; NR Description: UDP-Glc-4-epimerase
  misc_feature: GI Number: 3021355; NR Description: UDP-galactose 4-epimerase [Cyamopsis tetragonoloba] >gi|7437271|pir||T10496 UDPglucose 4-epimerase (EC 5.1.3.2) (clone GEPI42) - guar
  misc_feature: GI Number: 26106014; NR Description: putative UDP-glucose
  misc_feature: GI Number: 52077318; NR Description: putative UDP-glucose
ACCAATACAGCACTGGACCACTATATATCCCCCCGCCCCGCGCTGGGGCCGGTCCCCAGCTAGCGAGCGCCGCCGGTGCCAGTGCAACAGAACACGCACCACACGGGCGCAGACTGCAGAGACAACAGATCGATCGTCCAATGGCGATCGGCGGGTCGGAGGCCGGCGGGGGAGGCGCGGGGAGCATGAGGAGCGTGCTGGTGACGGGCGGCGCGGGGTTCATCGGCACGCACACGGTGCTGCGCCTGCTGGAGCAGGGCTACATCGTCACCGTCGTCGACAACTTCCACAACTCCGTCCCCGAGGCGCTCGACCGCGTCCGCCTCATCGCCGGCCCCGCGCTCTCCACCCGCCTCGACTTCATCCGCGGGGACCTGAGGAACACCGATGACTTGGAGAAGGTGTTCGCTGCCAGGAGGTACGACGCCGTCATCCACTTCGCTGGGCTGAAGGCCGTGGGGGAGAGCGTCGCGCACCCGGAGATGTACTACGAGAACAACCTCATCGGCACCATCAACCTCTACAAGAGCATGAAGGAGCACGGCTGCAAGAAGCTGGTTTTCTCGTCATCCGCCACCGTGTACGGCTGGCCGGAGGTGATCCCATGCGTCGAGGACTCCAAGCTGCAGGCCGCCAACCCATACGGCAGGACCAAGCTTATCCTTGAGGATATGGCGCGTGACTACCACCGCGCGGACACGGAGTGGAGCATCGTCCTGCTGCGCTACTTCAACCCCATCGGTGCGCACAGCTCCGGCGAGATCGGAGAGGACCCCAAGGGGATACCGAACAACCTGCTGCCCTACATCCAGCAGGTCGCCGTCGGCAGGCTCCCCGAGCTCAACGTCTACGGCCACGATTACCCCACCCGGGACGGCACCGCGATCAGGGACTACATACACGTCGTCGACCTCGCCGATGGGCACATCGCAGCGCTCAAGAAGCTCTTCGACTCTCCTGATATAGGTTGTGTGGCCTACAATCTGGGTACAGGGCGCGGCACATCCGTTCTGGAGATGGTGGCGGCGTTCAAGAAGGCCTCCGGCAAGGAGATTCCCACCAAGTTGTGCCCCAGGAGACCGGGTGACGCGACGGAGGTTTACGCGTCCACTGAGAAGGCTGAAAGAGAGCTTGCATGGAGGGCCCAATATGGAATCGAGGAGATGTGCAGGGACCAATGGAACTGGGCCAAGAAGAACCCGTATGGCTACTGCGGCGGTGCAAAAAAATAGCGTAGGTTCGTCGCAATGAAGAATTGTCGATAGTAGTTCTCTTCTCTACACTAATCAATGGAACATGTAATAAACACGGACCACCTAATCTCTACTAGTTTCTATGGTTTCCACT

SEQ ID NO: 1067 - DNA, 1714 bp, Zea mays
  misc_feature (1)..(1714): Ceres cDNA ID no. 12405876
  misc_feature (1)..(1714): Ceres CLONE  ID no. 238459
  misc_feature (1)..(1714): Also known as  Ceres CDNA ID no. 23754196
gttcccttcgatccaccccgcatcccagggagtcctccactacagttcttgcccacctacggcgatggccggccgcctcccgggcgccgctgcgtcctcaccgttaccccgcgccctcctcctcatcgccgcgcttgttctcttctccatctctttcctctcactccgctccctgcgccccgcggcggaccccgcgcttgcgtccgccgccgacaagtaccgtcctcttctccggctccagtcctcctcgtcggtgtaccattctccggaggcgttcacagcggggtacgcggagatggagcggagcttcaaggtgtacatttacccggacggcgaccccaagacattctatcagacgcctcgcaagctcacggggaagtacgccagcgagggctacttcttccagaacatccgagagagccggttccgcaccgacgacccggaccaggcgcatctcttcttcgtgcccatctcgccccacaagatgcgcggcaagggtacttcatacgagaatatgacggtgatagttaaggattacgtagaaggtttgataaacaagtatccttactggaacaggacactaggagcagaccacttctttgtcacctgccatgatgtgggtgtgagagcatttgaaggacttccattcatggtgaagaactctattagagttgtatgttcgccaagctataatgttgactttataccacataaggatattgcgcttcctcaagtactacagccatttgccctacctgaaggaggaaatgatattgagaacaggacaactcttggcttttgggctggccatcgcaattccaaaataagggttatcctagcacgagtttgggagaatgacacagagcttgctatcagcaacaaccggatcagtagagctattggagagctagtttatcagaagcagttttaccgtaccaagttctgtatctgtcctggcggctctcaagttaacagtgcccgtatatctgattcaatacactatggttgtgttcctgttattctgtcagattactatgacctgcctttcaatgacgcccttgactggagaaagtttgcggttatacttagggagagagatgtatatcaactgaagaatatcttgaaatctatatcacaggaggagtttgtttcattgcataaatctctagttcaggtgcagaaacactttgtgtggcattcacctcctgtatcctacgatgcattccacatgattatgtatgaactgtggctgcggcataatgtaataaagtactaagcttctcagcctctgagttttgatttctaacctaaatgactgatccatcggaaagatactacaaagtctgatagcctgctgttactgccttgaaaatgggcttctggttctttgttctttgaatcaccagatggatgattattgaatataatgttagctatgcatggtgcaatggagagcatttccatcgaagagttgaccgttgttcagcatatatgacaaaactgtagtcctggttaattgatggattacttgattcttttaacaatagttagctttcccatattgcaatctttccctctagatattacttatattccgtggatctgcttggttgattgcatgtattttctcgcgtaatttttttctgttcaatggtttcaggcatgtaagtaatgtacaatattattgatgtgaaacatagtccattttcttctg

SEQ ID NO: 1068 - protein, 1714 aa, Zea mays
  misc_feature: PFam Name: Exostosin; PFam Description: Exostosin family
  misc_feature: GI Number: 51535578; NR Description: pectin-glucuronyltransferase-like [Oryza sativa (japonica
  misc_feature: GI Number: 50905787; NR Description: putative pectin-glucuronyltransferase [Oryza sativa (japonica cultivar-group)] >gi|46390046|dbj|BAD15422.1| putative pectin-glucuronyltransferase [Oryza sativa (japonica
  misc_feature: GI Number: 34911614; NR Description: limonene cyclase-like protein [Oryza sativa (japonica cultivar-group)] >gi|20805119|dbj|BAB92790.1| limonene cyclase-like protein [Oryza
  misc_feature: GI Number: 15237526; NR Description: exostosin family protein / pentatricopeptide (PPR) repeat-containing protein [Arabidopsis
  misc_feature: GI Number: 55297176; NR Description: pectin-glucuronyltransferase-like [Oryza sativa (japonica
GTTCCCTTCGATCCACCCCGCATCCCAGGGAGTCCTCCACTACAGTTCTTGCCCACCTACGGCGATGGCCGGCCGCCTCCCGGGCGCCGCTGCGTCCTCACCGTTACCCCGCGCCCTCCTCCTCATCGCCGCGCTTGTTCTCTTCTCCATCTCTTTCCTCTCACTCCGCTCCCTGCGCCCCGCGGCGGACCCCGCGCTTGCGTCCGCCGCCGACAAGTACCGTCCTCTTCTCCGGCTCCAGTCCTCCTCGTCGGTGTACCATTCTCCGGAGGCGTTCACAGCGGGGTACGCGGAGATGGAGCGGAGCTTCAAGGTGTACATTTACCCGGACGGCGACCCCAAGACATTCTATCAGACGCCTCGCAAGCTCACGGGGAAGTACGCCAGCGAGGGCTACTTCTTCCAGAACATCCGAGAGAGCCGGTTCCGCACCGACGACCCGGACCAGGCGCATCTCTTCTTCGTGCCCATCTCGCCCCACAAGATGCGCGGCAAGGGTACTTCATACGAGAATATGACGGTGATAGTTAAGGATTACGTAGAAGGTTTGATAAACAAGTATCCTTACTGGAACAGGACACTAGGAGCAGACCACTTCTTTGTCACCTGCCATGATGTGGGTGTGAGAGCATTTGAAGGACTTCCATTCATGGTGAAGAACTCTATTAGAGTTGTATGTTCGCCAAGCTATAATGTTGACTTTATACCACATAAGGATATTGCGCTTCCTCAAGTACTACAGCCATTTGCCCTACCTGAAGGAGGAAATGATATTGAGAACAGGACAACTCTTGGCTTTTGGGCTGGCCATCGCAATTCCAAAATAAGGGTTATCCTAGCACGAGTTTGGGAGAATGACACAGAGCTTGCTATCAGCAACAACCGGATCAGTAGAGCTATTGGAGAGCTAGTTTATCAGAAGCAGTTTTACCGTACCAAGTTCTGTATCTGTCCTGGCGGCTCTCAAGTTAACAGTGCCCGTATATCTGATTCAATACACTATGGTTGTGTTCCTGTTATTCTGTCAGATTACTATGACCTGCCTTTCAATGACGCCCTTGACTGGAGAAAGTTTGCGGTTATACTTAGGGAGAGAGATGTATATCAACTGAAGAATATCTTGAAATCTATATCACAGGAGGAGTTTGTTTCATTGCATAAATCTCTAGTTCAGGTGCAGAAACACTTTGTGTGGCATTCACCTCCTGTATCCTACGATGCATTCCACATGATTATGTATGAACTGTGGCTGCGGCATAATGTAATAAAGTACTAAGCTTCTCAGCCTCTGAGTTTTGATTTCTAACCTAAATGACTGATCCATCGGAAAGATACTACAAAGTCTGATAGCCTGCTGTTACTGCCTTGAAAATGGGCTTCTGGTTCTTTGTTCTTTGAATCACCAGATGGATGATTATTGAATATAATGTTAGCTATGCATGGTGCAATGGAGAGCATTTCCATCGAAGAGTTGACCGTTGTTCAGCATATATGACAAAACTGTAGTCCTGGTTAATTGATGGATTACTTGATTCTTTTAACAATAGTTAGCTTTCCCATATTGCAATCTTTCCCTCTAGATATTACTTATATTCCGTGGATCTGCTTGGTTGATTGCATGTATTTTCTCGCGTAATTTTTTTCTGTTCAATGGTTTCAGGCATGTAAGTAATGTACAATATTATTGATGTGAAACATAGTCCATTTTCTTCTG

SEQ ID NO: 1069 - DNA, 1753 bp, Zea mays
  misc_feature (1)..(1753): Ceres cDNA ID no. 12405941
  misc_feature (1)..(1753): Ceres CLONE  ID no. 277316
  misc_feature (1)..(1753): Also known as  Ceres CDNA ID no. 23775145
agcaatagactggtcaccactcacgagagcagaaaacaaacaatgcctccttacctgctcgctgccggcgcgcttatcgtcttcctgtacatcatcaagaaccgcaggagcagaaagctcccgccatccccgccgtcgctaccgctgatcggccaccttcacctcatcggccgcgtcgcgcaccgatccttgctagagctgcaggttcgctatggcggcggcggcggtctcctcttcctgcaactcgggcgcagaccgaccttggtcgtgtccactgcggccgcggccgcggatctgttcaagaaccacgacctcgctttcgcctcccgcccacgcagcgtgggaggggataagctgatgtatgagtgcagcaacgtgtcgttcgcgccttacggcgagaactggcgccggggcaagaagatcgctgtggtccacctcctctctccacggcgcgtggaatcgttcgcgcccgtaagggccgccgaggtagccgcgctcgtcgcacggacacgccgcaccgcggaggctggggaggccgtggagttgagggagctcctgaacggctacgccaacgcggtggccacccgcgcggccaccggtgccgctggggcgacagcagagaagctgaaagagctgatggggaactccgagcccgaggcgctgatggcgggcttccaacccgaagacgtgctgccggacgcaccggcgaggttcgtgagatgggtgacgggcctcaataagaagctcgaagacttggtggagtcgtgggacaagttcctgtccgatatagtggccgcacacaaggagaaggggggtggcgacgcagaggaggatgaggacttcttggatgtcttgcttcggctgcgggaagaaggcgcagatgggctcgagctcacagacgatcgcatcaaagctaccgtcaaggacatgatagcggctgcaactgaaacatcgtcccaaacgctggaatggaccatggccgaactcattgccaacccgcgggtgatgagcaagctccaaggcgagatagcgcgagtcgtcagcgccgatcagacgaccatcgctgaaccggacctgaacaaaatggagtacctgagggcagtgttcaaagaggtgcttcggctccacccaccagcgccgctcctcgtcccgcacgaatcaacaacgcccgcggttgtgcagggctacgagatcccggccaagacggctctcttcgtcaacgtgtgggccatcgggcgggaccctgctgtgtgggacgcaccggacgagttccgcccagagcggttcgtgggcggcagtccctcggtggacttcagaggtactactaccagctcatcccgttcggcgccggccggaggatctgccccggcatcaacttcgcgctgccggtcttggagctcgcgcttgtcagccttctgcaccacttcgaatgggagctccccgccggcgtgggaaaagcggacctcgacgtgggcgaggcgccggggatgacgacgccgcggcggattccgctcgtccttgtccccaagtgcaggacgctcgttcagccagcgctgcagtagcgcgaggaatttcatgtgtctccatgcagtggcggaaccagaaatatttaagagcttgggtaaaaaataatacttatactgtaaatatgtagctttgtctaatttttacctgtgtttaactatattttactacttgttgtatgtgtataagttcactagcaataatggaggagcctatgctcttgcccccg

SEQ ID NO: 1070 - protein, 1753 aa, Zea mays
  misc_feature: PFam Name: p450; PFam Description: Cytochrome P450
  misc_feature: GI Number: 50725157; NR Description: putative Cytochrome P450
  misc_feature: GI Number: 50725156; NR Description: putative Cytochrome P450
  misc_feature: GI Number: 25282608; NR Description: cytochrome P-450LXXIA1 [similarity] - avocado >gi|166949|gb|AAA32913.1| cytochrome
  misc_feature: GI Number: 46409049; NR Description: cytochrome P450 [Muscari armeniacum] >gi|46409047|dbj|BAD16679.1| cytochrome P450 [Muscari
  misc_feature: GI Number: 40645046; NR Description: cytochrome P450
AGCAATAGACTGGTCACCACTCACGAGAGCAGAAAACAAACAATGCCTCCTTACCTGCTCGCTGCCGGCGCGCTTATCGTCTTCCTGTACATCATCAAGAACCGCAGGAGCAGAAAGCTCCCGCCATCCCCGCCGTCGCTACCGCTGATCGGCCACCTTCACCTCATCGGCCGCGTCGCGCACCGATCCTTGCTAGAGCTGCAGGTTCGCTATGGCGGCGGCGGCGGTCTCCTCTTCCTGCAACTCGGGCGCAGACCGACCTTGGTCGTGTCCACTGCGGCCGCGGCCGCGGATCTGTTCAAGAACCACGACCTCGCTTTCGCCTCCCGCCCACGCAGCGTGGGAGGGGATAAGCTGATGTATGAGTGCAGCAACGTGTCGTTCGCGCCTTACGGCGAGAACTGGCGCCGGGGCAAGAAGATCGCTGTGGTCCACCTCCTCTCTCCACGGCGCGTGGAATCGTTCGCGCCCGTAAGGGCCGCCGAGGTAGCCGCGCTCGTCGCACGGACACGCCGCACCGCGGAGGCTGGGGAGGCCGTGGAGTTGAGGGAGCTCCTGAACGGCTACGCCAACGCGGTGGCCACCCGCGCGGCCACCGGTGCCGCTGGGGCGACAGCAGAGAAGCTGAAAGAGCTGATGGGGAACTCCGAGCCCGAGGCGCTGATGGCGGGCTTCCAACCCGAAGACGTGCTGCCGGACGCACCGGCGAGGTTCGTGAGATGGGTGACGGGCCTCAATAAGAAGCTCGAAGACTTGGTGGAGTCGTGGGACAAGTTCCTGTCCGATATAGTGGCCGCACACAAGGAGAAGGGGGGTGGCGACGCAGAGGAGGATGAGGACTTCTTGGATGTCTTGCTTCGGCTGCGGGAAGAAGGCGCAGATGGGCTCGAGCTCACAGACGATCGCATCAAAGCTACCGTCAAGGACATGATAGCGGCTGCAACTGAAACATCGTCCCAAACGCTGGAATGGACCATGGCCGAACTCATTGCCAACCCGCGGGTGATGAGCAAGCTCCAAGGCGAGATAGCGCGAGTCGTCAGCGCCGATCAGACGACCATCGCTGAACCGGACCTGAACAAAATGGAGTACCTGAGGGCAGTGTTCAAAGAGGTGCTTCGGCTCCACCCACCAGCGCCGCTCCTCGTCCCGCACGAATCAACAACGCCCGCGGTTGTGCAGGGCTACGAGATCCCGGCCAAGACGGCTCTCTTCGTCAACGTGTGGGCCATCGGGCGGGACCCTGCTGTGTGGGACGCACCGGACGAGTTCCGCCCAGAGCGGTTCGTGGGCGGCAGTCCCTCGGTGGACTTCAGAGGTACTACTACCAGCTCATCCCGTTCGGCGCCGGCCGGAGGATCTGCCCCGGCATCAACTTCGCGCTGCCGGTCTTGGAGCTCGCGCTTGTCAGCCTTCTGCACCACTTCGAATGGGAGCTCCCCGCCGGCGTGGGAAAAGCGGACCTCGACGTGGGCGAGGCGCCGGGGATGACGACGCCGCGGCGGATTCCGCTCGTCCTTGTCCCCAAGTGCAGGACGCTCGTTCAGCCAGCGCTGCAGTAGCGCGAGGAATTTCATGTGTCTCCATGCAGTGGCGGAACCAGAAATATTTAAGAGCTTGGGTAAAAAATAATACTTATACTGTAAATATGTAGCTTTGTCTAATTTTTACCTGTGTTTAACTATATTTTACTACTTGTTGTATGTGTATAAGTTCACTAGCAATAATGGAGGAGCCTATGCTCTTGCCCCCG

SEQ ID NO: 1071 - DNA, 873 bp, Zea mays
  misc_feature (1)..(873): Ceres cDNA ID no. 12405991
  misc_feature (1)..(873): Ceres CLONE  ID no. 300102
  misc_feature (1)..(873): Also known as  Ceres CDNA ID no. 23762224
acaaagcagcaagcagggcaggttttgcgaagcaaagcccacgagcacaggatgaggatgcgtgcgcgggcggcatcggcatctgcgtcggcggctgtggtggtgctgctcctgctcctgctactggtgggcgtctgcgcgggcgccgtgtacaaggtaggcgacctggacgcctggggcgtgccgccgccgtccaagcccgacgtctacaagcgctgggccaagtccatccacttcgcgctcggcgactccatctggttcctgtacccgccgagccaggactcggtgctgcagctggcgccggcggccttcgcgtcctgcgacctgtcgcgccccgtggccaggctcgccgacggcaactccttattcaacctcaccgcgcccggccgcgcctactacgccagcggcgcgccgggtcactgccgcaggggccagaagctctgggtcgacgtgcccttgcccaacggcacctacctccagccctccgccaccgacctcgccgcgctcgcgcccacccccgccgccgacccgcccgccgggttcgcgtccgctgccgccgccgcgccacaggggggcaacgcctcgcccgcgccccgcgccgccgccgccgctggatccgtcgtcgcactctccttcgcgctccagatcctcctcctctgactgtgcggtacagtagctgattagctacctctatctcgctagttttgagatctccattttttgtgtgtgctgtggaacgagagtgagaacagttctttcttggctgaaaattgaattgaatgcatgatcggagggagattggatctccatttgctttctttttttctgttggcttctactgctactgtctctttccattaattaaattccttc

SEQ ID NO: 1072 - protein, 873 aa, Zea mays
  misc_feature: PFam Name: Cu_bind_like; PFam Description: Plastocyanin-like
  misc_feature: PFam Name: Extensin_2; PFam Description: Extensin-like region
  misc_feature: PFam Name: Pyr_redox_2; PFam Description: Pyridine
  misc_feature: PFam Name: FH2; PFam Description: Formin Homology 2 Domain
  misc_feature: PFam Name: 7tm_1; PFam Description: 7 transmembrane receptor
  misc_feature: GI Number: 46359847; NR Description: At1g64640 [Arabidopsis thaliana] >gi|45773786|gb|AAS76697.1| At1g64640 [Arabidopsis thaliana] >gi|42562941|ref|NP_176645.3| plastocyanin-like
  misc_feature: GI Number: 50905419; NR Description: phytocyanin protein-like [Oryza sativa (japonica cultivar-group)] >gi|49389255|dbj|BAD25217.1| phytocyanin protein-like [Oryza sativa
  misc_feature: GI Number: 56783790; NR Description: putative NtEPc-like
  misc_feature: GI Number: 53792667; NR Description: NtEPc-like [Oryza sativa
  misc_feature: GI Number: 34908784; NR Description: P0415A04.29 [Oryza sativa (japonica cultivar-group)] >gi|20161188|dbj|BAB90115.1| phytocyanin protein-like [Oryza sativa (japonica cultivar-group)] >gi|20160824|dbj|BAB89764.1| P0557A01.2 [Oryza sativa (japonica
ACAAAGCAGCAAGCAGGGCAGGTTTTGCGAAGCAAAGCCCACGAGCACAGGATGAGGATGCGTGCGCGGGCGGCATCGGCATCTGCGTCGGCGGCTGTGGTGGTGCTGCTCCTGCTCCTGCTACTGGTGGGCGTCTGCGCGGGCGCCGTGTACAAGGTAGGCGACCTGGACGCCTGGGGCGTGCCGCCGCCGTCCAAGCCCGACGTCTACAAGCGCTGGGCCAAGTCCATCCACTTCGCGCTCGGCGACTCCATCTGGTTCCTGTACCCGCCGAGCCAGGACTCGGTGCTGCAGCTGGCGCCGGCGGCCTTCGCGTCCTGCGACCTGTCGCGCCCCGTGGCCAGGCTCGCCGACGGCAACTCCTTATTCAACCTCACCGCGCCCGGCCGCGCCTACTACGCCAGCGGCGCGCCGGGTCACTGCCGCAGGGGCCAGAAGCTCTGGGTCGACGTGCCCTTGCCCAACGGCACCTACCTCCAGCCCTCCGCCACCGACCTCGCCGCGCTCGCGCCCACCCCCGCCGCCGACCCGCCCGCCGGGTTCGCGTCCGCTGCCGCCGCCGCGCCACAGGGGGGCAACGCCTCGCCCGCGCCCCGCGCCGCCGCCGCCGCTGGATCCGTCGTCGCACTCTCCTTCGCGCTCCAGATCCTCCTCCTCTGACTGTGCGGTACAGTAGCTGATTAGCTACCTCTATCTCGCTAGTTTTGAGATCTCCATTTTTTGTGTGTGCTGTGGAACGAGAGTGAGAACAGTTCTTTCTTGGCTGAAAATTGAATTGAATGCATGATCGGAGGGAGATTGGATCTCCATTTGCTTTCTTTTTTTCTGTTGGCTTCTACTGCTACTGTCTCTTTCCATTAATTAAATTCCTTC

SEQ ID NO: 1073 - DNA, 424 bp, Zea mays
  misc_feature (1)..(424): Ceres cDNA ID no. 12406025
  misc_feature (1)..(424): Ceres CLONE  ID no. 306279
  misc_feature (1)..(424): Also known as  Ceres CDNA ID no. 23778094
gatctgaggaaatcgtccttgagaccggagctgtacacgccagcctacggaggcttctttgagctggacctggagaaggaaaagacggtggtatctctgagaactttgatcgatcgctctgcggtggagagcttcggtggaggcggcagggtgtgcatcatggcccgggtctatccggcggcgctcgtcgacgacggcggcactcgcatgtacgcgttcaacaatggcactagcaccgtcagagtgccccggctagaagcgtggagcatgaggagggcacaggttaacaagggatgaggaggaacacaaggccatttgatagctagaggagaggaacagagcatgggcacatgaattaaacacacactgctggtttaatttgctggaattaatcaatcaatcaatcaacaaacacacgaagatt

SEQ ID NO: 1074 - protein, 424 aa, Zea mays
  misc_feature: PFam Name: Glyco_hydro_32; PFam Description: Glycosyl
  misc_feature: GI Number: 54112208; NR Description: cell wall invertase 5
  misc_feature: GI Number: 40217607; NR Description: cell wall invertase
  misc_feature: GI Number: 57900173; NR Description: cell wall invertase
  misc_feature: GI Number: 41581373; NR Description: fructan 1-exohydrolase
  misc_feature: GI Number: 28411218; NR Description: fructan 1-exohydrolase
GATCTGAGGAAATCGTCCTTGAGACCGGAGCTGTACACGCCAGCCTACGGAGGCTTCTTTGAGCTGGACCTGGAGAAGGAAAAGACGGTGGTATCTCTGAGAACTTTGATCGATCGCTCTGCGGTGGAGAGCTTCGGTGGAGGCGGCAGGGTGTGCATCATGGCCCGGGTCTATCCGGCGGCGCTCGTCGACGACGGCGGCACTCGCATGTACGCGTTCAACAATGGCACTAGCACCGTCAGAGTGCCCCGGCTAGAAGCGTGGAGCATGAGGAGGGCACAGGTTAACAAGGGATGAGGAGGAACACAAGGCCATTTGATAGCTAGAGGAGAGGAACAGAGCATGGGCACATGAATTAAACACACACTGCTGGTTTAATTTGCTGGAATTAATCAATCAATCAATCAACAAACACACGAAGATT

SEQ ID NO: 1075 - DNA, 1942 bp, Zea mays
  misc_feature (1)..(1942): Ceres cDNA ID no. 12406130
  misc_feature (1)..(1942): Ceres CLONE  ID no. 335550
  misc_feature (1)..(1942): Also known as  Ceres CDNA ID no. 23774366
  misc_feature (212)..(212): n is a, c, t, g, unknown, or other
aacatcctaatcgaaaaaaagaattttttttccgcataggctcagggttgcgtggcagcgtggagcatattcaacaccgccgtcagcccgtcaccgcaggccgcagcaggctcgcttcgcttgcgcctccccccttccccgccgtcgccgccgccgccggagccatgtccggctcggcgttgcaggcggtggagccccgcccagcggcagcngcgacgactgccgcggcttctccggccgccacggctcagcccgcggcggtggcagcggctaggggagcgagagggtgtggcggcccagcgcgtgcatcggggccggaggcaacgatggagcacgtgctgctggcgctgcgggagacggaggcggaacgggaagcgcggatccgcggcgtcttcggcttcttcgacgccgcggggcagggccacctcgagcacgcgcagatcacggccggtctcatcgcgctgcgcgtccccgaggagaccagcggagcaggcgccgaggccgaggactacgcgcgcgcgctgctgcgggcctgcgaccgggaccgcgacggccgcgtcggttatgacgacttccggaggtacatggacgacaaggagctcgagctctaccgcatcttccaggccatcgacgtcgaacacaacggatgtatcctgcccgaggagctctggcacgcgctcgtcaaggctggtatagaaattgatgatgaagagcttgcaagatttgttgagcatgtggataaggacaatgatggtattattacttttgaggagtggagagattttcttttgctttatcctcatgaagcaaccatggaaaacatatatcatcactgggaaagagtctgccttgtagatatcggagagcaggctgctataccagaagggataaacaaacatgtaagtgcgagcaaatatctgattgcaggaggcatcgctggtgcagcatctcgcactgcaactgcacctcttgatcgcctcaaagtaaatatgcaagtgcaaacgaactgtattgcagttgtagatgtagttaagggtatatggagagaaggtggtctactgggattttttagagggaatggactgaatgtggtaaaagttgctccagaaagtgctataaggttctatacctatgaaatgcttaaagaatacataatgaaaagtaaaggagaaaataagggtgacattggtacttctggacgtctcatggctgggggtttggctggtgctatcgcacagacagtgatttatcccatggatttggtgaagactcgtctgcagacttatgagggaggcagaattcctagccttggcgcactatcaagggatatatggacacatgaaggtcctcgagcattctacagaggccttgttccatcattgcttggcatggtcccttatgctggaattgatcttactgtttatgaaacactgaaagaaatgtccaggacatatgccctcgtggacaaagatcctggccctttagtacagctgggctgcggaacagtctctggagcgctaggagcgacatgcgtttatcctttacaagtcatcagaacaagaatgcaagctcagccagccaattcagaggatccatatagggggatgaccgattgtttccggataactctgcgtcgtgaaggagtttctggattttacaaaggccttgtaccaaatcttcttaaagtggtgccagctgcaagcattacctatcttgtttatgagacaatgaagaaaagtctctccctagattaagtgactttgtagattctggatatcagcgactgactctatagatagtgtcgaggcatgatcttccttgatgagtaggttctaacttaatgggcctgaggtgtaagatagtagtatttttggcctcaggatacagatgatgcagggcattttcattattattggtagaaataaaacgcgatacctgtcag

SEQ ID NO: 1076 - protein, 1942 aa, Zea mays
  misc_feature: PFam Name: Mito_carr; PFam Description: Mitochondrial
  misc_feature: PFam Name: efhand; PFam Description: EF hand
  misc_feature: GI Number: 9758252; NR Description: calcium-binding transporter-like protein [Arabidopsis thaliana] >gi|15241360|ref|NP_199918.1| mitochondrial substrate carrier
  misc_feature: GI Number: 7576170; NR Description: peroxisomal Ca-dependent solute carrier-like protein [Arabidopsis thaliana] >gi|51968598|dbj|BAD42991.1| peroxisomal Ca-dependent solute carrier-like protein [Arabidopsis thaliana]
  misc_feature: GI Number: 50906063; NR Description: putative Mcsc-pending-prov protein [Oryza sativa (japonica cultivar-group)] >gi|46390391|dbj|BAD15855.1| putative Mcsc-pending-prov protein
  misc_feature: GI Number: 20259153; NR Description: putative peroxisomal Ca-dependent solute carrier [Arabidopsis thaliana] >gi|15810361|gb|AAL07068.1| putative peroxisomal Ca-dependent solute carrier protein [Arabidopsis thaliana]
  misc_feature: GI Number: 51090928; NR Description: putative small calcium-binding mitochondrial carrier 2 [Oryza sativa (japonica
AACATCCTAATCGAAAAAAAGAATTTTTTTTCCGCATAGGCTCAGGGTTGCGTGGCAGCGTGGAGCATATTCAACACCGCCGTCAGCCCGTCACCGCAGGCCGCAGCAGGCTCGCTTCGCTTGCGCCTCCCCCCTTCCCCGCCGTCGCCGCCGCCGCCGGAGCCATGTCCGGCTCGGCGTTGCAGGCGGTGGAGCCCCGCCCAGCGGCAGCNGCGACGACTGCCGCGGCTTCTCCGGCCGCCACGGCTCAGCCCGCGGCGGTGGCAGCGGCTAGGGGAGCGAGAGGGTGTGGCGGCCCAGCGCGTGCATCGGGGCCGGAGGCAACGATGGAGCACGTGCTGCTGGCGCTGCGGGAGACGGAGGCGGAACGGGAAGCGCGGATCCGCGGCGTCTTCGGCTTCTTCGACGCCGCGGGGCAGGGCCACCTCGAGCACGCGCAGATCACGGCCGGTCTCATCGCGCTGCGCGTCCCCGAGGAGACCAGCGGAGCAGGCGCCGAGGCCGAGGACTACGCGCGCGCGCTGCTGCGGGCCTGCGACCGGGACCGCGACGGCCGCGTCGGTTATGACGACTTCCGGAGGTACATGGACGACAAGGAGCTCGAGCTCTACCGCATCTTCCAGGCCATCGACGTCGAACACAACGGATGTATCCTGCCCGAGGAGCTCTGGCACGCGCTCGTCAAGGCTGGTATAGAAATTGATGATGAAGAGCTTGCAAGATTTGTTGAGCATGTGGATAAGGACAATGATGGTATTATTACTTTTGAGGAGTGGAGAGATTTTCTTTTGCTTTATCCTCATGAAGCAACCATGGAAAACATATATCATCACTGGGAAAGAGTCTGCCTTGTAGATATCGGAGAGCAGGCTGCTATACCAGAAGGGATAAACAAACATGTAAGTGCGAGCAAATATCTGATTGCAGGAGGCATCGCTGGTGCAGCATCTCGCACTGCAACTGCACCTCTTGATCGCCTCAAAGTAAATATGCAAGTGCAAACGAACTGTATTGCAGTTGTAGATGTAGTTAAGGGTATATGGAGAGAAGGTGGTCTACTGGGATTTTTTAGAGGGAATGGACTGAATGTGGTAAAAGTTGCTCCAGAAAGTGCTATAAGGTTCTATACCTATGAAATGCTTAAAGAATACATAATGAAAAGTAAAGGAGAAAATAAGGGTGACATTGGTACTTCTGGACGTCTCATGGCTGGGGGTTTGGCTGGTGCTATCGCACAGACAGTGATTTATCCCATGGATTTGGTGAAGACTCGTCTGCAGACTTATGAGGGAGGCAGAATTCCTAGCCTTGGCGCACTATCAAGGGATATATGGACACATGAAGGTCCTCGAGCATTCTACAGAGGCCTTGTTCCATCATTGCTTGGCATGGTCCCTTATGCTGGAATTGATCTTACTGTTTATGAAACACTGAAAGAAATGTCCAGGACATATGCCCTCGTGGACAAAGATCCTGGCCCTTTAGTACAGCTGGGCTGCGGAACAGTCTCTGGAGCGCTAGGAGCGACATGCGTTTATCCTTTACAAGTCATCAGAACAAGAATGCAAGCTCAGCCAGCCAATTCAGAGGATCCATATAGGGGGATGACCGATTGTTTCCGGATAACTCTGCGTCGTGAAGGAGTTTCTGGATTTTACAAAGGCCTTGTACCAAATCTTCTTAAAGTGGTGCCAGCTGCAAGCATTACCTATCTTGTTTATGAGACAATGAAGAAAAGTCTCTCCCTAGATTAAGTGACTTTGTAGATTCTGGATATCAGCGACTGACTCTATAGATAGTGTCGAGGCATGATCTTCCTTGATGAGTAGGTTCTAACTTAATGGGCCTGAGGTGTAAGATAGTAGTATTTTTGGCCTCAGGATACAGATGATGCAGGGCATTTTCATTATTATTGGTAGAAATAAAACGCGATACCTGTCAG

SEQ ID NO: 1077 - DNA, 1865 bp, Zea mays
  misc_feature (1)..(1865): Ceres cDNA ID no. 12406164
  misc_feature (1)..(1865): Ceres CLONE  ID no. 265151
  misc_feature (1)..(1865): Also known as  Ceres CDNA ID no. 23757843
  misc_feature (1422)..(1422): n is a, c, t, g, unknown, or other
  misc_feature (1432)..(1432): n is a, c, t, g, unknown, or other
gaaaaatcggtttctcggaagcctgtcaaacacggactggcttagtcaaagccggctttcagacatataatcgcgctcgccgtcgtgcgcacggcagtcggcaggcagtaccggagcagccgtgccaggccccatggacagctcgagcggcatgtgggccgtgctcggccaggcctcgaacgtggcgcagctggtcggcgtggacgcgctcgggctggtgtccatggtcgtgcaggccgcgctggcggcgcgccgccaccgcgacgcgtgccgccggctggcgcagcacgtggaggtcgtcggcggcctgctgcgggagctggagctcgccgagctgatgcggcgggaggccacgcggcggccgctcgaccagctccgggccgcgctgcggcggtgctacgcgctcgtcacggcgtgccaggactgcgggtacctccgcagcctgctcctcggcgcccggatggccgacgagctccgcgcggcggagaaggaggtcgacttgttcatccgcttagtcccacttatcgccctcgtcgacagcacgcatggtcgcagtggcaagactgccgagggagtaccaggtctactcacgaacggttcaaaccatcatgtcaggttttcaagaagtgtttccgcctccatcaaaatacacattcaacgaactactcaaatctgcagtattgcagaacagccattagcaggagcactggacttgggagaacataaaaatctggactttgaagaattgttggagctttgcatccgtactcaagagagttgctcaggattcagaaggtttttgaattatttcagatcattgacgctacaggcaatttcccggaaagtagaatcatcgggtcgggtggttttgctatagtttacaagggtcagttacctgatggatccatggtcgccatcaaaaggatggatgaaggtgccacaatgtttgatttcagcagtgaatttctggctgcgaggcttcagcataccaatctaattagacttttggggtggtgtatccatgggaaagaaaggattctagtgtatgagttcatgcacaagggtaccctgcacagtttaatctttgacaaaagaatggggttgttgctagactggtctaaacgaatcgatataatcagaggggtagctgaaggacttctttaccttcacaaacagtccaagttatggattgttcatagggatttgaagcccaggaacgtcctattagatcatgacatgaagccaaagcttgctgattttggatcggctagaactctgacttcggattccgctgaagagtgtacaagcagggttgtggggactagtggctacaaagctcctgagtacacgtctcgaggtgtctattcactgaagacagatgtgttcagcttcggggtggtggttctagtgaccatcagcggncgagagaacnccatactggagaagcaaggagactctgttggcacccttgtacgagatgcctggcagctatggaacgatggaaggctgcatgagcttgtagatccagtgctgggtgacggattcgaacttgctgaggtggcgcaggaggagccagcagatcgtcccaccatgtccgacgtcgtgtcgctcctgaactttgaaagcataggtctgctgccagatcctaagcagccgtctgagctttgtaagggaggtggtggtacttctggtgacaggttgccgacatgtggtagccagtcgagcaggaccatagacatcacaatcacaagttcagctcctgtgtcaactagaactagggtccgcatcattgtggacccagagacctaaaatgtagacataaaccgatgttaatatgtaaaagaacatggagaacttttaaggcc

SEQ ID NO: 1078 - protein, 1865 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 52076708; NR Description: receptor protein
  misc_feature: GI Number: 52076711; NR Description: receptor protein
  misc_feature: GI Number: 53793308; NR Description: receptor protein kinase-like [Oryza sativa (japonica cultivar-group)] >gi|53792828|dbj|BAD53861.1| receptor protein kinase-like [Oryza
  misc_feature: GI Number: 51964828; NR Description: PREDICTED OJ1790_D02.36
  misc_feature: GI Number: 50944507; NR Description: receptor-like kinase CHRK1-like [Oryza sativa (japonica cultivar-group)] >gi|38423996|dbj|BAD01724.1| receptor-like kinase CHRK1-like [Oryza sativa (japonica cultivar-group)]
GAAAAATCGGTTTCTCGGAAGCCTGTCAAACACGGACTGGCTTAGTCAAAGCCGGCTTTCAGACATATAATCGCGCTCGCCGTCGTGCGCACGGCAGTCGGCAGGCAGTACCGGAGCAGCCGTGCCAGGCCCCATGGACAGCTCGAGCGGCATGTGGGCCGTGCTCGGCCAGGCCTCGAACGTGGCGCAGCTGGTCGGCGTGGACGCGCTCGGGCTGGTGTCCATGGTCGTGCAGGCCGCGCTGGCGGCGCGCCGCCACCGCGACGCGTGCCGCCGGCTGGCGCAGCACGTGGAGGTCGTCGGCGGCCTGCTGCGGGAGCTGGAGCTCGCCGAGCTGATGCGGCGGGAGGCCACGCGGCGGCCGCTCGACCAGCTCCGGGCCGCGCTGCGGCGGTGCTACGCGCTCGTCACGGCGTGCCAGGACTGCGGGTACCTCCGCAGCCTGCTCCTCGGCGCCCGGATGGCCGACGAGCTCCGCGCGGCGGAGAAGGAGGTCGACTTGTTCATCCGCTTAGTCCCACTTATCGCCCTCGTCGACAGCACGCATGGTCGCAGTGGCAAGACTGCCGAGGGAGTACCAGGTCTACTCACGAACGGTTCAAACCATCATGTCAGGTTTTCAAGAAGTGTTTCCGCCTCCATCAAAATACACATTCAACGAACTACTCAAATCTGCAGTATTGCAGAACAGCCATTAGCAGGAGCACTGGACTTGGGAGAACATAAAAATCTGGACTTTGAAGAATTGTTGGAGCTTTGCATCCGTACTCAAGAGAGTTGCTCAGGATTCAGAAGGTTTTTGAATTATTTCAGATCATTGACGCTACAGGCAATTTCCCGGAAAGTAGAATCATCGGGTCGGGTGGTTTTGCTATAGTTTACAAGGGTCAGTTACCTGATGGATCCATGGTCGCCATCAAAAGGATGGATGAAGGTGCCACAATGTTTGATTTCAGCAGTGAATTTCTGGCTGCGAGGCTTCAGCATACCAATCTAATTAGACTTTTGGGGTGGTGTATCCATGGGAAAGAAAGGATTCTAGTGTATGAGTTCATGCACAAGGGTACCCTGCACAGTTTAATCTTTGACAAAAGAATGGGGTTGTTGCTAGACTGGTCTAAACGAATCGATATAATCAGAGGGGTAGCTGAAGGACTTCTTTACCTTCACAAACAGTCCAAGTTATGGATTGTTCATAGGGATTTGAAGCCCAGGAACGTCCTATTAGATCATGACATGAAGCCAAAGCTTGCTGATTTTGGATCGGCTAGAACTCTGACTTCGGATTCCGCTGAAGAGTGTACAAGCAGGGTTGTGGGGACTAGTGGCTACAAAGCTCCTGAGTACACGTCTCGAGGTGTCTATTCACTGAAGACAGATGTGTTCAGCTTCGGGGTGGTGGTTCTAGTGACCATCAGCGGNCGAGAGAACNCCATACTGGAGAAGCAAGGAGACTCTGTTGGCACCCTTGTACGAGATGCCTGGCAGCTATGGAACGATGGAAGGCTGCATGAGCTTGTAGATCCAGTGCTGGGTGACGGATTCGAACTTGCTGAGGTGGCGCAGGAGGAGCCAGCAGATCGTCCCACCATGTCCGACGTCGTGTCGCTCCTGAACTTTGAAAGCATAGGTCTGCTGCCAGATCCTAAGCAGCCGTCTGAGCTTTGTAAGGGAGGTGGTGGTACTTCTGGTGACAGGTTGCCGACATGTGGTAGCCAGTCGAGCAGGACCATAGACATCACAATCACAAGTTCAGCTCCTGTGTCAACTAGAACTAGGGTCCGCATCATTGTGGACCCAGAGACCTAAAATGTAGACATAAACCGATGTTAATATGTAAAAGAACATGGAGAACTTTTAAGGCC

SEQ ID NO: 1079 - DNA, 1291 bp, Zea mays
  misc_feature (1)..(1291): Ceres cDNA ID no. 12406180
  misc_feature (1)..(1291): Ceres CLONE  ID no. 263328
  misc_feature (1)..(1291): Also known as  Ceres CDNA ID no. 23836959
  misc_feature (61)..(61): n is a, c, t, g, unknown, or other
atataaataaagtactcaagcaatcctcgagcctcaggcccaagcaaagcatccagcggancacaccacaccacccttggtccggcactagcactagctatccagtggagacgaagatggcgacggcgcggtggctgcaggttgccgccatggcggtggcgctgctggcggagtgggcgacggcggcggcgcctcggaagcccgtggacgtgccgttccagaagaactacgtgccgacgtgggcgcaggaccacatccactacatcgacggcgggcgggaggtgcagctgtacctggacaagtccaccggcacgggcttccagacgcggggctcctacctcttcggccacttcagcatgcacatgaagctcgtcggcggcgactccgcgggcaccgtcacggccttctacctgtcgtcgcagaactcgggagcacgacgagatcgacttcgagttcctgggcaaccggacggggcagccctacatcctgcagaccaacgtgttcaccggcggcaagggcgaccgcgagcagcggatctacctctggttcgaccccaccaaggagtaccactcctactccgtcctctggaacctctacatgatcgcgttcttcgtggacgacgtgccgatccgggtgttcaagaacacgagcgccgacctgggcgtgcggtacccgttcagccagccgatgaagctctactccagcctgtggaacgccgacgactgggcgacccgcggcgggcgcgagaagacggactggtccaacgcgcccttcgtcgcctcctaccgcggcttccacgtcgacggctgcgaggcctccgcggaggcgcgcttctgcgccacccagggcgcgcgctggtgggaccagccggagttcagggacctcgacgccgcgcagtaccgccgcctggccgaggtcaggcgccgctacaccatctacaactactgcaccgatcgcgaccgctacggcgccgccgtgccgcccgagtgcgcccgcgaccgcgacgtctgatgatgatgcgttgggccggcaagctgcttgatcgagagcagcctgtaatgtatgtatggtatggtattgttgtgtgtcaggttcgtcgtcgtgggtctgcagagacagagagagtccgatccggcgcgtacgtgtgcccgcgtgggcacatgcatacgtacatgcttgtgttgtactgtacgctcgtatctcctcacaccgaaatgaattgcgattaagtatcgaaatttcggcagcttatccatcatgtaatgagttcctctgcagtacttaaaactct

SEQ ID NO: 1080 - protein, 1291 aa, Zea mays
  misc_feature: PFam Name: Glyco_hydro_16; PFam Description: Glycosyl
  misc_feature: PFam Name: XET_C; PFam Description: Xyloglucan
  misc_feature: PFam Name: MAGE; PFam Description: MAGE family
  misc_feature: PFam Name: Mucin; PFam Description: Mucin-like glycoprotein
  misc_feature: PFam Name: Cupin_1; PFam Description: Cupin
  misc_feature: GI Number: 1885310; NR Description: Endoxyloglucan
  misc_feature: GI Number: 950299; NR Description: xyloglucan
  misc_feature: GI Number: 47169268; NR Description: Chain B, Xyloglucan Endotransglycosylase Native Structure. >gi|47169267|pdb|1UN1|A Chain A, Xyloglucan Endotransglycosylase Native Structure. >gi|47169266|pdb|1UMZ|B Chain B, Xyloglucan Xllg.
  misc_feature: GI Number: 27228078; NR Description: xyloglucan endotransglycosylase precursor [Populus tremula x Populus
  misc_feature: GI Number: 38605538; NR Description: Probable xyloglucan endotransglucosylase/hydrolase precursor >gi|469508|dbj|BAA03922.1|
ATATAAATAAAGTACTCAAGCAATCCTCGAGCCTCAGGCCCAAGCAAAGCATCCAGCGGANCACACCACACCACCCTTGGTCCGGCACTAGCACTAGCTATCCAGTGGAGACGAAGATGGCGACGGCGCGGTGGCTGCAGGTTGCCGCCATGGCGGTGGCGCTGCTGGCGGAGTGGGCGACGGCGGCGGCGCCTCGGAAGCCCGTGGACGTGCCGTTCCAGAAGAACTACGTGCCGACGTGGGCGCAGGACCACATCCACTACATCGACGGCGGGCGGGAGGTGCAGCTGTACCTGGACAAGTCCACCGGCACGGGCTTCCAGACGCGGGGCTCCTACCTCTTCGGCCACTTCAGCATGCACATGAAGCTCGTCGGCGGCGACTCCGCGGGCACCGTCACGGCCTTCTACCTGTCGTCGCAGAACTCGGGAGCACGACGAGATCGACTTCGAGTTCCTGGGCAACCGGACGGGGCAGCCCTACATCCTGCAGACCAACGTGTTCACCGGCGGCAAGGGCGACCGCGAGCAGCGGATCTACCTCTGGTTCGACCCCACCAAGGAGTACCACTCCTACTCCGTCCTCTGGAACCTCTACATGATCGCGTTCTTCGTGGACGACGTGCCGATCCGGGTGTTCAAGAACACGAGCGCCGACCTGGGCGTGCGGTACCCGTTCAGCCAGCCGATGAAGCTCTACTCCAGCCTGTGGAACGCCGACGACTGGGCGACCCGCGGCGGGCGCGAGAAGACGGACTGGTCCAACGCGCCCTTCGTCGCCTCCTACCGCGGCTTCCACGTCGACGGCTGCGAGGCCTCCGCGGAGGCGCGCTTCTGCGCCACCCAGGGCGCGCGCTGGTGGGACCAGCCGGAGTTCAGGGACCTCGACGCCGCGCAGTACCGCCGCCTGGCCGAGGTCAGGCGCCGCTACACCATCTACAACTACTGCACCGATCGCGACCGCTACGGCGCCGCCGTGCCGCCCGAGTGCGCCCGCGACCGCGACGTCTGATGATGATGCGTTGGGCCGGCAAGCTGCTTGATCGAGAGCAGCCTGTAATGTATGTATGGTATGGTATTGTTGTGTGTCAGGTTCGTCGTCGTGGGTCTGCAGAGACAGAGAGAGTCCGATCCGGCGCGTACGTGTGCCCGCGTGGGCACATGCATACGTACATGCTTGTGTTGTACTGTACGCTCGTATCTCCTCACACCGAAATGAATTGCGATTAAGTATCGAAATTTCGGCAGCTTATCCATCATGTAATGAGTTCCTCTGCAGTACTTAAAACTCT

SEQ ID NO: 1081 - DNA, 1238 bp, Zea mays
  misc_feature (1)..(1238): Ceres cDNA ID no. 12406405
  misc_feature (1)..(1238): Ceres CLONE  ID no. 218909
  misc_feature (1)..(1238): Also known as  Ceres CDNA ID no. 23776398
gcacgagaccattacctagaacatcctaatcgaaaaatcatcatcgactccacctggaactcgctcactggcaatggctaccaataccaagctcgtggcccttggcttggccgtcctcgtgagcgttgggttctccgatgcagcgagggtagttaggcttgggagctatgcgtctgccggaggaggcggcggcggtggaggcggcggctccggatcgaccggggctgctgggtacggcggtgggtctggcggtggcggtggctacggcataggcaagggtggcggggactggtggaacaatttcgtctccagcgtagcgggcggtggtggtgggggacagggcggagggggtggcaccaacggtggatccgggtccggcggtgggtcgggctatggttctggcaccagttccaccgcagcctctggccccagcagtggcaactacgccaacgctgagggcaagggcgccggtgggggcatgggcggcggtgccgatggcgcctacggttctggtgccggtggaggcgttggcaagggccagggcgagagtggcgtcgcattggcaccgtcgtccgatggctactacaatggcggcgccgctgatgctaccggtggtggttccggcgctggcggtggacatggcggtggcgccggagctccaagctacgggactggaggtggccttggcggaggcaagggcgaggccggcagcgacggtcctggggttcaggttacgcggcgggaatcggtgctggcactggcggcggcggtggcggcggattccaaggcgcctctggtggtggcggtggctctgggtccggatccggcagcggtggaatccactgagtttccctgcggcatgcagctggacggagcgctcggcgtgtagtgtcagtccattttggagtcggttcgtgtacctgagttttccttgaggagatgctgggtttcgcattctttgttgcaagaattattagtcaggaataatgggcttcgttcgtgattgtagttcgagtaggtaggtagtccagcatgcaactgacatgtaatggctacaggctactacgagtatatgcttgcatcgccatcttttgatgtgccccttgttgttactctcatcgatctttagaggtcgttgctaccggtttttatcttccaaaacacaaaatatactgggacgactcttgcagtctcttgctactgttgaatgtgactattgactagctatagtagtattt

SEQ ID NO: 1082 - protein, 1238 aa, Zea mays
  misc_feature: PFam Name: S-antigen; PFam Description: S-antigen protein
  misc_feature: PFam Name: Dehydrin; PFam Description: Dehydrin
  misc_feature: PFam Name: GRP; PFam Description: Glycine rich protein family
  misc_feature: PFam Name: Secretin_N; PFam Description: Bacterial type
  misc_feature: PFam Name: Harpin; PFam Description: Harpin protein (HrpN)
  misc_feature: GI Number: 1532071; NR Description: glycine-rich protein [Zea
  misc_feature: GI Number: 51090508; NR Description: putative glycine rich
  misc_feature: GI Number: 16293; NR Description: glycine rich protein [Arabidopsis thaliana] >gi|72320|pir||KNMU glycine-rich cell wall
  misc_feature: GI Number: 7636182; NR Description: glycine-rich protein
  misc_feature: GI Number: 34898126; NR Description: putative glycine-rich cell wall protein precursor [Oryza sativa (japonica cultivar-group)] >gi|24059890|dbj|BAC21356.1| putative glycine-rich cell wall protein precursor [Oryza sativa (japonica
GCACGAGACCATTACCTAGAACATCCTAATCGAAAAATCATCATCGACTCCACCTGGAACTCGCTCACTGGCAATGGCTACCAATACCAAGCTCGTGGCCCTTGGCTTGGCCGTCCTCGTGAGCGTTGGGTTCTCCGATGCAGCGAGGGTAGTTAGGCTTGGGAGCTATGCGTCTGCCGGAGGAGGCGGCGGCGGTGGAGGCGGCGGCTCCGGATCGACCGGGGCTGCTGGGTACGGCGGTGGGTCTGGCGGTGGCGGTGGCTACGGCATAGGCAAGGGTGGCGGGGACTGGTGGAACAATTTCGTCTCCAGCGTAGCGGGCGGTGGTGGTGGGGGACAGGGCGGAGGGGGTGGCACCAACGGTGGATCCGGGTCCGGCGGTGGGTCGGGCTATGGTTCTGGCACCAGTTCCACCGCAGCCTCTGGCCCCAGCAGTGGCAACTACGCCAACGCTGAGGGCAAGGGCGCCGGTGGGGGCATGGGCGGCGGTGCCGATGGCGCCTACGGTTCTGGTGCCGGTGGAGGCGTTGGCAAGGGCCAGGGCGAGAGTGGCGTCGCATTGGCACCGTCGTCCGATGGCTACTACAATGGCGGCGCCGCTGATGCTACCGGTGGTGGTTCCGGCGCTGGCGGTGGACATGGCGGTGGCGCCGGAGCTCCAAGCTACGGGACTGGAGGTGGCCTTGGCGGAGGCAAGGGCGAGGCCGGCAGCGACGGTCCTGGGGTTCAGGTTACGCGGCGGGAATCGGTGCTGGCACTGGCGGCGGCGGTGGCGGCGGATTCCAAGGCGCCTCTGGTGGTGGCGGTGGCTCTGGGTCCGGATCCGGCAGCGGTGGAATCCACTGAGTTTCCCTGCGGCATGCAGCTGGACGGAGCGCTCGGCGTGTAGTGTCAGTCCATTTTGGAGTCGGTTCGTGTACCTGAGTTTTCCTTGAGGAGATGCTGGGTTTCGCATTCTTTGTTGCAAGAATTATTAGTCAGGAATAATGGGCTTCGTTCGTGATTGTAGTTCGAGTAGGTAGGTAGTCCAGCATGCAACTGACATGTAATGGCTACAGGCTACTACGAGTATATGCTTGCATCGCCATCTTTTGATGTGCCCCTTGTTGTTACTCTCATCGATCTTTAGAGGTCGTTGCTACCGGTTTTTATCTTCCAAAACACAAAATATACTGGGACGACTCTTGCAGTCTCTTGCTACTGTTGAATGTGACTATTGACTAGCTATAGTAGTATTT

SEQ ID NO: 1083 - DNA, 1442 bp, Zea mays
  misc_feature (1)..(1442): Ceres cDNA ID no. 12406568
  misc_feature (1)..(1442): Ceres CLONE  ID no. 334666
  misc_feature (1)..(1442): Also known as  Ceres CDNA ID no. 23767469
atgcgagactggaggcggaaccgcgcacgacaccaagctgccgcgccggactgctgcacgcaagcgcagcgcaggaccgaccgacctccgtaggcacgcacggcgccggcggcatggcggagcacctcctgtcgacggccgtgcacgacacgctgccggggagctacgtgcggccggagccggagcgcccgcgcctcgcggaggtcgtgaccggcgcgcgcatccccgtcgtggacctgggcagccccgaccgcggcgcggtcgtggccgccgtcggcgacgcctgccgctcgcacggcttcttccaggtcgtcaaccacgggatacacgccgccctggtcgcggcggtgatggccgcggggcgcggcttcttccggctgccccccgaggagaaggccaagctctactccgacgaccccgccaggaagatccggctgtccaccagcttcaacgtgcgcaaggagacggtgcacaactggcgcgactacctccgcctgcactgccatcccctcgacgagttcctgcccgattggccgtccaacccgcccgatttcaaggagaccatgggcacctactgcaaggaggtccgggagctcgggttcaggctgtacgccgcgatctcggagagcctgggcctagaggcgagctacatgaaggaagcgctgggggagcaggagcagcacatggcggtcaacttctacccgccgtgcccggagccggagctcacctacggcctcccggcgcacaccgaccccaacgcgctcaccatcctgctcatggacccggacgtcgccggcctgcaggtgctccacgccggccagtgggtcgccgtcaacccgcagcccggcgcgctcatcatcaacatcggcgaccagctgcaggcgctgagcaacgggcagtaccggagcgtgtggcaccgcgcggtggtgaactcggaccgggagcgcatgtccgtggcgtcgttcctgtgcccgtgcaaccacgtcgtgctcggccccgcgcggaagctcgtcaccgaggacaccccggccgtgtacaggaactacacgtacgacaagtactacgccaagttctggagcaggaacctggaccaggagcactgcctcgagctcttcagaacctagcgaatcggatacggatggatggatacattacatacgcgccctctgtttttctccatgacgttagaagaacacgttctgcaatgtttgtccattcaaggtggtatcaatcaaggctgtggtcgttgcaattcttccgctccatatacatgattaaatgctttgaaagaaaaagaaaaaaagaaacacaagtattatggcactactagtgtttttaggaacaaggaaagaggggttgcccctgctggctatatatattaaatataaataaaggtaaggctgtagacattggtgaataagagaaagtatttgagtttctct

SEQ ID NO: 1084 - protein, 1442 aa, Zea mays
  misc_feature: PFam Name: 2OG-FeII_Oxy; PFam Description: 2OG-Fe(II)
  misc_feature: GI Number: 21553527; NR Description: flavanone
  misc_feature: GI Number: 28827438; NR Description: putative flavanone 3-beta-hydroxylase [Arabidopsis thaliana] >gi|4539409|emb|CAB40042.1| putative flavanone 3-beta-hydroxylase [Arabidopsis thaliana] >gi|7267746|emb|CAB78172.1| putative
  misc_feature: GI Number: 34365697; NR Description: At4g10500 [Arabidopsis thaliana] >gi|4539410|emb|CAB40043.1| putative Fe(II)/ascorbate oxidase [Arabidopsis thaliana] >gi|7267747|emb|CAB78173.1| putative Fe(II)/ascorbate oxidase [Arabidopsis thaliana]
  misc_feature: GI Number: 50916346; NR Description: Putative flavanone 3-hydroxylase [Oryza sativa (japonica cultivar-group)] >gi|25446682|gb|AAN74829.1| Putative flavanone 3-hydroxylase [Oryza
  misc_feature: GI Number: 50932077; NR Description: putative leucoanthocyanidin dioxygenase (EC 1.14.11.-) [Oryza sativa (japonica cultivar-group)] >gi|46391159|gb|AAS90686.1| putative leucoanthocyanidin dioxygenase (EC 1.14.11.-) [Oryza sativa
ATGCGAGACTGGAGGCGGAACCGCGCACGACACCAAGCTGCCGCGCCGGACTGCTGCACGCAAGCGCAGCGCAGGACCGACCGACCTCCGTAGGCACGCACGGCGCCGGCGGCATGGCGGAGCACCTCCTGTCGACGGCCGTGCACGACACGCTGCCGGGGAGCTACGTGCGGCCGGAGCCGGAGCGCCCGCGCCTCGCGGAGGTCGTGACCGGCGCGCGCATCCCCGTCGTGGACCTGGGCAGCCCCGACCGCGGCGCGGTCGTGGCCGCCGTCGGCGACGCCTGCCGCTCGCACGGCTTCTTCCAGGTCGTCAACCACGGGATACACGCCGCCCTGGTCGCGGCGGTGATGGCCGCGGGGCGCGGCTTCTTCCGGCTGCCCCCCGAGGAGAAGGCCAAGCTCTACTCCGACGACCCCGCCAGGAAGATCCGGCTGTCCACCAGCTTCAACGTGCGCAAGGAGACGGTGCACAACTGGCGCGACTACCTCCGCCTGCACTGCCATCCCCTCGACGAGTTCCTGCCCGATTGGCCGTCCAACCCGCCCGATTTCAAGGAGACCATGGGCACCTACTGCAAGGAGGTCCGGGAGCTCGGGTTCAGGCTGTACGCCGCGATCTCGGAGAGCCTGGGCCTAGAGGCGAGCTACATGAAGGAAGCGCTGGGGGAGCAGGAGCAGCACATGGCGGTCAACTTCTACCCGCCGTGCCCGGAGCCGGAGCTCACCTACGGCCTCCCGGCGCACACCGACCCCAACGCGCTCACCATCCTGCTCATGGACCCGGACGTCGCCGGCCTGCAGGTGCTCCACGCCGGCCAGTGGGTCGCCGTCAACCCGCAGCCCGGCGCGCTCATCATCAACATCGGCGACCAGCTGCAGGCGCTGAGCAACGGGCAGTACCGGAGCGTGTGGCACCGCGCGGTGGTGAACTCGGACCGGGAGCGCATGTCCGTGGCGTCGTTCCTGTGCCCGTGCAACCACGTCGTGCTCGGCCCCGCGCGGAAGCTCGTCACCGAGGACACCCCGGCCGTGTACAGGAACTACACGTACGACAAGTACTACGCCAAGTTCTGGAGCAGGAACCTGGACCAGGAGCACTGCCTCGAGCTCTTCAGAACCTAGCGAATCGGATACGGATGGATGGATACATTACATACGCGCCCTCTGTTTTTCTCCATGACGTTAGAAGAACACGTTCTGCAATGTTTGTCCATTCAAGGTGGTATCAATCAAGGCTGTGGTCGTTGCAATTCTTCCGCTCCATATACATGATTAAATGCTTTGAAAGAAAAAGAAAAAAAGAAACACAAGTATTATGGCACTACTAGTGTTTTTAGGAACAAGGAAAGAGGGGTTGCCCCTGCTGGCTATATATATTAAATATAAATAAAGGTAAGGCTGTAGACATTGGTGAATAAGAGAAAGTATTTGAGTTTCTCT

SEQ ID NO: 1085 - DNA, 1712 bp, Zea mays
  misc_feature (1)..(1712): Ceres cDNA ID no. 12406612
  misc_feature (1)..(1712): Ceres CLONE  ID no. 297868
  misc_feature (1)..(1712): Also known as  Ceres CDNA ID no. 23761258
cctagaacatcctaatcgaaaaactcagcacacacatcagatcgccacatctccgacaccaacccacctccctcctccccctctcgccgtcggccccgcccgtcagcctcggccgagtgcgtctgcctcgcactcccgcggcccctatagacagagcagccgctctagagcgggaggaaaggcgagcagaggagacagagatggggaagggaggaggagaagaggacggcgcggcggcggccgcgcgcgcggcggagcaggcgcgggagctgcaggacgcggcggctgcgctgctgacgcagacgcgggcggaggaggaggcgctgcgccgccgcgccgccgcgctgcagggggagctgcggcggctacgcgaggccgccgcggcgcacgcggacagcgacaaggttgaggaggacttggatcgagcagcgtgcctcatcgctgaaggtgacgttgcgtcgctgctcccgagcaagacgcaaggcgcttttctgaaaatgttcttgggaccagtaaatttgcgggcaacaaggaaggaggtgcagctcaaggtgaaggaggagtacaatagctacagggacagaactgccttgctgtttctttgttttccggtgattttgttgtttcttcgacaatggttatggaatggatgttttccagtattgccagttcagctataccaggcttggttattattcctgtataccagtttagctttgcgtgagaacatactgcgagttaatggaagtgatattcgtccttggtggatacttcatcactactgtgccatgctgatgtctcttgtaagtctcacatgggagataaaggggcaacctaattgtgcacgcaagcagagaggcgtggaacttttcctttgctgggccataatgcaaggatttgtcatgatgctgcagaatagatatcagcgtcaaagattatatactaggattgctttggggaaggctaaaagaatggatgttgtatggggagagactgctggtgttgaaggtcaattgttgctgttgtgccctctccttttcctcctgcagggattcgagggttatgttgggtttttacttctgcgcacagctcatactggcgttgtccctgagtggcaggttgtggtatgcgggatcctgctgatcgcgatggcaatcggtaactttgcaaacacagtggacaccctggtaaccaagtcccggttcaaggcgaagatgaagaaatccaagggcagacgggacctcgacacatgcccctcgccaacaggttcatcatcgccgatagattcagcgaccaccaaagcatgaacaaggccaagaggaaaaggtgcccgtgtttaacccgggtgtgttaccactgtaaagcattttagtgtttttttttcttggccgtcagctcgtaatcctgtccgtcgtctgtgtcgaagctcatactcgtgtaatcaatcatcaggcaagtaggctgctgatggttctaggctggaggtggccgagaataaacttgtggtgtttgtttatatacctgtaccctgaatgaacatcgagtgggctagggtggtgggcttaggactatgtaaggcttagcaaaattttccaagtatagttgtgagacaggcaggcatttgtcacaatgaatgaaacatgcgaagttgtatacacgttgtggcaatgtgttgctttgtatgttggttggtgcatgcttacgttgctctg

SEQ ID NO: 1086 - protein, 1712 aa, Zea mays
  misc_feature: PFam Name: TMPIT; PFam Description: TMPIT-like protein
  misc_feature: PFam Name: SET; PFam Description: SET domain
  misc_feature: GI Number: 30354641; NR Description: Transmembrane protein
  misc_feature: GI Number: 58047702; NR Description: Unknown (protein for
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 52354734; NR Description: Unknown (protein for
  misc_feature: GI Number: 50417977; NR Description: MGC80291 protein
CCTAGAACATCCTAATCGAAAAACTCAGCACACACATCAGATCGCCACATCTCCGACACCAACCCACCTCCCTCCTCCCCCTCTCGCCGTCGGCCCCGCCCGTCAGCCTCGGCCGAGTGCGTCTGCCTCGCACTCCCGCGGCCCCTATAGACAGAGCAGCCGCTCTAGAGCGGGAGGAAAGGCGAGCAGAGGAGACAGAGATGGGGAAGGGAGGAGGAGAAGAGGACGGCGCGGCGGCGGCCGCGCGCGCGGCGGAGCAGGCGCGGGAGCTGCAGGACGCGGCGGCTGCGCTGCTGACGCAGACGCGGGCGGAGGAGGAGGCGCTGCGCCGCCGCGCCGCCGCGCTGCAGGGGGAGCTGCGGCGGCTACGCGAGGCCGCCGCGGCGCACGCGGACAGCGACAAGGTTGAGGAGGACTTGGATCGAGCAGCGTGCCTCATCGCTGAAGGTGACGTTGCGTCGCTGCTCCCGAGCAAGACGCAAGGCGCTTTTCTGAAAATGTTCTTGGGACCAGTAAATTTGCGGGCAACAAGGAAGGAGGTGCAGCTCAAGGTGAAGGAGGAGTACAATAGCTACAGGGACAGAACTGCCTTGCTGTTTCTTTGTTTTCCGGTGATTTTGTTGTTTCTTCGACAATGGTTATGGAATGGATGTTTTCCAGTATTGCCAGTTCAGCTATACCAGGCTTGGTTATTATTCCTGTATACCAGTTTAGCTTTGCGTGAGAACATACTGCGAGTTAATGGAAGTGATATTCGTCCTTGGTGGATACTTCATCACTACTGTGCCATGCTGATGTCTCTTGTAAGTCTCACATGGGAGATAAAGGGGCAACCTAATTGTGCACGCAAGCAGAGAGGCGTGGAACTTTTCCTTTGCTGGGCCATAATGCAAGGATTTGTCATGATGCTGCAGAATAGATATCAGCGTCAAAGATTATATACTAGGATTGCTTTGGGGAAGGCTAAAAGAATGGATGTTGTATGGGGAGAGACTGCTGGTGTTGAAGGTCAATTGTTGCTGTTGTGCCCTCTCCTTTTCCTCCTGCAGGGATTCGAGGGTTATGTTGGGTTTTTACTTCTGCGCACAGCTCATACTGGCGTTGTCCCTGAGTGGCAGGTTGTGGTATGCGGGATCCTGCTGATCGCGATGGCAATCGGTAACTTTGCAAACACAGTGGACACCCTGGTAACCAAGTCCCGGTTCAAGGCGAAGATGAAGAAATCCAAGGGCAGACGGGACCTCGACACATGCCCCTCGCCAACAGGTTCATCATCGCCGATAGATTCAGCGACCACCAAAGCATGAACAAGGCCAAGAGGAAAAGGTGCCCGTGTTTAACCCGGGTGTGTTACCACTGTAAAGCATTTTAGTGTTTTTTTTTCTTGGCCGTCAGCTCGTAATCCTGTCCGTCGTCTGTGTCGAAGCTCATACTCGTGTAATCAATCATCAGGCAAGTAGGCTGCTGATGGTTCTAGGCTGGAGGTGGCCGAGAATAAACTTGTGGTGTTTGTTTATATACCTGTACCCTGAATGAACATCGAGTGGGCTAGGGTGGTGGGCTTAGGACTATGTAAGGCTTAGCAAAATTTTCCAAGTATAGTTGTGAGACAGGCAGGCATTTGTCACAATGAATGAAACATGCGAAGTTGTATACACGTTGTGGCAATGTGTTGCTTTGTATGTTGGTTGGTGCATGCTTACGTTGCTCTG

SEQ ID NO: 1087 - DNA, 1633 bp, Zea mays
  misc_feature (1)..(1633): Ceres cDNA ID no. 12406661
  misc_feature (1)..(1633): Ceres CLONE  ID no. 284040
  misc_feature (1)..(1633): Also known as  Ceres CDNA ID no. 23754160
  misc_feature (123)..(123): n is a, c, t, g, unknown, or other
atcaccaaccctcctcctccttgcctaggtactcgcagcagcgtcggcaagcaaggttctcttctcgcgccgcccagatctgagcgctcccatggccatgccgtcctcccgctccccggcgcngccgccaacggcctcctcctcctactggtgctacatgtgcgaccgcttcgttcgcgccgccgcttcctcctcctcctcacccacttcgccgtcctcctcctcccccgcctgcccgtcctgcggcgggggcttcctcgaggagatgggcgcgccgccgccccgcgcccgccggccccgccgcgccgcccgccgcggcaccgactcccgcgcctcgcccttcaaccccgtcatcgttctccgccgctccccgcccgccgacgccgacgccgatggctcctcctctcccgccgccgccaccggcagcagcttacgagctgttctacgacgacggggcggggtcgggcctccgcccgctcccggagagcatgtcggacttcctcatgggctccggcttcgagcggctgctggagcagctggcccagatggaggccggcggcggtctggcggcgcgcgcccgcgacgcgccgccggcgtccaaggccgccgtggactccatgcccgcgctccgcgtcggcgccgcccacgtcgcggccgacgcgcactgcgccgtctgcaaggaggccttcgagctgggcgccgaggccagggagatgccctgcgcccacatctaccatgccgactgcatcctgccctggctcgcgctccgcaactcctgccccgtctgccgccacgagatgcccgccgacaacgccgccccgcgcgctgccgccgccgccgccgcggacgaggacgccagggtcggcctcaccatctggaggctccccggcggcgggttcgcggtcgggagattcgccggcgggccgaggcccgacgagagggagctccccgtggtgtacacggagatggaaagcgggttcaacttcaacagcggccacgcgcccaggcggatctcgtggggcgccaggcaggccgcggccacggacaggggcaccgtccgccgcttcctccgcagcgtcttcgcctgctttggacgcggccacgccccgtcggcggcggccgcgcgcgccatgcctgagctcaacgacgacgacgtggcgtctgaccacagcgccgccttcagccgtgggtccaggagccggagcaccagctggaggctcgaggacgggcgtgccgacgccatggtgcagagatgaccgccgtatactgtgtggaactgcttgtagtacagttacagtaacgctgccgaaaaagattgctgctttgtttcattcatgttgtatttaccgtactactgctagcctcctgcctactacttaggaagatttgaggttgtagaacagggcaaattggtgttagtacatattgtagtagtgaggaagggaaagagagcagcatctcgacctctctttgttagagagtttgcattgcagctgcaggtggggggtcaactgcgaactcaaacacttgttcttggcttggttggtggtaatattaggagcgaggtgatggatcaactgttcttttattatctttctttctgttcagttcattgtggcaggaaccatccttg

SEQ ID NO: 1088 - protein, 1633 aa, Zea mays
  misc_feature: PFam Name: Pyr_redox_2; PFam Description: Pyridine
  misc_feature: PFam Name: FH2; PFam Description: Formin Homology 2 Domain
  misc_feature: PFam Name: GATase_2; PFam Description: Glutamine
  misc_feature: PFam Name: LMBR1; PFam Description: LMBR1-like membrane protein
  misc_feature: PFam Name: Drf_FH1; PFam Description: Formin Homology Region 1
  misc_feature: GI Number: 50949043; NR Description: putative RING-H2 finger protein [Oryza sativa] >gi|14719329|gb|AAK73147.1| putative RING-H2
  misc_feature: GI Number: 52353630; NR Description: putative ring-H2 finger
  misc_feature: GI Number: 57899217; NR Description: RING-H2 finger
  misc_feature: GI Number: 17380612; NR Description: AT5g59550/f2o15_210 [Arabidopsis thaliana] >gi|15450687|gb|AAK96615.1| AT5g59550/f2o15_210 [Arabidopsis thaliana] >gi|18424254|ref|NP_568910.1| zinc finger (C3HC4-type RING
  misc_feature: GI Number: 34906008; NR Description: putative RING-H2 finger protein RHC2a [Oryza sativa (japonica cultivar-group)] >gi|15289983|dbj|BAB63678.1| putative RING-H2 finger protein RHC2a
ATCACCAACCCTCCTCCTCCTTGCCTAGGTACTCGCAGCAGCGTCGGCAAGCAAGGTTCTCTTCTCGCGCCGCCCAGATCTGAGCGCTCCCATGGCCATGCCGTCCTCCCGCTCCCCGGCGCNGCCGCCAACGGCCTCCTCCTCCTACTGGTGCTACATGTGCGACCGCTTCGTTCGCGCCGCCGCTTCCTCCTCCTCCTCACCCACTTCGCCGTCCTCCTCCTCCCCCGCCTGCCCGTCCTGCGGCGGGGGCTTCCTCGAGGAGATGGGCGCGCCGCCGCCCCGCGCCCGCCGGCCCCGCCGCGCCGCCCGCCGCGGCACCGACTCCCGCGCCTCGCCCTTCAACCCCGTCATCGTTCTCCGCCGCTCCCCGCCCGCCGACGCCGACGCCGATGGCTCCTCCTCTCCCGCCGCCGCCACCGGCAGCAGCTTACGAGCTGTTCTACGACGACGGGGCGGGGTCGGGCCTCCGCCCGCTCCCGGAGAGCATGTCGGACTTCCTCATGGGCTCCGGCTTCGAGCGGCTGCTGGAGCAGCTGGCCCAGATGGAGGCCGGCGGCGGTCTGGCGGCGCGCGCCCGCGACGCGCCGCCGGCGTCCAAGGCCGCCGTGGACTCCATGCCCGCGCTCCGCGTCGGCGCCGCCCACGTCGCGGCCGACGCGCACTGCGCCGTCTGCAAGGAGGCCTTCGAGCTGGGCGCCGAGGCCAGGGAGATGCCCTGCGCCCACATCTACCATGCCGACTGCATCCTGCCCTGGCTCGCGCTCCGCAACTCCTGCCCCGTCTGCCGCCACGAGATGCCCGCCGACAACGCCGCCCCGCGCGCTGCCGCCGCCGCCGCCGCGGACGAGGACGCCAGGGTCGGCCTCACCATCTGGAGGCTCCCCGGCGGCGGGTTCGCGGTCGGGAGATTCGCCGGCGGGCCGAGGCCCGACGAGAGGGAGCTCCCCGTGGTGTACACGGAGATGGAAAGCGGGTTCAACTTCAACAGCGGCCACGCGCCCAGGCGGATCTCGTGGGGCGCCAGGCAGGCCGCGGCCACGGACAGGGGCACCGTCCGCCGCTTCCTCCGCAGCGTCTTCGCCTGCTTTGGACGCGGCCACGCCCCGTCGGCGGCGGCCGCGCGCGCCATGCCTGAGCTCAACGACGACGACGTGGCGTCTGACCACAGCGCCGCCTTCAGCCGTGGGTCCAGGAGCCGGAGCACCAGCTGGAGGCTCGAGGACGGGCGTGCCGACGCCATGGTGCAGAGATGACCGCCGTATACTGTGTGGAACTGCTTGTAGTACAGTTACAGTAACGCTGCCGAAAAAGATTGCTGCTTTGTTTCATTCATGTTGTATTTACCGTACTACTGCTAGCCTCCTGCCTACTACTTAGGAAGATTTGAGGTTGTAGAACAGGGCAAATTGGTGTTAGTACATATTGTAGTAGTGAGGAAGGGAAAGAGAGCAGCATCTCGACCTCTCTTTGTTAGAGAGTTTGCATTGCAGCTGCAGGTGGGGGGTCAACTGCGAACTCAAACACTTGTTCTTGGCTTGGTTGGTGGTAATATTAGGAGCGAGGTGATGGATCAACTGTTCTTTTATTATCTTTCTTTCTGTTCAGTTCATTGTGGCAGGAACCATCCTTG

SEQ ID NO: 1089 - DNA, 1352 bp, Zea mays
  misc_feature (1)..(1352): Ceres cDNA ID no. 12406751
  misc_feature (1)..(1352): Ceres CLONE  ID no. 331422
  misc_feature (1)..(1352): Also known as  Ceres CDNA ID no. 23778522
gagcagagcagcagtgaccagtgagctgcttgtccaagaatcgctcccactcccggctgtcgggagagcgcagcccagctagccgcctccgcttcttggaggtcgatggccgcgaaggggttgagggaggtggggaggaggagggcggcggaggtcgggcggcgctgcttgtctggcgggagcgctgggccgccggcgccggcggcgaagcggaaggagggagggaaggcggtgaacctgttcacggccgtcaaccaggcgctccacatcgccctcgacaccgacccccgcgcctacgtcttcggagaggacgtcgggttcggcggcgtcttccgctgcacgacaggcctcgccgatcggttcggcaagagcagagtgttcaacacgccgctgtgtgagcagggtattgctggatttgccatcggcctagcagcgatgggcaatcgagctatcgcagaaatccagtttgcggactacatctttccagcctttgatcagattgtcaatgaagcagctaagttcagatatcggagtggaaatgaatttaactgtggaggcttaacgattcgaactccctatggtgctgttgggcatggtggtcattaccattcacagtcaccagaggctttcttctgtcacgttcctggactcaaggttgtcataccacggagtccgcgcgaggctaaggggttgctgttggccagcatccgagatccaaacccagttgtattttttgagccaaagtggctgtatcgtttggctgttgaagaagttcctgaggaggattacatgctgccgttatccgaggcagaagtgattagggaaggaagtgatataacgcttgttggatggggagctcagcttgcggtgctgaaagaagcctgtgaagatgctgcaaaggacggggtgtcttgcgagctcattgatctgaaaacactcgtaccatgggacaaggaaacggtagaggcctcggtgaagaagaccgggaagctcctcgttagccacgaggctccagtcaccgggggcttcggcgcggagatcgccgcgtccattgccgagcgctgcttccagaggttagaagcacccgtggcgagagtctgcggtctcgacacccctttccctctcgtgtacgagccattttacatgcccaccaagaacaaggtcctggatgcgataaaagccaccatagatttctgaaacatgttgcttgatcgatacagagtactctagttacatgtgcacggtttgtgctggtctgggtctgtagcctgcctgaggatgagcgatccacaaaccggcttatttgtattcaacaatacagcgataaataaagccgcaaggtgcaaaattgt

SEQ ID NO: 1090 - protein, 1352 aa, Zea mays
  misc_feature: PFam Name: Transket_pyr; PFam Description: Transketolase,
  misc_feature: PFam Name: Transketolase_C; PFam Description: Transketolase,
  misc_feature: GI Number: 9280297; NR Description: branched chain alpha-keto acid dehydrogenase E1 beta subunit [Arabidopsis thaliana] >gi|7021286|gb|AAF35281.1| branched chain alpha-keto acid dehydrogenase E1 beta subunit [Arabidopsis thaliana]
  misc_feature: GI Number: 3746568; NR Description: branched-chain alpha-keto acid decarboxylase E1 beta subunit [Arabidopsis thaliana] >gi|11252215|pir||T51835 3-methyl-2-oxobutanoate dehydrogenase (lipoamide) (EC 1.2.4.4) beta chain [imported] - Arabidopsis
  misc_feature: GI Number: 4204270; NR Description: branched-chain alpha-keto acid decarboxylase E1 beta subunit [Arabidopsis thaliana] >gi|15222731|ref|NP_175947.1| 2-oxoisovalerate dehydrogenase, putative / 3-methyl-2-oxobutanoate dehydrogenase, putative /
  misc_feature: GI Number: 60475528; NR Description: 3-methyl-2-oxobutanoate
  misc_feature: GI Number: 45382817; NR Description: mitochondrial branched-chain alpha-keto acid dehydrogenase E1-beta subunit [Gallus gallus] >gi|12964600|dbj|BAB32666.1| branched-chain
GAGCAGAGCAGCAGTGACCAGTGAGCTGCTTGTCCAAGAATCGCTCCCACTCCCGGCTGTCGGGAGAGCGCAGCCCAGCTAGCCGCCTCCGCTTCTTGGAGGTCGATGGCCGCGAAGGGGTTGAGGGAGGTGGGGAGGAGGAGGGCGGCGGAGGTCGGGCGGCGCTGCTTGTCTGGCGGGAGCGCTGGGCCGCCGGCGCCGGCGGCGAAGCGGAAGGAGGGAGGGAAGGCGGTGAACCTGTTCACGGCCGTCAACCAGGCGCTCCACATCGCCCTCGACACCGACCCCCGCGCCTACGTCTTCGGAGAGGACGTCGGGTTCGGCGGCGTCTTCCGCTGCACGACAGGCCTCGCCGATCGGTTCGGCAAGAGCAGAGTGTTCAACACGCCGCTGTGTGAGCAGGGTATTGCTGGATTTGCCATCGGCCTAGCAGCGATGGGCAATCGAGCTATCGCAGAAATCCAGTTTGCGGACTACATCTTTCCAGCCTTTGATCAGATTGTCAATGAAGCAGCTAAGTTCAGATATCGGAGTGGAAATGAATTTAACTGTGGAGGCTTAACGATTCGAACTCCCTATGGTGCTGTTGGGCATGGTGGTCATTACCATTCACAGTCACCAGAGGCTTTCTTCTGTCACGTTCCTGGACTCAAGGTTGTCATACCACGGAGTCCGCGCGAGGCTAAGGGGTTGCTGTTGGCCAGCATCCGAGATCCAAACCCAGTTGTATTTTTTGAGCCAAAGTGGCTGTATCGTTTGGCTGTTGAAGAAGTTCCTGAGGAGGATTACATGCTGCCGTTATCCGAGGCAGAAGTGATTAGGGAAGGAAGTGATATAACGCTTGTTGGATGGGGAGCTCAGCTTGCGGTGCTGAAAGAAGCCTGTGAAGATGCTGCAAAGGACGGGGTGTCTTGCGAGCTCATTGATCTGAAAACACTCGTACCATGGGACAAGGAAACGGTAGAGGCCTCGGTGAAGAAGACCGGGAAGCTCCTCGTTAGCCACGAGGCTCCAGTCACCGGGGGCTTCGGCGCGGAGATCGCCGCGTCCATTGCCGAGCGCTGCTTCCAGAGGTTAGAAGCACCCGTGGCGAGAGTCTGCGGTCTCGACACCCCTTTCCCTCTCGTGTACGAGCCATTTTACATGCCCACCAAGAACAAGGTCCTGGATGCGATAAAAGCCACCATAGATTTCTGAAACATGTTGCTTGATCGATACAGAGTACTCTAGTTACATGTGCACGGTTTGTGCTGGTCTGGGTCTGTAGCCTGCCTGAGGATGAGCGATCCACAAACCGGCTTATTTGTATTCAACAATACAGCGATAAATAAAGCCGCAAGGTGCAAAATTGT

SEQ ID NO: 1091 - DNA, 1965 bp, Zea mays
  misc_feature (1)..(1965): Ceres cDNA ID no. 12406856
  misc_feature (1)..(1965): Ceres CLONE  ID no. 295693
  misc_feature (1)..(1965): Also known as  Ceres CDNA ID no. 23760672
gtaggatcgtcacatgtttaccaactaataactagttaactactctcggtaccacgggtccacggcgggccgaactcgagcccctacgccgatcttatggagcttctctaatctaaaatatatacgatgtaaccttttctaatctaaaatatatacaatgtaacgtagaagtagattacatactgcagagtttagttcaattcctcgtaaactttttttatgcctccatccctgtttgcaaaaggtgcatcacttcgatcggcttcaagctccatgtctaagattcatggacatggatgaacatgaacgtgagatgacagatgaggtagaggcgtagggctcatgtgcgcacgcacgacaaccaccagctcatggatgaagcagctgatgaacgcttcccggcaaggccgccacggccgcgtcctccaccttctcttcacccacctacgacgcggcgacagaggggcgtggtagagctgcaccgcgcggccgtccccacggcactccgcgcctgcgcgcgcctcggaaacgcctcttccggccgcctaatccacgcgctcgtcctcacccggttcccgtccctcgcctccgacgccgtcgccgccaccgcgcttctcgacatgtacgccaaatgtggccttgtcgcgagtgcccagagggtgttcgacgaaatgccgagtagggatgacctcgtcgcctggaacgcgctggtcgcatgctacgcgcgccacgccctcccggagcgcgcactggtgctggctatcaaaatgcggggccagtgcctgtgccccgacctggtgacatggaacgccgtcgtctccggttttgcactggccggcgacgaccaaatggccacaaaattggtcggcgccatggaggtggacgggttccagccggacgtggtcacttggacatcgcttgtatccggctcggtgctgaacttccagtatgccagggcgcgcgtgctgttccggagaatgatgaccactgccaaccctgtcctgccgagctcggccacgattgccagcatcctgcctgcgttcgccaatgttgctgacgtgaagcgtggcaaggaagtccacgcctacgccgtggtgaccggcgtcgaacaggagctcaatgtgagcagtgctctagtagatatgtacacgaagagcgggtttgtggtcgaagcccgcaggctgtttgacaagatgtcggaaagaagcacggtgacatggaattccatgatcttcgggctggcgaattccggtcactgccaagaagccatcggtctcttcaaccggatgctgtgcgacggagcaaggccggatcacctgacgttcaccgccgctctgacggtttgcagctacgccggcatggtggagctcgggaagggcctgtaccgcgccatgcaggaagaacacggcatcgagccgaggctggagcattgtgcatgcatggtgcatttgcttggccgagccggctggctcgccgaggcttatgatttcatcaaagccatgcccctggggcctgactgcttcgtttggggggcgttgctgggggcatgccggagccatggcgacatcaagcttgccgagctggctgcgtcccacctgctaaccgtcgagccggccaatgcagcaagttgcctcctactctcggactcgctggcaagtgtaggcagacaagatgatgttatgaagatgaagaggctggcaaagagacggcgcatgaagaagctgcatggctgcagctggttagagtgagtctacataatcgagagcgatatatggtctgagatcaaaggaacagaattgattgatcacagattcatagttgcccagatttgcagaagcaaacatccaagagtttcctacaaatgcatgtgttggtctatttgatgctaccatgaaagtagaaatgttgtgctacttagatttaatggatgtaatgtttagcattcacactgtttactcaacgtcg

SEQ ID NO: 1092 - protein, 1965 aa, Zea mays
  misc_feature: PFam Name: PPR; PFam Description: PPR repeat
  misc_feature: GI Number: 34902102; NR Description: chloroplast import-associated channel protein homolog [Oryza sativa (japonica cultivar-group)] >gi|29893615|gb|AAP06869.1| chloroplast import-associated channel protein homolog [Oryza sativa (japonica
  misc_feature: GI Number: 15238469; NR Description: pentatricopeptide (PPR)
  misc_feature: GI Number: 50901930; NR Description: P0025A05.28 [Oryza
  misc_feature: GI Number: 34914806; NR Description: B1045D11.13 [Oryza sativa (japonica cultivar-group)] >gi|14587213|dbj|BAB61147.1|
  misc_feature: GI Number: 49333391; NR Description: putative
GTAGGATCGTCACATGTTTACCAACTAATAACTAGTTAACTACTCTCGGTACCACGGGTCCACGGCGGGCCGAACTCGAGCCCCTACGCCGATCTTATGGAGCTTCTCTAATCTAAAATATATACGATGTAACCTTTTCTAATCTAAAATATATACAATGTAACGTAGAAGTAGATTACATACTGCAGAGTTTAGTTCAATTCCTCGTAAACTTTTTTTATGCCTCCATCCCTGTTTGCAAAAGGTGCATCACTTCGATCGGCTTCAAGCTCCATGTCTAAGATTCATGGACATGGATGAACATGAACGTGAGATGACAGATGAGGTAGAGGCGTAGGGCTCATGTGCGCACGCACGACAACCACCAGCTCATGGATGAAGCAGCTGATGAACGCTTCCCGGCAAGGCCGCCACGGCCGCGTCCTCCACCTTCTCTTCACCCACCTACGACGCGGCGACAGAGGGGCGTGGTAGAGCTGCACCGCGCGGCCGTCCCCACGGCACTCCGCGCCTGCGCGCGCCTCGGAAACGCCTCTTCCGGCCGCCTAATCCACGCGCTCGTCCTCACCCGGTTCCCGTCCCTCGCCTCCGACGCCGTCGCCGCCACCGCGCTTCTCGACATGTACGCCAAATGTGGCCTTGTCGCGAGTGCCCAGAGGGTGTTCGACGAAATGCCGAGTAGGGATGACCTCGTCGCCTGGAACGCGCTGGTCGCATGCTACGCGCGCCACGCCCTCCCGGAGCGCGCACTGGTGCTGGCTATCAAAATGCGGGGCCAGTGCCTGTGCCCCGACCTGGTGACATGGAACGCCGTCGTCTCCGGTTTTGCACTGGCCGGCGACGACCAAATGGCCACAAAATTGGTCGGCGCCATGGAGGTGGACGGGTTCCAGCCGGACGTGGTCACTTGGACATCGCTTGTATCCGGCTCGGTGCTGAACTTCCAGTATGCCAGGGCGCGCGTGCTGTTCCGGAGAATGATGACCACTGCCAACCCTGTCCTGCCGAGCTCGGCCACGATTGCCAGCATCCTGCCTGCGTTCGCCAATGTTGCTGACGTGAAGCGTGGCAAGGAAGTCCACGCCTACGCCGTGGTGACCGGCGTCGAACAGGAGCTCAATGTGAGCAGTGCTCTAGTAGATATGTACACGAAGAGCGGGTTTGTGGTCGAAGCCCGCAGGCTGTTTGACAAGATGTCGGAAAGAAGCACGGTGACATGGAATTCCATGATCTTCGGGCTGGCGAATTCCGGTCACTGCCAAGAAGCCATCGGTCTCTTCAACCGGATGCTGTGCGACGGAGCAAGGCCGGATCACCTGACGTTCACCGCCGCTCTGACGGTTTGCAGCTACGCCGGCATGGTGGAGCTCGGGAAGGGCCTGTACCGCGCCATGCAGGAAGAACACGGCATCGAGCCGAGGCTGGAGCATTGTGCATGCATGGTGCATTTGCTTGGCCGAGCCGGCTGGCTCGCCGAGGCTTATGATTTCATCAAAGCCATGCCCCTGGGGCCTGACTGCTTCGTTTGGGGGGCGTTGCTGGGGGCATGCCGGAGCCATGGCGACATCAAGCTTGCCGAGCTGGCTGCGTCCCACCTGCTAACCGTCGAGCCGGCCAATGCAGCAAGTTGCCTCCTACTCTCGGACTCGCTGGCAAGTGTAGGCAGACAAGATGATGTTATGAAGATGAAGAGGCTGGCAAAGAGACGGCGCATGAAGAAGCTGCATGGCTGCAGCTGGTTAGAGTGAGTCTACATAATCGAGAGCGATATATGGTCTGAGATCAAAGGAACAGAATTGATTGATCACAGATTCATAGTTGCCCAGATTTGCAGAAGCAAACATCCAAGAGTTTCCTACAAATGCATGTGTTGGTCTATTTGATGCTACCATGAAAGTAGAAATGTTGTGCTACTTAGATTTAATGGATGTAATGTTTAGCATTCACACTGTTTACTCAACGTCG

SEQ ID NO: 1093 - DNA, 1457 bp, Zea mays
  misc_feature (1)..(1457): Ceres cDNA ID no. 12406983
  misc_feature (1)..(1457): Ceres CLONE  ID no. 272337
  misc_feature (1)..(1457): Also known as  Ceres CDNA ID no. 24287540
acctcccttgacccgtcgtcccatgctaaaagcccagggttaggagctagaggtaatctctctcccgtctctccccagtgggcgtgggggcgccgcatggaagccatggacgtcaagtacaagcccgtcatgttccccaacggcgccggcctcaagaagccgaagccggcggcggccgtggcgctggccggggagccgctgtaccgggagtgcctcaagaaccacgccgcgagcctgggcgggcacgccgtcgacggttgcggcgagttcatgccctcgccgggggccaaccccgccgacccgacgtcgctcaagtgcgcggcgtgcgggtgccaccgcaacttccaccgccggacgctggagggttcccctccgccgcccgcgcccgcgccgctggcgcttcccgcctccgccgagcgtgatgcacggccagccgcaccgcgcccgggaggagacgcccgaggaccgccacccgggggtcgtcgacgccgacgactccgattccgactcggaaggctcggagtacgacgaggagcggtcggtgtccccgccgccgccgccgcaccacctgctgccggcgccggtggcgcagcagcccccgccaccgtcctacttcccgacggcgccgcacatggtgctctcgctaggttccggcgtgcccgggcccgcggtggcggtatccccggcgcagaggctggccccgacccagctgacgccgtccagcgcgccgccccacgccgggggcgcgatgcccatgcccaggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcgtcttcaaggtctggatgcacaacaacaagcacaacttcctgggcgggcacagcgcccgccgcagcgcctcctcgcccgcccccgcccccgccgccgcgtcgctccaaaccccagccgccggcgccggcgctgctgcagcaccgtcattccacccgtccaggatcacccctccccctcccgtcctcacctcgtccccgacggccgccaccggcttcaacatcaacggcgccgcctcgtcggcgcccaccgtcgccaccgactacaccacggacaacgccaacggagcttcgtcgccgcactccgcttgaactagagaagggagaagagaggaggggggaagggaagggagagcggagagagagaaacatttagcttaatttcagtgatcactcgttttttttttctttagacttcttgccatctactaagaaattaaccccaagaaaaagcatgccgctgtgcgccatgcctagaaatccaagcttcttcctcccctgtactagtactgtatgctcttgggatccgatgatgatgctgatgctgatttaggattag

SEQ ID NO: 1094 - protein, 1457 aa, Zea mays
  misc_feature: PFam Name: ZF-HD_dimer; PFam Description: ZF-HD protein
  misc_feature: PFam Name: Pyr_redox_2; PFam Description: Pyridine
  misc_feature: PFam Name: Homeobox; PFam Description: Homeobox domain
  misc_feature: PFam Name: Extensin_2; PFam Description: Extensin-like region
  misc_feature: PFam Name: GATase_2; PFam Description: Glutamine
  misc_feature: GI Number: 50251525; NR Description: putative ZF-HD homeobox
  misc_feature: GI Number: 50946127; NR Description: putative ZF-HD homeobox protein [Oryza sativa (japonica cultivar-group)] >gi|42408649|dbj|BAD09869.1| putative ZF-HD homeobox protein [Oryza sativa (japonica cultivar-group)]
  misc_feature: GI Number: 53689757; NR Description: ZF-HD homeobox
  misc_feature: GI Number: 48057668; NR Description: putative ZF-HD homeobox
  misc_feature: GI Number: 13277220; NR Description: ZF-HD homeobox protein
ACCTCCCTTGACCCGTCGTCCCATGCTAAAAGCCCAGGGTTAGGAGCTAGAGGTAATCTCTCTCCCGTCTCTCCCCAGTGGGCGTGGGGGCGCCGCATGGAAGCCATGGACGTCAAGTACAAGCCCGTCATGTTCCCCAACGGCGCCGGCCTCAAGAAGCCGAAGCCGGCGGCGGCCGTGGCGCTGGCCGGGGAGCCGCTGTACCGGGAGTGCCTCAAGAACCACGCCGCGAGCCTGGGCGGGCACGCCGTCGACGGTTGCGGCGAGTTCATGCCCTCGCCGGGGGCCAACCCCGCCGACCCGACGTCGCTCAAGTGCGCGGCGTGCGGGTGCCACCGCAACTTCCACCGCCGGACGCTGGAGGGTTCCCCTCCGCCGCCCGCGCCCGCGCCGCTGGCGCTTCCCGCCTCCGCCGAGCGTGATGCACGGCCAGCCGCACCGCGCCCGGGAGGAGACGCCCGAGGACCGCCACCCGGGGGTCGTCGACGCCGACGACTCCGATTCCGACTCGGAAGGCTCGGAGTACGACGAGGAGCGGTCGGTGTCCCCGCCGCCGCCGCCGCACCACCTGCTGCCGGCGCCGGTGGCGCAGCAGCCCCCGCCACCGTCCTACTTCCCGACGGCGCCGCACATGGTGCTCTCGCTAGGTTCCGGCGTGCCCGGGCCCGCGGTGGCGGTATCCCCGGCGCAGAGGCTGGCCCCGACCCAGCTGACGCCGTCCAGCGCGCCGCCCCACGCCGGGGGCGCGATGCCCATGCCCAGGAAGCGGTTCCGCACCAAGTTCACCGCCGAGCAGAAGCAGCGGATGCAGGAGCTGTCGGAGCGGCTCGGGTGGCGGCTGCAGAAGCGCGACGAGGCCATCGTCGACGAGTGGTGCCGCGACATCGGCGTCGGCAAGGGCGTCTTCAAGGTCTGGATGCACAACAACAAGCACAACTTCCTGGGCGGGCACAGCGCCCGCCGCAGCGCCTCCTCGCCCGCCCCCGCCCCCGCCGCCGCGTCGCTCCAAACCCCAGCCGCCGGCGCCGGCGCTGCTGCAGCACCGTCATTCCACCCGTCCAGGATCACCCCTCCCCCTCCCGTCCTCACCTCGTCCCCGACGGCCGCCACCGGCTTCAACATCAACGGCGCCGCCTCGTCGGCGCCCACCGTCGCCACCGACTACACCACGGACAACGCCAACGGAGCTTCGTCGCCGCACTCCGCTTGAACTAGAGAAGGGAGAAGAGAGGAGGGGGGAAGGGAAGGGAGAGCGGAGAGAGAGAAACATTTAGCTTAATTTCAGTGATCACTCGTTTTTTTTTTCTTTAGACTTCTTGCCATCTACTAAGAAATTAACCCCAAGAAAAAGCATGCCGCTGTGCGCCATGCCTAGAAATCCAAGCTTCTTCCTCCCCTGTACTAGTACTGTATGCTCTTGGGATCCGATGATGATGCTGATGCTGATTTAGGATTAG

SEQ ID NO: 1095 - DNA, 1942 bp, Zea mays
  misc_feature (1)..(1942): Ceres cDNA ID no. 12407041
  misc_feature (1)..(1942): Ceres CLONE  ID no. 330939
  misc_feature (1)..(1942): Also known as  Ceres CDNA ID no. 23850473
accttacctttttactcctccagtccagtcagagaacaccataagtggccgctacacctgctcactccattgcaccactagcaagtagcaacaggagcgcaggcagaactagagcggtcttggtatggcttcttccctcgcgcccgcgtcgtgggcactgccgctgcagatggtcggggctggggcggcagcggcggggccttcctgccgcgcgacgctagccgtcgtcacggagccccgctgggccgcgtcgctgcgccgggcaagggttctcgtggcgctggcgccccggtgcgtggcgctcgacgggcccggcgccagcggcgaggaggaggcgcccaagatcgaggacgagaggaagaagagcggtgagacgaagaagccggcgcgcggccggccggtgtggagccggatcctcttcgcctccaagaagacacgaagtatcatcatcctcaacgccctcacggtcatctatgcaagtgatattccggttttgaaagaggtcgaagccctgacagagcctgcggtcttcaacatggtgcggttcgttgttgcagccatccccttcgtaccattcgcgctccgttccttcggtgaccgcagtgtacgctacgcgggactggagctgggagtctgggttagcttagcttacctttctcaagcaattggattgctctcatctgatgctggccgagcatccttcatcacggccttcacggtcgtagttgtgcctctaattgatggtcttcttggtgcttcgatccccagactcacatggttcggagccatcatgtctctgttcggaattggcctgctggaatgtggtggatctcctcccagtgttggcgatattttgaacttcttcagtgccgtgtttttcgggatccatatgcttagaacagaacaaatatcaaggagtacggacaagaagaaatttttagctcttcttggcttcgaggtccttgtggttgctttctcctccgttctctggtttatgttcaaagatggctacgttgataccagcggatccagctttgaatcttggacgttcgggatgctctgggataccacagtttcgtttccttggataccagcattgtacactggggttctttctacggtgttatgcatgtgggcagagatggtggcgatgggcgatgtttcagcaaccgaaactgcagttgtttacgggttggagccagtttggggagctgcttttgcttggttcctccttggtgaaagatgggatgacgctgcatggactggagctgctctcgtattatgtggcagtttgacagttcagctatttgggtcagctcctgagaagtccaagaaagtcaaaaaacgcagcagcaatgctttagaaactccagtgaaacgacgagactacttatcgttgtctcccataccagttgattccgggaagatcataggaaggcaattagaaaggaagaacaaagcagtataggtagcccaactacaaggcaagaagaaaggaaacgctgcgatgataggggcgcgcatgtaccaaatcattgtcctgaggcatcgtctgtttggctccgtcaatggccatatggggatgctgctcgattgtccgcatggagttttttttttcctttgtccgtattgaaaatggtcgtatttggatttctgttgtctcggttgaccgtgctagagtacctcatgcgtattaggaaatgaggcattggtagtggcaactcgaggagaatacttagacacatctactggcgtagtaatgacgttcagtgagataacttagtatgttttgggcactgctaaccgtaaaggttcatgtattaatatagtgggtaaatggttctagagtactgaactgagcataccattgtatagtactgaaataacaaataccacgcatggtattatttggctcccagtcaatagatccaggaatcagggc

SEQ ID NO: 1096 - protein, 1942 aa, Zea mays
  misc_feature: GI Number: 46200289; NR Description: transporter [Thermus thermophilus HB27] >gi|46197917|gb|AAS82329.1| transporter [Thermus
  misc_feature: GI Number: 51891502; NR Description: permeases of drug/metabolite transporter superfamily [Symbiobacterium thermophilum IAM 14863] >gi|51855191|dbj|BAD39349.1| permeases of drug/metabolite transporter superfamily [Symbiobacterium
  misc_feature: GI Number: 53686783; NR Description: COG0697: Permeases of the drug/metabolite transporter (DMT) superfamily [Nostoc
  misc_feature: GI Number: 66780971; NR Description: Protein of unknown function DUF6 [Deinococcus geothermalis DSM 11300] >gi|66798722|ref|ZP_00397472.1| Protein of unknown function DUF6
  misc_feature: GI Number: 20807132; NR Description: Permeases of the drug/metabolite transporter (DMT) superfamily [Thermoanaerobacter tengcongensis] >gi|20515627|gb|AAM23907.1| Permeases of the drug/metabolite transporter (DMT) superfamily [Thermoanaerobacter
ACCTTACCTTTTTACTCCTCCAGTCCAGTCAGAGAACACCATAAGTGGCCGCTACACCTGCTCACTCCATTGCACCACTAGCAAGTAGCAACAGGAGCGCAGGCAGAACTAGAGCGGTCTTGGTATGGCTTCTTCCCTCGCGCCCGCGTCGTGGGCACTGCCGCTGCAGATGGTCGGGGCTGGGGCGGCAGCGGCGGGGCCTTCCTGCCGCGCGACGCTAGCCGTCGTCACGGAGCCCCGCTGGGCCGCGTCGCTGCGCCGGGCAAGGGTTCTCGTGGCGCTGGCGCCCCGGTGCGTGGCGCTCGACGGGCCCGGCGCCAGCGGCGAGGAGGAGGCGCCCAAGATCGAGGACGAGAGGAAGAAGAGCGGTGAGACGAAGAAGCCGGCGCGCGGCCGGCCGGTGTGGAGCCGGATCCTCTTCGCCTCCAAGAAGACACGAAGTATCATCATCCTCAACGCCCTCACGGTCATCTATGCAAGTGATATTCCGGTTTTGAAAGAGGTCGAAGCCCTGACAGAGCCTGCGGTCTTCAACATGGTGCGGTTCGTTGTTGCAGCCATCCCCTTCGTACCATTCGCGCTCCGTTCCTTCGGTGACCGCAGTGTACGCTACGCGGGACTGGAGCTGGGAGTCTGGGTTAGCTTAGCTTACCTTTCTCAAGCAATTGGATTGCTCTCATCTGATGCTGGCCGAGCATCCTTCATCACGGCCTTCACGGTCGTAGTTGTGCCTCTAATTGATGGTCTTCTTGGTGCTTCGATCCCCAGACTCACATGGTTCGGAGCCATCATGTCTCTGTTCGGAATTGGCCTGCTGGAATGTGGTGGATCTCCTCCCAGTGTTGGCGATATTTTGAACTTCTTCAGTGCCGTGTTTTTCGGGATCCATATGCTTAGAACAGAACAAATATCAAGGAGTACGGACAAGAAGAAATTTTTAGCTCTTCTTGGCTTCGAGGTCCTTGTGGTTGCTTTCTCCTCCGTTCTCTGGTTTATGTTCAAAGATGGCTACGTTGATACCAGCGGATCCAGCTTTGAATCTTGGACGTTCGGGATGCTCTGGGATACCACAGTTTCGTTTCCTTGGATACCAGCATTGTACACTGGGGTTCTTTCTACGGTGTTATGCATGTGGGCAGAGATGGTGGCGATGGGCGATGTTTCAGCAACCGAAACTGCAGTTGTTTACGGGTTGGAGCCAGTTTGGGGAGCTGCTTTTGCTTGGTTCCTCCTTGGTGAAAGATGGGATGACGCTGCATGGACTGGAGCTGCTCTCGTATTATGTGGCAGTTTGACAGTTCAGCTATTTGGGTCAGCTCCTGAGAAGTCCAAGAAAGTCAAAAAACGCAGCAGCAATGCTTTAGAAACTCCAGTGAAACGACGAGACTACTTATCGTTGTCTCCCATACCAGTTGATTCCGGGAAGATCATAGGAAGGCAATTAGAAAGGAAGAACAAAGCAGTATAGGTAGCCCAACTACAAGGCAAGAAGAAAGGAAACGCTGCGATGATAGGGGCGCGCATGTACCAAATCATTGTCCTGAGGCATCGTCTGTTTGGCTCCGTCAATGGCCATATGGGGATGCTGCTCGATTGTCCGCATGGAGTTTTTTTTTTCCTTTGTCCGTATTGAAAATGGTCGTATTTGGATTTCTGTTGTCTCGGTTGACCGTGCTAGAGTACCTCATGCGTATTAGGAAATGAGGCATTGGTAGTGGCAACTCGAGGAGAATACTTAGACACATCTACTGGCGTAGTAATGACGTTCAGTGAGATAACTTAGTATGTTTTGGGCACTGCTAACCGTAAAGGTTCATGTATTAATATAGTGGGTAAATGGTTCTAGAGTACTGAACTGAGCATACCATTGTATAGTACTGAAATAACAAATACCACGCATGGTATTATTTGGCTCCCAGTCAATAGATCCAGGAATCAGGGC

SEQ ID NO: 1097 - DNA, 1522 bp, Zea mays
  misc_feature (1)..(1522): Ceres cDNA ID no. 12407056
  misc_feature (1)..(1522): Ceres CLONE  ID no. 327346
  misc_feature (1)..(1522): Also known as  Ceres CDNA ID no. 23764313
acgcaggaggtagcgttccactcgcttcgcggtggccatggtctcgtctccttcccctcccttgcccaccggtgtaagtgtgcctccctccctccttcctcctgcctcctctcctctgttaccgcggttctgccgtggctgagtatacgagtcgttcactgcacaatggtgcgccgtcaggcctccgagccgaagcagcagcgaggcggcaccaaggcggcgccggagaaggccgacaagaagtacgcgcacgtcccgacgccgctccaccacggtcacggcggtgccagcaacaagacaacaccccgcggggccaaggacgccgccggcccggcggcgtacgtcgcggcggtgtccttctccgactgccgcttcaagcagcgcgccctcgcgccggcgtcgcccggcgccgtcatccgctcgctgttcgtctccctcacccgccgctccaccccgcgctcgtcgccgtcggccacgccggcctcggcaggcgccgacgcgggggacggcgagcagtggcgcctcgccgcggccgacctctcccgcaggctcgccgcggccacgcgcacgcgggacgaggcgctggaggagaccacgcgcctgaagcactccctcgccgagctggagcacaagctcgcgcgcctcgaggcgcgcgtgctcccgacccccgcggccgccttccccgtcgactccttcctccgcgccgtctcgaccgcccgcgccgccgtgcggaacctcgcgcgcgcgctgtctgcccacctccgcagcccctccagccccggcccgagcctcgagagcttcctcaaccgcgcgttccacgccgacttcgagctggacaccgacgccgatgctcacaccacggaccccgcgggccggtgccaggccaacctcgcggcgtaccacgccgtcgcggtgctcacgtgggaggaggtcctcctccacggcaccaagcactacagcgaggggctcagccgcttctgcgacgccaagatgagcgaggtggtgtcctcgctcggctgggcgcgcgcgcggccgtggcctgagccgctgctgcaggccttcttcctcgccgccaagggcgtgtggggcgtccgcctcctggcgcgctccgtccacccgccgctccccgttgtgcgcgccgagcgaggcgcgcgcttcgacccgcggttcatggaggacgccgcggccagccgggcggggacgctggaaccggccagcgtgaagatgatgatggcgccagggttccacgtctacctggccggcgcgggcgtggtgaaatgcagggtcgtctgcttctacaccagcagtaacgcccgcacagacggccacagagatggcgggagcagcgccaacggcagcgtggggttggggagtagctgtagtgacattaatgggagtgctacagatgtggttgatagctgtagagcagtgaagtagggtaaaatgttgcccttgcacaggtagaaagaacacggggattttacttgttcgctaaaaaaacatgatgatctgcgtttaggcg

SEQ ID NO: 1098 - protein, 1522 aa, Zea mays
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Cupin_1; PFam Description: Cupin
  misc_feature: PFam Name: Peptidase_S8; PFam Description: Subtilase family
  misc_feature: GI Number: 13592175; NR Description: ppg3 [Leishmania major]
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
  misc_feature: GI Number: 29250754; NR Description: GLP_49_64409_65443
  misc_feature: GI Number: 66776813; NR Description: Phosphoribosylaminoimidazole-succinocarboxamide synthase [Anaeromyxobacter dehalogenans 2CP-C] >gi|66857369|ref|ZP_00401420.1|
  misc_feature: GI Number: 66778735; NR Description: Polysulphide reductase, NrfD [Anaeromyxobacter dehalogenans 2CP-C] >gi|66855600|ref|ZP_00399674.1| Polysulphide reductase, NrfD
ACGCAGGAGGTAGCGTTCCACTCGCTTCGCGGTGGCCATGGTCTCGTCTCCTTCCCCTCCCTTGCCCACCGGTGTAAGTGTGCCTCCCTCCCTCCTTCCTCCTGCCTCCTCTCCTCTGTTACCGCGGTTCTGCCGTGGCTGAGTATACGAGTCGTTCACTGCACAATGGTGCGCCGTCAGGCCTCCGAGCCGAAGCAGCAGCGAGGCGGCACCAAGGCGGCGCCGGAGAAGGCCGACAAGAAGTACGCGCACGTCCCGACGCCGCTCCACCACGGTCACGGCGGTGCCAGCAACAAGACAACACCCCGCGGGGCCAAGGACGCCGCCGGCCCGGCGGCGTACGTCGCGGCGGTGTCCTTCTCCGACTGCCGCTTCAAGCAGCGCGCCCTCGCGCCGGCGTCGCCCGGCGCCGTCATCCGCTCGCTGTTCGTCTCCCTCACCCGCCGCTCCACCCCGCGCTCGTCGCCGTCGGCCACGCCGGCCTCGGCAGGCGCCGACGCGGGGGACGGCGAGCAGTGGCGCCTCGCCGCGGCCGACCTCTCCCGCAGGCTCGCCGCGGCCACGCGCACGCGGGACGAGGCGCTGGAGGAGACCACGCGCCTGAAGCACTCCCTCGCCGAGCTGGAGCACAAGCTCGCGCGCCTCGAGGCGCGCGTGCTCCCGACCCCCGCGGCCGCCTTCCCCGTCGACTCCTTCCTCCGCGCCGTCTCGACCGCCCGCGCCGCCGTGCGGAACCTCGCGCGCGCGCTGTCTGCCCACCTCCGCAGCCCCTCCAGCCCCGGCCCGAGCCTCGAGAGCTTCCTCAACCGCGCGTTCCACGCCGACTTCGAGCTGGACACCGACGCCGATGCTCACACCACGGACCCCGCGGGCCGGTGCCAGGCCAACCTCGCGGCGTACCACGCCGTCGCGGTGCTCACGTGGGAGGAGGTCCTCCTCCACGGCACCAAGCACTACAGCGAGGGGCTCAGCCGCTTCTGCGACGCCAAGATGAGCGAGGTGGTGTCCTCGCTCGGCTGGGCGCGCGCGCGGCCGTGGCCTGAGCCGCTGCTGCAGGCCTTCTTCCTCGCCGCCAAGGGCGTGTGGGGCGTCCGCCTCCTGGCGCGCTCCGTCCACCCGCCGCTCCCCGTTGTGCGCGCCGAGCGAGGCGCGCGCTTCGACCCGCGGTTCATGGAGGACGCCGCGGCCAGCCGGGCGGGGACGCTGGAACCGGCCAGCGTGAAGATGATGATGGCGCCAGGGTTCCACGTCTACCTGGCCGGCGCGGGCGTGGTGAAATGCAGGGTCGTCTGCTTCTACACCAGCAGTAACGCCCGCACAGACGGCCACAGAGATGGCGGGAGCAGCGCCAACGGCAGCGTGGGGTTGGGGAGTAGCTGTAGTGACATTAATGGGAGTGCTACAGATGTGGTTGATAGCTGTAGAGCAGTGAAGTAGGGTAAAATGTTGCCCTTGCACAGGTAGAAAGAACACGGGGATTTTACTTGTTCGCTAAAAAAACATGATGATCTGCGTTTAGGCG

SEQ ID NO: 1099 - DNA, 1432 bp, Zea mays
  misc_feature (1)..(1432): Ceres cDNA ID no. 12407071
  misc_feature (1)..(1432): Ceres CLONE  ID no. 298094
  misc_feature (1)..(1432): Also known as  Ceres CDNA ID no. 23781148
  misc_feature (585)..(585): n is a, c, t, g, unknown, or other
atcttccccgtgcttgcagttgcagtgcagctgtacccacagtgccctgtcagtctcggccattgcaatgcctcaagaagcagcaatggagttgccaagaccaatgggcgtgcttctgctcgtgttcttcgtcttgtgcagagtgggggacgcggcgacgttcatgttcgtgaaccggtgcacggacacggtgtggccgggcgtcctgtccaacgccggcagcccaaggctggagccgacggggttcgagctcccgccgggcgcggcacgcgcggtgccggcgccggcgggctggtccggccgcatgtgggcgcgcacgggctgctcccaggacggcgccacggggcggctcgtctgtgccacgggcgactgcggctctggctccgccgagtgcgcgggcgcgggcgctgcgccgccggccacgctggccgagttcacgctcgacggcagtggcgggctggacttctacgacgtcagcctcgtggatggctacaacctccccgtgctggtggagacctccggcggcgcaggctccagcgggccggcgtcgtgcgcggcggccgggtgcgcagcgaacctgaaacncgatgtgccccgccgagctccgagccgggggcggcgccgcgtgccggagcgcgtgcgacgcgttcgcgcggcccgagtactgctgcagcggcgccttcgcgtccccggcggcgtgccggccgactacctactcgcaggtgttcaagagcgcgtgcccgcgctcctacagttacgccttcgacgatcccacctccacattcacctgcggcggcggcccagactacaccgtcaccttctgccccggcgccaccccaagccagaagtcgacgaccacaccgggcgcgacgccggcgacggtgccggggacaatgacgacgacggtgccggaggcaacgccgatgccgggcgcgaccccggctatgccgacggggaccatgatgccaccgggcgcgacgttcacggacgccaccccggacagcgcgatgatgccgatgggtggcctgggcatcgagggcgggggccaaggcagcgtgctcctgggcggcagcagcagcgaaggcagcgtctcttggctcgccaacatggccaccggcgacgcggccgtcccgctggtggcttcggctcggttattggtggcgccactggcaacgttgctctgcggcctccatttgctgtagtagtggtgatggagggagcagaggaatctgttggcgattcgcacggtggcgcctttgtattgccgtgtctgtagatgattttactgtccattgatcatgttgcgttagccccggtcccaggattagatacttgtggctactagtagtactagttctagaggagaaattaaagcatggatgtggacattgattaaagttaatcgctgtcgtgctagctgcgctttgttgtt

SEQ ID NO: 1100 - protein, 1432 aa, Zea mays
  misc_feature: PFam Name: Thaumatin; PFam Description: Thaumatin family
  misc_feature: PFam Name: Cupin_1; PFam Description: Cupin
  misc_feature: GI Number: 21280949; NR Description: putative thaumatin protein [Arabidopsis thaliana] >gi|13430506|gb|AAK25875.1| putative thaumatin protein [Arabidopsis thaliana] >gi|7270553|emb|CAB81510.1| thaumatin-like protein protein
  misc_feature: GI Number: 50726592; NR Description: putative thaumatin-like
  misc_feature: GI Number: 20334826; NR Description: At1g75800/T4O12_2 [Arabidopsis thaliana] >gi|6721098|gb|AAF26752.1| T4O12.3 [Arabidopsis thaliana] >gi|18377860|gb|AAL67116.1| At1g75800/T4O12_2 [Arabidopsis thaliana]
  misc_feature: GI Number: 2262099; NR Description: thaumatin isolog
  misc_feature: GI Number: 7269268; NR Description: thaumatin-like protein [Arabidopsis thaliana] >gi|5051760|emb|CAB45053.1| thaumatin-like protein [Arabidopsis thaliana] >gi|15233738|ref|NP_194149.1| pathogenesis-related thaumatin family protein [Arabidopsis
ATCTTCCCCGTGCTTGCAGTTGCAGTGCAGCTGTACCCACAGTGCCCTGTCAGTCTCGGCCATTGCAATGCCTCAAGAAGCAGCAATGGAGTTGCCAAGACCAATGGGCGTGCTTCTGCTCGTGTTCTTCGTCTTGTGCAGAGTGGGGGACGCGGCGACGTTCATGTTCGTGAACCGGTGCACGGACACGGTGTGGCCGGGCGTCCTGTCCAACGCCGGCAGCCCAAGGCTGGAGCCGACGGGGTTCGAGCTCCCGCCGGGCGCGGCACGCGCGGTGCCGGCGCCGGCGGGCTGGTCCGGCCGCATGTGGGCGCGCACGGGCTGCTCCCAGGACGGCGCCACGGGGCGGCTCGTCTGTGCCACGGGCGACTGCGGCTCTGGCTCCGCCGAGTGCGCGGGCGCGGGCGCTGCGCCGCCGGCCACGCTGGCCGAGTTCACGCTCGACGGCAGTGGCGGGCTGGACTTCTACGACGTCAGCCTCGTGGATGGCTACAACCTCCCCGTGCTGGTGGAGACCTCCGGCGGCGCAGGCTCCAGCGGGCCGGCGTCGTGCGCGGCGGCCGGGTGCGCAGCGAACCTGAAACNCGATGTGCCCCGCCGAGCTCCGAGCCGGGGGCGGCGCCGCGTGCCGGAGCGCGTGCGACGCGTTCGCGCGGCCCGAGTACTGCTGCAGCGGCGCCTTCGCGTCCCCGGCGGCGTGCCGGCCGACTACCTACTCGCAGGTGTTCAAGAGCGCGTGCCCGCGCTCCTACAGTTACGCCTTCGACGATCCCACCTCCACATTCACCTGCGGCGGCGGCCCAGACTACACCGTCACCTTCTGCCCCGGCGCCACCCCAAGCCAGAAGTCGACGACCACACCGGGCGCGACGCCGGCGACGGTGCCGGGGACAATGACGACGACGGTGCCGGAGGCAACGCCGATGCCGGGCGCGACCCCGGCTATGCCGACGGGGACCATGATGCCACCGGGCGCGACGTTCACGGACGCCACCCCGGACAGCGCGATGATGCCGATGGGTGGCCTGGGCATCGAGGGCGGGGGCCAAGGCAGCGTGCTCCTGGGCGGCAGCAGCAGCGAAGGCAGCGTCTCTTGGCTCGCCAACATGGCCACCGGCGACGCGGCCGTCCCGCTGGTGGCTTCGGCTCGGTTATTGGTGGCGCCACTGGCAACGTTGCTCTGCGGCCTCCATTTGCTGTAGTAGTGGTGATGGAGGGAGCAGAGGAATCTGTTGGCGATTCGCACGGTGGCGCCTTTGTATTGCCGTGTCTGTAGATGATTTTACTGTCCATTGATCATGTTGCGTTAGCCCCGGTCCCAGGATTAGATACTTGTGGCTACTAGTAGTACTAGTTCTAGAGGAGAAATTAAAGCATGGATGTGGACATTGATTAAAGTTAATCGCTGTCGTGCTAGCTGCGCTTTGTTGTT

SEQ ID NO: 1101 - DNA, 1396 bp, Zea mays
  misc_feature (1)..(1396): Ceres cDNA ID no. 12407155
  misc_feature (1)..(1396): Ceres CLONE  ID no. 312062
  misc_feature (1)..(1396): Also known as  Ceres CDNA ID no. 23772218
  misc_feature (212)..(212): n is a, c, t, g, unknown, or other
  misc_feature (301)..(301): n is a, c, t, g, unknown, or other
  misc_feature (302)..(302): n is a, c, t, g, unknown, or other
  misc_feature (309)..(309): n is a, c, t, g, unknown, or other
  misc_feature (317)..(317): n is a, c, t, g, unknown, or other
  misc_feature (387)..(387): n is a, c, t, g, unknown, or other
  misc_feature (388)..(388): n is a, c, t, g, unknown, or other
agtcacaactcacaatcacccagcgacagacaacaactacccagtccgtcgtcccggcttccgtgcgggccggggtttcccacgagcgcgcacggcacggcgccgccagcaaggtcacgagtcgggtggaggcatcggacatggccaccacgacggtgacgacgactgcggaggcggcgagcgcgcccgggaagcggcgcggcggggggtgntgcgccctcgcggcggcggcggcgagcgtcgtgcccgtgaaggcggcgggtgagcaggggcagcagccgctgccgctgccgcggctggnncggttcnaggagctnccggactacctgcgcgacaacgagttcatccacgcgcactaccgctgcgagtggtccgtccgcgacgcgnngcgcagcgccctcgcctggcacaacgagacgctcaacgtctggagccatctcggaggcttcttcctgttcctgtacctcgccgtcgccgagccaacggggacggtggccggcggcgccggcgccggagccgccccgggtatcgtgacgttcgtgctcgcgtcggccaacacctcctggtcttcgtgggaggccagcagtaactcgagcttgacggccagcaagggtttgatggccgtgttcgggagcagcgacggcgacgcccacgcggtgccgaggtggccgcggacggtgttcctggcgggcgcgatggcgtgcctggcggtgagcgcggcggcgcacctgctggcgtgccactcgcgccgcttcacgcgcctcttctggcagctcgactacgcggggatcgcggtgatgatcgtcgcctccttcttccctcccgtctactacgccttcctcggccgcgcccgcacgcagctcgtctacctgtccgccgtcaccctgctgggcctgctggtggtggcgctgctcctggcgcccgcgcgctcgtcgccgcgcctgcgccacctccgcgccggcctcttcgtgtccatggccttctccggggtgctgccggcgctgcacgcgctgtggctcaactgggtacaccgcgagtgccacctcgcgctggcgctcgagctcctcatgggcctcgtgtacgccgccggcgccgggttctacgtcacccgcgtgccggagcgctggagccccggcaggttcgactgcgtcggccacagccaccagatcttccacgtgctcgtgctcgtcggcgcgctcacgcactacgccgccaccgccatcctcatcgactggcgagaggcgatggccgtcgctgccggcggggcatcggtgctctcgtgatccgtgactgcaaagcagcgcagtgtatatgtaggtgaagggggtactatcgattcgttcattctttgtacgcgacgtcgatttatttacctcaatcgaaatatttgttcggc

SEQ ID NO: 1102 - protein, 1396 aa, Zea mays
  misc_feature: PFam Name: HlyIII; PFam Description: Haemolysin-III related
  misc_feature: GI Number: 51535032; NR Description: putative adiponectin
  misc_feature: GI Number: 50252081; NR Description: putative adiponectin
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 63146260; NR Description: Unknown (protein for
  misc_feature: GI Number: 27696972; NR Description: Adipor1-prov protein
AGTCACAACTCACAATCACCCAGCGACAGACAACAACTACCCAGTCCGTCGTCCCGGCTTCCGTGCGGGCCGGGGTTTCCCACGAGCGCGCACGGCACGGCGCCGCCAGCAAGGTCACGAGTCGGGTGGAGGCATCGGACATGGCCACCACGACGGTGACGACGACTGCGGAGGCGGCGAGCGCGCCCGGGAAGCGGCGCGGCGGGGGGTGNTGCGCCCTCGCGGCGGCGGCGGCGAGCGTCGTGCCCGTGAAGGCGGCGGGTGAGCAGGGGCAGCAGCCGCTGCCGCTGCCGCGGCTGGNNCGGTTCNAGGAGCTNCCGGACTACCTGCGCGACAACGAGTTCATCCACGCGCACTACCGCTGCGAGTGGTCCGTCCGCGACGCGNNGCGCAGCGCCCTCGCCTGGCACAACGAGACGCTCAACGTCTGGAGCCATCTCGGAGGCTTCTTCCTGTTCCTGTACCTCGCCGTCGCCGAGCCAACGGGGACGGTGGCCGGCGGCGCCGGCGCCGGAGCCGCCCCGGGTATCGTGACGTTCGTGCTCGCGTCGGCCAACACCTCCTGGTCTTCGTGGGAGGCCAGCAGTAACTCGAGCTTGACGGCCAGCAAGGGTTTGATGGCCGTGTTCGGGAGCAGCGACGGCGACGCCCACGCGGTGCCGAGGTGGCCGCGGACGGTGTTCCTGGCGGGCGCGATGGCGTGCCTGGCGGTGAGCGCGGCGGCGCACCTGCTGGCGTGCCACTCGCGCCGCTTCACGCGCCTCTTCTGGCAGCTCGACTACGCGGGGATCGCGGTGATGATCGTCGCCTCCTTCTTCCCTCCCGTCTACTACGCCTTCCTCGGCCGCGCCCGCACGCAGCTCGTCTACCTGTCCGCCGTCACCCTGCTGGGCCTGCTGGTGGTGGCGCTGCTCCTGGCGCCCGCGCGCTCGTCGCCGCGCCTGCGCCACCTCCGCGCCGGCCTCTTCGTGTCCATGGCCTTCTCCGGGGTGCTGCCGGCGCTGCACGCGCTGTGGCTCAACTGGGTACACCGCGAGTGCCACCTCGCGCTGGCGCTCGAGCTCCTCATGGGCCTCGTGTACGCCGCCGGCGCCGGGTTCTACGTCACCCGCGTGCCGGAGCGCTGGAGCCCCGGCAGGTTCGACTGCGTCGGCCACAGCCACCAGATCTTCCACGTGCTCGTGCTCGTCGGCGCGCTCACGCACTACGCCGCCACCGCCATCCTCATCGACTGGCGAGAGGCGATGGCCGTCGCTGCCGGCGGGGCATCGGTGCTCTCGTGATCCGTGACTGCAAAGCAGCGCAGTGTATATGTAGGTGAAGGGGGTACTATCGATTCGTTCATTCTTTGTACGCGACGTCGATTTATTTACCTCAATCGAAATATTTGTTCGGC

SEQ ID NO: 1103 - DNA, 1703 bp, Zea mays
  misc_feature (1)..(1703): Ceres cDNA ID no. 12407213
  misc_feature (1)..(1703): Ceres CLONE  ID no. 298604
  misc_feature (1)..(1703): Also known as  Ceres CDNA ID no. 23761188
atctccgcctcccctcacggaaaggaaagaaacgctctccccccggggcaaagggaaccgtcgccgcgtcgcggaaaactgaagcggggcacaggaggaggagaggccgaggcagggagagggttccggcggcgatggagcggtacaacccctccgaggtgtacgagctcttcgtgcgccacatgaacaacccgagggtggtggtggacaacggcgcgtgcgcgacggcgacgctggtgcaggtgcacagcgcgaggaagcacggcgtgctgctcgacgcggtggcggccctgtccgaccacggcgtctgcgtccgcaaaggctacatctcctccgacgacggccgctggttcatggacgtcttccacgtcgtcgacgccgcgggcggcaaggtggccgacgccggcgccctgctggcgcgcctcgagtcctcgctctccgccgacgcattgccgccccgcccgccgcccgccgccgcgggggccgggacgcccaccctgctcgagctcgtcggcgccgaccgcccgggcctcctctccgaggtcttcgccgtgctgcacgacctccgctgcggcaccgtcgacgccagggcctggacgcacgccggccgcgtcgccgcgctcgtgttcgtgcgcgacgaggagaccggctcgccgatcgacgacgcggcgcgggtcaggcgcgtggagtccaggctccggcacgtcctccgcggcggcgcgctcggcgcgaggatggtccgggcagacgcctccgccgtcaacatggaccggaggctccaccagcttctcaacgaggacggggaggccgggagccgcgccgaccgggcggagtcggaggcggaggcgcccacgcccacagcggtcgccgtgcaggattgggtggagagggggtactcggtggtgacagtgagctgccgcgaccggcccaagctgctcttcgacgtcgtctgcaccttgacagacttggattacgtggtgtaccacggcacgttccacacagacgacgatcacgcccgccaggagttctacatcaggcggttggacgagcggccaattagctcggcgaccgagaggcggcgcgtgatccaatgcttggaagcggccatcgagaggcgcgcatccgagggagtgaggctggagctgcgcatcaccgaccgccgcgggctgctcgcctacgtcacgcgtgtgttcagggagaacagcctctcggtcacgcacgccgagatcaccaccaggggcgacatggccatgaacgtgttccacgtcaccgacgtggccggccgacccgcggaccccaagaccatcgacgaggtgatccagaggatcggcacggagagcctccgggtggacgaggagcggtggccgcgcctgtgctcgacggagggcgacgctggccgcggcggcggcggtgcggggatcttctcgctcgggagccttgtcaagaagaacctggtcagtcttggcctcataagatcctgctcgtgaggacgcgatcaatggggggcatgtgctccatgggatccttgtgtaaatatgggatggtgcatgggttagtttgtaaatggagtaggggtttaaatcgccgtttctagttctaggtttaagttgccacgtgtacatagtagcaagtggagatggaaggttttaaaagttgctggtcggcaacagcaaggataatggacctctctggtgggtcgtgcc

SEQ ID NO: 1104 - protein, 1703 aa, Zea mays
  misc_feature: PFam Name: ACT; PFam Description: ACT domain
  misc_feature: PFam Name: HlyD; PFam Description: HlyD family secretion protein
  misc_feature: PFam Name: Peptidase_S8; PFam Description: Subtilase family
  misc_feature: PFam Name: Pkinase; PFam Description: Protein kinase domain
  misc_feature: PFam Name: Cation_efflux; PFam Description: Cation efflux family
  misc_feature: GI Number: 50940555; NR Description: putative ACT domain-containing protein [Oryza sativa (japonica cultivar-group)] >gi|42407901|dbj|BAD09041.1| putative ACT domain-containing protein [Oryza sativa (japonica
  misc_feature: GI Number: 8778647; NR Description: F5O11.14 [Arabidopsis thaliana] >gi|22138106|gb|AAM93433.1| ACR8 [Arabidopsis thaliana] >gi|25370630|pir||F86258 protein F5O11.14 [imported] - Arabidopsis
  misc_feature: GI Number: 22138104; NR Description: ACR7 [Arabidopsis thaliana] >gi|22328873|ref|NP_194009.2| ACT domain-containing
  misc_feature: GI Number: 50916533; NR Description: putative ACT domain containing protein, ACR4, with alternative splicing forms [Oryza sativa (japonica cultivar-group)] >gi|41469089|gb|AAS07063.1|
  misc_feature: GI Number: 20466646; NR Description: translation factor EF-1
ATCTCCGCCTCCCCTCACGGAAAGGAAAGAAACGCTCTCCCCCCGGGGCAAAGGGAACCGTCGCCGCGTCGCGGAAAACTGAAGCGGGGCACAGGAGGAGGAGAGGCCGAGGCAGGGAGAGGGTTCCGGCGGCGATGGAGCGGTACAACCCCTCCGAGGTGTACGAGCTCTTCGTGCGCCACATGAACAACCCGAGGGTGGTGGTGGACAACGGCGCGTGCGCGACGGCGACGCTGGTGCAGGTGCACAGCGCGAGGAAGCACGGCGTGCTGCTCGACGCGGTGGCGGCCCTGTCCGACCACGGCGTCTGCGTCCGCAAAGGCTACATCTCCTCCGACGACGGCCGCTGGTTCATGGACGTCTTCCACGTCGTCGACGCCGCGGGCGGCAAGGTGGCCGACGCCGGCGCCCTGCTGGCGCGCCTCGAGTCCTCGCTCTCCGCCGACGCATTGCCGCCCCGCCCGCCGCCCGCCGCCGCGGGGGCCGGGACGCCCACCCTGCTCGAGCTCGTCGGCGCCGACCGCCCGGGCCTCCTCTCCGAGGTCTTCGCCGTGCTGCACGACCTCCGCTGCGGCACCGTCGACGCCAGGGCCTGGACGCACGCCGGCCGCGTCGCCGCGCTCGTGTTCGTGCGCGACGAGGAGACCGGCTCGCCGATCGACGACGCGGCGCGGGTCAGGCGCGTGGAGTCCAGGCTCCGGCACGTCCTCCGCGGCGGCGCGCTCGGCGCGAGGATGGTCCGGGCAGACGCCTCCGCCGTCAACATGGACCGGAGGCTCCACCAGCTTCTCAACGAGGACGGGGAGGCCGGGAGCCGCGCCGACCGGGCGGAGTCGGAGGCGGAGGCGCCCACGCCCACAGCGGTCGCCGTGCAGGATTGGGTGGAGAGGGGGTACTCGGTGGTGACAGTGAGCTGCCGCGACCGGCCCAAGCTGCTCTTCGACGTCGTCTGCACCTTGACAGACTTGGATTACGTGGTGTACCACGGCACGTTCCACACAGACGACGATCACGCCCGCCAGGAGTTCTACATCAGGCGGTTGGACGAGCGGCCAATTAGCTCGGCGACCGAGAGGCGGCGCGTGATCCAATGCTTGGAAGCGGCCATCGAGAGGCGCGCATCCGAGGGAGTGAGGCTGGAGCTGCGCATCACCGACCGCCGCGGGCTGCTCGCCTACGTCACGCGTGTGTTCAGGGAGAACAGCCTCTCGGTCACGCACGCCGAGATCACCACCAGGGGCGACATGGCCATGAACGTGTTCCACGTCACCGACGTGGCCGGCCGACCCGCGGACCCCAAGACCATCGACGAGGTGATCCAGAGGATCGGCACGGAGAGCCTCCGGGTGGACGAGGAGCGGTGGCCGCGCCTGTGCTCGACGGAGGGCGACGCTGGCCGCGGCGGCGGCGGTGCGGGGATCTTCTCGCTCGGGAGCCTTGTCAAGAAGAACCTGGTCAGTCTTGGCCTCATAAGATCCTGCTCGTGAGGACGCGATCAATGGGGGGCATGTGCTCCATGGGATCCTTGTGTAAATATGGGATGGTGCATGGGTTAGTTTGTAAATGGAGTAGGGGTTTAAATCGCCGTTTCTAGTTCTAGGTTTAAGTTGCCACGTGTACATAGTAGCAAGTGGAGATGGAAGGTTTTAAAAGTTGCTGGTCGGCAACAGCAAGGATAATGGACCTCTCTGGTGGGTCGTGCC

SEQ ID NO: 1105 - DNA, 1335 bp, Zea mays
  misc_feature (1)..(1335): Ceres cDNA ID no. 12407481
  misc_feature (1)..(1335): Ceres CLONE  ID no. 320600
  misc_feature (1)..(1335): Also known as  Ceres CDNA ID no. 23763610
agacaccagaccaccggagcggaccaagtacgagcatgggcggcgccgcggaggaggcgttgcggcgggagtacgtggtcggcgaggagatcgggcgcggccggttcgggacggtccgccgctgctacgccgccgccacgggggagccgttcgcgctcaagacgacgcccaaggcggcgctgcgggcggacccgctggacctggcgctggcggagcaggagcccaaggtgcaccacctggcgtctgccgccagccgccacgtggtcgcgctgcacgccgccttcgtggacgccgacgccgtgcacctggtgctggacctgtgcgcgggcggggacctgttcgcgctcgtctccgcgcggggcgcgctcccggaggcccgaggcggcggagctcatggcgcaggctcgccgacgcgctcgccggctgccaccgccgcggggtcgcgcaccgcgacgtcaagcccgacaacctcctcttcgacgccgccgccggcggcgcgctcaggctcggggacttcggctccgccgcctggttcggggacggcaggcccatgacggggctggtcgggacgccctactacgtcgcgcccgaggtggtggccggcagcgagtacaccgagaaggtggacgtctggagcgccggggtcgtgctctacatgatgctctccgggaccgtgcccttctccggcgccaccgcgggggagatcttccaggccgtgctccgcgggaacctgcgcttccctccgcgcgccttcgccgccgtctcgcccgaggccaaggacctcctgcgccgcatgctctgcagggacgtctggcgcaggctctccgccgagcaagtcctgagtcacccatggattgtgactcgcggcggaagtgtgcctggcggtagactggtttagatgctccgcgccgcatccgatgaatctccatccgaagtgtacatagtggcgtcctccatccaatccaagaggagtagagaaggaccttttgctgttgatctcttcgctatggttctggcaaatgatcgtgaatttggacactagtgctgtagttggttaccagtagcacgcagaaagaagtaatcgttaggctaagcagggatttaggagggctgcctcttcctgggtttgctctgttctgcagtaatcctgtgctcgtcttagcttgtttgcattgcaacccaaacccatgtatgtgtatagcacagccttcttatggctgaggaagagacgactagctctgttcaggagaaaatgcttccgggttcactgtgactgtgagtttctactgtgttggaaccttgaatgaaatatacatcctgaatgtgttaggctcc

SEQ ID NO: 1106 - protein, 1335 aa, Zea mays
  misc_feature: PFam Name: Pkinase; PFam Description: Protein kinase domain
  misc_feature: GI Number: 59803708; NR Description: phosphoenolpyruvate
  misc_feature: GI Number: 59803714; NR Description: phosphoenolpyruvate
  misc_feature: GI Number: 50910689; NR Description: putative phosphoenolpyruvate carboxylase kinase [Oryza sativa (japonica cultivar-group)] >gi|48716248|dbj|BAD23784.1| putative phosphoenolpyruvate carboxylase kinase [Oryza sativa (japonica
  misc_feature: GI Number: 59803710; NR Description: phosphoenolpyruvate
  misc_feature: GI Number: 15029405; NR Description: phosphoenolpyruvate
AGACACCAGACCACCGGAGCGGACCAAGTACGAGCATGGGCGGCGCCGCGGAGGAGGCGTTGCGGCGGGAGTACGTGGTCGGCGAGGAGATCGGGCGCGGCCGGTTCGGGACGGTCCGCCGCTGCTACGCCGCCGCCACGGGGGAGCCGTTCGCGCTCAAGACGACGCCCAAGGCGGCGCTGCGGGCGGACCCGCTGGACCTGGCGCTGGCGGAGCAGGAGCCCAAGGTGCACCACCTGGCGTCTGCCGCCAGCCGCCACGTGGTCGCGCTGCACGCCGCCTTCGTGGACGCCGACGCCGTGCACCTGGTGCTGGACCTGTGCGCGGGCGGGGACCTGTTCGCGCTCGTCTCCGCGCGGGGCGCGCTCCCGGAGGCCCGAGGCGGCGGAGCTCATGGCGCAGGCTCGCCGACGCGCTCGCCGGCTGCCACCGCCGCGGGGTCGCGCACCGCGACGTCAAGCCCGACAACCTCCTCTTCGACGCCGCCGCCGGCGGCGCGCTCAGGCTCGGGGACTTCGGCTCCGCCGCCTGGTTCGGGGACGGCAGGCCCATGACGGGGCTGGTCGGGACGCCCTACTACGTCGCGCCCGAGGTGGTGGCCGGCAGCGAGTACACCGAGAAGGTGGACGTCTGGAGCGCCGGGGTCGTGCTCTACATGATGCTCTCCGGGACCGTGCCCTTCTCCGGCGCCACCGCGGGGGAGATCTTCCAGGCCGTGCTCCGCGGGAACCTGCGCTTCCCTCCGCGCGCCTTCGCCGCCGTCTCGCCCGAGGCCAAGGACCTCCTGCGCCGCATGCTCTGCAGGGACGTCTGGCGCAGGCTCTCCGCCGAGCAAGTCCTGAGTCACCCATGGATTGTGACTCGCGGCGGAAGTGTGCCTGGCGGTAGACTGGTTTAGATGCTCCGCGCCGCATCCGATGAATCTCCATCCGAAGTGTACATAGTGGCGTCCTCCATCCAATCCAAGAGGAGTAGAGAAGGACCTTTTGCTGTTGATCTCTTCGCTATGGTTCTGGCAAATGATCGTGAATTTGGACACTAGTGCTGTAGTTGGTTACCAGTAGCACGCAGAAAGAAGTAATCGTTAGGCTAAGCAGGGATTTAGGAGGGCTGCCTCTTCCTGGGTTTGCTCTGTTCTGCAGTAATCCTGTGCTCGTCTTAGCTTGTTTGCATTGCAACCCAAACCCATGTATGTGTATAGCACAGCCTTCTTATGGCTGAGGAAGAGACGACTAGCTCTGTTCAGGAGAAAATGCTTCCGGGTTCACTGTGACTGTGAGTTTCTACTGTGTTGGAACCTTGAATGAAATATACATCCTGAATGTGTTAGGCTCC

SEQ ID NO: 1107 - DNA, 1421 bp, Zea mays
  misc_feature (1)..(1421): Ceres cDNA ID no. 12407513
  misc_feature (1)..(1421): Ceres CLONE  ID no. 333787
  misc_feature (1)..(1421): Also known as  Ceres CDNA ID no. 23763871
  misc_feature (971)..(971): n is a, c, t, g, unknown, or other
acaaaccataaaccaagaagctgctgcgggacgttcaaatcaaacatctctaccctctccttccagcgaaatggcaagagcggcggctcctccgcctctgcaccggctgcccggtctggccttgctgtgccttgccgtggcagtttgcttctccggcggcgaaaacgccgcggcggcggcctggacgaggaagatagtcggcgttcacgagctcagggtgggggatttctccgtcaaggtcaccaactggggggcgactctcatgtccgtcatcctccccgactccaaagggaacttgggcgacgttgtgctcggctacgacaccgtcgctgaatacgtcaacggcaccgcctacttcggcggtctgatcggccgcgtggccaacagggtcgccggcgcgcggttcacgctggacgggaaagcctaccgcctctaccgcaacgacggcaacaactcgctccacggtggccaccgggggttcagcaaggtcgtatggacggtgaaggagcacgtcggcggcggtgactccccgtacatcacgctctactaccatagcttcgacggggagcaagggttccccggcgacctggacgtgtacgtgacgtaccgtctgtcgcgcccgtacgtgctgagcgtgcgcatgaacgccacggcgcggagcagggccaccccggtgaacctcgcgcaccacgcgtactggaacctcggcggccacggcagcgggcccgtcctcggcgaaacggtgcagctcttcgcgtcgcggtacacgccggtggacgccgcgctcgtgccgacgggcgcgctggcgcccgtggccggcacgccctacgacttccgcgcgccggcgcccgtgggggcgcgcctgggcggacctgcggccgcgccgtggcactggcggcgtcgcgggctacgacaccaactacgccgtggacggcgccgcgtcgccgtcgctgcggccggtggcgcgcgtntgggacggcgccacggggcgggccatggagctgtgggcggaccagcccggggtgcagttctacaccagcaacgggctcgctggcgtcaggggcaagggcggtagcgtgtaccggcggtacgccgcgctgtgcctcgagacgcaggggttccccgatgccgtcaaccacccgagcttcccgtcgcagatcgtgaggccgggcaaggtgtatagccatgacatgctctttaagttctccttcgcctagctacaagactactggtgcatgcggttcatgcgtacacctgcgcagtgctgtgtcaccttgatgtgtcttgattagactcctccgtctactctcaagaactttacatccccaaataacagcgtgctgcccggtacgagctagggttttatatgtatgcgcgggcgcggcttatgctcgataatttccgtctcattggttggccgt

SEQ ID NO: 1108 - protein, 1421 aa, Zea mays
  misc_feature: PFam Name: Aldose_epim; PFam Description: Aldose 1-epimerase
  misc_feature: PFam Name: Mucin; PFam Description: Mucin-like glycoprotein
  misc_feature: GI Number: 50909807; NR Description: putative non-cell-autonomous protein pathway2; plasmodesmal receptor [Oryza sativa (japonica cultivar-group)] >gi|50725243|dbj|BAD34245.1| putative non-cell-autonomous protein pathway2; plasmodesmal
  misc_feature: GI Number: 50920801; NR Description: putative aldose 1-epimerase [Oryza sativa (japonica cultivar-group)] >gi|40882679|gb|AAR96220.1| putative aldose 1-epimerase [Oryza
  misc_feature: GI Number: 15824567; NR Description: non-cell-autonomous
  misc_feature: GI Number: 15824565; NR Description: non-cell-autonomous
  misc_feature: GI Number: 2739168; NR Description: aldose-1-epimerase-like protein [Nicotiana tabacum] >gi|7430313|pir||T01933 probable aldose
ACAAACCATAAACCAAGAAGCTGCTGCGGGACGTTCAAATCAAACATCTCTACCCTCTCCTTCCAGCGAAATGGCAAGAGCGGCGGCTCCTCCGCCTCTGCACCGGCTGCCCGGTCTGGCCTTGCTGTGCCTTGCCGTGGCAGTTTGCTTCTCCGGCGGCGAAAACGCCGCGGCGGCGGCCTGGACGAGGAAGATAGTCGGCGTTCACGAGCTCAGGGTGGGGGATTTCTCCGTCAAGGTCACCAACTGGGGGGCGACTCTCATGTCCGTCATCCTCCCCGACTCCAAAGGGAACTTGGGCGACGTTGTGCTCGGCTACGACACCGTCGCTGAATACGTCAACGGCACCGCCTACTTCGGCGGTCTGATCGGCCGCGTGGCCAACAGGGTCGCCGGCGCGCGGTTCACGCTGGACGGGAAAGCCTACCGCCTCTACCGCAACGACGGCAACAACTCGCTCCACGGTGGCCACCGGGGGTTCAGCAAGGTCGTATGGACGGTGAAGGAGCACGTCGGCGGCGGTGACTCCCCGTACATCACGCTCTACTACCATAGCTTCGACGGGGAGCAAGGGTTCCCCGGCGACCTGGACGTGTACGTGACGTACCGTCTGTCGCGCCCGTACGTGCTGAGCGTGCGCATGAACGCCACGGCGCGGAGCAGGGCCACCCCGGTGAACCTCGCGCACCACGCGTACTGGAACCTCGGCGGCCACGGCAGCGGGCCCGTCCTCGGCGAAACGGTGCAGCTCTTCGCGTCGCGGTACACGCCGGTGGACGCCGCGCTCGTGCCGACGGGCGCGCTGGCGCCCGTGGCCGGCACGCCCTACGACTTCCGCGCGCCGGCGCCCGTGGGGGCGCGCCTGGGCGGACCTGCGGCCGCGCCGTGGCACTGGCGGCGTCGCGGGCTACGACACCAACTACGCCGTGGACGGCGCCGCGTCGCCGTCGCTGCGGCCGGTGGCGCGCGTNTGGGACGGCGCCACGGGGCGGGCCATGGAGCTGTGGGCGGACCAGCCCGGGGTGCAGTTCTACACCAGCAACGGGCTCGCTGGCGTCAGGGGCAAGGGCGGTAGCGTGTACCGGCGGTACGCCGCGCTGTGCCTCGAGACGCAGGGGTTCCCCGATGCCGTCAACCACCCGAGCTTCCCGTCGCAGATCGTGAGGCCGGGCAAGGTGTATAGCCATGACATGCTCTTTAAGTTCTCCTTCGCCTAGCTACAAGACTACTGGTGCATGCGGTTCATGCGTACACCTGCGCAGTGCTGTGTCACCTTGATGTGTCTTGATTAGACTCCTCCGTCTACTCTCAAGAACTTTACATCCCCAAATAACAGCGTGCTGCCCGGTACGAGCTAGGGTTTTATATGTATGCGCGGGCGCGGCTTATGCTCGATAATTTCCGTCTCATTGGTTGGCCGT

SEQ ID NO: 1109 - DNA, 1552 bp, Zea mays
  misc_feature (1)..(1552): Ceres cDNA ID no. 12407539
  misc_feature (1)..(1552): Ceres CLONE  ID no. 332592
  misc_feature (1)..(1552): Also known as  Ceres CDNA ID no. 23774244
ggtcgcgcacacggaagagcgcgagaggttcggttccatggcggcgccgcgcggccttctcgccttgttcgcggtggctgccgccgctacggcggcgacgggcgtgggcgtggacgcgctcggggtgaactggggcaccatgtccgcgcgccggctcccgcccaaggtgatggcgcgcctgctcacggacaacgggttcacgaaggtgaagatcttcgacgccgacgagcggaccatgaagggcctcgccgggacgagcatcgagacgatggtcgccgtgcccaacgacatgctcgcggccgtcgccgactacgaccgggcccggcggtgggttagggacaatgtcaccaagtacaccttcgacggcggcgtcaacatcaagttcgtggccgtcggcaacgagccgttcctcagggcgtacaacggctcgttcgaccacgtgacggtgcccggcgctcaggaacatccagcgcgcgctggacgaggccgggcacggcgcggcggtcaaggcaacggtccccgtcaacgcggacgtgtacgattcgccggcgagcaacccggtgccgtcggcagggaggttccgcagcgacgtggcgcgggtcatggcggacatggtccgcgtcctcaaccgcagcggcgcgccgctcaccgtcaacatctacccgttcctcagcctgtacgggaacgacgacttcccgctggactacgccttcttcgatggcggcgccggtgcgccggtggtcgacggccgggccgtctacaccaacgtgttcgacgccaacttcgacacgctggtgtcggcgctcaagagggtcgggctcggccacctgccggtcatcatcggcgaggtcggctggccgacggacggcgacaggcacgccacggcggccctcgcggagcgcttctacgcggggctcctccagcggctcgcggccaggagaggcacgccgctccggcccggcgcgcgcatcgaggcctacctgttcgggctcgtggacgaggacgccaagagcgtggcgccgggcaacttcgagcgccactggggaatcttcaccttcgacgggcggcccaagttcccgctggacctgcgcggcgacgggcggccggcgatgcccgtcccggcccggggcgtggagtacctgccccggcggtggtgcgtcctgaaccccatcagcatggccggggacggacggctcccggacaacgtcgcgtacgcgtgctcccgcgccgactgcacggcgctaggctacgggtgcagctgcggcgcgctggacgcgcgcgggaacgcgtcgtacgccttcaacgcctattaccaggcacagggacaggtggagtcggcgtgcgacttccaggggctcgccgtcgtcgtcgacgaggacgcgtctcagggcgcctgcaacttcagcgtgcagctcgttgggtcaggggctccggtggccaccggggtcaccacgatggcggccgtactggtggctctgtttcttgtgttgatttgagctgacgcaaggtgtggtgcttgcctgcctgactggaatcctgatgactgtactgt

SEQ ID NO: 1110 - protein, 1552 aa, Zea mays
  misc_feature: PFam Name: Glyco_hydro_17; PFam Description: Glycosyl
  misc_feature: PFam Name: X8; PFam Description: X8 domain
  misc_feature: PFam Name: Peptidase_S8; PFam Description: Subtilase family
  misc_feature: PFam Name: Glutenin_hmw; PFam Description: High molecular
  misc_feature: PFam Name: HlyD; PFam Description: HlyD family secretion protein
  misc_feature: GI Number: 18483232; NR Description: 3-glucanase [Sorghum bicolor]
  misc_feature: GI Number: 46518473; NR Description: At1g64760 [Arabidopsis
  misc_feature: GI Number: 37223500; NR Description: beta-1,3-glucanase,
  misc_feature: GI Number: 48374979; NR Description: putative 3-glucanase
  misc_feature: GI Number: 50919115; NR Description: putative beta-1,3 glucanase [Oryza sativa (japonica cultivar-group)] >gi|28269434|gb|AAO37977.1| putative beta-1,3 glucanase [Oryza
GGTCGCGCACACGGAAGAGCGCGAGAGGTTCGGTTCCATGGCGGCGCCGCGCGGCCTTCTCGCCTTGTTCGCGGTGGCTGCCGCCGCTACGGCGGCGACGGGCGTGGGCGTGGACGCGCTCGGGGTGAACTGGGGCACCATGTCCGCGCGCCGGCTCCCGCCCAAGGTGATGGCGCGCCTGCTCACGGACAACGGGTTCACGAAGGTGAAGATCTTCGACGCCGACGAGCGGACCATGAAGGGCCTCGCCGGGACGAGCATCGAGACGATGGTCGCCGTGCCCAACGACATGCTCGCGGCCGTCGCCGACTACGACCGGGCCCGGCGGTGGGTTAGGGACAATGTCACCAAGTACACCTTCGACGGCGGCGTCAACATCAAGTTCGTGGCCGTCGGCAACGAGCCGTTCCTCAGGGCGTACAACGGCTCGTTCGACCACGTGACGGTGCCCGGCGCTCAGGAACATCCAGCGCGCGCTGGACGAGGCCGGGCACGGCGCGGCGGTCAAGGCAACGGTCCCCGTCAACGCGGACGTGTACGATTCGCCGGCGAGCAACCCGGTGCCGTCGGCAGGGAGGTTCCGCAGCGACGTGGCGCGGGTCATGGCGGACATGGTCCGCGTCCTCAACCGCAGCGGCGCGCCGCTCACCGTCAACATCTACCCGTTCCTCAGCCTGTACGGGAACGACGACTTCCCGCTGGACTACGCCTTCTTCGATGGCGGCGCCGGTGCGCCGGTGGTCGACGGCCGGGCCGTCTACACCAACGTGTTCGACGCCAACTTCGACACGCTGGTGTCGGCGCTCAAGAGGGTCGGGCTCGGCCACCTGCCGGTCATCATCGGCGAGGTCGGCTGGCCGACGGACGGCGACAGGCACGCCACGGCGGCCCTCGCGGAGCGCTTCTACGCGGGGCTCCTCCAGCGGCTCGCGGCCAGGAGAGGCACGCCGCTCCGGCCCGGCGCGCGCATCGAGGCCTACCTGTTCGGGCTCGTGGACGAGGACGCCAAGAGCGTGGCGCCGGGCAACTTCGAGCGCCACTGGGGAATCTTCACCTTCGACGGGCGGCCCAAGTTCCCGCTGGACCTGCGCGGCGACGGGCGGCCGGCGATGCCCGTCCCGGCCCGGGGCGTGGAGTACCTGCCCCGGCGGTGGTGCGTCCTGAACCCCATCAGCATGGCCGGGGACGGACGGCTCCCGGACAACGTCGCGTACGCGTGCTCCCGCGCCGACTGCACGGCGCTAGGCTACGGGTGCAGCTGCGGCGCGCTGGACGCGCGCGGGAACGCGTCGTACGCCTTCAACGCCTATTACCAGGCACAGGGACAGGTGGAGTCGGCGTGCGACTTCCAGGGGCTCGCCGTCGTCGTCGACGAGGACGCGTCTCAGGGCGCCTGCAACTTCAGCGTGCAGCTCGTTGGGTCAGGGGCTCCGGTGGCCACCGGGGTCACCACGATGGCGGCCGTACTGGTGGCTCTGTTTCTTGTGTTGATTTGAGCTGACGCAAGGTGTGGTGCTTGCCTGCCTGACTGGAATCCTGATGACTGTACTGT

SEQ ID NO: 1111 - DNA, 1431 bp, Zea mays
  misc_feature (1)..(1431): Ceres cDNA ID no. 12407603
  misc_feature (1)..(1431): Ceres CLONE  ID no. 313650
  misc_feature (1)..(1431): Also known as  Ceres CDNA ID no. 23782190
acacttcgatcagtgtcgccaacaagtagctagacgatgagcagaggagctgagaagaagaattggccgccgtctcggtcttcttcctcctcctcttcttcaccgacgtcgtcgtgggtcgccagcaggtccatggcggggttctaccgctacccgtcctccactcgcacctccggcaaggacagaacccagccgccgccagcaccagctgcaccgacacaacaacaaggcgacaagagcagcagcaagaagaagaggaggagtatcagcatcggccggagcatcacgtgcgcgggctccatctgcagtaccaaggagagctcggtcatgagccgggaccgccgcggcgcctccagcaggtcgctcagggcaccctacgtcgacgtcgacgtcaacgacgcctctgccgccgccatctccgccacgtcgtccttcaactcggagaccaccgtggcgtcgacgaccaccgtcacgtcctcgtcctcgtcctcgtcctcgtcctcgtccgtcgggacctccttcaggggcgtgcacatcaggaagctctccggctgctacgagtgccactccgtcttcgaccccaggagcttcggcgccgccgccttcccctgcgcggactgcgacgaggtgttcgccaaggcagagtcgctacagctccacagggcaaccaggcatgcagttttggagctgggccccgaggacacgagcaggaacatcgtggagatcatcttccagtccagctggccggccgggaagcagcagcaggcgccggtctgcaagatcgagcgggtactcaaggtgcagagcagcgacaggaccctggagaggttcgagcagtacaaggagagcgtcagggagagggcgagcagcgaccggggcaggaagaacaaccctcggtgcgtcgccgacggcaacgagctcctcaggttccactgcaccaccttcacctgctccctcggcctcgccggcagcaccgcgctgtgccgggcgccgtgcaagctgtgcgccatcgtcagggacggtttcagggtcgacgacgacggcaagattgcgacgatgggcaccagcgggcgcgcccacgacatggcgcaggtgctgtcggagtcggacggtgacaagagagcaatgctcgtgtgcagggtcgtcgcggggagggtgaagaagaaggccagcgatgagaagaagccttcagaggactctggctttgactctgtcagccccagcacagaaggcgtctgctccgatttggatcaactctttgtcttcaatcagagagctatactgccctgctttgtagtcatatacagtggctattagggttgtagggacctaagttataacttattagctagttttgtttcctttcactgtcacctgctcctttaatccagttcttcttttttttatgggccagaagtgcaagttttggcg

SEQ ID NO: 1112 - protein, 1431 aa, Zea mays
  misc_feature: PFam Name: Pyr_redox_2; PFam Description: Pyridine
  misc_feature: PFam Name: MAGE; PFam Description: MAGE family
  misc_feature: PFam Name: Pkinase; PFam Description: Protein kinase domain
  misc_feature: PFam Name: 7tm_1; PFam Description: 7 transmembrane receptor
  misc_feature: PFam Name: FH2; PFam Description: Formin Homology 2 Domain
  misc_feature: GI Number: 62701936; NR Description: Zinc finger, C2H2 type,
  misc_feature: GI Number: 5777616; NR Description: CAA30374.1 protein [Oryza
  misc_feature: GI Number: 9802582; NR Description: T2E6.3 [Arabidopsis thaliana]
  misc_feature: GI Number: 15222333; NR Description: zinc finger (C2H2 type) family protein [Arabidopsis thaliana] >gi|9369383|gb|AAF87132.1|
  misc_feature: GI Number: 52076893; NR Description: zinc finger (C2H2 type) protein-like [Oryza sativa (japonica cultivar-group)] >gi|52076647|dbj|BAD45547.1| zinc finger (C2H2 type) protein-like
ACACTTCGATCAGTGTCGCCAACAAGTAGCTAGACGATGAGCAGAGGAGCTGAGAAGAAGAATTGGCCGCCGTCTCGGTCTTCTTCCTCCTCCTCTTCTTCACCGACGTCGTCGTGGGTCGCCAGCAGGTCCATGGCGGGGTTCTACCGCTACCCGTCCTCCACTCGCACCTCCGGCAAGGACAGAACCCAGCCGCCGCCAGCACCAGCTGCACCGACACAACAACAAGGCGACAAGAGCAGCAGCAAGAAGAAGAGGAGGAGTATCAGCATCGGCCGGAGCATCACGTGCGCGGGCTCCATCTGCAGTACCAAGGAGAGCTCGGTCATGAGCCGGGACCGCCGCGGCGCCTCCAGCAGGTCGCTCAGGGCACCCTACGTCGACGTCGACGTCAACGACGCCTCTGCCGCCGCCATCTCCGCCACGTCGTCCTTCAACTCGGAGACCACCGTGGCGTCGACGACCACCGTCACGTCCTCGTCCTCGTCCTCGTCCTCGTCCTCGTCCGTCGGGACCTCCTTCAGGGGCGTGCACATCAGGAAGCTCTCCGGCTGCTACGAGTGCCACTCCGTCTTCGACCCCAGGAGCTTCGGCGCCGCCGCCTTCCCCTGCGCGGACTGCGACGAGGTGTTCGCCAAGGCAGAGTCGCTACAGCTCCACAGGGCAACCAGGCATGCAGTTTTGGAGCTGGGCCCCGAGGACACGAGCAGGAACATCGTGGAGATCATCTTCCAGTCCAGCTGGCCGGCCGGGAAGCAGCAGCAGGCGCCGGTCTGCAAGATCGAGCGGGTACTCAAGGTGCAGAGCAGCGACAGGACCCTGGAGAGGTTCGAGCAGTACAAGGAGAGCGTCAGGGAGAGGGCGAGCAGCGACCGGGGCAGGAAGAACAACCCTCGGTGCGTCGCCGACGGCAACGAGCTCCTCAGGTTCCACTGCACCACCTTCACCTGCTCCCTCGGCCTCGCCGGCAGCACCGCGCTGTGCCGGGCGCCGTGCAAGCTGTGCGCCATCGTCAGGGACGGTTTCAGGGTCGACGACGACGGCAAGATTGCGACGATGGGCACCAGCGGGCGCGCCCACGACATGGCGCAGGTGCTGTCGGAGTCGGACGGTGACAAGAGAGCAATGCTCGTGTGCAGGGTCGTCGCGGGGAGGGTGAAGAAGAAGGCCAGCGATGAGAAGAAGCCTTCAGAGGACTCTGGCTTTGACTCTGTCAGCCCCAGCACAGAAGGCGTCTGCTCCGATTTGGATCAACTCTTTGTCTTCAATCAGAGAGCTATACTGCCCTGCTTTGTAGTCATATACAGTGGCTATTAGGGTTGTAGGGACCTAAGTTATAACTTATTAGCTAGTTTTGTTTCCTTTCACTGTCACCTGCTCCTTTAATCCAGTTCTTCTTTTTTTTATGGGCCAGAAGTGCAAGTTTTGGCG

SEQ ID NO: 1113 - DNA, 1529 bp, Zea mays
  misc_feature (1)..(1529): Ceres cDNA ID no. 12407871
  misc_feature (1)..(1529): Ceres CLONE  ID no. 264450
  misc_feature (1)..(1529): Also known as  Ceres CDNA ID no. 23766518
accacacgaattgcacatctccacagctcacgattccaacactagctacatatatatgtagctttctaggctactatatacactcaccaccaagtgtgaagtgtgtatatatagtgacagctactgcaatatatacatacgcgtcacctatatattagccaagctagctatatgagcttggttgcggcgccaatggcgatcgtcgacgtggccaacgcccagctgcagcaagcagcagcagcagctgccaagaaagacgaggacggccatgagcagcaggagtcgtcctacgactacggcgcgctgatgaaaggcgtgaggcacctgtcggacagcggcattaccaggctgcccgacaggtacgtcctgcccgcgtccgaccgccccggcgtccttgccgtctcgtcgtccgtgggcgggcagcggcagggtcaagctccctgtcgtcaacctcgccggcctccgcgacccctgccagcgcgccgccgtgctggccacgctcgacgccgcgtgccgggagtacggcttctttcaggtggtaaaccacgggttcgggagcgacgtgagcggcgggatgctggacgtggcgcagcgcttcttcgagctgccgctggccgagcgagcgcggcacatgtcggcggacgtgcgggcgccggtgcgctacggcaccagcttcaaccaggccaaggacgacgtgctctgctggcgcgacttcctcaagctcgtctgccagccgctgcaggcggtgctcccgtactggccccagcagccggcggacctcagggacgtggccaccaggtacgccacggcgagccaccggctgttcatggaggtcatggaggcggcgctggaggccctgggcatccccacggccggcggcgtgctcggggagctggcagcgtcgtcgtcgcacatgatgacggtgaactgctacccggcttgcccgcagcctgagctcacgctggggatgccctcgcactcggactacggcctcttcacgttcgtcctgcaggaccacgtcgagggcctccaggtcatgcacgacggccgctggctcaccatcgaccccatcccgggatcgttcgtcgtcaacgtcggcgaccacctagagatctacagcaacgggcggtacaagagcgcgctgcaccgggtgcacgtgaactccacgcggccgcgcatctcggtggcgtcgttccacagcctgccggcggagcgagtgatcgggccggcgccggagctggtggacgacgaggccggcaacccgcggcggtacatggacaccgacttcgctaccttcctcgcctacctcgcatccgcggacggcaagaacaagaccttcctccagtcaaggaagctgcctgctgctgctcctccatgcctctagctaactagatagctgcttattaatctgacagaataaaattaatcagttcagcgcacaattccacaagcgaaaacaaacctggatttgttttaattagctctgcccttcattattacattcaagctagctcttggtcaacgcatgc

SEQ ID NO: 1114 - protein, 1529 aa, Zea mays
  misc_feature: PFam Name: 2OG-FeII_Oxy; PFam Description: 2OG-Fe(II)
  misc_feature: GI Number: 51965106; NR Description: PREDICTED P0562A06.31 gene product [Oryza sativa (japonica cultivar-group)] >gi|50948493|ref|XP_483774.1| putative iron deficiency protein Ids3 [Oryza sativa (japonica cultivar-group)] [Oryza sativa
  misc_feature: GI Number: 42569681; NR Description: oxidoreductase,
  misc_feature: GI Number: 4415914; NR Description: putative giberellin beta-hydroxylase [Arabidopsis thaliana] >gi|25285698|pir||E84783 probable giberellin beta-hydroxylase [imported] - Arabidopsis
  misc_feature: GI Number: 52076088; NR Description: putative dioxygenase
  misc_feature: GI Number: 30689834; NR Description: oxidoreductase,
ACCACACGAATTGCACATCTCCACAGCTCACGATTCCAACACTAGCTACATATATATGTAGCTTTCTAGGCTACTATATACACTCACCACCAAGTGTGAAGTGTGTATATATAGTGACAGCTACTGCAATATATACATACGCGTCACCTATATATTAGCCAAGCTAGCTATATGAGCTTGGTTGCGGCGCCAATGGCGATCGTCGACGTGGCCAACGCCCAGCTGCAGCAAGCAGCAGCAGCAGCTGCCAAGAAAGACGAGGACGGCCATGAGCAGCAGGAGTCGTCCTACGACTACGGCGCGCTGATGAAAGGCGTGAGGCACCTGTCGGACAGCGGCATTACCAGGCTGCCCGACAGGTACGTCCTGCCCGCGTCCGACCGCCCCGGCGTCCTTGCCGTCTCGTCGTCCGTGGGCGGGCAGCGGCAGGGTCAAGCTCCCTGTCGTCAACCTCGCCGGCCTCCGCGACCCCTGCCAGCGCGCCGCCGTGCTGGCCACGCTCGACGCCGCGTGCCGGGAGTACGGCTTCTTTCAGGTGGTAAACCACGGGTTCGGGAGCGACGTGAGCGGCGGGATGCTGGACGTGGCGCAGCGCTTCTTCGAGCTGCCGCTGGCCGAGCGAGCGCGGCACATGTCGGCGGACGTGCGGGCGCCGGTGCGCTACGGCACCAGCTTCAACCAGGCCAAGGACGACGTGCTCTGCTGGCGCGACTTCCTCAAGCTCGTCTGCCAGCCGCTGCAGGCGGTGCTCCCGTACTGGCCCCAGCAGCCGGCGGACCTCAGGGACGTGGCCACCAGGTACGCCACGGCGAGCCACCGGCTGTTCATGGAGGTCATGGAGGCGGCGCTGGAGGCCCTGGGCATCCCCACGGCCGGCGGCGTGCTCGGGGAGCTGGCAGCGTCGTCGTCGCACATGATGACGGTGAACTGCTACCCGGCTTGCCCGCAGCCTGAGCTCACGCTGGGGATGCCCTCGCACTCGGACTACGGCCTCTTCACGTTCGTCCTGCAGGACCACGTCGAGGGCCTCCAGGTCATGCACGACGGCCGCTGGCTCACCATCGACCCCATCCCGGGATCGTTCGTCGTCAACGTCGGCGACCACCTAGAGATCTACAGCAACGGGCGGTACAAGAGCGCGCTGCACCGGGTGCACGTGAACTCCACGCGGCCGCGCATCTCGGTGGCGTCGTTCCACAGCCTGCCGGCGGAGCGAGTGATCGGGCCGGCGCCGGAGCTGGTGGACGACGAGGCCGGCAACCCGCGGCGGTACATGGACACCGACTTCGCTACCTTCCTCGCCTACCTCGCATCCGCGGACGGCAAGAACAAGACCTTCCTCCAGTCAAGGAAGCTGCCTGCTGCTGCTCCTCCATGCCTCTAGCTAACTAGATAGCTGCTTATTAATCTGACAGAATAAAATTAATCAGTTCAGCGCACAATTCCACAAGCGAAAACAAACCTGGATTTGTTTTAATTAGCTCTGCCCTTCATTATTACATTCAAGCTAGCTCTTGGTCAACGCATGC

SEQ ID NO: 1115 - DNA, 1464 bp, Zea mays
  misc_feature (1)..(1464): Ceres cDNA ID no. 12408236
  misc_feature (1)..(1464): Ceres CLONE  ID no. 260621
  misc_feature (1)..(1464): Also known as  Ceres CDNA ID no. 23760157
acagtttccctcgcatcctcctcctacatctatctcccacctcgcacaatcacagattcctgattcctcaatcctcagtaccccgctgcctgtcctccacgcacctcaccgcaaacatggcgaacgccgccgacgacctggacctcctgctatcactaggcgaggccgtcccggagacacctcccgcctccccccgcaccgccgatgtccccgtgtgcgacggcgctttcacaccaccaaggacggctccccccggcggcaccgacatgtccgttttccgcgacgccgtcaaggattacctcgaggcggcccccgaaaccacctccccgcttgctaatcgccccaagcgacccaaggccaccgaaatcctcgtcgacaaatactccggcctccgcatcaagcaccttacgctctcgcctcttgagattagcaaccgcttcgctgacatccgatttgtgcgcatcaccgcgttaaagaactctgtggggagcgacaggttctccggctgttgggcaaccgcgggcgtgttactggacaagggcgtgcagcgggtgagtgcgaaggggagcagctacagcatctggaagatgggcgctctggacgagaccgacgtatctctgttcctgtttggggacgcgcacgttcactactccggagctgctgtgggttcagtgttcgctgtgttcaatggcaatgtccgcatggacaatgggggcaaagggttctctatgagtgttgcttctgttggacagatgttgaagatgggggtcgcatcagattttggtctctgcaaaggcaagaggaaagacggggtggcttgcaccatggctataaataagagtaaaggatcatactgcaaatttcattcgtcgaaaacatcacaaaagtatactactggcagagtagagcttaagggcggaaatttcaaatttgcttccaaacttcgatctgaagggatttacatggtcaatccttcctcagaacgacccaatccaagaaattctttgcaaccggtgaaagtaatgtcaattgatgggctaaaaagggctttaagcaatgcagatagagtgactaataagaaccagtcccagggtataagatttctttcccatgttacagctaatatggacaatatggtaccaaaagccccaaccaccggctctaggaatcaacagagatcgaaggccggcttaaacaaaagtttgtcatcatctggcgccaaagccttgcccaaggagggattgcgaaaaccacaacaggatgttaaaaggcaaaagatgaacaatcctacagagaatattgttgagcttgatgcggtcagctcagacgatgacgagataaatatagtactgcgacgctgatgcttcatcaataatagcgtgacatgtaattgtactccaaatcggctaaacaattgtacgctcttgttttcatatatcccaagtcatccgaggcagaaaaatt

SEQ ID NO: 1116 - protein, 1464 aa, Zea mays
  misc_feature: PFam Name: FH2; PFam Description: Formin Homology 2 Domain
  misc_feature: GI Number: 52076055; NR Description: minichromosome maintenance protein 10 isoform 1 -like [Oryza sativa (japonica
  misc_feature: GI Number: 63101617; NR Description: Mcm10 protein [Mus musculus]
  misc_feature: GI Number: 61813627; NR Description: PREDICTED: similar to minichromosome maintenance protein 10 isoform 2, partial [Bos
  misc_feature: GI Number: 47125104; NR Description: LOC398196 protein [Xenopus laevis] >gi|11276023|gb|AAG33858.1| Mcm10p [Xenopus
  misc_feature: GI Number: 58701913; NR Description: Unknown (protein for
ACAGTTTCCCTCGCATCCTCCTCCTACATCTATCTCCCACCTCGCACAATCACAGATTCCTGATTCCTCAATCCTCAGTACCCCGCTGCCTGTCCTCCACGCACCTCACCGCAAACATGGCGAACGCCGCCGACGACCTGGACCTCCTGCTATCACTAGGCGAGGCCGTCCCGGAGACACCTCCCGCCTCCCCCCGCACCGCCGATGTCCCCGTGTGCGACGGCGCTTTCACACCACCAAGGACGGCTCCCCCCGGCGGCACCGACATGTCCGTTTTCCGCGACGCCGTCAAGGATTACCTCGAGGCGGCCCCCGAAACCACCTCCCCGCTTGCTAATCGCCCCAAGCGACCCAAGGCCACCGAAATCCTCGTCGACAAATACTCCGGCCTCCGCATCAAGCACCTTACGCTCTCGCCTCTTGAGATTAGCAACCGCTTCGCTGACATCCGATTTGTGCGCATCACCGCGTTAAAGAACTCTGTGGGGAGCGACAGGTTCTCCGGCTGTTGGGCAACCGCGGGCGTGTTACTGGACAAGGGCGTGCAGCGGGTGAGTGCGAAGGGGAGCAGCTACAGCATCTGGAAGATGGGCGCTCTGGACGAGACCGACGTATCTCTGTTCCTGTTTGGGGACGCGCACGTTCACTACTCCGGAGCTGCTGTGGGTTCAGTGTTCGCTGTGTTCAATGGCAATGTCCGCATGGACAATGGGGGCAAAGGGTTCTCTATGAGTGTTGCTTCTGTTGGACAGATGTTGAAGATGGGGGTCGCATCAGATTTTGGTCTCTGCAAAGGCAAGAGGAAAGACGGGGTGGCTTGCACCATGGCTATAAATAAGAGTAAAGGATCATACTGCAAATTTCATTCGTCGAAAACATCACAAAAGTATACTACTGGCAGAGTAGAGCTTAAGGGCGGAAATTTCAAATTTGCTTCCAAACTTCGATCTGAAGGGATTTACATGGTCAATCCTTCCTCAGAACGACCCAATCCAAGAAATTCTTTGCAACCGGTGAAAGTAATGTCAATTGATGGGCTAAAAAGGGCTTTAAGCAATGCAGATAGAGTGACTAATAAGAACCAGTCCCAGGGTATAAGATTTCTTTCCCATGTTACAGCTAATATGGACAATATGGTACCAAAAGCCCCAACCACCGGCTCTAGGAATCAACAGAGATCGAAGGCCGGCTTAAACAAAAGTTTGTCATCATCTGGCGCCAAAGCCTTGCCCAAGGAGGGATTGCGAAAACCACAACAGGATGTTAAAAGGCAAAAGATGAACAATCCTACAGAGAATATTGTTGAGCTTGATGCGGTCAGCTCAGACGATGACGAGATAAATATAGTACTGCGACGCTGATGCTTCATCAATAATAGCGTGACATGTAATTGTACTCCAAATCGGCTAAACAATTGTACGCTCTTGTTTTCATATATCCCAAGTCATCCGAGGCAGAAAAATT

SEQ ID NO: 1117 - DNA, 1577 bp, Zea mays
  misc_feature (1)..(1577): Ceres cDNA ID no. 12408300
  misc_feature (1)..(1577): Ceres CLONE  ID no. 230135
  misc_feature (1)..(1577): Also known as  Ceres CDNA ID no. 23777703
ataggaacacacgaatacgcgaccacacgttcacctcggccatgatccaccaacacagcagctccctccctgaaatctcattcccatgaatttccacacggccagcttctgcgcttccgcggcgataggcctcccaacagcccccaaaatatcggcttcgttggctactggtcgctttgcctgccgcagtgagagatgtctggagacctggaccttcagatctcctgctatctgccttcttgctgctacccccacacgctgcaccctcacagacaccatggatccgagctccgacatcatactcgacactccgttcttccgcatctacagcgaccgccgcatcgaccgcttggtcgggcaccgataccgtgccggccggctttgatcccgccaccggcgtcacctccaaagatgtcgttttagacagcaactccggcctctacgttcgcctgtacctcccggacacggctaccgggtctgaccactactccaagaaattccccgtgctagtctacttccacggcggcggctttgtcacccactcggcagcgtctccgccctatcagcccttcctcaacacccttgccgcgaaggccggcttgctcatcgtctccgtgaactaccgcctcgcgccagagcacccgcttccggcaggttacgaggactccttccgcgcgctcaagtgggcggcctctggaagcggggacccctggctatcacatcacggcgacctgggccgcatcttcctggccggggacagctccggcgggaactttgtccacaacgtcgctatgatggccgccgcgtcagagttgcaaatcgagggcgcggtcctcctgcacgccgggttcgctggcaagcagcgcatcgacggagagaaaccagagtcagtggcgctgacgcagaagctgtgggggatcgtgtgccccgaggcgacggacggcgtggacgacccgcggatgaaccccttggccgccgcggcgcccagcctgcgaaacctgccgtgcgagagggtgctcgtctgcgcggcagagctggactcgctgcgggcgaggaacagggcgtactacgacgccctcgcggcaagcgggtggggtggcacggtggagtggctcgagtctaagggcaagcagcacgccttcttcctctacgactccggctgcggcgaggccgtggagctcatggatcgactggtcgcgttctttgctgggaacttgaattcgtcatgtgtggatgtgaccacacatcacacgaccacatccggtgagaccctgagatgaatggaacaaacgaagatgcagctcattgctcaatcgaaataactgagctcagtcctcaaaacaatgaaaaaagaggaagaacagctgagatcggatccttgtactgatcagtttatgttatcgcttgggtcatcaatttctactagttgtgtgcccgtgcgttgcaacggaaacatataataccattgatagcttatgtacgttgggatgaacatcgacatatatctgaccggatcttcttcttccttggggatctggagaaaagcctgttcgaaagccaaacatgttaagacctgt

SEQ ID NO: 1118 - protein, 1577 aa, Zea mays
  misc_feature: PFam Name: Abhydrolase_3; PFam Description: alpha/beta
  misc_feature: PFam Name: COesterase; PFam Description: Carboxylesterase
  misc_feature: GI Number: 51535280; NR Description: putative PrMC3 [Oryza
  misc_feature: GI Number: 51535273; NR Description: putative PrMC3 [Oryza
  misc_feature: GI Number: 51535271; NR Description: putative PrMC3 [Oryza
  misc_feature: GI Number: 51535268; NR Description: putative PrMC3 [Oryza
  misc_feature: GI Number: 51536295; NR Description: putative PrMC3 [Oryza sativa (japonica cultivar-group)] >gi|51535241|dbj|BAD38290.1|
ATAGGAACACACGAATACGCGACCACACGTTCACCTCGGCCATGATCCACCAACACAGCAGCTCCCTCCCTGAAATCTCATTCCCATGAATTTCCACACGGCCAGCTTCTGCGCTTCCGCGGCGATAGGCCTCCCAACAGCCCCCAAAATATCGGCTTCGTTGGCTACTGGTCGCTTTGCCTGCCGCAGTGAGAGATGTCTGGAGACCTGGACCTTCAGATCTCCTGCTATCTGCCTTCTTGCTGCTACCCCCACACGCTGCACCCTCACAGACACCATGGATCCGAGCTCCGACATCATACTCGACACTCCGTTCTTCCGCATCTACAGCGACCGCCGCATCGACCGCTTGGTCGGGCACCGATACCGTGCCGGCCGGCTTTGATCCCGCCACCGGCGTCACCTCCAAAGATGTCGTTTTAGACAGCAACTCCGGCCTCTACGTTCGCCTGTACCTCCCGGACACGGCTACCGGGTCTGACCACTACTCCAAGAAATTCCCCGTGCTAGTCTACTTCCACGGCGGCGGCTTTGTCACCCACTCGGCAGCGTCTCCGCCCTATCAGCCCTTCCTCAACACCCTTGCCGCGAAGGCCGGCTTGCTCATCGTCTCCGTGAACTACCGCCTCGCGCCAGAGCACCCGCTTCCGGCAGGTTACGAGGACTCCTTCCGCGCGCTCAAGTGGGCGGCCTCTGGAAGCGGGGACCCCTGGCTATCACATCACGGCGACCTGGGCCGCATCTTCCTGGCCGGGGACAGCTCCGGCGGGAACTTTGTCCACAACGTCGCTATGATGGCCGCCGCGTCAGAGTTGCAAATCGAGGGCGCGGTCCTCCTGCACGCCGGGTTCGCTGGCAAGCAGCGCATCGACGGAGAGAAACCAGAGTCAGTGGCGCTGACGCAGAAGCTGTGGGGGATCGTGTGCCCCGAGGCGACGGACGGCGTGGACGACCCGCGGATGAACCCCTTGGCCGCCGCGGCGCCCAGCCTGCGAAACCTGCCGTGCGAGAGGGTGCTCGTCTGCGCGGCAGAGCTGGACTCGCTGCGGGCGAGGAACAGGGCGTACTACGACGCCCTCGCGGCAAGCGGGTGGGGTGGCACGGTGGAGTGGCTCGAGTCTAAGGGCAAGCAGCACGCCTTCTTCCTCTACGACTCCGGCTGCGGCGAGGCCGTGGAGCTCATGGATCGACTGGTCGCGTTCTTTGCTGGGAACTTGAATTCGTCATGTGTGGATGTGACCACACATCACACGACCACATCCGGTGAGACCCTGAGATGAATGGAACAAACGAAGATGCAGCTCATTGCTCAATCGAAATAACTGAGCTCAGTCCTCAAAACAATGAAAAAAGAGGAAGAACAGCTGAGATCGGATCCTTGTACTGATCAGTTTATGTTATCGCTTGGGTCATCAATTTCTACTAGTTGTGTGCCCGTGCGTTGCAACGGAAACATATAATACCATTGATAGCTTATGTACGTTGGGATGAACATCGACATATATCTGACCGGATCTTCTTCTTCCTTGGGGATCTGGAGAAAAGCCTGTTCGAAAGCCAAACATGTTAAGACCTGT

SEQ ID NO: 1119 - DNA, 1511 bp, Zea mays
  misc_feature (1)..(1511): Ceres cDNA ID no. 12408397
  misc_feature (1)..(1511): Ceres CLONE  ID no. 306366
  misc_feature (1)..(1511): Also known as  Ceres CDNA ID no. 24262825
  misc_feature (1063)..(1063): n is a, c, t, g, unknown, or other
  misc_feature (1078)..(1078): n is a, c, t, g, unknown, or other
  misc_feature (1089)..(1089): n is a, c, t, g, unknown, or other
  misc_feature (1134)..(1134): n is a, c, t, g, unknown, or other
  misc_feature (1136)..(1136): n is a, c, t, g, unknown, or other
cctgcccgcagctgagctcccccatagttactagctagcttatattgcatatctcctccccctcctccgtcctcgctagctcgtgttcttcttcctctcatcttttgcttgtcctccattccatcgatctcctattcctgtgccgaccgcgaggccatcgtcaaagagaaacacagagcgggtcggggactctcggggagtcgggggaggctgctagtgctagctagctcgaccatatacagtttgtgggcgcggccgggcgggcaacaagctgctaaggtaccagcataccacccatctccatggctttcctggtggagcggtgcggcgagatggtggtgtcgatggagagcccgcacgcgaaccggtgccggcgccgttcctgaccaagacgtaccagctggtggacgacccctgcaccgaccacttcgtgtcgtggggcgacgacgacaccaccttcgtcgtgtggcgcccgcccgagttcgcccgcgacctcctcccaaactacttcaagcacaacaacttctccagcttcgtcaggcagctcaacacctatggcttcaggaagatagtggcggacaggtgggagttcgccaacgagttcttcaggaagggcgccaagcacctcctcgccgagatccaccggaggaagtcgtcgcagccgctgccgacgccgctgccgccgcaccagccctaccaccaccaccaccaccatctccaccaccacctcagcccgttctccccgccgccgctggcacagccggtgccgtcgtaccaccaccaccacttccaagaagagcccatcgccaccgccaccgcgccgcacggcggtgctcaagccgccgccgccggcggcaacaatgaaggcagcggcgccggctccggcggggactttctggccgcgctgtcggaggacaaccggcagctgtggcggcgcaactcgctgctgctgtcggagctggcgcacatgaagaagctctacaacgacatcatctacttcctgcagaaccacgtggccccggtgacgagcccctcgtcggcggcgcacgcgtccctgcccaangcgccggcggcggcngcgccgcggcntcctcctgcaggctaatggagctggacccggcggactccccatcncnccgccgcggcggccggaggcggacgacggcacggacacggtgaagctgttcggcgtggccctgcagggcaagaagaagaagcgggcgcaccaggaggatggggacgacggcaaccatgagcagggaagcagcgacgtctagccgccggccggcttgcattgctagctctctcgttcgtgtacatacagagatcagatcagagagtagtagtttgcctcgctagctaggctaggctaggctttggtaattttcttctgagtgcgtactgaaattaatgtgcaagagcgaagtgtttgtctgagtaaaactaacaagaatctacggatgcgtgcatggaagctaagctagatgcagaggcttgcaccaccttctctt

SEQ ID NO: 1120 - protein, 1511 aa, Zea mays
  misc_feature: PFam Name: HSF_DNA-bind; PFam Description: HSF-type DNA-binding
  misc_feature: PFam Name: Drf_FH1; PFam Description: Formin Homology Region 1
  misc_feature: PFam Name: FH2; PFam Description: Formin Homology 2 Domain
  misc_feature: PFam Name: Mucin; PFam Description: Mucin-like glycoprotein
  misc_feature: PFam Name: Endostatin; PFam Description: Collagenase NC10
  misc_feature: GI Number: 671868; NR Description: heat shock transcription factor 5 [Glycine max] >gi|2129832|pir||S59539 heat shock
  misc_feature: GI Number: 12321016; NR Description: heat shock transcription factor, putative [Arabidopsis thaliana] >gi|15220101|ref|NP_175142.1| heat shock transcription factor family protein [Arabidopsis thaliana] >gi|25296103|pir||C96511
  misc_feature: GI Number: 51535228; NR Description: putative heat shock
  misc_feature: GI Number: 50946723; NR Description: putative heat shock transcription factor [Oryza sativa (japonica cultivar-group)] >gi|42408639|dbj|BAD09860.1| putative heat shock transcription
  misc_feature: GI Number: 50939533; NR Description: heat shock transcription factor -like protein [Oryza sativa (japonica cultivar-group)] >gi|33146639|dbj|BAC79969.1| heat shock transcription factor -like protein [Oryza sativa (japonica cultivar-group)]
CCTGCCCGCAGCTGAGCTCCCCCATAGTTACTAGCTAGCTTATATTGCATATCTCCTCCCCCTCCTCCGTCCTCGCTAGCTCGTGTTCTTCTTCCTCTCATCTTTTGCTTGTCCTCCATTCCATCGATCTCCTATTCCTGTGCCGACCGCGAGGCCATCGTCAAAGAGAAACACAGAGCGGGTCGGGGACTCTCGGGGAGTCGGGGGAGGCTGCTAGTGCTAGCTAGCTCGACCATATACAGTTTGTGGGCGCGGCCGGGCGGGCAACAAGCTGCTAAGGTACCAGCATACCACCCATCTCCATGGCTTTCCTGGTGGAGCGGTGCGGCGAGATGGTGGTGTCGATGGAGAGCCCGCACGCGAACCGGTGCCGGCGCCGTTCCTGACCAAGACGTACCAGCTGGTGGACGACCCCTGCACCGACCACTTCGTGTCGTGGGGCGACGACGACACCACCTTCGTCGTGTGGCGCCCGCCCGAGTTCGCCCGCGACCTCCTCCCAAACTACTTCAAGCACAACAACTTCTCCAGCTTCGTCAGGCAGCTCAACACCTATGGCTTCAGGAAGATAGTGGCGGACAGGTGGGAGTTCGCCAACGAGTTCTTCAGGAAGGGCGCCAAGCACCTCCTCGCCGAGATCCACCGGAGGAAGTCGTCGCAGCCGCTGCCGACGCCGCTGCCGCCGCACCAGCCCTACCACCACCACCACCACCATCTCCACCACCACCTCAGCCCGTTCTCCCCGCCGCCGCTGGCACAGCCGGTGCCGTCGTACCACCACCACCACTTCCAAGAAGAGCCCATCGCCACCGCCACCGCGCCGCACGGCGGTGCTCAAGCCGCCGCCGCCGGCGGCAACAATGAAGGCAGCGGCGCCGGCTCCGGCGGGGACTTTCTGGCCGCGCTGTCGGAGGACAACCGGCAGCTGTGGCGGCGCAACTCGCTGCTGCTGTCGGAGCTGGCGCACATGAAGAAGCTCTACAACGACATCATCTACTTCCTGCAGAACCACGTGGCCCCGGTGACGAGCCCCTCGTCGGCGGCGCACGCGTCCCTGCCCAANGCGCCGGCGGCGGCNGCGCCGCGGCNTCCTCCTGCAGGCTAATGGAGCTGGACCCGGCGGACTCCCCATCNCNCCGCCGCGGCGGCCGGAGGCGGACGACGGCACGGACACGGTGAAGCTGTTCGGCGTGGCCCTGCAGGGCAAGAAGAAGAAGCGGGCGCACCAGGAGGATGGGGACGACGGCAACCATGAGCAGGGAAGCAGCGACGTCTAGCCGCCGGCCGGCTTGCATTGCTAGCTCTCTCGTTCGTGTACATACAGAGATCAGATCAGAGAGTAGTAGTTTGCCTCGCTAGCTAGGCTAGGCTAGGCTTTGGTAATTTTCTTCTGAGTGCGTACTGAAATTAATGTGCAAGAGCGAAGTGTTTGTCTGAGTAAAACTAACAAGAATCTACGGATGCGTGCATGGAAGCTAAGCTAGATGCAGAGGCTTGCACCACCTTCTCTT

SEQ ID NO: 1121 - DNA, 1108 bp, Zea mays
  misc_feature (1)..(1108): Ceres cDNA ID no. 12408505
  misc_feature (1)..(1108): Ceres CLONE  ID no. 305418
  misc_feature (1)..(1108): Also known as  Ceres CDNA ID no. 23761391
atatctatatctgtagagtgtagactagacggcacgcttggtgttggtggacttgtgctctaggacgaacagcttcatctcctcaacgaacttgccggagtcggtgagctccgggaacacgtggaagccatggacggcgtcagggtactcgaccacccacaccggcttccccttcccgcgcagcgcctccacgtacctggcctgccagtccttgagcaggtcgaagccgccgaccaccaccatcgcgggcgggaacgcgtcggcgagcttgacgccctcgccgcacacgcgcgcggcctcgtggtcccgtgtggcgccctccggcaggaactccttccagaagtggtccgtcgccgccaccgacagcgcggacgccccgtccagcgccacctcggccgccgtccgctcctccccgccgaagaacggctggatcaagacggcgccggcgacgcggaggttcgtgggcgacgccgcggccaccgcccatcgctgtgccacgtggtgcgtgatgttgccgcccgcgctgtctccggcgaggaagcagctggagaggtcgacggggacgtgcgccggcagggagtcggcgttggcgtcgaggtagcggagcgccgcgacgccgtcgtcgtacgccgcggggaaccggtgcccgggggccaggcggtagttgacggacacgacgacggcgcggaggccgcggcagagccgccggcagaaggcgtcgtaggggcgagacgccgcggagaagagcacgaacccgccgctgtggaagtagacgacgacgggaacgggtgccgccgcggcgtccgcgtccgcgtccgcgccggacgagggggagaagacgcgcgcccacaggccgcgggaggcgtcgatggtgacgtccgcggagcgcacccccgaggcacccgggcgagacgtggtgccagacttgaggtcgccgagggagaagaggaggcgccggatgttggcgccgaccgccggaatggctgtgtcgacggcgagctctgaagtttaggtgacaactgaacaagcgataagatgtggcgctgcctaaaaccgtcgcagctttttctggtctttcttgttacttatttgcggtgcttacatggtc

SEQ ID NO: 1122 - protein, 1108 aa, Zea mays
  misc_feature: PFam Name: FH2; PFam Description: Formin Homology 2 Domain
  misc_feature: PFam Name: TT_ORF1; PFam Description: TT viral orf 1
  misc_feature: PFam Name: Peptidase_S8; PFam Description: Subtilase family
  misc_feature: PFam Name: Aldedh; PFam Description: Aldehyde dehydrogenase family
  misc_feature: PFam Name: Pyr_redox_2; PFam Description: Pyridine
  misc_feature: GI Number: 66776896; NR Description: LigA [Anaeromyxobacter dehalogenans 2CP-C] >gi|66857361|ref|ZP_00401413.1| LigA
  misc_feature: GI Number: 53767310; NR Description: COG1309: Transcriptional
  misc_feature: GI Number: 66776103; NR Description: LigA [Anaeromyxobacter dehalogenans 2CP-C] >gi|66858140|ref|ZP_00402169.1| LigA
  misc_feature: GI Number: 5821145; NR Description: RNA binding protein [Homo
  misc_feature: GI Number: 47124032; NR Description: SRRM2 protein [Homo sapiens]
ATATCTATATCTGTAGAGTGTAGACTAGACGGCACGCTTGGTGTTGGTGGACTTGTGCTCTAGGACGAACAGCTTCATCTCCTCAACGAACTTGCCGGAGTCGGTGAGCTCCGGGAACACGTGGAAGCCATGGACGGCGTCAGGGTACTCGACCACCCACACCGGCTTCCCCTTCCCGCGCAGCGCCTCCACGTACCTGGCCTGCCAGTCCTTGAGCAGGTCGAAGCCGCCGACCACCACCATCGCGGGCGGGAACGCGTCGGCGAGCTTGACGCCCTCGCCGCACACGCGCGCGGCCTCGTGGTCCCGTGTGGCGCCCTCCGGCAGGAACTCCTTCCAGAAGTGGTCCGTCGCCGCCACCGACAGCGCGGACGCCCCGTCCAGCGCCACCTCGGCCGCCGTCCGCTCCTCCCCGCCGAAGAACGGCTGGATCAAGACGGCGCCGGCGACGCGGAGGTTCGTGGGCGACGCCGCGGCCACCGCCCATCGCTGTGCCACGTGGTGCGTGATGTTGCCGCCCGCGCTGTCTCCGGCGAGGAAGCAGCTGGAGAGGTCGACGGGGACGTGCGCCGGCAGGGAGTCGGCGTTGGCGTCGAGGTAGCGGAGCGCCGCGACGCCGTCGTCGTACGCCGCGGGGAACCGGTGCCCGGGGGCCAGGCGGTAGTTGACGGACACGACGACGGCGCGGAGGCCGCGGCAGAGCCGCCGGCAGAAGGCGTCGTAGGGGCGAGACGCCGCGGAGAAGAGCACGAACCCGCCGCTGTGGAAGTAGACGACGACGGGAACGGGTGCCGCCGCGGCGTCCGCGTCCGCGTCCGCGCCGGACGAGGGGGAGAAGACGCGCGCCCACAGGCCGCGGGAGGCGTCGATGGTGACGTCCGCGGAGCGCACCCCCGAGGCACCCGGGCGAGACGTGGTGCCAGACTTGAGGTCGCCGAGGGAGAAGAGGAGGCGCCGGATGTTGGCGCCGACCGCCGGAATGGCTGTGTCGACGGCGAGCTCTGAAGTTTAGGTGACAACTGAACAAGCGATAAGATGTGGCGCTGCCTAAAACCGTCGCAGCTTTTTCTGGTCTTTCTTGTTACTTATTTGCGGTGCTTACATGGTC

SEQ ID NO: 1123 - DNA, 1285 bp, Zea mays
  misc_feature (1)..(1285): Ceres cDNA ID no. 12408603
  misc_feature (1)..(1285): Ceres CLONE  ID no. 302726
  misc_feature (1)..(1285): Also known as  Ceres CDNA ID no. 23768125
aactagacggaccagaggacgctgccacactatagatcccgtgcttggctgtacaagaacaaccgcactgatgctaccgaccactggtgtccgattaagcagctcatttctaagaagccgacccaggccagccgatatcgagcaccaacgacacaccccattgacgtacagctatgatgcggccgacgtcgacccttgctatggtcgtgccgtcgctcgctgtagccatcctctgcatcctagtccggtccgcctccgcggagttctggctcgacgagttcaccacggacggcgacgtccgcagagactacgaccgttctggccggcaggtggcgtcgcttgtcctcgaccagcgttctggcgctggcttcaactccacgcgcaagtacctcttcggcgagttcagcgtggagatgaagctcgtcggcggcaactccgctgggactgtcacctccttctacctgacgtccggcgagggcgacgagcacgacgagatcgacatggagttcatgggcaactccagcggctccccgacggtgctcaacacgaacgtgtgggccaacggcgacggcaagaaggagcaccagttctacctgtggttcgacccggccgccgacttccacaaatacaagatcgtctggaacgacaagaacatcatcttccaggtggacgacgtgacggtgcgcgtcttcaagcgctacgatgacctgccgtacccggacgccaagcccatggcggtgcacgccacgctgtgggacggcagctactgggccacgcgcaagggcgaggtcaagatcgactggtccagcgcgcccttcgtcgtctcctaccgagactacaccgccaacgcctgcgccgtcgacggccggaacggcggcggcagctcgtcgtgccccgccggtgccaacgagtggatggacaggcagtccgacgacaccgaccgtctcaccgtggcttgggcgcgccggaactgcttgcagtacaactactgcgatgacgggtggcgcttcccgcaggggttccccggagagtgcgcccgcaactgatccaccatctgccctgcagtcgcgagtctccaagtctcgccggcctcatcgcatcctcttaccgcagatataggcatactagatcgagttcattcttggattttatgttcttgtaattgtcttattgtacgtacgtacatcgtctcttccgactcacaaagagcccagcagcgtgcgtcctggatctggatgcatatcgaaggtactagttctgtgacttctaaaagatctttttttct

SEQ ID NO: 1124 - protein, 1285 aa, Zea mays
  misc_feature: PFam Name: Glyco_hydro_16; PFam Description: Glycosyl
  misc_feature: PFam Name: XET_C; PFam Description: Xyloglucan
  misc_feature: PFam Name: Mucin; PFam Description: Mucin-like glycoprotein
  misc_feature: PFam Name: Pkinase; PFam Description: Protein kinase domain
  misc_feature: PFam Name: Syndecan; PFam Description: Syndecan domain
  misc_feature: GI Number: 51964776; NR Description: PREDICTED P0682A06.17 gene product [Oryza sativa (japonica cultivar-group)] >gi|50942681|ref|XP_480868.1| putative end-xyloglucan transferase [Oryza sativa (japonica cultivar-group)] [Oryza sativa (japonica
  misc_feature: GI Number: 51039056; NR Description:
  misc_feature: GI Number: 51039058; NR Description:
  misc_feature: GI Number: 1890573; NR Description: xyloglucan endotransglycosylase (XET) [Hordeum vulgare subsp. vulgare] >gi|7447410|pir||T06200 xyloglucan endo-1,4-beta-D-glucanase (EC
  misc_feature: GI Number: 51039060; NR Description:
AACTAGACGGACCAGAGGACGCTGCCACACTATAGATCCCGTGCTTGGCTGTACAAGAACAACCGCACTGATGCTACCGACCACTGGTGTCCGATTAAGCAGCTCATTTCTAAGAAGCCGACCCAGGCCAGCCGATATCGAGCACCAACGACACACCCCATTGACGTACAGCTATGATGCGGCCGACGTCGACCCTTGCTATGGTCGTGCCGTCGCTCGCTGTAGCCATCCTCTGCATCCTAGTCCGGTCCGCCTCCGCGGAGTTCTGGCTCGACGAGTTCACCACGGACGGCGACGTCCGCAGAGACTACGACCGTTCTGGCCGGCAGGTGGCGTCGCTTGTCCTCGACCAGCGTTCTGGCGCTGGCTTCAACTCCACGCGCAAGTACCTCTTCGGCGAGTTCAGCGTGGAGATGAAGCTCGTCGGCGGCAACTCCGCTGGGACTGTCACCTCCTTCTACCTGACGTCCGGCGAGGGCGACGAGCACGACGAGATCGACATGGAGTTCATGGGCAACTCCAGCGGCTCCCCGACGGTGCTCAACACGAACGTGTGGGCCAACGGCGACGGCAAGAAGGAGCACCAGTTCTACCTGTGGTTCGACCCGGCCGCCGACTTCCACAAATACAAGATCGTCTGGAACGACAAGAACATCATCTTCCAGGTGGACGACGTGACGGTGCGCGTCTTCAAGCGCTACGATGACCTGCCGTACCCGGACGCCAAGCCCATGGCGGTGCACGCCACGCTGTGGGACGGCAGCTACTGGGCCACGCGCAAGGGCGAGGTCAAGATCGACTGGTCCAGCGCGCCCTTCGTCGTCTCCTACCGAGACTACACCGCCAACGCCTGCGCCGTCGACGGCCGGAACGGCGGCGGCAGCTCGTCGTGCCCCGCCGGTGCCAACGAGTGGATGGACAGGCAGTCCGACGACACCGACCGTCTCACCGTGGCTTGGGCGCGCCGGAACTGCTTGCAGTACAACTACTGCGATGACGGGTGGCGCTTCCCGCAGGGGTTCCCCGGAGAGTGCGCCCGCAACTGATCCACCATCTGCCCTGCAGTCGCGAGTCTCCAAGTCTCGCCGGCCTCATCGCATCCTCTTACCGCAGATATAGGCATACTAGATCGAGTTCATTCTTGGATTTTATGTTCTTGTAATTGTCTTATTGTACGTACGTACATCGTCTCTTCCGACTCACAAAGAGCCCAGCAGCGTGCGTCCTGGATCTGGATGCATATCGAAGGTACTAGTTCTGTGACTTCTAAAAGATCTTTTTTTCT

SEQ ID NO: 1125 - DNA, 1259 bp, Zea mays
  misc_feature (1)..(1259): Ceres cDNA ID no. 12408752
  misc_feature (1)..(1259): Ceres CLONE  ID no. 298326
  misc_feature (1)..(1259): Also known as  Ceres CDNA ID no. 23777324
aacacacaatgccatcacgaatgtggaacctcaacaaagccctggtcacctcactactctgcatctcggcgttgtcgtcgtcgccatggccatgcacggcagccggtcagctgggcggtaagcccctggtcaccgccgtcaccaaggacgcgtccacctccctctacacggcgccgctcaaggacggccacccgctcgtcctcgacctcagtagcccggtcatctcgctggccacgtgcgcctcctccaagaacaataacaacggcacgctcaccgccacgctatccgccaacgccaccgacggccagaacccgctgttcccggtctccttctcggcggtggccacgtgcgcgccgtcgtcgaggctgcccgccggcgccgtcggcgtcgcggggctcgcgccctcctccagcagccagcagtcgctcccggcgcaggtggcgcgcacgcagaaggtcgccgacaaggtcgcgctgtgcctgcccagcgacggcaggtccacgtcgggcgacagcgtcggcgtggccatcttcggcggcggcccgctgttcttcgtcccgccggaccgcggcgacttcaccacgatgctggccggcacggcgccgctccacgccggagccggagccggtgcccccgggtactacgtctcctccaccggcatcgccgtggagcaggcccgcgtgggcggccccgccggggcgctcgtcgtggcgctgagctccacggtcccgtacacggcgctccggcccgacgtgtacgctccgttcgtcaaggcgttcgacgcggcggccgccgggcccaacttcccctggatgtccagggtcgccgcggtggcgccgttcgaccggtgctacgactccaccaagctcccgcagagtctgctcggctacgccgtgccgcagatcgacgtgatgctggagggcgggcagaacttcacggttgctcggcggcaactccatggtgcaggtgaacggcaacacggcctgcctcggcttcgtccaggcgccggggcaagcgccggcggccgtcatcggtgggttccagctggagaaccacctgctgctgctcgacgtggacaagaagcagcttggattcaccactttcctcaacgcaatcgggctttcctgcagcagcttcaatttcactcttgctagctagtgtgctgcatcggcatgtatacttaactgtaaacaacttgtactgccgtgtattacaaataaataaataaataaataataaagtgggaataaattgattgg

SEQ ID NO: 1126 - protein, 1259 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: FH2; PFam Description: Formin Homology 2 Domain
  misc_feature: PFam Name: Peptidase_S8; PFam Description: Subtilase family
  misc_feature: PFam Name: Cation_efflux; PFam Description: Cation efflux family
  misc_feature: GI Number: 34907226; NR Description: putative dermal glycoprotein precursor [Oryza sativa (japonica cultivar-group)] >gi|20160766|dbj|BAB89707.1| putative dermal glycoprotein precursor
  misc_feature: GI Number: 34907222; NR Description: putative dermal glycoprotein precursor [Oryza sativa (japonica cultivar-group)] >gi|20160764|dbj|BAB89705.1| putative dermal glycoprotein precursor
  misc_feature: GI Number: 34907228; NR Description: putative dermal glycoprotein precursor [Oryza sativa (japonica cultivar-group)] >gi|20160767|dbj|BAB89708.1| putative dermal glycoprotein precursor
  misc_feature: GI Number: 62996370; NR Description: xylanase inhibitor
  misc_feature: GI Number: 23954367; NR Description: xylanase inhibitor
AACACACAATGCCATCACGAATGTGGAACCTCAACAAAGCCCTGGTCACCTCACTACTCTGCATCTCGGCGTTGTCGTCGTCGCCATGGCCATGCACGGCAGCCGGTCAGCTGGGCGGTAAGCCCCTGGTCACCGCCGTCACCAAGGACGCGTCCACCTCCCTCTACACGGCGCCGCTCAAGGACGGCCACCCGCTCGTCCTCGACCTCAGTAGCCCGGTCATCTCGCTGGCCACGTGCGCCTCCTCCAAGAACAATAACAACGGCACGCTCACCGCCACGCTATCCGCCAACGCCACCGACGGCCAGAACCCGCTGTTCCCGGTCTCCTTCTCGGCGGTGGCCACGTGCGCGCCGTCGTCGAGGCTGCCCGCCGGCGCCGTCGGCGTCGCGGGGCTCGCGCCCTCCTCCAGCAGCCAGCAGTCGCTCCCGGCGCAGGTGGCGCGCACGCAGAAGGTCGCCGACAAGGTCGCGCTGTGCCTGCCCAGCGACGGCAGGTCCACGTCGGGCGACAGCGTCGGCGTGGCCATCTTCGGCGGCGGCCCGCTGTTCTTCGTCCCGCCGGACCGCGGCGACTTCACCACGATGCTGGCCGGCACGGCGCCGCTCCACGCCGGAGCCGGAGCCGGTGCCCCCGGGTACTACGTCTCCTCCACCGGCATCGCCGTGGAGCAGGCCCGCGTGGGCGGCCCCGCCGGGGCGCTCGTCGTGGCGCTGAGCTCCACGGTCCCGTACACGGCGCTCCGGCCCGACGTGTACGCTCCGTTCGTCAAGGCGTTCGACGCGGCGGCCGCCGGGCCCAACTTCCCCTGGATGTCCAGGGTCGCCGCGGTGGCGCCGTTCGACCGGTGCTACGACTCCACCAAGCTCCCGCAGAGTCTGCTCGGCTACGCCGTGCCGCAGATCGACGTGATGCTGGAGGGCGGGCAGAACTTCACGGTTGCTCGGCGGCAACTCCATGGTGCAGGTGAACGGCAACACGGCCTGCCTCGGCTTCGTCCAGGCGCCGGGGCAAGCGCCGGCGGCCGTCATCGGTGGGTTCCAGCTGGAGAACCACCTGCTGCTGCTCGACGTGGACAAGAAGCAGCTTGGATTCACCACTTTCCTCAACGCAATCGGGCTTTCCTGCAGCAGCTTCAATTTCACTCTTGCTAGCTAGTGTGCTGCATCGGCATGTATACTTAACTGTAAACAACTTGTACTGCCGTGTATTACAAATAAATAAATAAATAAATAATAAAGTGGGAATAAATTGATTGG

SEQ ID NO: 1127 - DNA, 1751 bp, Zea mays
  misc_feature (1)..(1751): Ceres cDNA ID no. 12408818
  misc_feature (1)..(1751): Ceres CLONE  ID no. 297761
  misc_feature (1)..(1751): Also known as  Ceres CDNA ID no. 23766164
ataagagtaggtgcagtatatcagtaaccagtaaatacttggacccagcagtaaccaggaccaggagagatcatcaaagtaaccttgctgccttttgagaacagaagcgtcagcagcaccagcaagaagcatcttctctctggagcggcgcctccgagaagaggacgacggatcgggaccaggaggcatggatctatctggcacgcagggcgagctcgcgatcccaatgcacgccaacgtcgcgtcgccctacggaggcggcgtcggcggccatgtcctgcagctgcaccgtgacgaccacggcagcaacaacggccagtctccggcgccgctgctgccaccgccgcctgccgcggcggaggagacggagagctcggcgaagaagcgcggtccggcagccggggccggcggcggcggaggcagctccgcggtgaagtaccgggagtgcctcaagaatcacgcggcggccatcggcgggaacgccaccgacgggtgtggcgagttcatgccaagcggcgaggagggctcgttggaggcgctcaagtgctccgcctgcggctgccaccgcaatttccaccgcaaggaggtggacgacgaggacgacgacatgtacggcgccgccgaaggcttcagcggcctcggtctcggcctcggcctcgggcacggccaccgcgccgcccgccgcctcctggcccccgccatggcgcacccgcaccacaagagcggcggcggggggctcctgatctccggggccgacccctacgccgcgtacgcgtcggcgcgcgcgctccctccggcgctgccgccgccgccagggcacgcccaccaccaccaccagtacgtgatgccgctgaacatgatgcacacctcggagtccgacgacatggagggcggccgcggcggctgcggggacgcggcgcgcggcagcggcgggtcgtcgtcgtccaggaagcggttccgcaccaagttcaccccggagcagaaggcgcgcatgctggagttcgcggagcgcgtggggtggcgcctccagaagctggacgacggcatggtgcaggccttctgccaggagatcggcgtgaagcggcgcgtgctcaaggtgtggatgcacaacaacaagcacaacctcgccaccaagcgcctcgaggcctcgccggcgcaggagcaggcgatggcgggcatggcgtcgccgccgccgccgccgccacccccacagctgcacttgcctctgcagatgcccgctggagtcatgccgccgccgccgccgccgccgcaggccgggtcgtcctgtcaccgcggcggtcccggctccccgctgccgctcaagctcgagtgaccaccgacaacctgacaaaaaacaagaagagggtgaccaccattggtggccgttgatccgtcctggtggtaagtggtaaactagctagctagcagaccgacggaccgcatcgatggctatttcactgttccattagtccattccttcccaagtgatctatctaccgtcgtcgtccaagcagggagagaagtgggcgatgaacttttcttgaaacaacaaaacgaacaaagtccaggttattatcgtctcttttttttccttcccttttccggtgctcgttgctttgtcacaaggtaggggagcaagcaaccaagcatgcatgatagtagtagctgatttcgactggactggactgatttccttccaaaaatttttttcctgatggtgaagaaaactaaatatcctactagtttcctcc

SEQ ID NO: 1128 - protein, 1751 aa, Zea mays
  misc_feature: PFam Name: ZF-HD_dimer; PFam Description: ZF-HD protein
  misc_feature: PFam Name: Homeobox; PFam Description: Homeobox domain
  misc_feature: PFam Name: FH2; PFam Description: Formin Homology 2 Domain
  misc_feature: PFam Name: HlyD; PFam Description: HlyD family secretion protein
  misc_feature: PFam Name: Drf_FH1; PFam Description: Formin Homology Region 1
  misc_feature: GI Number: 62733875; NR Description: ZF-HD protein dimerisation region, putative [Oryza sativa (japonica
  misc_feature: GI Number: 50946893; NR Description: putative ZF-HD homeobox protein [Oryza sativa (japonica cultivar-group)] >gi|42408573|dbj|BAD09750.1| putative ZF-HD homeobox protein [Oryza
  misc_feature: GI Number: 13374061; NR Description: ZF-HD homeobox protein
  misc_feature: GI Number: 50900288; NR Description: putative ZF-HD homeobox protein [Oryza sativa (japonica cultivar-group)] >gi|46806323|dbj|BAD17515.1| putative ZF-HD homeobox protein [Oryza
  misc_feature: GI Number: 5091602; NR Description: 10A19I.6 [Oryza sativa
ATAAGAGTAGGTGCAGTATATCAGTAACCAGTAAATACTTGGACCCAGCAGTAACCAGGACCAGGAGAGATCATCAAAGTAACCTTGCTGCCTTTTGAGAACAGAAGCGTCAGCAGCACCAGCAAGAAGCATCTTCTCTCTGGAGCGGCGCCTCCGAGAAGAGGACGACGGATCGGGACCAGGAGGCATGGATCTATCTGGCACGCAGGGCGAGCTCGCGATCCCAATGCACGCCAACGTCGCGTCGCCCTACGGAGGCGGCGTCGGCGGCCATGTCCTGCAGCTGCACCGTGACGACCACGGCAGCAACAACGGCCAGTCTCCGGCGCCGCTGCTGCCACCGCCGCCTGCCGCGGCGGAGGAGACGGAGAGCTCGGCGAAGAAGCGCGGTCCGGCAGCCGGGGCCGGCGGCGGCGGAGGCAGCTCCGCGGTGAAGTACCGGGAGTGCCTCAAGAATCACGCGGCGGCCATCGGCGGGAACGCCACCGACGGGTGTGGCGAGTTCATGCCAAGCGGCGAGGAGGGCTCGTTGGAGGCGCTCAAGTGCTCCGCCTGCGGCTGCCACCGCAATTTCCACCGCAAGGAGGTGGACGACGAGGACGACGACATGTACGGCGCCGCCGAAGGCTTCAGCGGCCTCGGTCTCGGCCTCGGCCTCGGGCACGGCCACCGCGCCGCCCGCCGCCTCCTGGCCCCCGCCATGGCGCACCCGCACCACAAGAGCGGCGGCGGGGGGCTCCTGATCTCCGGGGCCGACCCCTACGCCGCGTACGCGTCGGCGCGCGCGCTCCCTCCGGCGCTGCCGCCGCCGCCAGGGCACGCCCACCACCACCACCAGTACGTGATGCCGCTGAACATGATGCACACCTCGGAGTCCGACGACATGGAGGGCGGCCGCGGCGGCTGCGGGGACGCGGCGCGCGGCAGCGGCGGGTCGTCGTCGTCCAGGAAGCGGTTCCGCACCAAGTTCACCCCGGAGCAGAAGGCGCGCATGCTGGAGTTCGCGGAGCGCGTGGGGTGGCGCCTCCAGAAGCTGGACGACGGCATGGTGCAGGCCTTCTGCCAGGAGATCGGCGTGAAGCGGCGCGTGCTCAAGGTGTGGATGCACAACAACAAGCACAACCTCGCCACCAAGCGCCTCGAGGCCTCGCCGGCGCAGGAGCAGGCGATGGCGGGCATGGCGTCGCCGCCGCCGCCGCCGCCACCCCCACAGCTGCACTTGCCTCTGCAGATGCCCGCTGGAGTCATGCCGCCGCCGCCGCCGCCGCCGCAGGCCGGGTCGTCCTGTCACCGCGGCGGTCCCGGCTCCCCGCTGCCGCTCAAGCTCGAGTGACCACCGACAACCTGACAAAAAACAAGAAGAGGGTGACCACCATTGGTGGCCGTTGATCCGTCCTGGTGGTAAGTGGTAAACTAGCTAGCTAGCAGACCGACGGACCGCATCGATGGCTATTTCACTGTTCCATTAGTCCATTCCTTCCCAAGTGATCTATCTACCGTCGTCGTCCAAGCAGGGAGAGAAGTGGGCGATGAACTTTTCTTGAAACAACAAAACGAACAAAGTCCAGGTTATTATCGTCTCTTTTTTTTCCTTCCCTTTTCCGGTGCTCGTTGCTTTGTCACAAGGTAGGGGAGCAAGCAACCAAGCATGCATGATAGTAGTAGCTGATTTCGACTGGACTGGACTGATTTCCTTCCAAAAATTTTTTTCCTGATGGTGAAGAAAACTAAATATCCTACTAGTTTCCTCC

SEQ ID NO: 1129 - DNA, 1395 bp, Zea mays
  misc_feature (1)..(1395): Ceres cDNA ID no. 12408833
  misc_feature (1)..(1395): Ceres CLONE  ID no. 297597
  misc_feature (1)..(1395): Also known as  Ceres CDNA ID no. 23766132
aaataggtagatgatgccgctaacagtaacacagagtaaaagactccaattttcccacggctactgaatcacggatgcttaaatctccccaatccgtatctctgtttccctcacagcgcggctgcctataaccactccaggtctccagcgaagcaggctcaggcgcaacgcaacaacacaaggcggcggttatggcctctgctgctgcgacggctacgatggggacggggaaggtggtgtgcgtcaccggcgcatcagggtacatcgcgtcctggattgtcaggctcctcctcgaccgcggctacaccgtccgcgccaccgtgcgagacaccgctgacccaaagaaaacattgcacctgactgcgttggatggtgctaaggataggctgcacttatttaaagctagcctgctagaagagggttctttcgatgctgcagttcatggatgcgacactgtatttcatactgcctctcccttttatcacaatgtcaaggatgctaaggcagagttacttgacccagcagttaagggaacactcaatgttctcggttcatgcaagaaagcttctattaaaaaggtggttgtaacatcatctatggctgctgtagcctacaacgggaggccaaggactcctgaggtcacagttgacgagacatggttttctgatccacaaatttgtgaaacaaatcagcaatggtatattttgtccaagacgctggcagaggaggctgcttggaagttctcaagggataatggacttgaaatcgttactataaacccagcgatggttattggtcccctgctgcagcctacactaaataccagtgctgaagcaatcctgaagttaatcaatgggtcatcgtctacatatcccaatttttgctttggatgggttaatgtcaaggatgttgccctggcccatatccttgcatacgaggttccctcatcaaatggaaggtactgcatggtggaaagagttgttcactactcagaactggtgaacattatccgcaacatgtatcctacccttcctcttccggacaagtgtgcagatgacaagccgtttgtcccaccctaccaagtatcaaaggagaagataaaaagcataggcatcgagttgattccactggagacgagcgtcaaggagaccatcgaaagcttgaaagagaaggggttcgctagtttttgactcgtgcaagctgtgaaacagaagtgttactgtactacgtgatgttgcattgtacacatgcatcggacttcgcagttcccaagctattttggtagctttggtctgtaagattacctaaaataaactgagccacgttgccacgctgtagcttttgtacatgttatgctttgatcggattgagacacgtgatatatggtcgttgctt

SEQ ID NO: 1130 - protein, 1395 aa, Zea mays
  misc_feature: PFam Name: Epimerase; PFam Description: NAD dependent
  misc_feature: PFam Name: NAD_binding_4; PFam Description: Male sterility protein
  misc_feature: PFam Name: 3Beta_HSD; PFam Description: 3-beta
  misc_feature: GI Number: 15239741; NR Description: cinnamyl-alcohol
  misc_feature: GI Number: 21594240; NR Description: cinnamyl-alcohol
  misc_feature: GI Number: 34913420; NR Description: putative cinnamyl-alcohol dehydrogenase [Oryza sativa (japonica cultivar-group)] >gi|20161203|dbj|BAB90130.1| putative cinnamyl-alcohol dehydrogenase [Oryza sativa (japonica
  misc_feature: GI Number: 2981475; NR Description: putative cinnamyl alcohol dehydrogenase [Malus x domestica] >gi|7488627|pir||T16995 probable
  misc_feature: GI Number: 1143445; NR Description: cinnamyl alcohol dehydrogenase [Eucalyptus gunnii] >gi|7431409|pir||T10736
AAATAGGTAGATGATGCCGCTAACAGTAACACAGAGTAAAAGACTCCAATTTTCCCACGGCTACTGAATCACGGATGCTTAAATCTCCCCAATCCGTATCTCTGTTTCCCTCACAGCGCGGCTGCCTATAACCACTCCAGGTCTCCAGCGAAGCAGGCTCAGGCGCAACGCAACAACACAAGGCGGCGGTTATGGCCTCTGCTGCTGCGACGGCTACGATGGGGACGGGGAAGGTGGTGTGCGTCACCGGCGCATCAGGGTACATCGCGTCCTGGATTGTCAGGCTCCTCCTCGACCGCGGCTACACCGTCCGCGCCACCGTGCGAGACACCGCTGACCCAAAGAAAACATTGCACCTGACTGCGTTGGATGGTGCTAAGGATAGGCTGCACTTATTTAAAGCTAGCCTGCTAGAAGAGGGTTCTTTCGATGCTGCAGTTCATGGATGCGACACTGTATTTCATACTGCCTCTCCCTTTTATCACAATGTCAAGGATGCTAAGGCAGAGTTACTTGACCCAGCAGTTAAGGGAACACTCAATGTTCTCGGTTCATGCAAGAAAGCTTCTATTAAAAAGGTGGTTGTAACATCATCTATGGCTGCTGTAGCCTACAACGGGAGGCCAAGGACTCCTGAGGTCACAGTTGACGAGACATGGTTTTCTGATCCACAAATTTGTGAAACAAATCAGCAATGGTATATTTTGTCCAAGACGCTGGCAGAGGAGGCTGCTTGGAAGTTCTCAAGGGATAATGGACTTGAAATCGTTACTATAAACCCAGCGATGGTTATTGGTCCCCTGCTGCAGCCTACACTAAATACCAGTGCTGAAGCAATCCTGAAGTTAATCAATGGGTCATCGTCTACATATCCCAATTTTTGCTTTGGATGGGTTAATGTCAAGGATGTTGCCCTGGCCCATATCCTTGCATACGAGGTTCCCTCATCAAATGGAAGGTACTGCATGGTGGAAAGAGTTGTTCACTACTCAGAACTGGTGAACATTATCCGCAACATGTATCCTACCCTTCCTCTTCCGGACAAGTGTGCAGATGACAAGCCGTTTGTCCCACCCTACCAAGTATCAAAGGAGAAGATAAAAAGCATAGGCATCGAGTTGATTCCACTGGAGACGAGCGTCAAGGAGACCATCGAAAGCTTGAAAGAGAAGGGGTTCGCTAGTTTTTGACTCGTGCAAGCTGTGAAACAGAAGTGTTACTGTACTACGTGATGTTGCATTGTACACATGCATCGGACTTCGCAGTTCCCAAGCTATTTTGGTAGCTTTGGTCTGTAAGATTACCTAAAATAAACTGAGCCACGTTGCCACGCTGTAGCTTTTGTACATGTTATGCTTTGATCGGATTGAGACACGTGATATATGGTCGTTGCTT

SEQ ID NO: 1131 - DNA, 1620 bp, Zea mays
  misc_feature (1)..(1620): Ceres cDNA ID no. 12408990
  misc_feature (1)..(1620): Ceres CLONE  ID no. 294302
  misc_feature (1)..(1620): Also known as  Ceres CDNA ID no. 23771660
  misc_feature (1106)..(1106): n is a, c, t, g, unknown, or other
actgtactaaaccgcgaggaaaagtagcaaagaaattacaagggggtggacgcgcggggggcaagtcgtctccttcgatttcgttcttgcctctttgcctctctcaaggtctgctcaaactcaaagtggattcggcagaacacgcatggcgtagagcgcggggagcaagagatttcctagcttcaagaacctggaagaacaagtcgaggatccgtcgtcgagcccgactgttctaagagaaagtaattagcaagcagctctcgattatactgtattatttatcgaaaccctatctaagctagtagcaagctagctagctagaagaggaggaggaagctggcgaactggtggtgggacgaggggcggggcggcctgccggagccatcccttggcaagaaccaagaagaaatggcaccttcctccaaggacggcgccaccgccaccgagcagccgacgagcggcgacgacgaccgggagaacggcggcacgggcgagcccaaggaaggcgcggtggtggcgggcaaccggcggccccgcgggcggccgccggggtccaagaacaagcccaagccgcccatcttcgtgacgcgcgacagccccaacgcgctgcgcagccacgtgatggaggtggccggcggcgccgacgtggccgagtccatcgcccacttcgcgcgccgcaggcagcgcggcgtgtgcgtgctcagcggcgcgggcaccgtcgccgacgtggcgctccgccagcccgcggctccgggcgccgtggtcgccctccgcggccgcttcgagatcctctcgctcaccggcacgttcctgccgggccccgcgccgccgggctccacggggctcaccgtgtacctcgcgggcggccaggggcaggtcgtcggcggcagcgtcgtcggcacgctcaccgcggcggggcccgtcatggtgatggcgtccacgttcgccaacgccacctacgagaggctgccgctggacgacgccgacgaggagcccgccgggcagcaggcggcgcagctgcctcccggaccgggcggagggcagcctatggtaatgggcgggatggccgacccctcagcggtgccaatgttcggcggcgccggcgntgtgccgccaagcctcatgccagcaggggccgcagccgcctcctccggtgcgggcctgcagctcgggcacgaccgacttgcatgggctcatgcacggccaccgccatactaggaagccggggaggatgcatcatccatgaccgaggaaattgatgaattagaaatggaggatcgttcagcgcaacaacagctagcagcagctcaaggacgactgccactcaccatcatatagtaactagaaccgaacgaagatcgaattaagcgctagcttccaggagctaataaaactctcttcgatcaattctacctattacagtactctgctaagaaggtaaactacttatagtgctatatatgtatgtatattactacactgctactgcatgcatgtgactgtgtggctgtgccaaatgtcagcgcaagatacgatggagcttgcattgttttttcccattgtaatgtttgatttatattaattattagatacagcatgataaatagatgatggatgatt

SEQ ID NO: 1132 - protein, 1620 aa, Zea mays
  misc_feature: PFam Name: HlyD; PFam Description: HlyD family secretion protein
  misc_feature: PFam Name: Peptidase_S8; PFam Description: Subtilase family
  misc_feature: GI Number: 50915952; NR Description: DNA-binding protein-like [Oryza sativa (japonica cultivar-group)] >gi|48716263|dbj|BAD22878.1| DNA-binding protein-like [Oryza sativa (japonica cultivar-group)] >gi|48716505|dbj|BAD23110.1|
  misc_feature: GI Number: 50948561; NR Description: putative SAP1 protein [Oryza sativa (japonica cultivar-group)] >gi|42408442|dbj|BAD09624.1| putative SAP1 protein [Oryza sativa
  misc_feature: GI Number: 21593180; NR Description: putative DNA-binding
  misc_feature: GI Number: 50252749; NR Description: putative DNA-binding
  misc_feature: GI Number: 50912085; NR Description: DNA-binding protein-like [Oryza sativa (japonica cultivar-group)] >gi|41052877|dbj|BAD07790.1| DNA-binding protein-like [Oryza sativa
ACTGTACTAAACCGCGAGGAAAAGTAGCAAAGAAATTACAAGGGGGTGGACGCGCGGGGGGCAAGTCGTCTCCTTCGATTTCGTTCTTGCCTCTTTGCCTCTCTCAAGGTCTGCTCAAACTCAAAGTGGATTCGGCAGAACACGCATGGCGTAGAGCGCGGGGAGCAAGAGATTTCCTAGCTTCAAGAACCTGGAAGAACAAGTCGAGGATCCGTCGTCGAGCCCGACTGTTCTAAGAGAAAGTAATTAGCAAGCAGCTCTCGATTATACTGTATTATTTATCGAAACCCTATCTAAGCTAGTAGCAAGCTAGCTAGCTAGAAGAGGAGGAGGAAGCTGGCGAACTGGTGGTGGGACGAGGGGCGGGGCGGCCTGCCGGAGCCATCCCTTGGCAAGAACCAAGAAGAAATGGCACCTTCCTCCAAGGACGGCGCCACCGCCACCGAGCAGCCGACGAGCGGCGACGACGACCGGGAGAACGGCGGCACGGGCGAGCCCAAGGAAGGCGCGGTGGTGGCGGGCAACCGGCGGCCCCGCGGGCGGCCGCCGGGGTCCAAGAACAAGCCCAAGCCGCCCATCTTCGTGACGCGCGACAGCCCCAACGCGCTGCGCAGCCACGTGATGGAGGTGGCCGGCGGCGCCGACGTGGCCGAGTCCATCGCCCACTTCGCGCGCCGCAGGCAGCGCGGCGTGTGCGTGCTCAGCGGCGCGGGCACCGTCGCCGACGTGGCGCTCCGCCAGCCCGCGGCTCCGGGCGCCGTGGTCGCCCTCCGCGGCCGCTTCGAGATCCTCTCGCTCACCGGCACGTTCCTGCCGGGCCCCGCGCCGCCGGGCTCCACGGGGCTCACCGTGTACCTCGCGGGCGGCCAGGGGCAGGTCGTCGGCGGCAGCGTCGTCGGCACGCTCACCGCGGCGGGGCCCGTCATGGTGATGGCGTCCACGTTCGCCAACGCCACCTACGAGAGGCTGCCGCTGGACGACGCCGACGAGGAGCCCGCCGGGCAGCAGGCGGCGCAGCTGCCTCCCGGACCGGGCGGAGGGCAGCCTATGGTAATGGGCGGGATGGCCGACCCCTCAGCGGTGCCAATGTTCGGCGGCGCCGGCGNTGTGCCGCCAAGCCTCATGCCAGCAGGGGCCGCAGCCGCCTCCTCCGGTGCGGGCCTGCAGCTCGGGCACGACCGACTTGCATGGGCTCATGCACGGCCACCGCCATACTAGGAAGCCGGGGAGGATGCATCATCCATGACCGAGGAAATTGATGAATTAGAAATGGAGGATCGTTCAGCGCAACAACAGCTAGCAGCAGCTCAAGGACGACTGCCACTCACCATCATATAGTAACTAGAACCGAACGAAGATCGAATTAAGCGCTAGCTTCCAGGAGCTAATAAAACTCTCTTCGATCAATTCTACCTATTACAGTACTCTGCTAAGAAGGTAAACTACTTATAGTGCTATATATGTATGTATATTACTACACTGCTACTGCATGCATGTGACTGTGTGGCTGTGCCAAATGTCAGCGCAAGATACGATGGAGCTTGCATTGTTTTTTCCCATTGTAATGTTTGATTTATATTAATTATTAGATACAGCATGATAAATAGATGATGGATGATT

SEQ ID NO: 1133 - DNA, 1639 bp, Zea mays
  misc_feature (1)..(1639): Ceres cDNA ID no. 12409056
  misc_feature (1)..(1639): Ceres CLONE  ID no. 291806
  misc_feature (1)..(1639): Also known as  Ceres CDNA ID no. 24195601
atcagtcgcagtgaggtgctcgacgacacaaggcgttcgctcgacctccctgaccagtttcccgagcatcgcgtcgccgcagccacagagagagctgaaagaagcggttcgaagtctgccgcggacctggcctgggagatagccgtcctggaggagcaagtcgtccgcaaggagctgcacctgctgtccctgtacagagccgcgttcgaccagtacctcggcgtctcccctcgcgcgtctgctcaggaaccgcgccatgagcgcagcagcagaagggctactgctgctgacgacgaaggcgcccttcgcctgaggagcatcaaggagtctgcgtcctacagcctaccaacgctctccgattctaaacgcgtacacgcgcaggagctctccaggtgctcctcagggcggtccagcctggccaacttcctgagcgcctcgatcgctgagtacgtgcctaagatctcgtgcaagctctcggaggacatactgcggtgcgtctccgccgtctactgcaagctcgcgagcaggccgctgtcgcaggaggaggaggaggcgaggtccgagacgccgccgttcacgccttctctctcggtctcgtccgcgtcgagctccttctccctcaagaagcagcaccccgtccgtggctggagccctcggtgctactacaacgccgacgcgactgcgaccccggacgcgtacgcttcgtccggcgggagcagtgggcggtacagtggggtgatggttttcccagggatacatgtagacgaggagaagtttgagtatgcctgcaaaatgctggacactatcaggtggtattttgtgacccagtagatcgctgatcaaacggctggagaagattgatcctagaaagatggcacatgaagagcagctctgtttctgggtcaacatccacaatgccttggttatgcatgctttcatggcctatggattacaggaaaaacggatgaaaagcactgacttgattctgaaggctgcatacaatgtgggtgggcattcagtgaactcccaaactatccagaactcgattctaggatgccagtcccaccgcccttcactgtgggttcggacactatttacgccgacgaaaaaatctgggagctccatacatccatatgcgcttcagtacgcagagccaattgcgcactttgcgctctcgaccggcgcgttttcagacccacctgtgaggctgtacacagccaagaaactgtaccatcagctggagcaagccagggccgagttcatccaagcaaatgtcatggtccggaggcagaccatcttcctgcccaaggttctccacttctatgcaaaggatgcttccctggagctacctgaccttgttgacatagtgtgcgagagcatgcctgagctgcagcgaaaagagatcaggcagtatcttaggaggaggatcgacaagtgtgttcagtggttgccctacaagtcttctttcaggtacactgtgcatagcagtttggctgagtaggcacttttttttcttctctatgtgcttgtaaataaggagccatgattctaagaacagtcgtctgttggggtgtgtgtgtgtatgtaaaactatattgtgacagttctttctttcttagaggaaaattacagcttatct

SEQ ID NO: 1134 - protein, 1639 aa, Zea mays
  misc_feature: GI Number: 50947619; NR Description: ternary complex factor-like [Oryza sativa (japonica cultivar-group)] >gi|42408754|dbj|BAD09990.1| ternary complex factor-like [Oryza
  misc_feature: GI Number: 28916180; NR Description: putative ternary complex
  misc_feature: GI Number: 21618245; NR Description: unknown [Arabidopsis thaliana]
  misc_feature: GI Number: 51535341; NR Description: ternary complex factor
  misc_feature: GI Number: 50725195; NR Description: ternary complex factor
ATCAGTCGCAGTGAGGTGCTCGACGACACAAGGCGTTCGCTCGACCTCCCTGACCAGTTTCCCGAGCATCGCGTCGCCGCAGCCACAGAGAGAGCTGAAAGAAGCGGTTCGAAGTCTGCCGCGGACCTGGCCTGGGAGATAGCCGTCCTGGAGGAGCAAGTCGTCCGCAAGGAGCTGCACCTGCTGTCCCTGTACAGAGCCGCGTTCGACCAGTACCTCGGCGTCTCCCCTCGCGCGTCTGCTCAGGAACCGCGCCATGAGCGCAGCAGCAGAAGGGCTACTGCTGCTGACGACGAAGGCGCCCTTCGCCTGAGGAGCATCAAGGAGTCTGCGTCCTACAGCCTACCAACGCTCTCCGATTCTAAACGCGTACACGCGCAGGAGCTCTCCAGGTGCTCCTCAGGGCGGTCCAGCCTGGCCAACTTCCTGAGCGCCTCGATCGCTGAGTACGTGCCTAAGATCTCGTGCAAGCTCTCGGAGGACATACTGCGGTGCGTCTCCGCCGTCTACTGCAAGCTCGCGAGCAGGCCGCTGTCGCAGGAGGAGGAGGAGGCGAGGTCCGAGACGCCGCCGTTCACGCCTTCTCTCTCGGTCTCGTCCGCGTCGAGCTCCTTCTCCCTCAAGAAGCAGCACCCCGTCCGTGGCTGGAGCCCTCGGTGCTACTACAACGCCGACGCGACTGCGACCCCGGACGCGTACGCTTCGTCCGGCGGGAGCAGTGGGCGGTACAGTGGGGTGATGGTTTTCCCAGGGATACATGTAGACGAGGAGAAGTTTGAGTATGCCTGCAAAATGCTGGACACTATCAGGTGGTATTTTGTGACCCAGTAGATCGCTGATCAAACGGCTGGAGAAGATTGATCCTAGAAAGATGGCACATGAAGAGCAGCTCTGTTTCTGGGTCAACATCCACAATGCCTTGGTTATGCATGCTTTCATGGCCTATGGATTACAGGAAAAACGGATGAAAAGCACTGACTTGATTCTGAAGGCTGCATACAATGTGGGTGGGCATTCAGTGAACTCCCAAACTATCCAGAACTCGATTCTAGGATGCCAGTCCCACCGCCCTTCACTGTGGGTTCGGACACTATTTACGCCGACGAAAAAATCTGGGAGCTCCATACATCCATATGCGCTTCAGTACGCAGAGCCAATTGCGCACTTTGCGCTCTCGACCGGCGCGTTTTCAGACCCACCTGTGAGGCTGTACACAGCCAAGAAACTGTACCATCAGCTGGAGCAAGCCAGGGCCGAGTTCATCCAAGCAAATGTCATGGTCCGGAGGCAGACCATCTTCCTGCCCAAGGTTCTCCACTTCTATGCAAAGGATGCTTCCCTGGAGCTACCTGACCTTGTTGACATAGTGTGCGAGAGCATGCCTGAGCTGCAGCGAAAAGAGATCAGGCAGTATCTTAGGAGGAGGATCGACAAGTGTGTTCAGTGGTTGCCCTACAAGTCTTCTTTCAGGTACACTGTGCATAGCAGTTTGGCTGAGTAGGCACTTTTTTTTCTTCTCTATGTGCTTGTAAATAAGGAGCCATGATTCTAAGAACAGTCGTCTGTTGGGGTGTGTGTGTGTATGTAAAACTATATTGTGACAGTTCTTTCTTTCTTAGAGGAAAATTACAGCTTATCT

SEQ ID NO: 1135 - DNA, 1768 bp, Zea mays
  misc_feature (1)..(1768): Ceres cDNA ID no. 12409131
  misc_feature (1)..(1768): Ceres CLONE  ID no. 289732
  misc_feature (1)..(1768): Also known as  Ceres CDNA ID no. 23770275
atctcttgtgccagcacaatgatgctttgtcatatctagggagaagtgagtaaaagccatgagtgatgattatgcttctcttcttcttttccttcttaatgacgtactgccagtacgtacgtgctgttgtcagggaactgtatccgaattccaaattttgaacatgatttagcaagacagacagagagaaagagaatagttgactagttgtaaacttgtaatgtatggatcatgcctttcattcgatggctactgatcttgcttcgagcgcagtctgccgcggacctggcctgggagatagccgtcctggaggagcaagtcgtccgcaaggagctgcacctgctgtccctgtacagagccgcgttcgaccagtacctcggcgtctcccctcgcgcgtctgctcaggaaccgcgccatgagcgcagcagcagaagggctactgctgctgacgacgaaggcgcccttcgcctgaggagcatcaaggagtctgcgtcctacagcctaccaacgctctccgattctaaacgcgtagagctctccaggtgctcctcagggcggtccagcctggccaacttcctgagcgcctcgatcgctgagtacgtgcctaagatctcgtgcaagctctcggaggacatactgcggtgcgtctccgccgtctactgcaagctcgcgagcaggccgctgtcgcaggaggaggaggaggcgaggtccgagacgccgccgttcacgccttctctctcggtctcgtccgcgtcgagctccttctccctcaagaagcagcaccccgtccgtggctggagccctcggtgctactacaacgccgacgcgactgcgaccccggacgcgtacgcttcgtccggcgggagcagtgggcggtacagtggggtgatggttttcccagggatacatgtagacgaggagaagtttgagtatgcctgcaaaatcctggacactatcagatcgctgatcaaacggctggagaagattgatcctagaaagatggcacatgaagagcagctctgtttctgggtcaacatccacaatgccttggttatgcatgctttcatggcctatggattacaggaaaaacggatgaaaagcactgacttgattctgaaggctgcatacaatgtgggtgggcattcagtgaactcccaaactatccagaactcgattctaggatgccagtcccaccgcccttcactgtgggttcggacactatttacgccgacgaaaaaatctgggagctccatacatccatatgcgcttcagtacgcagagccaattgcgcactttgcgctctcgaccggcgcgttttcagacccacctgtgaggctgtacacagccaagaaactgtaccatcagctggagcaagccagggccgagttcatccaagcaaatgtcatggtccggaggcagaccatcttcctgcccaaggttctccacttctatgcgaaggatgcttccctggagctacctgaccttgttgacatagtgtgcgagagcatgcctgagctgcagcgaaaagagatcaggcagtatcttaggaggaggatcgacaagtgtgttcagtggttgccctacaagtcttctttcaggtacactgtgcatagcagtttggctgagtaggcacttttttttcttctctatgtgcttgtaaataaggagccatgattctaagaacagtcgtctgttggggtgtgtgtgtgtatgtaaaactatattgtgacagttctttctttcttagaggaaaattacagcttatctc

SEQ ID NO: 1136 - protein, 1768 aa, Zea mays
  misc_feature: GI Number: 50947619; NR Description: ternary complex factor-like [Oryza sativa (japonica cultivar-group)] >gi|42408754|dbj|BAD09990.1| ternary complex factor-like [Oryza
  misc_feature: GI Number: 28916180; NR Description: putative ternary complex
  misc_feature: GI Number: 51535341; NR Description: ternary complex factor
  misc_feature: GI Number: 53791925; NR Description: ternary complex factor
  misc_feature: GI Number: 53793306; NR Description: ternary complex factor MIP1-like [Oryza sativa (japonica cultivar-group)] >gi|53792826|dbj|BAD53859.1| ternary complex factor MIP1-like
ATCTCTTGTGCCAGCACAATGATGCTTTGTCATATCTAGGGAGAAGTGAGTAAAAGCCATGAGTGATGATTATGCTTCTCTTCTTCTTTTCCTTCTTAATGACGTACTGCCAGTACGTACGTGCTGTTGTCAGGGAACTGTATCCGAATTCCAAATTTTGAACATGATTTAGCAAGACAGACAGAGAGAAAGAGAATAGTTGACTAGTTGTAAACTTGTAATGTATGGATCATGCCTTTCATTCGATGGCTACTGATCTTGCTTCGAGCGCAGTCTGCCGCGGACCTGGCCTGGGAGATAGCCGTCCTGGAGGAGCAAGTCGTCCGCAAGGAGCTGCACCTGCTGTCCCTGTACAGAGCCGCGTTCGACCAGTACCTCGGCGTCTCCCCTCGCGCGTCTGCTCAGGAACCGCGCCATGAGCGCAGCAGCAGAAGGGCTACTGCTGCTGACGACGAAGGCGCCCTTCGCCTGAGGAGCATCAAGGAGTCTGCGTCCTACAGCCTACCAACGCTCTCCGATTCTAAACGCGTAGAGCTCTCCAGGTGCTCCTCAGGGCGGTCCAGCCTGGCCAACTTCCTGAGCGCCTCGATCGCTGAGTACGTGCCTAAGATCTCGTGCAAGCTCTCGGAGGACATACTGCGGTGCGTCTCCGCCGTCTACTGCAAGCTCGCGAGCAGGCCGCTGTCGCAGGAGGAGGAGGAGGCGAGGTCCGAGACGCCGCCGTTCACGCCTTCTCTCTCGGTCTCGTCCGCGTCGAGCTCCTTCTCCCTCAAGAAGCAGCACCCCGTCCGTGGCTGGAGCCCTCGGTGCTACTACAACGCCGACGCGACTGCGACCCCGGACGCGTACGCTTCGTCCGGCGGGAGCAGTGGGCGGTACAGTGGGGTGATGGTTTTCCCAGGGATACATGTAGACGAGGAGAAGTTTGAGTATGCCTGCAAAATCCTGGACACTATCAGATCGCTGATCAAACGGCTGGAGAAGATTGATCCTAGAAAGATGGCACATGAAGAGCAGCTCTGTTTCTGGGTCAACATCCACAATGCCTTGGTTATGCATGCTTTCATGGCCTATGGATTACAGGAAAAACGGATGAAAAGCACTGACTTGATTCTGAAGGCTGCATACAATGTGGGTGGGCATTCAGTGAACTCCCAAACTATCCAGAACTCGATTCTAGGATGCCAGTCCCACCGCCCTTCACTGTGGGTTCGGACACTATTTACGCCGACGAAAAAATCTGGGAGCTCCATACATCCATATGCGCTTCAGTACGCAGAGCCAATTGCGCACTTTGCGCTCTCGACCGGCGCGTTTTCAGACCCACCTGTGAGGCTGTACACAGCCAAGAAACTGTACCATCAGCTGGAGCAAGCCAGGGCCGAGTTCATCCAAGCAAATGTCATGGTCCGGAGGCAGACCATCTTCCTGCCCAAGGTTCTCCACTTCTATGCGAAGGATGCTTCCCTGGAGCTACCTGACCTTGTTGACATAGTGTGCGAGAGCATGCCTGAGCTGCAGCGAAAAGAGATCAGGCAGTATCTTAGGAGGAGGATCGACAAGTGTGTTCAGTGGTTGCCCTACAAGTCTTCTTTCAGGTACACTGTGCATAGCAGTTTGGCTGAGTAGGCACTTTTTTTTCTTCTCTATGTGCTTGTAAATAAGGAGCCATGATTCTAAGAACAGTCGTCTGTTGGGGTGTGTGTGTGTATGTAAAACTATATTGTGACAGTTCTTTCTTTCTTAGAGGAAAATTACAGCTTATCTC

SEQ ID NO: 1137 - DNA, 1450 bp, Zea mays
  misc_feature (1)..(1450): Ceres cDNA ID no. 12409243
  misc_feature (1)..(1450): Ceres CLONE  ID no. 287294
  misc_feature (1)..(1450): Also known as  Ceres CDNA ID no. 23759256
agggagacggacaaaaggagaggcgtggacacgggacgcgaggtagacagcgcccggcgtgacgtggcgcgagatggagagcggagaggggggctcaccaaactgcaagtctgtctcctgactcctcgccggcgtgccggatctcctgtctctctcgcggtcggcggccgcatagcctcgttcactcgcacgacacagggcaggggggcgatgggctgcgcgacgtccaagcagttcagcaggagcgcgccggcgcacgcggatccggccgtgctggcgacccagacctcattcacggtgaacgaggtggaggcgctgtacgagctgtacaagaagctgagctgctccatcgtcaaagacgggctcatccacaaggaggagttccagctcgccttgttcaggaacagcaggagagcgaacctctttgcagacagggtcttcgatctgttcgatctcaagcggaacggagtcatcgatttcgaggagttcgtgcggtcgctcagtgtgttccaccctaaagcagatacgtcggagaagacggcgttcgctttcaagctgtatgatctgaggggaacaggctacatcgagaaagaagagctcagagagatggtcttggcgctgcttgatgagtccgacctctgcctttcagacagcaccgtcgagacgatcgtcgataacacgttcagccaagcggactcgaacggagatggcaggatagatcctgaagaatgggaggagttcgtgaagaagaacccggcaacgttaaggaacatgactctcccctatctgcaggacatcaccatgtcatttccgagcttcataatgcgttcagaagccagtgactgaaatgtttgcgtacatctgcgtgtaaggaagcaccgttccatcagctctgctgtttgttggagcctacagcttagtccatggcacgaggcaccggagaaagttcagaatgtagcagcaacggccagcagagtgcatgagggttgctgccatagctgcaggctgcagccaaacaaaatgatgaccaaagattcatctagtgtcagcttcagggttcagatggtataccagccaacaattttctttctcggtatctaaacaccgtggatgttgcgtttaaaaaaattgttgcagaggatcaacaagtctgttcatcgaagcagtgcctgagtttagaatcagaagctaactgtctattgctgagatgctttcgtctaaatcttgcgtgtagttgtaactgcaaggaaagaataacttgtggagagttggatttgttgatgaaccttagtagttcttgacttggttagttgtttccacatttcttcgcagtgccagtgcgtgcacttgtaacttgcaaattcttctcaatccacccctaatcgaagggtggatccagttccgcatgtaatgaggcaatatcatcaatagtttatgcttcgtttatccc

SEQ ID NO: 1138 - protein, 1450 aa, Zea mays
  misc_feature: PFam Name: efhand; PFam Description: EF hand
  misc_feature: GI Number: 50932465; NR Description: putative calcineurin B-like protein 8 (CBL8) [Oryza sativa (japonica cultivar-group)] >gi|45680422|gb|AAS75223.1| putative calcineurin B-like protein [Oryza sativa (japonica cultivar-group)] (CBL8) [Oryza sativa
  misc_feature: GI Number: 50907083; NR Description: putative calcineurin B [Oryza sativa (japonica cultivar-group)] >gi|47847964|dbj|BAD21753.1| putative calcineurin B [Oryza sativa
  misc_feature: GI Number: 66765939; NR Description: calcium sensor
  misc_feature: GI Number: 50907095; NR Description: putative calcineurin B [Oryza sativa (japonica cultivar-group)] >gi|47847971|dbj|BAD21759.1| putative calcineurin B [Oryza sativa
  misc_feature: GI Number: 53791389; NR Description: calcineurin B-like
AGGGAGACGGACAAAAGGAGAGGCGTGGACACGGGACGCGAGGTAGACAGCGCCCGGCGTGACGTGGCGCGAGATGGAGAGCGGAGAGGGGGGCTCACCAAACTGCAAGTCTGTCTCCTGACTCCTCGCCGGCGTGCCGGATCTCCTGTCTCTCTCGCGGTCGGCGGCCGCATAGCCTCGTTCACTCGCACGACACAGGGCAGGGGGGCGATGGGCTGCGCGACGTCCAAGCAGTTCAGCAGGAGCGCGCCGGCGCACGCGGATCCGGCCGTGCTGGCGACCCAGACCTCATTCACGGTGAACGAGGTGGAGGCGCTGTACGAGCTGTACAAGAAGCTGAGCTGCTCCATCGTCAAAGACGGGCTCATCCACAAGGAGGAGTTCCAGCTCGCCTTGTTCAGGAACAGCAGGAGAGCGAACCTCTTTGCAGACAGGGTCTTCGATCTGTTCGATCTCAAGCGGAACGGAGTCATCGATTTCGAGGAGTTCGTGCGGTCGCTCAGTGTGTTCCACCCTAAAGCAGATACGTCGGAGAAGACGGCGTTCGCTTTCAAGCTGTATGATCTGAGGGGAACAGGCTACATCGAGAAAGAAGAGCTCAGAGAGATGGTCTTGGCGCTGCTTGATGAGTCCGACCTCTGCCTTTCAGACAGCACCGTCGAGACGATCGTCGATAACACGTTCAGCCAAGCGGACTCGAACGGAGATGGCAGGATAGATCCTGAAGAATGGGAGGAGTTCGTGAAGAAGAACCCGGCAACGTTAAGGAACATGACTCTCCCCTATCTGCAGGACATCACCATGTCATTTCCGAGCTTCATAATGCGTTCAGAAGCCAGTGACTGAAATGTTTGCGTACATCTGCGTGTAAGGAAGCACCGTTCCATCAGCTCTGCTGTTTGTTGGAGCCTACAGCTTAGTCCATGGCACGAGGCACCGGAGAAAGTTCAGAATGTAGCAGCAACGGCCAGCAGAGTGCATGAGGGTTGCTGCCATAGCTGCAGGCTGCAGCCAAACAAAATGATGACCAAAGATTCATCTAGTGTCAGCTTCAGGGTTCAGATGGTATACCAGCCAACAATTTTCTTTCTCGGTATCTAAACACCGTGGATGTTGCGTTTAAAAAAATTGTTGCAGAGGATCAACAAGTCTGTTCATCGAAGCAGTGCCTGAGTTTAGAATCAGAAGCTAACTGTCTATTGCTGAGATGCTTTCGTCTAAATCTTGCGTGTAGTTGTAACTGCAAGGAAAGAATAACTTGTGGAGAGTTGGATTTGTTGATGAACCTTAGTAGTTCTTGACTTGGTTAGTTGTTTCCACATTTCTTCGCAGTGCCAGTGCGTGCACTTGTAACTTGCAAATTCTTCTCAATCCACCCCTAATCGAAGGGTGGATCCAGTTCCGCATGTAATGAGGCAATATCATCAATAGTTTATGCTTCGTTTATCCC

SEQ ID NO: 1139 - DNA, 1282 bp, Zea mays
  misc_feature (1)..(1282): Ceres cDNA ID no. 12409311
  misc_feature (1)..(1282): Ceres CLONE  ID no. 286438
  misc_feature (1)..(1282): Also known as  Ceres CDNA ID no. 23758708
  misc_feature (113)..(113): n is a, c, t, g, unknown, or other
  misc_feature (220)..(220): n is a, c, t, g, unknown, or other
  misc_feature (307)..(307): n is a, c, t, g, unknown, or other
  misc_feature (1103)..(1103): n is a, c, t, g, unknown, or other
aaactctgctgcatcttcttccactctccagtctccactagcatcagtcgccgctgcctatcctcgagcaccatttccatcaacagcatccgcctctggcaagctagcgacanaactcatggcactccgcgcgctcgacaacacgatgcccgccgccgtcgaggagcggcccaagaaggtggctaaggtgggcgtccccgccgccgccgccaaggccgcngcctcccccgggagtggcggcaagaagaagaaggggaacgacgagaactcggcgccaagggccacggccgcggcggcggagcaggcngtggagtacatctcgtcggaggagctggaggcggcggccaaccctaaggccaagggccgcgggggctggtcgcgggccttgactccaaggactgggtcaggacctgcgaggcgctcaacgacgcgcgccgcctcgcgatccaccaccccgcgctgctgaacccgatcctggagaaggtggtgctggcggtcgtgaagacgatgaagagcccccgcagcgcggtgctcaagacgtccatcatggcctgcgccgacatcttcagctccttcggcaacctcctcgcctccgtctccgacgacgccttcgacaagctgctgctccagctcctgctgaaggcgtcccaggacaagcggttcgtgtgcgaggaggccgagaaggcgacgcgcgcgatggcggcgtcgatgccgccgctgccgctgctgaagaagctcaaggcgtacgtccaccacgccaacctcagggtcagggctaaggccgccgtcgccatctcccactgcgccgcccggatggacatcggcgcgatgaaggagttcgggatgtcggcgctgctgcagctggcggcggagctgctgaacgaccggctgccggaggcgagggaggccgcccgcggcgtggtggcgtcgacgcacgcggccttcgccaaggaggccgccgcgagcggccaggaggaggacgcggccgcgtcctgggagagcctctgcgcgctcagcctcccgcccatctccgcgcaggccgtcgccaagatcgctgccgccgcctcctcctcgcagtagccacggcacgcgtgcggacttgnccgctggcgttgtttttgggggtcgtctggttcggttcagaagtagcgctcgtgagtcttcagacagagctcgtttgtcgccgccgccgagtctgtttgtttgttctttctactccatgctatctcgcatggttagtgttctgtttatggcttcgtcaagtaataacatagtatcaatt

SEQ ID NO: 1140 - protein, 1282 aa, Zea mays
  misc_feature: PFam Name: FH2; PFam Description: Formin Homology 2 Domain
  misc_feature: PFam Name: Extensin_2; PFam Description: Extensin-like region
  misc_feature: PFam Name: MARCKS; PFam Description: MARCKS family
  misc_feature: PFam Name: Pyr_redox_2; PFam Description: Pyridine
  misc_feature: PFam Name: TT_ORF1; PFam Description: TT viral orf 1
  misc_feature: GI Number: 21593517; NR Description: unknown [Arabidopsis thaliana]
  misc_feature: GI Number: 51979208; NR Description: PREDICTED P0543C11.17-3 gene product [Oryza sativa (japonica cultivar-group)] >gi|51979206|ref|XP_507469.1| PREDICTED P0543C11.17-3 gene product [Oryza sativa (japonica cultivar-group)] [Oryza sativa
  misc_feature: GI Number: 51979707; NR Description: PREDICTED P0702C09.23 gene product [Oryza sativa (japonica cultivar-group)] >gi|51979705|ref|XP_507599.1| PREDICTED P0702C09.23 gene product [Oryza sativa (japonica cultivar-group)] [Oryza sativa (japonica
  misc_feature: GI Number: 21537265; NR Description: unknown [Arabidopsis thaliana]
  misc_feature: GI Number: 29829093; NR Description: putative translation initiation factor IF-2 [Streptomyces avermitilis MA-4680] >gi|39931258|sp|Q82K53|IF2_STRAW Translation initiation factor IF-2
AAACTCTGCTGCATCTTCTTCCACTCTCCAGTCTCCACTAGCATCAGTCGCCGCTGCCTATCCTCGAGCACCATTTCCATCAACAGCATCCGCCTCTGGCAAGCTAGCGACANAACTCATGGCACTCCGCGCGCTCGACAACACGATGCCCGCCGCCGTCGAGGAGCGGCCCAAGAAGGTGGCTAAGGTGGGCGTCCCCGCCGCCGCCGCCAAGGCCGCNGCCTCCCCCGGGAGTGGCGGCAAGAAGAAGAAGGGGAACGACGAGAACTCGGCGCCAAGGGCCACGGCCGCGGCGGCGGAGCAGGCNGTGGAGTACATCTCGTCGGAGGAGCTGGAGGCGGCGGCCAACCCTAAGGCCAAGGGCCGCGGGGGCTGGTCGCGGGCCTTGACTCCAAGGACTGGGTCAGGACCTGCGAGGCGCTCAACGACGCGCGCCGCCTCGCGATCCACCACCCCGCGCTGCTGAACCCGATCCTGGAGAAGGTGGTGCTGGCGGTCGTGAAGACGATGAAGAGCCCCCGCAGCGCGGTGCTCAAGACGTCCATCATGGCCTGCGCCGACATCTTCAGCTCCTTCGGCAACCTCCTCGCCTCCGTCTCCGACGACGCCTTCGACAAGCTGCTGCTCCAGCTCCTGCTGAAGGCGTCCCAGGACAAGCGGTTCGTGTGCGAGGAGGCCGAGAAGGCGACGCGCGCGATGGCGGCGTCGATGCCGCCGCTGCCGCTGCTGAAGAAGCTCAAGGCGTACGTCCACCACGCCAACCTCAGGGTCAGGGCTAAGGCCGCCGTCGCCATCTCCCACTGCGCCGCCCGGATGGACATCGGCGCGATGAAGGAGTTCGGGATGTCGGCGCTGCTGCAGCTGGCGGCGGAGCTGCTGAACGACCGGCTGCCGGAGGCGAGGGAGGCCGCCCGCGGCGTGGTGGCGTCGACGCACGCGGCCTTCGCCAAGGAGGCCGCCGCGAGCGGCCAGGAGGAGGACGCGGCCGCGTCCTGGGAGAGCCTCTGCGCGCTCAGCCTCCCGCCCATCTCCGCGCAGGCCGTCGCCAAGATCGCTGCCGCCGCCTCCTCCTCGCAGTAGCCACGGCACGCGTGCGGACTTGNCCGCTGGCGTTGTTTTTGGGGGTCGTCTGGTTCGGTTCAGAAGTAGCGCTCGTGAGTCTTCAGACAGAGCTCGTTTGTCGCCGCCGCCGAGTCTGTTTGTTTGTTCTTTCTACTCCATGCTATCTCGCATGGTTAGTGTTCTGTTTATGGCTTCGTCAAGTAATAACATAGTATCAATT

SEQ ID NO: 1141 - DNA, 1187 bp, Zea mays
  misc_feature (1)..(1187): Ceres cDNA ID no. 12409333
  misc_feature (1)..(1187): Ceres CLONE  ID no. 286077
  misc_feature (1)..(1187): Also known as  Ceres CDNA ID no. 23775984
ccaacagcccgcatcgctcactccgtcactcactcggcgcggcgcccatccccgcggttctcacgagcgcgcgcgcctgcgtccggcgccgtccgccatggcgtcgtccaagcctttattccccttccccgtccccgcccccgacccgtccgacgaggtcgtgcgcgagttcggcccgctgctccgggtctacaagagcggccgcatcgagcggcccctggtggctccgcccgtggagcctggccacgacgccgccacgggggtccaatccaaggacgtccacctcggctcctactcggcccgcctctacctgccccccgtggccgacgccggtgccaagctgcccgtcgtcgtgttcgtgcacggcggcggcttcgtggccgagtccgccgcctcgcccaactaccacctcttcctcaacaggctcgccgccgcctgccccgcgctcgcggtctccgtcgactaccgcctggcgcccgagcacccgctcccggcggggtacgacgactgcctcgccgcgctcaagtgggtgctttccgccgccgacccctgggtcgccgcccacggggatctcgcgcgcgtcttcgtcgccggggacagcgccggcggcaacgtctgccactacctcgccatccacccggacgtcgtccaggcgcagcagcagggctgcccgccgccgctcaagggcgccgtgctcatccacccctggttctggggctccgaggccgtgggcgaggagcccagggaccccgccgtgcgcaccatgggcgccggactctggttcttcgcgtgccccgatgctaatagcatggaagacccgcggatgaaccccatggcgcccgccgcaccgggactccacacgctggcgtgtgagcgcgtcatggtgtgtaccgcggagggcgacttcctcaggtggcgcggccgcgcgtacgccgaggcggtggccgcggcgaggggaggccgcctggggcaggccgccggcgtcgagctgctggagaccatgggagagggccatgtcttcttcctcttcaaacccgactgcgacaaggccaaggagatgctggacaagatggcggctttcatcaatgcgccgtgaacgtgaacgtgatccgtgacgcgtgcgcccttgttcctttgtgtttgcgtgacaatgtggaaaataaaataatatatttcagctgttttgg

SEQ ID NO: 1142 - protein, 1187 aa, Zea mays
  misc_feature: PFam Name: Abhydrolase_3; PFam Description: alpha/beta
  misc_feature: PFam Name: Pyr_redox_2; PFam Description: Pyridine
  misc_feature: PFam Name: FH2; PFam Description: Formin Homology 2 Domain
  misc_feature: PFam Name: COesterase; PFam Description: Carboxylesterase
  misc_feature: PFam Name: Pkinase; PFam Description: Protein kinase domain
  misc_feature: GI Number: 50909645; NR Description: putative PrMC3 [Oryza sativa (japonica cultivar-group)] >gi|46806692|dbj|BAD17762.1|
  misc_feature: GI Number: 51535268; NR Description: putative PrMC3 [Oryza
  misc_feature: GI Number: 51535271; NR Description: putative PrMC3 [Oryza
  misc_feature: GI Number: 51535273; NR Description: putative PrMC3 [Oryza
  misc_feature: GI Number: 51535269; NR Description: putative PrMC3 [Oryza
CCAACAGCCCGCATCGCTCACTCCGTCACTCACTCGGCGCGGCGCCCATCCCCGCGGTTCTCACGAGCGCGCGCGCCTGCGTCCGGCGCCGTCCGCCATGGCGTCGTCCAAGCCTTTATTCCCCTTCCCCGTCCCCGCCCCCGACCCGTCCGACGAGGTCGTGCGCGAGTTCGGCCCGCTGCTCCGGGTCTACAAGAGCGGCCGCATCGAGCGGCCCCTGGTGGCTCCGCCCGTGGAGCCTGGCCACGACGCCGCCACGGGGGTCCAATCCAAGGACGTCCACCTCGGCTCCTACTCGGCCCGCCTCTACCTGCCCCCCGTGGCCGACGCCGGTGCCAAGCTGCCCGTCGTCGTGTTCGTGCACGGCGGCGGCTTCGTGGCCGAGTCCGCCGCCTCGCCCAACTACCACCTCTTCCTCAACAGGCTCGCCGCCGCCTGCCCCGCGCTCGCGGTCTCCGTCGACTACCGCCTGGCGCCCGAGCACCCGCTCCCGGCGGGGTACGACGACTGCCTCGCCGCGCTCAAGTGGGTGCTTTCCGCCGCCGACCCCTGGGTCGCCGCCCACGGGGATCTCGCGCGCGTCTTCGTCGCCGGGGACAGCGCCGGCGGCAACGTCTGCCACTACCTCGCCATCCACCCGGACGTCGTCCAGGCGCAGCAGCAGGGCTGCCCGCCGCCGCTCAAGGGCGCCGTGCTCATCCACCCCTGGTTCTGGGGCTCCGAGGCCGTGGGCGAGGAGCCCAGGGACCCCGCCGTGCGCACCATGGGCGCCGGACTCTGGTTCTTCGCGTGCCCCGATGCTAATAGCATGGAAGACCCGCGGATGAACCCCATGGCGCCCGCCGCACCGGGACTCCACACGCTGGCGTGTGAGCGCGTCATGGTGTGTACCGCGGAGGGCGACTTCCTCAGGTGGCGCGGCCGCGCGTACGCCGAGGCGGTGGCCGCGGCGAGGGGAGGCCGCCTGGGGCAGGCCGCCGGCGTCGAGCTGCTGGAGACCATGGGAGAGGGCCATGTCTTCTTCCTCTTCAAACCCGACTGCGACAAGGCCAAGGAGATGCTGGACAAGATGGCGGCTTTCATCAATGCGCCGTGAACGTGAACGTGATCCGTGACGCGTGCGCCCTTGTTCCTTTGTGTTTGCGTGACAATGTGGAAAATAAAATAATATATTTCAGCTGTTTTGG

SEQ ID NO: 1143 - DNA, 1428 bp, Zea mays
  misc_feature (1)..(1428): Ceres cDNA ID no. 12409365
  misc_feature (1)..(1428): Ceres CLONE  ID no. 285661
  misc_feature (1)..(1428): Also known as  Ceres CDNA ID no. 23759209
gcgtctggtcggacgggtgcatctaaatccgaacccccccgctcttggtcagagggggagtaaagcaaacaacggcggacatggtgcgcccaggaaaagcgcttgcggcgccccagctcctcctcctcgtgttcctctgcctcctagccggtggagcccgcgcatccccgcccacagacgcgctacgccgcgtctccccgcgcgcgggggccggtggcctctgccagcagctgctcctgccgcagggttacccgtgcaccgagcacaccgttcaaacggatgatggctttcttttgtctcttcagcatattccacatggcagaaatggaattgcagataatactggacctccagtttttcttcagcacggtcttttccagggtggagatacatggttcataaactccaatgaacaatcacttggatatatccttgctgacaatggttttgatgtttgggtcggaaatgttcgtggcacacgttggagtaaaggccactctactctctctgttcatgataagcttttctgggattggagttggcaagaccttgctgaatacgacgttttggcaatgttaagctatgtatatacagttgcacagtccaaaattttgtatgtgggacattcacagggaactatcatgggtttggctgcgtttacaatgcctgaaacagtaaagatgataagctctgctgcgcttctttgtcccatttcttaccttgatcacgtcagtgctagttttgttcttagagcagttgccatgcatcttgatgagatgcttgttattatgggcatccatcagttgaacttccggagcgatatgggtgtacagatattagattcgctgtgcgatgatgaacatttggactgcaacgatctgttatcttcaataacaggtcaaaactgttgtttcaattcatctcggattgactattatttggagtatgaaccccatccgtcatcatcaaaaaatttgcggcatcttttccagatgatcaggaaaggcagcttcgcaaagtacgactatggatggtggggaaacctaaggcgctacggccagctgcgtcctccctcattcgatctaagcagcataccggaatcactgccgatatggatggggtatgggggccttgatgccctggctgacgtaacagacgttgagcgcaccatcaaagagctgagatccacgccagagctcttgtacattggtggttatggccacattgatttcatcatgagcgtcaaggcaaaggaagatgtttatgttgacttaatgaggtttctcagggcccagcagggaatgcacagtagctattaggacgcacgtcacgtacgccttcaaataaatgcttatgctatgatgacagtacgaccatgtaaatacggacacagcatagcatgtaaatacaaacagtctattgcattgc

SEQ ID NO: 1144 - protein, 1428 aa, Zea mays
  misc_feature: PFam Name: Abhydrolase_1; PFam Description: alpha/beta
  misc_feature: PFam Name: Abhydro_lipase; PFam Description: ab-hydrolase
  misc_feature: GI Number: 51091881; NR Description: lingual lipase-like
  misc_feature: GI Number: 30679362; NR Description: lipase family protein [Arabidopsis thaliana] >gi|25992524|gb|AAN77143.1| putative
  misc_feature: GI Number: 4585908; NR Description: putative lysosomal acid lipase [Arabidopsis thaliana] >gi|25411617|pir||E84526 probable
  misc_feature: GI Number: 38344633; NR Description: OSJNBa0094P09.4 [Oryza
  misc_feature: GI Number: 50947883; NR Description: putative gastric lipase precursor [Oryza sativa (japonica cultivar-group)] >gi|42407876|dbj|BAD09017.1| putative gastric lipase precursor [Oryza sativa (japonica cultivar-group)]
GCGTCTGGTCGGACGGGTGCATCTAAATCCGAACCCCCCCGCTCTTGGTCAGAGGGGGAGTAAAGCAAACAACGGCGGACATGGTGCGCCCAGGAAAAGCGCTTGCGGCGCCCCAGCTCCTCCTCCTCGTGTTCCTCTGCCTCCTAGCCGGTGGAGCCCGCGCATCCCCGCCCACAGACGCGCTACGCCGCGTCTCCCCGCGCGCGGGGGCCGGTGGCCTCTGCCAGCAGCTGCTCCTGCCGCAGGGTTACCCGTGCACCGAGCACACCGTTCAAACGGATGATGGCTTTCTTTTGTCTCTTCAGCATATTCCACATGGCAGAAATGGAATTGCAGATAATACTGGACCTCCAGTTTTTCTTCAGCACGGTCTTTTCCAGGGTGGAGATACATGGTTCATAAACTCCAATGAACAATCACTTGGATATATCCTTGCTGACAATGGTTTTGATGTTTGGGTCGGAAATGTTCGTGGCACACGTTGGAGTAAAGGCCACTCTACTCTCTCTGTTCATGATAAGCTTTTCTGGGATTGGAGTTGGCAAGACCTTGCTGAATACGACGTTTTGGCAATGTTAAGCTATGTATATACAGTTGCACAGTCCAAAATTTTGTATGTGGGACATTCACAGGGAACTATCATGGGTTTGGCTGCGTTTACAATGCCTGAAACAGTAAAGATGATAAGCTCTGCTGCGCTTCTTTGTCCCATTTCTTACCTTGATCACGTCAGTGCTAGTTTTGTTCTTAGAGCAGTTGCCATGCATCTTGATGAGATGCTTGTTATTATGGGCATCCATCAGTTGAACTTCCGGAGCGATATGGGTGTACAGATATTAGATTCGCTGTGCGATGATGAACATTTGGACTGCAACGATCTGTTATCTTCAATAACAGGTCAAAACTGTTGTTTCAATTCATCTCGGATTGACTATTATTTGGAGTATGAACCCCATCCGTCATCATCAAAAAATTTGCGGCATCTTTTCCAGATGATCAGGAAAGGCAGCTTCGCAAAGTACGACTATGGATGGTGGGGAAACCTAAGGCGCTACGGCCAGCTGCGTCCTCCCTCATTCGATCTAAGCAGCATACCGGAATCACTGCCGATATGGATGGGGTATGGGGGCCTTGATGCCCTGGCTGACGTAACAGACGTTGAGCGCACCATCAAAGAGCTGAGATCCACGCCAGAGCTCTTGTACATTGGTGGTTATGGCCACATTGATTTCATCATGAGCGTCAAGGCAAAGGAAGATGTTTATGTTGACTTAATGAGGTTTCTCAGGGCCCAGCAGGGAATGCACAGTAGCTATTAGGACGCACGTCACGTACGCCTTCAAATAAATGCTTATGCTATGATGACAGTACGACCATGTAAATACGGACACAGCATAGCATGTAAATACAAACAGTCTATTGCATTGC

SEQ ID NO: 1145 - DNA, 1343 bp, Zea mays
  misc_feature (1)..(1343): Ceres cDNA ID no. 12409395
  misc_feature (1)..(1343): Ceres CLONE  ID no. 285434
  misc_feature (1)..(1343): Also known as  Ceres CDNA ID no. 23758798
agttcccatccgccgcccgcgcacttgttccttccggcacagcacacaggacaccgtagacagattcatcgcgacgatggggctggacgtcgtggagatcgggatgggcgccgatttgagcctggatctgaggcacttcgcctccaaggccgtgcggcagagcaaggactacgcgccggcgccggcgccggacatggacgcctgcatccgccgcctcgaggaggagcggggcaagatcgagatgttcaagcgggagctgccgctctgcgcgcgcctcctcgcagacgtgatcgatgtgatgaaggaggaagcggggaaggcggtggcggaggaggacggcgccgccggggacaagagcaagtggatgagcacggcgcagctctggacgggcgattgcggccgcgaggacgcggaaccagagaagcaagacaaggagaggagctcgcctgaggccaggtctcgcgccgccggcggcgctttcttgccgctcaaggctgccgtgggctccggcgcgccggcgttcgcgccgctcggcttgagaatggacgacaaggccgccgcgcgcgccgggatgcccgacctgtgcttgctgtcgccgccggcgaccaagagcgccgccgaggagagccgacgccaggtggtggggtttgcgcaggcggcgacgagggcggccgccgccacggcgccagctgccccttcgcttagcgttggcgtccagtccccgtcgcagcaggcgaggaaggctcggcgttgctggtccacggagctgcatcgccagttcgtcgccgccttgaaccagctcggtggcccccaagttgccaccccaaagcagatcagggagctgatgaaggtggacggcctcacaaacgacgaagtgaaaagccaccttcagaaataccggctgcacaaccggagggcgccagggtccggcgtggtgagccagcccatcgtgctggtgggagggctgtggattccgcaggagcaaagcagctcgcagtccgggtctcccccacggcccgctccacttctccacctcaggcatcgcagtctcgtcggcggccaccgtcagctgcgaggaggaagacggacggtccgagagctatggctggaaatgatgcagaggctgctgctgctgctgctgctgagaggggagctgcagcctcaggaacgggaatcatcaggagggaaactgagagtagtgtagctgtctgtacacatacatagttacattacattacatacagggagtgagggagatcgggccttgagcgctcgagaccaaactgatgcttcgggtttgtacatcccaaagagatgagatgatacagttttgcggctaatcc

SEQ ID NO: 1146 - protein, 1343 aa, Zea mays
  misc_feature: PFam Name: Myb_DNA-binding; PFam Description: Myb-like
  misc_feature: GI Number: 50933785; NR Description: putative cytoskeletal protein-like protein [Oryza sativa (japonica cultivar-group)] >gi|33146555|dbj|BAC79732.1| putative cytoskeletal protein-like
  misc_feature: GI Number: 34910306; NR Description: P0013F10.12 [Oryza sativa (japonica cultivar-group)] >gi|11034542|dbj|BAB17066.1|
  misc_feature: GI Number: 18419989; NR Description: myb family transcription
  misc_feature: GI Number: 21700901; NR Description: At1g13300/T6J4_6 [Arabidopsis thaliana] >gi|13605875|gb|AAK32923.1| At1g13300/T6J4_6 [Arabidopsis thaliana] >gi|25511627|pir||F86267 T6J4.6 protein - Arabidopsis thaliana
  misc_feature: GI Number: 21553699; NR Description: unknown [Arabidopsis thaliana]
AGTTCCCATCCGCCGCCCGCGCACTTGTTCCTTCCGGCACAGCACACAGGACACCGTAGACAGATTCATCGCGACGATGGGGCTGGACGTCGTGGAGATCGGGATGGGCGCCGATTTGAGCCTGGATCTGAGGCACTTCGCCTCCAAGGCCGTGCGGCAGAGCAAGGACTACGCGCCGGCGCCGGCGCCGGACATGGACGCCTGCATCCGCCGCCTCGAGGAGGAGCGGGGCAAGATCGAGATGTTCAAGCGGGAGCTGCCGCTCTGCGCGCGCCTCCTCGCAGACGTGATCGATGTGATGAAGGAGGAAGCGGGGAAGGCGGTGGCGGAGGAGGACGGCGCCGCCGGGGACAAGAGCAAGTGGATGAGCACGGCGCAGCTCTGGACGGGCGATTGCGGCCGCGAGGACGCGGAACCAGAGAAGCAAGACAAGGAGAGGAGCTCGCCTGAGGCCAGGTCTCGCGCCGCCGGCGGCGCTTTCTTGCCGCTCAAGGCTGCCGTGGGCTCCGGCGCGCCGGCGTTCGCGCCGCTCGGCTTGAGAATGGACGACAAGGCCGCCGCGCGCGCCGGGATGCCCGACCTGTGCTTGCTGTCGCCGCCGGCGACCAAGAGCGCCGCCGAGGAGAGCCGACGCCAGGTGGTGGGGTTTGCGCAGGCGGCGACGAGGGCGGCCGCCGCCACGGCGCCAGCTGCCCCTTCGCTTAGCGTTGGCGTCCAGTCCCCGTCGCAGCAGGCGAGGAAGGCTCGGCGTTGCTGGTCCACGGAGCTGCATCGCCAGTTCGTCGCCGCCTTGAACCAGCTCGGTGGCCCCCAAGTTGCCACCCCAAAGCAGATCAGGGAGCTGATGAAGGTGGACGGCCTCACAAACGACGAAGTGAAAAGCCACCTTCAGAAATACCGGCTGCACAACCGGAGGGCGCCAGGGTCCGGCGTGGTGAGCCAGCCCATCGTGCTGGTGGGAGGGCTGTGGATTCCGCAGGAGCAAAGCAGCTCGCAGTCCGGGTCTCCCCCACGGCCCGCTCCACTTCTCCACCTCAGGCATCGCAGTCTCGTCGGCGGCCACCGTCAGCTGCGAGGAGGAAGACGGACGGTCCGAGAGCTATGGCTGGAAATGATGCAGAGGCTGCTGCTGCTGCTGCTGCTGAGAGGGGAGCTGCAGCCTCAGGAACGGGAATCATCAGGAGGGAAACTGAGAGTAGTGTAGCTGTCTGTACACATACATAGTTACATTACATTACATACAGGGAGTGAGGGAGATCGGGCCTTGAGCGCTCGAGACCAAACTGATGCTTCGGGTTTGTACATCCCAAAGAGATGAGATGATACAGTTTTGCGGCTAATCC

SEQ ID NO: 1147 - DNA, 1721 bp, Zea mays
  misc_feature (1)..(1721): Ceres cDNA ID no. 12409460
  misc_feature (1)..(1721): Ceres CLONE  ID no. 284838
  misc_feature (1)..(1721): Also known as  Ceres CDNA ID no. 23767827
acaaaggcgacgcgagcagcgtttgcttccctttccctgctgtgctcggcctcgccgcttcctctgccctggctcaacgattcctccgcttttcctttttcaaaatcgccctttcctcgtgcgcgtgtcgactccttcctgctcgccgccgggtctgggctgggtgacgctgcctcggatgaggccgcgctgaccggagccgtagccggaccacccgcccacccatggcgcgcccgcagcgcgtgtatgaggcttggaaagggaacaataaattcttctttggtgggaggctcatattcggacctgacgccaagtcactgatcctgtctgtttcgctcattgtggccccggtattggtcttctgcggattcgttgctcggcatcttcgccaccacttcccggcttacaatgctggatatgcgattcctgcggtagctgtagtgtttatgatttatgtgctagtcctgctcttgattacatcagcgcaggatcctgggatcgttccccgcgcagcccacccgccggaggatgagttttcttatggcaacgctttgtctgggggcacgcctgggaggctacaattcccccgtgtaaaggaagtactggttaatgggatgcctgtgaaagtgaagtattgtgacacctgcatgatttatcggcctcctcgatgctcacactgttcgatatgcaacaattgtgtagagcgctttgaccatcattgcccctgggttggacaatgcattgggcagcgcaattaccggtactttttcatgtttgtttcttcctcgactcttctctgcatttatgtatttgcaatgtcagccttgtacatcaagtttatcatggatgaggattatccaacagtatggaaggctttcaaacactctcccgcttctttggggcttctgatatattgtttcattgctctctggtttgttggtggactcactgcatttcatatgtacctcattagcaccaaccagaccacgtacgagaatttccgatacagatcagacagcaggcctaacatctatagccaaggatgtctgaataactttctacaagtcttctgcagcaagacaaagccttctaaacacaagttccgggcctacgcgcaagaggaagtgcggcctccaacggttagcttcggcagggaggtcgatgaggaaccggtcggcgggcctcggccgaaagttgaggacgatcttgaaattggtaccgatcttctgaagatctctcagcggcgcaactacgaggacgtcgatgcagaaacgggaggccgtcgcagtcgcagcagcgaggtggaaggcacggccagtgccagacctgctgtggcgtgctcggagtcccagatccctgcggtcgggggtactgacgtgagggtgcggcactcgagctgggaccggcgaagcgggaactgggacatgtcgtcggctgtgcttacgaggagcgcgtcagatgtgattggacgtagcagcgtgtttgccgcggacgctgcacgtccatctctagaagagactcgctagcgaactgtgtctgtgcatccaggaaacatgtgcgagcggttcggatagcgaggccatttgactcgtggtggtggtgacacacacccaggtgttttggctttggctgccttgattgggttttgttaccgacccttgtcagttgtcatgtatggacagttatttttagtcaaagaatctgcccccattgttggcgcc

SEQ ID NO: 1148 - protein, 1721 aa, Zea mays
  misc_feature: PFam Name: zf-DHHC; PFam Description: DHHC zinc finger domain
  misc_feature: GI Number: 56784777; NR Description: putative NEW1 domain
  misc_feature: GI Number: 34908626; NR Description: P0677H08.13 [Oryza sativa (japonica cultivar-group)] >gi|29365512|dbj|BAB89798.2|
  misc_feature: GI Number: 30688566; NR Description: zinc finger (DHHC type)
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 30693084; NR Description: zinc finger (DHHC type)
ACAAAGGCGACGCGAGCAGCGTTTGCTTCCCTTTCCCTGCTGTGCTCGGCCTCGCCGCTTCCTCTGCCCTGGCTCAACGATTCCTCCGCTTTTCCTTTTTCAAAATCGCCCTTTCCTCGTGCGCGTGTCGACTCCTTCCTGCTCGCCGCCGGGTCTGGGCTGGGTGACGCTGCCTCGGATGAGGCCGCGCTGACCGGAGCCGTAGCCGGACCACCCGCCCACCCATGGCGCGCCCGCAGCGCGTGTATGAGGCTTGGAAAGGGAACAATAAATTCTTCTTTGGTGGGAGGCTCATATTCGGACCTGACGCCAAGTCACTGATCCTGTCTGTTTCGCTCATTGTGGCCCCGGTATTGGTCTTCTGCGGATTCGTTGCTCGGCATCTTCGCCACCACTTCCCGGCTTACAATGCTGGATATGCGATTCCTGCGGTAGCTGTAGTGTTTATGATTTATGTGCTAGTCCTGCTCTTGATTACATCAGCGCAGGATCCTGGGATCGTTCCCCGCGCAGCCCACCCGCCGGAGGATGAGTTTTCTTATGGCAACGCTTTGTCTGGGGGCACGCCTGGGAGGCTACAATTCCCCCGTGTAAAGGAAGTACTGGTTAATGGGATGCCTGTGAAAGTGAAGTATTGTGACACCTGCATGATTTATCGGCCTCCTCGATGCTCACACTGTTCGATATGCAACAATTGTGTAGAGCGCTTTGACCATCATTGCCCCTGGGTTGGACAATGCATTGGGCAGCGCAATTACCGGTACTTTTTCATGTTTGTTTCTTCCTCGACTCTTCTCTGCATTTATGTATTTGCAATGTCAGCCTTGTACATCAAGTTTATCATGGATGAGGATTATCCAACAGTATGGAAGGCTTTCAAACACTCTCCCGCTTCTTTGGGGCTTCTGATATATTGTTTCATTGCTCTCTGGTTTGTTGGTGGACTCACTGCATTTCATATGTACCTCATTAGCACCAACCAGACCACGTACGAGAATTTCCGATACAGATCAGACAGCAGGCCTAACATCTATAGCCAAGGATGTCTGAATAACTTTCTACAAGTCTTCTGCAGCAAGACAAAGCCTTCTAAACACAAGTTCCGGGCCTACGCGCAAGAGGAAGTGCGGCCTCCAACGGTTAGCTTCGGCAGGGAGGTCGATGAGGAACCGGTCGGCGGGCCTCGGCCGAAAGTTGAGGACGATCTTGAAATTGGTACCGATCTTCTGAAGATCTCTCAGCGGCGCAACTACGAGGACGTCGATGCAGAAACGGGAGGCCGTCGCAGTCGCAGCAGCGAGGTGGAAGGCACGGCCAGTGCCAGACCTGCTGTGGCGTGCTCGGAGTCCCAGATCCCTGCGGTCGGGGGTACTGACGTGAGGGTGCGGCACTCGAGCTGGGACCGGCGAAGCGGGAACTGGGACATGTCGTCGGCTGTGCTTACGAGGAGCGCGTCAGATGTGATTGGACGTAGCAGCGTGTTTGCCGCGGACGCTGCACGTCCATCTCTAGAAGAGACTCGCTAGCGAACTGTGTCTGTGCATCCAGGAAACATGTGCGAGCGGTTCGGATAGCGAGGCCATTTGACTCGTGGTGGTGGTGACACACACCCAGGTGTTTTGGCTTTGGCTGCCTTGATTGGGTTTTGTTACCGACCCTTGTCAGTTGTCATGTATGGACAGTTATTTTTAGTCAAAGAATCTGCCCCCATTGTTGGCGCC

SEQ ID NO: 1149 - DNA, 1161 bp, Zea mays
  misc_feature (1)..(1161): Ceres cDNA ID no. 12409751
  misc_feature (1)..(1161): Ceres CLONE  ID no. 281763
  misc_feature (1)..(1161): Also known as  Ceres CDNA ID no. 23767911
gaactgtcaacgaattgaattggccgcgagtttcctacctataaaacgacccggatcccccacccccacatttcctcatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgcgtacgccaagcagggcgccggcccgctccgccccggggtcgatcaggtcgagggcaccgtgaaggccgtcgtcggccccgtctacgaccgtttccacgccgtcccgctcgacctcctcaagttcatcgaccgcaaggttggtgagtccgttgaggagatagaccgccgcgtccctccagtggtgaaggaagccccaaccttggcccgctcggctgcgaaggaggttcgccaggccggcctggtgggcacggccactggccttgccaagtcagccatcgcccgcgccgagccaaaggcccgggagctctacacccgctacgagcctgtggcagagcggcgtgccgccgaggcctgggtggccctgaaccgtctccctctggtgccctcggtcaccagggccgtcctccccactgccgcacagctctctgccaggtacaattcggcggtgcgtgatggtgccaagcgcgggaacgccgtggccacctatctcccgctggtgcccactgagcggctcgcccgcgtgttcaggtaccccgtggctgacgttgctgcagcaccagagatgcagcccattccttcccagtagaagatgaaatggaatgtgaactgcataaaccaatatcaagaagtattactgtgttttgtctttgcgtaccttatggtgaactcatgcgtggttcagtatcgtttcattcctttttgttgcagtgagcctacacaagttcgtctttgttttatggataatatgtataacattatctattggaatagcaatgttgatgcttgtgctttgcc

SEQ ID NO: 1150 - protein, 1161 aa, Zea mays
  misc_feature: PFam Name: REF; PFam Description: Rubber elongation factor
  misc_feature: PFam Name: Pyr_redox_2; PFam Description: Pyridine
  misc_feature: PFam Name: GRP; PFam Description: Glycine rich protein family
  misc_feature: GI Number: 7596762; NR Description: stress related protein, putative [Arabidopsis thaliana] >gi|21537353|gb|AAM61694.1| stress related protein, putative [Arabidopsis thaliana] >gi|17380640|gb|AAL36083.1| AT3g05500/F22F7_5 [Arabidopsis
  misc_feature: GI Number: 5802955; NR Description: stress related protein [Vitis riparia] >gi|15214303|sp|Q9SW70|SRP_VITRI Stress-related
  misc_feature: GI Number: 33332330; NR Description: rubber synthesis protein
  misc_feature: GI Number: 3319925; NR Description: Hev b 3 [Hevea brasiliensis] >gi|3319923|emb|CAA11304.1| Hev b 3 [Hevea brasiliensis] >gi|3319921|emb|CAA11303.1| Hev b 3 [Hevea brasiliensis] >gi|14423933|sp|O82803|SRPP_HEVBR Small rubber Hev b3
  misc_feature: GI Number: 37622210; NR Description: small rubber particle
GAACTGTCAACGAATTGAATTGGCCGCGAGTTTCCTACCTATAAAACGACCCGGATCCCCCACCCCCACATTTCCTCATCGTCACAACGCGTCCTCGAATAAAAATCCAGACGAAACCCAAAATCCCCACCGAACGCAACCTAAAATCTCCCCATCCCTCCTCGATCCAGCCCCGCGGAGAAGAGCCATGGCCGATTCCGCAACCAACGACGCCCCCCTGGTCGCCAGCAACCAGCCCACGGAGGAGGAGGTGACGGTGGAGAGGGCCGCGGCGACGGAGGAGCAGGAGGAGGAGAGGCTGCGGTACCTCGAGTTCGTGCAGCAGGCGGCGGCGCAGGCGCTGGTGCTGGCGGCCGCGGCGTACGCGTACGCCAAGCAGGGCGCCGGCCCGCTCCGCCCCGGGGTCGATCAGGTCGAGGGCACCGTGAAGGCCGTCGTCGGCCCCGTCTACGACCGTTTCCACGCCGTCCCGCTCGACCTCCTCAAGTTCATCGACCGCAAGGTTGGTGAGTCCGTTGAGGAGATAGACCGCCGCGTCCCTCCAGTGGTGAAGGAAGCCCCAACCTTGGCCCGCTCGGCTGCGAAGGAGGTTCGCCAGGCCGGCCTGGTGGGCACGGCCACTGGCCTTGCCAAGTCAGCCATCGCCCGCGCCGAGCCAAAGGCCCGGGAGCTCTACACCCGCTACGAGCCTGTGGCAGAGCGGCGTGCCGCCGAGGCCTGGGTGGCCCTGAACCGTCTCCCTCTGGTGCCCTCGGTCACCAGGGCCGTCCTCCCCACTGCCGCACAGCTCTCTGCCAGGTACAATTCGGCGGTGCGTGATGGTGCCAAGCGCGGGAACGCCGTGGCCACCTATCTCCCGCTGGTGCCCACTGAGCGGCTCGCCCGCGTGTTCAGGTACCCCGTGGCTGACGTTGCTGCAGCACCAGAGATGCAGCCCATTCCTTCCCAGTAGAAGATGAAATGGAATGTGAACTGCATAAACCAATATCAAGAAGTATTACTGTGTTTTGTCTTTGCGTACCTTATGGTGAACTCATGCGTGGTTCAGTATCGTTTCATTCCTTTTTGTTGCAGTGAGCCTACACAAGTTCGTCTTTGTTTTATGGATAATATGTATAACATTATCTATTGGAATAGCAATGTTGATGCTTGTGCTTTGCC

SEQ ID NO: 1151 - DNA, 1705 bp, Zea mays
  misc_feature (1)..(1705): Ceres cDNA ID no. 12409831
  misc_feature (1)..(1705): Ceres CLONE  ID no. 280829
  misc_feature (1)..(1705): Also known as  Ceres CDNA ID no. 23758219
  misc_feature (893)..(893): n is a, c, t, g, unknown, or other
ggctatccaggctccagtcgtccccggattagttgtactgtacattgttcctgcgaagacactgggtcgtccgggtcaatcggcagcttgaacaagccatggcggcgcaccggccgaacgccgcggcgccgctgctcgccaagctcgacgccaccgccacgccgccggcgaagcgcaacaagtaccccttcttctgcgccgtgctcgcatccatgacctccgtgctcatgggctacaacgtcgcggtgacgagcggcgcgcagatcttcatggcggaggacctcgggatgagcgacgcgcagatcgaggtgctctcgggggtcatcaacatatactcgctcgtcggcgcgctgctggcaggctggacctccgaccgtctcggccggcgcctcaccatcgtcctcgccaacgccttcttcctcgtcggcccgctcgccatggcgcttgccggcgggtacaccttgctcatggtgggccgcttcatcgccggcgtcggcgtcgggtacgcgctcgtcatcgcgccagtctacgctgccgagatcgcgccggcgtcatcccgcgggctcctcagctcacttcctgagatttttatcaacactggggtgatgctgagttacgtgtcgaatctcgccttctcggggctgcccgtgcacctgtcgtggcgggtgatgttcgcggcgggcgtggtgcccaccgtgttcatggcggccggggtgttcaccatgccggagtcgccgcggtggctggttatgaagggccgggtcgccgaggccaaggccgtgctcgacaagacgtcggacacgcccgctgaggccgagcagcggctgctcgagatcgaggacgtcgtgatggacagcagcggcgacagcggcgcgtggaaggaggtggcgacnaaggctggcgtccagcgcgtgttggcaaccgtggtgacgctgcagttcttccagcaggcgtcaggcatcgactcggtggtgctgtacggcccgcgcgttctcgccatggctggtgtcacgtccaacagcttgctcctgagcctcaacatcctcttcggcgttgccaaggttggctccatcctcatcgccatggcgctagccgaccgcgtcgggcggcgcccactcctgctggtcagcactagcggcatgacggtggcgctgctcgtcctaggctccctgttcgcggtgtttgcgggagccaaggataacgctgcggtggctgcggtgagtgtggtggccgtcatggcgttcgtgatggccttctccgtcggcttgggccctctggcgtgggtgtacagctccgagatactgccgctccgacttcgcgggcagggtgccggggctcggcaccgccatgaaccggatcatgagcggcgtgatcaccatgaccttcatctcgctctaccagggcatcaccatggccggcgcgttctacctctacgccgccatcgccgccgcgtcgttcgtgttcgtgtacgcctgcctgccggagaccaggggccggagcctcgaggacatggaagagctcttccacaccaagtgatttcgtatgtgctgatccaaccaccatttggttcaattctcgattcagtggcaatgcagattttgccattgttggagctggttttgagcttggtcgttatcatcatgggcacatgcgtatacaattgcaagattatattgaaatcgattgattgagccggttggcgtcg

SEQ ID NO: 1152 - protein, 1705 aa, Zea mays
  misc_feature: PFam Name: Sugar_tr; PFam Description: Sugar (and other)
  misc_feature: PFam Name: MFS_1; PFam Description: Major Facilitator Superfamily
  misc_feature: GI Number: 51849627; NR Description: sorbitol transporter
  misc_feature: GI Number: 28316433; NR Description: sorbitol transporter
  misc_feature: GI Number: 30025133; NR Description: putative sorbitol
  misc_feature: GI Number: 12004316; NR Description: mannitol transporter
  misc_feature: GI Number: 33636088; NR Description: sorbitol-like
GGCTATCCAGGCTCCAGTCGTCCCCGGATTAGTTGTACTGTACATTGTTCCTGCGAAGACACTGGGTCGTCCGGGTCAATCGGCAGCTTGAACAAGCCATGGCGGCGCACCGGCCGAACGCCGCGGCGCCGCTGCTCGCCAAGCTCGACGCCACCGCCACGCCGCCGGCGAAGCGCAACAAGTACCCCTTCTTCTGCGCCGTGCTCGCATCCATGACCTCCGTGCTCATGGGCTACAACGTCGCGGTGACGAGCGGCGCGCAGATCTTCATGGCGGAGGACCTCGGGATGAGCGACGCGCAGATCGAGGTGCTCTCGGGGGTCATCAACATATACTCGCTCGTCGGCGCGCTGCTGGCAGGCTGGACCTCCGACCGTCTCGGCCGGCGCCTCACCATCGTCCTCGCCAACGCCTTCTTCCTCGTCGGCCCGCTCGCCATGGCGCTTGCCGGCGGGTACACCTTGCTCATGGTGGGCCGCTTCATCGCCGGCGTCGGCGTCGGGTACGCGCTCGTCATCGCGCCAGTCTACGCTGCCGAGATCGCGCCGGCGTCATCCCGCGGGCTCCTCAGCTCACTTCCTGAGATTTTTATCAACACTGGGGTGATGCTGAGTTACGTGTCGAATCTCGCCTTCTCGGGGCTGCCCGTGCACCTGTCGTGGCGGGTGATGTTCGCGGCGGGCGTGGTGCCCACCGTGTTCATGGCGGCCGGGGTGTTCACCATGCCGGAGTCGCCGCGGTGGCTGGTTATGAAGGGCCGGGTCGCCGAGGCCAAGGCCGTGCTCGACAAGACGTCGGACACGCCCGCTGAGGCCGAGCAGCGGCTGCTCGAGATCGAGGACGTCGTGATGGACAGCAGCGGCGACAGCGGCGCGTGGAAGGAGGTGGCGACNAAGGCTGGCGTCCAGCGCGTGTTGGCAACCGTGGTGACGCTGCAGTTCTTCCAGCAGGCGTCAGGCATCGACTCGGTGGTGCTGTACGGCCCGCGCGTTCTCGCCATGGCTGGTGTCACGTCCAACAGCTTGCTCCTGAGCCTCAACATCCTCTTCGGCGTTGCCAAGGTTGGCTCCATCCTCATCGCCATGGCGCTAGCCGACCGCGTCGGGCGGCGCCCACTCCTGCTGGTCAGCACTAGCGGCATGACGGTGGCGCTGCTCGTCCTAGGCTCCCTGTTCGCGGTGTTTGCGGGAGCCAAGGATAACGCTGCGGTGGCTGCGGTGAGTGTGGTGGCCGTCATGGCGTTCGTGATGGCCTTCTCCGTCGGCTTGGGCCCTCTGGCGTGGGTGTACAGCTCCGAGATACTGCCGCTCCGACTTCGCGGGCAGGGTGCCGGGGCTCGGCACCGCCATGAACCGGATCATGAGCGGCGTGATCACCATGACCTTCATCTCGCTCTACCAGGGCATCACCATGGCCGGCGCGTTCTACCTCTACGCCGCCATCGCCGCCGCGTCGTTCGTGTTCGTGTACGCCTGCCTGCCGGAGACCAGGGGCCGGAGCCTCGAGGACATGGAAGAGCTCTTCCACACCAAGTGATTTCGTATGTGCTGATCCAACCACCATTTGGTTCAATTCTCGATTCAGTGGCAATGCAGATTTTGCCATTGTTGGAGCTGGTTTTGAGCTTGGTCGTTATCATCATGGGCACATGCGTATACAATTGCAAGATTATATTGAAATCGATTGATTGAGCCGGTTGGCGTCG

SEQ ID NO: 1153 - DNA, 1522 bp, Zea mays
  misc_feature (1)..(1522): Ceres cDNA ID no. 12409851
  misc_feature (1)..(1522): Ceres CLONE  ID no. 280543
  misc_feature (1)..(1522): Also known as  Ceres CDNA ID no. 23766102
attattagagagagctacaacaagcatgaagctaagactggtagcgctagtgctggcggtagcgtccggtgtacgcttgctcgtcggcggcatcagcgttcgcgggggacgacgtcgtccgtgtcgcgctaaagcatgtcgacgctgggaagcagctgtccaggcccgagctgatccggcgcgccatgcggaggagcaaggcgagggcggccgcgctctccgcggtgaggaaccgcgcccgcttctctggcaagaacgagcagcaaacgcccgccggcgtgctgccggtgcgcccgtcgggggacctcgagtacgtcatcgacctcgccatcggcacgccgccgcagcccgtctcggcgctgctcgacaccggcagcgacctcatctggacgcagtgcgcgccgtgcgccagctgcctctcgcagccggacccgctgttcgcgccggggcagtcggcgtcgtacgagcccatgcggtgcgccgggacgctctgctctgacatcctgcaccacagctgcgagaggcccgacacgtgcacctaccgctacaactacggcgacggcacgatgaccgtgggcgtgtacgccacggagcgcttcaccttcgcgtcgtcgggcggcggcgggctcacgactaccgtcccgctcggcttcgggtgcggctccgtgaacgtcggcagcctcaacaacggctccggcatcgtgggcttcggccggaacccgctctcgctcgtgtcccagctctccatccgccgcttctcctactgcctcacgtcctacgccagccgcaggcagagcaccctcctgtttggctccctgtccgacggagtctacggtgacgccacgggccgcgtgcagaccacaccgctcctccagagcccccagaacccgaccttctactacgtacacttcacgggcctgaccgtcggcgccaggcggctgcggataccggagtcagcgttcgcgctccggcccgacggctcgggcggcgtgatcgtcgactccggcacggcgctcacgctcctcccagccgcggtgctcgcgggaggtggtgcgggcgttccgccagcagctgaggctgccgttcgcaaacggcggcaaccccgaggacggcgtgtgcttcctggtgcccgcggcctggcggcgctcgtcgtcgacgtcacagatgccggtcccgaggatggtgctccacttccagggcgcggacctcgacctgccgcgccgaaactacgtcctggacgaccacaggaggggccgcctgtgcctcctcctggcagactccggcgacgatggctccacgattggcaacctggtgcagcaggacatgcgcgtgctctacgatttggaggcagagaccttgtcgatcgctccggcacgatgctgacacgcgcgcaactagtagaaaggccgccgactactcgactactctcactgtatgcaagttagtgttaaccatgcaaatgcatgccaaccataccgggtcgcactttgcacgcaggcaaacaaattttttttgtcggtcg

SEQ ID NO: 1154 - protein, 1522 aa, Zea mays
  misc_feature: PFam Name: Asp; PFam Description: Eukaryotic aspartyl protease
  misc_feature: GI Number: 51535938; NR Description: putative aspartic
  misc_feature: GI Number: 51535935; NR Description: putative aspartic
  misc_feature: GI Number: 50946685; NR Description: putative nucleoid DNA-binding protein [Oryza sativa (japonica cultivar-group)] >gi|42407407|dbj|BAD09565.1| putative nucleoid DNA-binding protein
  misc_feature: GI Number: 41016421; NR Description: aspartic proteinase
  misc_feature: GI Number: 41016423; NR Description: aspartic proteinase
ATTATTAGAGAGAGCTACAACAAGCATGAAGCTAAGACTGGTAGCGCTAGTGCTGGCGGTAGCGTCCGGTGTACGCTTGCTCGTCGGCGGCATCAGCGTTCGCGGGGGACGACGTCGTCCGTGTCGCGCTAAAGCATGTCGACGCTGGGAAGCAGCTGTCCAGGCCCGAGCTGATCCGGCGCGCCATGCGGAGGAGCAAGGCGAGGGCGGCCGCGCTCTCCGCGGTGAGGAACCGCGCCCGCTTCTCTGGCAAGAACGAGCAGCAAACGCCCGCCGGCGTGCTGCCGGTGCGCCCGTCGGGGGACCTCGAGTACGTCATCGACCTCGCCATCGGCACGCCGCCGCAGCCCGTCTCGGCGCTGCTCGACACCGGCAGCGACCTCATCTGGACGCAGTGCGCGCCGTGCGCCAGCTGCCTCTCGCAGCCGGACCCGCTGTTCGCGCCGGGGCAGTCGGCGTCGTACGAGCCCATGCGGTGCGCCGGGACGCTCTGCTCTGACATCCTGCACCACAGCTGCGAGAGGCCCGACACGTGCACCTACCGCTACAACTACGGCGACGGCACGATGACCGTGGGCGTGTACGCCACGGAGCGCTTCACCTTCGCGTCGTCGGGCGGCGGCGGGCTCACGACTACCGTCCCGCTCGGCTTCGGGTGCGGCTCCGTGAACGTCGGCAGCCTCAACAACGGCTCCGGCATCGTGGGCTTCGGCCGGAACCCGCTCTCGCTCGTGTCCCAGCTCTCCATCCGCCGCTTCTCCTACTGCCTCACGTCCTACGCCAGCCGCAGGCAGAGCACCCTCCTGTTTGGCTCCCTGTCCGACGGAGTCTACGGTGACGCCACGGGCCGCGTGCAGACCACACCGCTCCTCCAGAGCCCCCAGAACCCGACCTTCTACTACGTACACTTCACGGGCCTGACCGTCGGCGCCAGGCGGCTGCGGATACCGGAGTCAGCGTTCGCGCTCCGGCCCGACGGCTCGGGCGGCGTGATCGTCGACTCCGGCACGGCGCTCACGCTCCTCCCAGCCGCGGTGCTCGCGGGAGGTGGTGCGGGCGTTCCGCCAGCAGCTGAGGCTGCCGTTCGCAAACGGCGGCAACCCCGAGGACGGCGTGTGCTTCCTGGTGCCCGCGGCCTGGCGGCGCTCGTCGTCGACGTCACAGATGCCGGTCCCGAGGATGGTGCTCCACTTCCAGGGCGCGGACCTCGACCTGCCGCGCCGAAACTACGTCCTGGACGACCACAGGAGGGGCCGCCTGTGCCTCCTCCTGGCAGACTCCGGCGACGATGGCTCCACGATTGGCAACCTGGTGCAGCAGGACATGCGCGTGCTCTACGATTTGGAGGCAGAGACCTTGTCGATCGCTCCGGCACGATGCTGACACGCGCGCAACTAGTAGAAAGGCCGCCGACTACTCGACTACTCTCACTGTATGCAAGTTAGTGTTAACCATGCAAATGCATGCCAACCATACCGGGTCGCACTTTGCACGCAGGCAAACAAATTTTTTTTGTCGGTCG

SEQ ID NO: 1155 - DNA, 1230 bp, Zea mays
  misc_feature (1)..(1230): Ceres cDNA ID no. 12410035
  misc_feature (1)..(1230): Ceres CLONE  ID no. 275421
  misc_feature (1)..(1230): Also known as  Ceres CDNA ID no. 23775081
aatcaacacaccaccaccaccagcagcacatcaatttagctagttccaggaacacgcgaggaaaccgcaggcatggccaacaaccgcatcttcgacgagtacaaccccgccgtcgaatggagccgctccgacgaggcggacgccgtccggatctcgctcccagggttcaagagggaggacatacgcgtgctggtggacagccacggccacctgcggacgcgcggcgagcggcacatcgccggcaacaggtggagccgcttccagacggacgtcgacctccccgccaactgcaacgccgacggcatccgcgccaagttcgagaacgacaggctcaccatcacgctccccaagagcacctcctcggcgcccattccggcgccgccgcagaggccgcacgtgaaggcgccgtcgacgtcgtcggcgaggcttccgccggtgactgctaggccagtggcgaggcctgccgcgccgcggcccctggtgccgccagcggcgccgctggctcctcctccttccgtgaagccgcccgccgagcccaggccgtcgatgccgaaaacccgtacgcttccgtgccggcaacggcaccagcgccggcgccggcgccgcaagtggaacaacctgcaaccaccaccaagcccgccgagcccaggccgtcgatgccgaagaacccgtacgcttccgtgccggcaccggcaccagcgccggcgccggcgccgcaagtggaacaacctgcaaccaccaccaagcccgccgagtcgtcgctgggggctgttcagaggccgaaggagcaggaggacaggcagaggaagagggacgaagaggggaagatggctgaggacaggaaggagacggtgcaggagaaggacacggtcacggagcagcaccagcagcaggaggagaaggcaatgctggcagagaaagagatggcgttcgcgaaccagcccgggccggccttcgcgagccgcggcctgctgatgaacgtggcgatcgccgtggtggtgctcctcggggtcaccgtccacttgtggcttagcctgaggaacgccactggaggcgccggcgagcacggccacggcccacgggcagatgggggccggtagacatacgaccacgagctgtgaacaggccgggctgactcgagctggggcgtgaccgcgtgagtacacaatacacgtacacagtacactaaactgaaaggggaaatgggaaataatccaagtacatacaatt

SEQ ID NO: 1156 - protein, 1230 aa, Zea mays
  misc_feature: PFam Name: HSP20; PFam Description: Hsp20/alpha crystallin family
  misc_feature: PFam Name: Pyr_redox_2; PFam Description: Pyridine
  misc_feature: PFam Name: Extensin_2; PFam Description: Extensin-like region
  misc_feature: PFam Name: BASP1; PFam Description: Brain acid soluble
  misc_feature: PFam Name: GATase_2; PFam Description: Glutamine
  misc_feature: GI Number: 18483234; NR Description: small heat shock-like
  misc_feature: GI Number: 21592618; NR Description: unknown [Arabidopsis thaliana]
  misc_feature: GI Number: 50919779; NR Description: Putative small heat shock protein [Oryza sativa (japonica cultivar-group)] >gi|21397266|gb|AAM51830.1| Putative small heat shock protein [Oryza sativa (japonica cultivar-group)]
  misc_feature: GI Number: 34894166; NR Description: P0439B06.4 [Oryza sativa
  misc_feature: GI Number: 15242107; NR Description: heat shock family
AATCAACACACCACCACCACCAGCAGCACATCAATTTAGCTAGTTCCAGGAACACGCGAGGAAACCGCAGGCATGGCCAACAACCGCATCTTCGACGAGTACAACCCCGCCGTCGAATGGAGCCGCTCCGACGAGGCGGACGCCGTCCGGATCTCGCTCCCAGGGTTCAAGAGGGAGGACATACGCGTGCTGGTGGACAGCCACGGCCACCTGCGGACGCGCGGCGAGCGGCACATCGCCGGCAACAGGTGGAGCCGCTTCCAGACGGACGTCGACCTCCCCGCCAACTGCAACGCCGACGGCATCCGCGCCAAGTTCGAGAACGACAGGCTCACCATCACGCTCCCCAAGAGCACCTCCTCGGCGCCCATTCCGGCGCCGCCGCAGAGGCCGCACGTGAAGGCGCCGTCGACGTCGTCGGCGAGGCTTCCGCCGGTGACTGCTAGGCCAGTGGCGAGGCCTGCCGCGCCGCGGCCCCTGGTGCCGCCAGCGGCGCCGCTGGCTCCTCCTCCTTCCGTGAAGCCGCCCGCCGAGCCCAGGCCGTCGATGCCGAAAACCCGTACGCTTCCGTGCCGGCAACGGCACCAGCGCCGGCGCCGGCGCCGCAAGTGGAACAACCTGCAACCACCACCAAGCCCGCCGAGCCCAGGCCGTCGATGCCGAAGAACCCGTACGCTTCCGTGCCGGCACCGGCACCAGCGCCGGCGCCGGCGCCGCAAGTGGAACAACCTGCAACCACCACCAAGCCCGCCGAGTCGTCGCTGGGGGCTGTTCAGAGGCCGAAGGAGCAGGAGGACAGGCAGAGGAAGAGGGACGAAGAGGGGAAGATGGCTGAGGACAGGAAGGAGACGGTGCAGGAGAAGGACACGGTCACGGAGCAGCACCAGCAGCAGGAGGAGAAGGCAATGCTGGCAGAGAAAGAGATGGCGTTCGCGAACCAGCCCGGGCCGGCCTTCGCGAGCCGCGGCCTGCTGATGAACGTGGCGATCGCCGTGGTGGTGCTCCTCGGGGTCACCGTCCACTTGTGGCTTAGCCTGAGGAACGCCACTGGAGGCGCCGGCGAGCACGGCCACGGCCCACGGGCAGATGGGGGCCGGTAGACATACGACCACGAGCTGTGAACAGGCCGGGCTGACTCGAGCTGGGGCGTGACCGCGTGAGTACACAATACACGTACACAGTACACTAAACTGAAAGGGGAAATGGGAAATAATCCAAGTACATACAATT

SEQ ID NO: 1157 - DNA, 1005 bp, Zea mays
  misc_feature (1)..(1005): Ceres cDNA ID no. 12410091
  misc_feature (1)..(1005): Ceres CLONE  ID no. 273838
  misc_feature (1)..(1005): Also known as  Ceres CDNA ID no. 23765214
acaaccgctacggccacagctacagctacggcggcgggtacggccaaggggccagcgccctcggccccgccggcaccgcacatgcccaccgctacatccgccgccccgccctcctcctcctcatacggcgcgtacgccgggtacccgcccgcctaccctccgccgccctcgcaggcggcggagcggattcggtcccgctggctccggctacggcttcgtccccgtcgcgttcccgccggggacgcacccggacgtcgagcgcgccttccgggccgccgaccgcgactgcagcggcgccatcgacgagcgcgagctgcagggagcgctctcctccgcctaccaccgcttcagcgtccgcaccgttcgcctcctcatgttcctcttcaacgacccctcctcctccacgccgtcacggatggggccaacacagttcgtatccctctgggattgccttgggcaatggcggggaatttttgacaggtacgacagggaccggagcggcaaaatcgactcccgtgagctgaccgaggctctccggagccttggatatgctgttccaccttctgtcatcgagcttcttatagcgaattacagcaatggtgtgcccagcaatggcgcgctagactttgacaactttgtggaatgtgggatgattgtgaagggtttaaccgagaaattcaaggagaaggatacgcgctacaccggctcggctactcttacatacgatggtttcttgtcaatggtgatccccttcatcgtcccttagctgtgctgtatgtagttcggtaacttgatagtagtcatcaaccatggttctagtaggagtgctctcccctagtctgtgcgaaaggttttttttttctcttcttcgtttctgagtcttgtctacctttttcgttttgtacattaataacctcgatttgtttgtttcatgggatttacatcgttttggactatgaaatcttccaaggattgaaagtcatatgccatccttcagtattcctg

SEQ ID NO: 1158 - protein, 1005 aa, Zea mays
  misc_feature: PFam Name: Extensin_2; PFam Description: Extensin-like region
  misc_feature: PFam Name: efhand; PFam Description: EF hand
  misc_feature: PFam Name: FH2; PFam Description: Formin Homology 2 Domain
  misc_feature: PFam Name: Pyr_redox_2; PFam Description: Pyridine
  misc_feature: GI Number: 31711842; NR Description: At5g04170 [Arabidopsis thaliana] >gi|9955572|emb|CAC05499.1| EF-hand Calcium binding protein-like [Arabidopsis thaliana] >gi|19698991|gb|AAL91231.1| EF-hand calcium binding protein-like [Arabidopsis thaliana]
  misc_feature: GI Number: 4314390; NR Description: putative calcium binding protein [Arabidopsis thaliana] >gi|25407902|pir||D84673 probable calcium binding protein [imported] - Arabidopsis thaliana >gi|15225885|ref|NP_180317.1| calcium-binding EF hand family
  misc_feature: GI Number: 6624721; NR Description: putative cysteine
  misc_feature: GI Number: 30681239; NR Description: calcium-binding EF-hand
  misc_feature: GI Number: 25992527; NR Description: fiber protein Fb1
ACAACCGCTACGGCCACAGCTACAGCTACGGCGGCGGGTACGGCCAAGGGGCCAGCGCCCTCGGCCCCGCCGGCACCGCACATGCCCACCGCTACATCCGCCGCCCCGCCCTCCTCCTCCTCATACGGCGCGTACGCCGGGTACCCGCCCGCCTACCCTCCGCCGCCCTCGCAGGCGGCGGAGCGGATTCGGTCCCGCTGGCTCCGGCTACGGCTTCGTCCCCGTCGCGTTCCCGCCGGGGACGCACCCGGACGTCGAGCGCGCCTTCCGGGCCGCCGACCGCGACTGCAGCGGCGCCATCGACGAGCGCGAGCTGCAGGGAGCGCTCTCCTCCGCCTACCACCGCTTCAGCGTCCGCACCGTTCGCCTCCTCATGTTCCTCTTCAACGACCCCTCCTCCTCCACGCCGTCACGGATGGGGCCAACACAGTTCGTATCCCTCTGGGATTGCCTTGGGCAATGGCGGGGAATTTTTGACAGGTACGACAGGGACCGGAGCGGCAAAATCGACTCCCGTGAGCTGACCGAGGCTCTCCGGAGCCTTGGATATGCTGTTCCACCTTCTGTCATCGAGCTTCTTATAGCGAATTACAGCAATGGTGTGCCCAGCAATGGCGCGCTAGACTTTGACAACTTTGTGGAATGTGGGATGATTGTGAAGGGTTTAACCGAGAAATTCAAGGAGAAGGATACGCGCTACACCGGCTCGGCTACTCTTACATACGATGGTTTCTTGTCAATGGTGATCCCCTTCATCGTCCCTTAGCTGTGCTGTATGTAGTTCGGTAACTTGATAGTAGTCATCAACCATGGTTCTAGTAGGAGTGCTCTCCCCTAGTCTGTGCGAAAGGTTTTTTTTTTCTCTTCTTCGTTTCTGAGTCTTGTCTACCTTTTTCGTTTTGTACATTAATAACCTCGATTTGTTTGTTTCATGGGATTTACATCGTTTTGGACTATGAAATCTTCCAAGGATTGAAAGTCATATGCCATCCTTCAGTATTCCTG

SEQ ID NO: 1159 - DNA, 1471 bp, Zea mays
  misc_feature (1)..(1471): Ceres cDNA ID no. 12410223
  misc_feature (1)..(1471): Ceres CLONE  ID no. 265061
  misc_feature (1)..(1471): Also known as  Ceres CDNA ID no. 23765052
agtccacccccttcccttctttcccctttgcttgctgctgcctgcttctcgccgtcgccgcctcaattccctcctcctcgtccgtcgcctcgtccacgcgcacctcgtcctcctctccgttcccaccacctcctcgaccgcaccgtcgtcgtctagctagcggagcgagctgcgaccagatcggagagccaagcacccaggaagagggggccggggaacaagaagaagccgccggaagccgggcgtggacgtgtggtggttttctgccggcggctgacaagtggtgtaggctacccgctctggccatggatccgtcgggcggcgcgttcctgccgccgctgcagcaagggagctcctccttcccgcggtcctccagcaacgcgtcgctcgccaggagcggcagcggcggcggcggcgttggcgccgggcgcgggaccaggggcaggaagatgatgcgcagggtctgccgcggcgtcatcaccttcatcttcgccatcgctgggctgttcctgggagcggtgaccggcggtctgatcgggctggcgacggagagcggtctgttccgcggcaccgggatcggcgccatcactggcgcgctcgtctccatcgaggtcgtcgactcctccatccgcctctggcaggcgcgccgatccgggatctggagcatcctctacgtgctgaacgtgatctacagcctcctgacgggcaggctggtgcgcgagaaggtcgacccggcggtgcagcgggtggtccgcagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggctgctccgtctgcctccaggatttccaggtcggggagaaggtgcggagcctgccggactgctggcacgtgttccacgtgccgtgcatcgacggctggctcatcaagcacggctcctgcccgctctgcaggaggaagctgtaggcggatcgaccggacgacgccatgaacgatgttcttctctgcgatcgagccgatgatgtgtgtgtgtgtgcccccgccgccaccaccgatagctgctgctaggatcggaggaggggaggaggaagaagagactgacatctatagaacccttaatttatagagagggcttttgctttgctacttgtacgtgctctactacgtacctattgcatcttttttttttttttgattcaccatgatcgacctccttcctcagatccatccatgcatgtaatataccctggaccggcttgtgcttcgttcgatccattccatgcatctccggactgtgatctcgatctggtgtaatatatataaaaaaactactagtatgtaccatcgcactttggacatctatacatgcatgctggttggtc

SEQ ID NO: 1160 - protein, 1471 aa, Zea mays
  misc_feature: PFam Name: zf-C3HC4; PFam Description: Zinc finger, C3HC4
  misc_feature: GI Number: 18855037; NR Description: putative zinc finger
  misc_feature: GI Number: 50948297; NR Description: putative NEP1-interacting protein [Oryza sativa (japonica cultivar-group)] >gi|42407817|dbj|BAD08961.1| putative NEP1-interacting protein
  misc_feature: GI Number: 27524904; NR Description: NEP1-interacting protein 2 [Arabidopsis thaliana] >gi|30680091|ref|NP_179364.2| zinc finger
  misc_feature: GI Number: 27524902; NR Description: NEP1-interacting protein
  misc_feature: GI Number: 50937111; NR Description: putative NEP1-interacting protein 2 [Oryza sativa (japonica cultivar-group)] >gi|33146606|dbj|BAC79837.1| putative NEP1-interacting protein 2 [Oryza sativa (japonica cultivar-group)] [Oryza sativa (japonica
AGTCCACCCCCTTCCCTTCTTTCCCCTTTGCTTGCTGCTGCCTGCTTCTCGCCGTCGCCGCCTCAATTCCCTCCTCCTCGTCCGTCGCCTCGTCCACGCGCACCTCGTCCTCCTCTCCGTTCCCACCACCTCCTCGACCGCACCGTCGTCGTCTAGCTAGCGGAGCGAGCTGCGACCAGATCGGAGAGCCAAGCACCCAGGAAGAGGGGGCCGGGGAACAAGAAGAAGCCGCCGGAAGCCGGGCGTGGACGTGTGGTGGTTTTCTGCCGGCGGCTGACAAGTGGTGTAGGCTACCCGCTCTGGCCATGGATCCGTCGGGCGGCGCGTTCCTGCCGCCGCTGCAGCAAGGGAGCTCCTCCTTCCCGCGGTCCTCCAGCAACGCGTCGCTCGCCAGGAGCGGCAGCGGCGGCGGCGGCGTTGGCGCCGGGCGCGGGACCAGGGGCAGGAAGATGATGCGCAGGGTCTGCCGCGGCGTCATCACCTTCATCTTCGCCATCGCTGGGCTGTTCCTGGGAGCGGTGACCGGCGGTCTGATCGGGCTGGCGACGGAGAGCGGTCTGTTCCGCGGCACCGGGATCGGCGCCATCACTGGCGCGCTCGTCTCCATCGAGGTCGTCGACTCCTCCATCCGCCTCTGGCAGGCGCGCCGATCCGGGATCTGGAGCATCCTCTACGTGCTGAACGTGATCTACAGCCTCCTGACGGGCAGGCTGGTGCGCGAGAAGGTCGACCCGGCGGTGCAGCGGGTGGTCCGCAGCCAGATGAACGCGGTGGACTCGTCGCCGTTCAGGGAGTCGCCGGACCTGTTCGAGGTGGAGGCCACCAACGGCATGCCGCGGGCGTCCATCGACAAGCTCCCCGAGTCGTGGATCACCGAGGAGTACAGGCGCGACGCCGTCGGCGACCTCTCCGGCTGCTCCGTCTGCCTCCAGGATTTCCAGGTCGGGGAGAAGGTGCGGAGCCTGCCGGACTGCTGGCACGTGTTCCACGTGCCGTGCATCGACGGCTGGCTCATCAAGCACGGCTCCTGCCCGCTCTGCAGGAGGAAGCTGTAGGCGGATCGACCGGACGACGCCATGAACGATGTTCTTCTCTGCGATCGAGCCGATGATGTGTGTGTGTGTGCCCCCGCCGCCACCACCGATAGCTGCTGCTAGGATCGGAGGAGGGGAGGAGGAAGAAGAGACTGACATCTATAGAACCCTTAATTTATAGAGAGGGCTTTTGCTTTGCTACTTGTACGTGCTCTACTACGTACCTATTGCATCTTTTTTTTTTTTTTGATTCACCATGATCGACCTCCTTCCTCAGATCCATCCATGCATGTAATATACCCTGGACCGGCTTGTGCTTCGTTCGATCCATTCCATGCATCTCCGGACTGTGATCTCGATCTGGTGTAATATATATAAAAAAACTACTAGTATGTACCATCGCACTTTGGACATCTATACATGCATGCTGGTTGGTC

SEQ ID NO: 1161 - DNA, 1481 bp, Zea mays
  misc_feature (1)..(1481): Ceres cDNA ID no. 12410320
  misc_feature (1)..(1481): Ceres CLONE  ID no. 263361
  misc_feature (1)..(1481): Also known as  Ceres CDNA ID no. 23757691
gccaaccgatcctcctcctcctcgctcgacgagtcgtctgtgagaacaatggcaactgccgcgggtggagccaccgccggctcgcgccgtcgggcgctgctcctgatcgcgaactacgccgcgctgctggtggggtccgtctcgtcgagcctgctgtccaggttctacttcgcgcgaggcgggcggaaccggtgggtggtgacgctggtgcagtcggcgggcttcccactgctggtcgtcgccgtcctcgtcgccggccgccccgccgccgcgccgcgccccttcacgtggttctcgaggcggttcctcacggtgtgcctcgtcatcggcgcgctcatgggcgccaacaacctgctcttctcgtacagcacgtcgttcctgcccgtgtccacgtcgtcgctgctgctgtcgacgcagttggcgttcacgctcgtgctggccgccgtcatcgtccgccacccgctcaccttcgtcaacctcaatgccgtcgtgctcctgaccgtcagctccgtgctcctggcgctccgctcgggggactccggcgagaacccggacgggggcggcgcggccgcggcgcactacttcgccgggtacgtggtcacgctgggcgcggcggggctgttcgccgcgtacctgcccgtcatggagctcctgtaccgccaggccgtgtccggcgggttcgtcctggccgtggaggtgcaggcggtgatgcaggccatggcctcgctggtggcggcgatcgggctggcggccaagggaggcctgggcggcgacgtggcgcgctggaagggctcggcggcgctctactgggtcgtggtgtccaccctggtcctgacttggcaggcgtgcttcatgggcacggcgggggtgatctacctcacgtcgtcgctacacagcggcgtgtgcatgaccgccgtgctgacggcgaacgtgctgggcggcgtgttggtgttcggcgacccattcggcgccgagaagggcatcgcgaccgcgctctgcgcctggggcctcgcctcctacctctacggcgagtacaccaagaaaaagaaagaagaagaggatgaggccgtcgccgacgcgtccgcttccgacgccgacagcgtccggaagagccttacaggcggcgccggagacgagctagaagacgtctgaaaacaaactaaaggccacaggggaatgaaccgtgtgatcagggacgaagcaagaatggaaactgaaaagggtgtagctgcagttgttgagtcatgttagatcgatggattataggcaaagttacaagcaaccaaacttgtaactgatggccagctcttctggctgctagctagtagctattaatctagtcatgaggtttcactagcggtttaagtgatcagggtttagtactttagtgtagtgtggggtgggtggaatacaacatgtaaaccagctgttcctcctccttactcactgtcgtcatcaatattcaatagccgccgttgttg

SEQ ID NO: 1162 - protein, 1481 aa, Zea mays
  misc_feature: PFam Name: Peptidase_S8; PFam Description: Subtilase family
  misc_feature: PFam Name: DivIVA; PFam Description: DivIVA protein
  misc_feature: PFam Name: GRP; PFam Description: Glycine rich protein family
  misc_feature: GI Number: 34911172; NR Description: putative purine permease [Oryza sativa (japonica cultivar-group)] >gi|20161112|dbj|BAB90042.1| putative purine permease [Oryza sativa (japonica cultivar-group)] >gi|21644687|dbj|BAC01243.1|
  misc_feature: GI Number: 50900310; NR Description: putative purine permease [Oryza sativa (japonica cultivar-group)] >gi|47497670|dbj|BAD19737.1| putative purine permease [Oryza sativa
  misc_feature: GI Number: 50900308; NR Description: putative purine permease [Oryza sativa (japonica cultivar-group)] >gi|47497669|dbj|BAD19736.1| putative purine permease [Oryza sativa
  misc_feature: GI Number: 50900306; NR Description: putative purine permease [Oryza sativa (japonica cultivar-group)] >gi|46806332|dbj|BAD17524.1| putative purine permease [Oryza sativa (japonica cultivar-group)] >gi|47497668|dbj|BAD19735.1|
  misc_feature: GI Number: 42571037; NR Description: purine permease,
GCCAACCGATCCTCCTCCTCCTCGCTCGACGAGTCGTCTGTGAGAACAATGGCAACTGCCGCGGGTGGAGCCACCGCCGGCTCGCGCCGTCGGGCGCTGCTCCTGATCGCGAACTACGCCGCGCTGCTGGTGGGGTCCGTCTCGTCGAGCCTGCTGTCCAGGTTCTACTTCGCGCGAGGCGGGCGGAACCGGTGGGTGGTGACGCTGGTGCAGTCGGCGGGCTTCCCACTGCTGGTCGTCGCCGTCCTCGTCGCCGGCCGCCCCGCCGCCGCGCCGCGCCCCTTCACGTGGTTCTCGAGGCGGTTCCTCACGGTGTGCCTCGTCATCGGCGCGCTCATGGGCGCCAACAACCTGCTCTTCTCGTACAGCACGTCGTTCCTGCCCGTGTCCACGTCGTCGCTGCTGCTGTCGACGCAGTTGGCGTTCACGCTCGTGCTGGCCGCCGTCATCGTCCGCCACCCGCTCACCTTCGTCAACCTCAATGCCGTCGTGCTCCTGACCGTCAGCTCCGTGCTCCTGGCGCTCCGCTCGGGGGACTCCGGCGAGAACCCGGACGGGGGCGGCGCGGCCGCGGCGCACTACTTCGCCGGGTACGTGGTCACGCTGGGCGCGGCGGGGCTGTTCGCCGCGTACCTGCCCGTCATGGAGCTCCTGTACCGCCAGGCCGTGTCCGGCGGGTTCGTCCTGGCCGTGGAGGTGCAGGCGGTGATGCAGGCCATGGCCTCGCTGGTGGCGGCGATCGGGCTGGCGGCCAAGGGAGGCCTGGGCGGCGACGTGGCGCGCTGGAAGGGCTCGGCGGCGCTCTACTGGGTCGTGGTGTCCACCCTGGTCCTGACTTGGCAGGCGTGCTTCATGGGCACGGCGGGGGTGATCTACCTCACGTCGTCGCTACACAGCGGCGTGTGCATGACCGCCGTGCTGACGGCGAACGTGCTGGGCGGCGTGTTGGTGTTCGGCGACCCATTCGGCGCCGAGAAGGGCATCGCGACCGCGCTCTGCGCCTGGGGCCTCGCCTCCTACCTCTACGGCGAGTACACCAAGAAAAAGAAAGAAGAAGAGGATGAGGCCGTCGCCGACGCGTCCGCTTCCGACGCCGACAGCGTCCGGAAGAGCCTTACAGGCGGCGCCGGAGACGAGCTAGAAGACGTCTGAAAACAAACTAAAGGCCACAGGGGAATGAACCGTGTGATCAGGGACGAAGCAAGAATGGAAACTGAAAAGGGTGTAGCTGCAGTTGTTGAGTCATGTTAGATCGATGGATTATAGGCAAAGTTACAAGCAACCAAACTTGTAACTGATGGCCAGCTCTTCTGGCTGCTAGCTAGTAGCTATTAATCTAGTCATGAGGTTTCACTAGCGGTTTAAGTGATCAGGGTTTAGTACTTTAGTGTAGTGTGGGGTGGGTGGAATACAACATGTAAACCAGCTGTTCCTCCTCCTTACTCACTGTCGTCATCAATATTCAATAGCCGCCGTTGTTG

SEQ ID NO: 1163 - DNA, 1456 bp, Zea mays
  misc_feature (1)..(1456): Ceres cDNA ID no. 12410566
  misc_feature (1)..(1456): Ceres CLONE  ID no. 257288
  misc_feature (1)..(1456): Also known as  Ceres CDNA ID no. 23783534
aacacaccgcacacgcacgcacgaacgcgctcccaccccctcccgccgccaccgccgccaaaaccccggcccgactcggcgtcctccgccaacctcctcctgggcagcgccggcgggggatatggcatcggaggacgtggtgggcaagagcaggggcgacacggccgtcaccaccatcgtcaacctggcggaggaggccaagctcgcgcgcgagggggtcaaggcgcccggccaccagatcctcaccatctgcaagtcgctcgtcgccggcggcgtagcaggcggagtgtctcgtactgctgttgctccacttgaacgattgaaaatattgcttcaggttcaaaatccgcacagcatcaagtacaatggtactgttcagggtctcaagtatatctggagaacagagggcctccgtggacttttcaagggcaatggtaccaattgtgcaaggattgttccaaattctgccgtgaagttttttagctacgagcaggcgtcaaagggaattctgtgggcctaccgtcaacagactggtgaagaggatgctcagcttactccgctcttgcgccttggagctggagcatgtgctggtatcatagctatgtctgctacttacccgatggatatggttaggggaaggatcactgttcagacagacaaatctccctaccagtaccgtggtatgtttcatgcactgggtacagtctaccgtgaagaaggctttcgtgctctatacaaagggtggcttccatctgtaatcggagttgttccatatgttggtctcaactttgctgtatatgagtccctcaaagactggctactccagacaaattcatttggccttgcaaatgacaacgagctgcacgtagttacaaggcttgggtgtggagctgtggcgggaaccattggccagactgttgcatacccgcttgatgtcatcaggagaagaatgcagatggttggttggagccatgctgactctattgttactgggcaaggcaaagaagcactccagtacaatggcatgatcgatgcattcaggaagactgttcgtcatgaaggagttggtgctctctacaagggtcttgtgccgaactcagtcaaggtggtgccctcaattgccattgcatttgtgacttacgaggttgtgaaggatgtgctaggagtagagatgaggatatcagactgaggatggccgttttcaactgctatttttgtaggctttgggaagttgtgtttttttttgtaggcagggcgggtagaaggatatgaccgcggctccattcagcatcaggccctctctggcttcaggtcctagaattgtttgctgggtcgtgcaaaaagtaataagtcggctgtaaagcttattaagcatctgcctaactcatcaaaagaaatctattccttattgatgatgtaccgagatttttgaacttaaagcggtactacgtgctgc

SEQ ID NO: 1164 - protein, 1456 aa, Zea mays
  misc_feature: PFam Name: Mito_carr; PFam Description: Mitochondrial
  misc_feature: GI Number: 15810609; NR Description: putative carrier protein [Arabidopsis thaliana] >gi|13430512|gb|AAK25878.1| putative carrier protein [Arabidopsis thaliana] >gi|7267607|emb|CAB80919.1| putative
  misc_feature: GI Number: 50932895; NR Description: putative peroxisomal Ca-dependent solute carrier [Oryza sativa (japonica cultivar-group)] >gi|48843809|gb|AAT47068.1| putative peroxisomal Ca-dependent solute carrier [Oryza sativa (japonica
  misc_feature: GI Number: 66543799; NR Description: PREDICTED: similar to
  misc_feature: GI Number: 50750910; NR Description: PREDICTED: similar to
  misc_feature: GI Number: 33417112; NR Description: MGC68982 protein
AACACACCGCACACGCACGCACGAACGCGCTCCCACCCCCTCCCGCCGCCACCGCCGCCAAAACCCCGGCCCGACTCGGCGTCCTCCGCCAACCTCCTCCTGGGCAGCGCCGGCGGGGGATATGGCATCGGAGGACGTGGTGGGCAAGAGCAGGGGCGACACGGCCGTCACCACCATCGTCAACCTGGCGGAGGAGGCCAAGCTCGCGCGCGAGGGGGTCAAGGCGCCCGGCCACCAGATCCTCACCATCTGCAAGTCGCTCGTCGCCGGCGGCGTAGCAGGCGGAGTGTCTCGTACTGCTGTTGCTCCACTTGAACGATTGAAAATATTGCTTCAGGTTCAAAATCCGCACAGCATCAAGTACAATGGTACTGTTCAGGGTCTCAAGTATATCTGGAGAACAGAGGGCCTCCGTGGACTTTTCAAGGGCAATGGTACCAATTGTGCAAGGATTGTTCCAAATTCTGCCGTGAAGTTTTTTAGCTACGAGCAGGCGTCAAAGGGAATTCTGTGGGCCTACCGTCAACAGACTGGTGAAGAGGATGCTCAGCTTACTCCGCTCTTGCGCCTTGGAGCTGGAGCATGTGCTGGTATCATAGCTATGTCTGCTACTTACCCGATGGATATGGTTAGGGGAAGGATCACTGTTCAGACAGACAAATCTCCCTACCAGTACCGTGGTATGTTTCATGCACTGGGTACAGTCTACCGTGAAGAAGGCTTTCGTGCTCTATACAAAGGGTGGCTTCCATCTGTAATCGGAGTTGTTCCATATGTTGGTCTCAACTTTGCTGTATATGAGTCCCTCAAAGACTGGCTACTCCAGACAAATTCATTTGGCCTTGCAAATGACAACGAGCTGCACGTAGTTACAAGGCTTGGGTGTGGAGCTGTGGCGGGAACCATTGGCCAGACTGTTGCATACCCGCTTGATGTCATCAGGAGAAGAATGCAGATGGTTGGTTGGAGCCATGCTGACTCTATTGTTACTGGGCAAGGCAAAGAAGCACTCCAGTACAATGGCATGATCGATGCATTCAGGAAGACTGTTCGTCATGAAGGAGTTGGTGCTCTCTACAAGGGTCTTGTGCCGAACTCAGTCAAGGTGGTGCCCTCAATTGCCATTGCATTTGTGACTTACGAGGTTGTGAAGGATGTGCTAGGAGTAGAGATGAGGATATCAGACTGAGGATGGCCGTTTTCAACTGCTATTTTTGTAGGCTTTGGGAAGTTGTGTTTTTTTTTGTAGGCAGGGCGGGTAGAAGGATATGACCGCGGCTCCATTCAGCATCAGGCCCTCTCTGGCTTCAGGTCCTAGAATTGTTTGCTGGGTCGTGCAAAAAGTAATAAGTCGGCTGTAAAGCTTATTAAGCATCTGCCTAACTCATCAAAAGAAATCTATTCCTTATTGATGATGTACCGAGATTTTTGAACTTAAAGCGGTACTACGTGCTGC

SEQ ID NO: 1165 - DNA, 1286 bp, Zea mays
  misc_feature (1)..(1286): Ceres cDNA ID no. 12410790
  misc_feature (1)..(1286): Ceres CLONE  ID no. 245133
  misc_feature (1)..(1286): Also known as  Ceres CDNA ID no. 23770010
gagagccccgcccccgggaggccgggagagaagagaacacgcgcgtcaggagcgcacaccgcacggcgcacacacacacgcctcccgcggcaagcagcgcaggacaccgacgacgaagcgaggagaggggaggaggcggagccgagcgcccgagcccaaccccgcaaccacgacccacttccccgtcgcgattcgcattgcccttccctcgggttctacccccagcctcgcgccgccgccgccgccgccgcccttgccagagagatcaccccccattcccacaatcccgtccctccctccgtccctcgacgagccgagccctccgcgcggccgtgggatggggcagtgaccggtgagtggcgtggggagccggtgggcggtggcgagggcatatcatggtgcagtgcctggacggggtgaggcagctgctcgcggtcctgctcaattgctgcgacgtcgagctcaagcagccgcgggggctccaagacccccaggtcctcgcgagggagaccgtcttcagcgtgagtgaggtcgaggcgctgtacgagctgtttaagaggatcagcagcgccgtcattgatgatgggctgattaacaaggaggaatttcagttggcgctatttaagaccaacaagaaggagagcctgttcgcggatcgcgtatttgatttatttgacacaaagcacagtggaattttgggatttgaagaatttgctcgtgctctctcagtatttcatcctaatgctccccttgatgagaaaattgatttttcattccggctgtatgatctcaagcagcaaggctatattgagagacaagaggttaagcagatggttgttgcaacacttgccgagtcaggaatgaatctttcggatgaaattgtagagagtataattgacaagacatttgaggaggcagacacaaagcatgatggaagaattgacaaggaagagtggcgcaatctagtcattcggcatccttctttgctgaagaacatgactcttcagtacctcaaggacatcaccactacatttccaagctttgtctttcactctcaggttgatgataactgaaattgatggggttactttgaaaagaaacattagaagatattctcatgggttctgatatggttttcatttttcaaaattgggttgttggattgaaagattgtagtgttgtgaagtacgtgcatgttggattcgaggactcgattttttttgtcaaccttgtttctttcatttgcatgtctggatgcgcatgaataagatatgaagtttatgtct

SEQ ID NO: 1166 - protein, 1286 aa, Zea mays
  misc_feature: PFam Name: efhand; PFam Description: EF hand
  misc_feature: PFam Name: TT_ORF2; PFam Description: TT viral ORF2
  misc_feature: PFam Name: Drf_FH1; PFam Description: Formin Homology Region 1
  misc_feature: GI Number: 57472399; NR Description: calcineurin B [Pisum sativum] gi|58397762|gb|AAW73072.1| calcineurin B-like protein
  misc_feature: GI Number: 22137326; NR Description: calcineurin B [Pisum sativum]
  misc_feature: GI Number: 60460514; NR Description: calcineurin B-like
  misc_feature: GI Number: 22136404; NR Description: calcineurin B-like protein 3 [Arabidopsis thaliana] >gi|7269509|emb|CAB79512.1| calcineurin B-like protein 3 [Arabidopsis thaliana] >gi|4938495|emb|CAB43853.1| calcineurin B-like protein 3
  misc_feature: GI Number: 56748808; NR Description: Calcineurin B-like protein 3 (SOS3-like calcium binding protein 6) gi|22136404|gb|AAM91280.1| calcineurin B-like protein 3 [Arabidopsis thaliana] gi|7269509|emb|CAB79512.1| calcineurin
GAGAGCCCCGCCCCCGGGAGGCCGGGAGAGAAGAGAACACGCGCGTCAGGAGCGCACACCGCACGGCGCACACACACACGCCTCCCGCGGCAAGCAGCGCAGGACACCGACGACGAAGCGAGGAGAGGGGAGGAGGCGGAGCCGAGCGCCCGAGCCCAACCCCGCAACCACGACCCACTTCCCCGTCGCGATTCGCATTGCCCTTCCCTCGGGTTCTACCCCCAGCCTCGCGCCGCCGCCGCCGCCGCCGCCCTTGCCAGAGAGATCACCCCCCATTCCCACAATCCCGTCCCTCCCTCCGTCCCTCGACGAGCCGAGCCCTCCGCGCGGCCGTGGGATGGGGCAGTGACCGGTGAGTGGCGTGGGGAGCCGGTGGGCGGTGGCGAGGGCATATCATGGTGCAGTGCCTGGACGGGGTGAGGCAGCTGCTCGCGGTCCTGCTCAATTGCTGCGACGTCGAGCTCAAGCAGCCGCGGGGGCTCCAAGACCCCCAGGTCCTCGCGAGGGAGACCGTCTTCAGCGTGAGTGAGGTCGAGGCGCTGTACGAGCTGTTTAAGAGGATCAGCAGCGCCGTCATTGATGATGGGCTGATTAACAAGGAGGAATTTCAGTTGGCGCTATTTAAGACCAACAAGAAGGAGAGCCTGTTCGCGGATCGCGTATTTGATTTATTTGACACAAAGCACAGTGGAATTTTGGGATTTGAAGAATTTGCTCGTGCTCTCTCAGTATTTCATCCTAATGCTCCCCTTGATGAGAAAATTGATTTTTCATTCCGGCTGTATGATCTCAAGCAGCAAGGCTATATTGAGAGACAAGAGGTTAAGCAGATGGTTGTTGCAACACTTGCCGAGTCAGGAATGAATCTTTCGGATGAAATTGTAGAGAGTATAATTGACAAGACATTTGAGGAGGCAGACACAAAGCATGATGGAAGAATTGACAAGGAAGAGTGGCGCAATCTAGTCATTCGGCATCCTTCTTTGCTGAAGAACATGACTCTTCAGTACCTCAAGGACATCACCACTACATTTCCAAGCTTTGTCTTTCACTCTCAGGTTGATGATAACTGAAATTGATGGGGTTACTTTGAAAAGAAACATTAGAAGATATTCTCATGGGTTCTGATATGGTTTTCATTTTTCAAAATTGGGTTGTTGGATTGAAAGATTGTAGTGTTGTGAAGTACGTGCATGTTGGATTCGAGGACTCGATTTTTTTTGTCAACCTTGTTTCTTTCATTTGCATGTCTGGATGCGCATGAATAAGATATGAAGTTTATGTCT

SEQ ID NO: 1167 - DNA, 1231 bp, Zea mays
  misc_feature (1)..(1231): Ceres cDNA ID no. 12410989
  misc_feature (1)..(1231): Ceres CLONE  ID no. 242126
  misc_feature (1)..(1231): Also known as  Ceres CDNA ID no. 23773531
attggtttcgccaaaaacctcaccggctccattcgaccattccatcctttccttatcccctcccacttcgtctcccttcctggcttcctttcttcgccatggcaaccatgtccctccgctccctcgccatggccatggccgacaccgcgctcccgcccgcccacaagctcctccccacagtttccctcccgctcctctcctcgtccacccgcgccgcgccgctcctcctcttcgccaggcgccgcctgccgctcgcgcccctcgttacctcctccgacgccgttgaggccaagtcggcagacgaggaggaggagaaggccggagagcccgtcgacatggaagctggggagtttgaggaggtgctagcctcaggcggcgagggtgaggggcagtacgctgcggtggagccgccagaggaggccaaggtctacgttgggaaccttccctacgacgtcgacagcgagggactcgcgcagatcttcgaccaggccggcgtcgtcgaggtcgccgaggttatctacaacagagaaactggccagagccgtgggtttggctttgttaccatgagcactgttgaggaagctgacaaagccattgagatgttcaaccgctatgatattagcgggaggcttctgaatgtaaacagggcatcttctaggggcactcgcatggaaagacctcagagacaatttgcaccagctttcagagcttatgttggcaacttgccatggcaagttgatgactctaggctggtgcagttgttcagcgagcatggagaagttgttgatgctaaggttgtctacgacagagaaactgggcgctcacgaggattcggttttgtatcaatggtgtcaaaggaggaactcaatgatgctatttcggccctagatggacaggaattggacggccgccctcttcgagtgaatgttgcagcagagcggccacagaggggcttttgatgcggttgtatgagagagatgactgcttgtttgtaatgagcatggagacacagagacacaatggactgaatggaggagcaatggtacaaattagcggaagcggatgctgtcacaagttgctagatctttctcccttagcttcttgacatttggttcttgccacagctttttgatgcttctcttggcagctggacttaatgttttgctattcttgtcgacatcacgagttgaattgtcaaactagtctcttatgttctatgctgatatgcctt

SEQ ID NO: 1168 - protein, 1231 aa, Zea mays
  misc_feature: PFam Name: RRM_1; PFam Description: RNA recognition motif.
  misc_feature: GI Number: 3550483; NR Description: cp31BHv [Hordeum vulgare subsp. vulgare] >gi|7446359|pir||T05727 nucleic acid-binding
  misc_feature: GI Number: 52076131; NR Description: putative nucleic acid-binding protein [Oryza sativa (japonica cultivar-group)] gi|52076138|dbj|BAD46651.1| putative nucleic acid-binding protein
  misc_feature: GI Number: 7446356; NR Description: Ps16 protein - wheat
  misc_feature: GI Number: 3550467; NR Description: cp31AHv protein [Hordeum vulgare subsp. vulgare] >gi|7446358|pir||T05725 cp31AHv protein -
  misc_feature: GI Number: 100903; NR Description: nucleic acid-binding protein - maize >gi|168526|gb|AAA33486.1| nucleic acid-binding
ATTGGTTTCGCCAAAAACCTCACCGGCTCCATTCGACCATTCCATCCTTTCCTTATCCCCTCCCACTTCGTCTCCCTTCCTGGCTTCCTTTCTTCGCCATGGCAACCATGTCCCTCCGCTCCCTCGCCATGGCCATGGCCGACACCGCGCTCCCGCCCGCCCACAAGCTCCTCCCCACAGTTTCCCTCCCGCTCCTCTCCTCGTCCACCCGCGCCGCGCCGCTCCTCCTCTTCGCCAGGCGCCGCCTGCCGCTCGCGCCCCTCGTTACCTCCTCCGACGCCGTTGAGGCCAAGTCGGCAGACGAGGAGGAGGAGAAGGCCGGAGAGCCCGTCGACATGGAAGCTGGGGAGTTTGAGGAGGTGCTAGCCTCAGGCGGCGAGGGTGAGGGGCAGTACGCTGCGGTGGAGCCGCCAGAGGAGGCCAAGGTCTACGTTGGGAACCTTCCCTACGACGTCGACAGCGAGGGACTCGCGCAGATCTTCGACCAGGCCGGCGTCGTCGAGGTCGCCGAGGTTATCTACAACAGAGAAACTGGCCAGAGCCGTGGGTTTGGCTTTGTTACCATGAGCACTGTTGAGGAAGCTGACAAAGCCATTGAGATGTTCAACCGCTATGATATTAGCGGGAGGCTTCTGAATGTAAACAGGGCATCTTCTAGGGGCACTCGCATGGAAAGACCTCAGAGACAATTTGCACCAGCTTTCAGAGCTTATGTTGGCAACTTGCCATGGCAAGTTGATGACTCTAGGCTGGTGCAGTTGTTCAGCGAGCATGGAGAAGTTGTTGATGCTAAGGTTGTCTACGACAGAGAAACTGGGCGCTCACGAGGATTCGGTTTTGTATCAATGGTGTCAAAGGAGGAACTCAATGATGCTATTTCGGCCCTAGATGGACAGGAATTGGACGGCCGCCCTCTTCGAGTGAATGTTGCAGCAGAGCGGCCACAGAGGGGCTTTTGATGCGGTTGTATGAGAGAGATGACTGCTTGTTTGTAATGAGCATGGAGACACAGAGACACAATGGACTGAATGGAGGAGCAATGGTACAAATTAGCGGAAGCGGATGCTGTCACAAGTTGCTAGATCTTTCTCCCTTAGCTTCTTGACATTTGGTTCTTGCCACAGCTTTTTGATGCTTCTCTTGGCAGCTGGACTTAATGTTTTGCTATTCTTGTCGACATCACGAGTTGAATTGTCAAACTAGTCTCTTATGTTCTATGCTGATATGCCTT

SEQ ID NO: 1169 - DNA, 1495 bp, Zea mays
  misc_feature (1)..(1495): Ceres cDNA ID no. 12411232
  misc_feature (1)..(1495): Ceres CLONE  ID no. 239575
  misc_feature (1)..(1495): Also known as  Ceres CDNA ID no. 23755665
  misc_feature (215)..(215): n is a, c, t, g, unknown, or other
atcgaaaagaaaaacctcaccggctccattccaatccatcttttccttatcccctctccctcccttcgttcgccatggcaaccgtgttcctccgttccctcgccatggccatggccgacaccgcgctcccgcccacccacaagctcctccctacggtttccctgccgctcctcccctcgtccacccgcgccgcgccgctcctcctctgcgccacngccgcctgccgcccgcgcccctcgttgcctcctccgacgccgtcgagacgagcattgaatgggttgacgacgaggaggaggaggctggagaagccttcgacgaggagggtgaggatgttgaggaggaggtgctggcctcaggcgacgagggggaaggggagtacgccgcggtggagccgcccgaggaggcaaaggtctacgttgggaacctcccctacgacatcgaaagcgagggactcgcgcagctcttcgaccaggccggcgtcgtcgaggtcgccgaggttatttacaacaaagagactggccagagccgtgggtttggctttgttaccatgagcactattgaggaagctgataaagccattgagatgttcaaccgctatgacattagtgggaggcttctgaatgtaaacagggcatctcctaggggcactcgcatggaaaggcctccgagacaatttgcgcctgctttcagagcttatgttggcaacttgccatggcaagctgatgactctaggctggtgcaattgttcagcgagtacggagaagtcgttaatgctgcggttgtctatgatagagaaaccgggcgctcacgaggattcggttttgtaacgatggtgtcgaaggaggaactcgacgacgctatctctgccctggatggacaggaattggacggccgccctcttcgggtgaacgttgcagcagagcgaccacagaggggcttttgatgcggcggtacgagagagatggctgcttgtttgtgatgagagcacggagacacaacgcaggaggaacggtacaaattagcggaagctgatgctgtcacaagttgctagatccctcccttagcttcctgattttggttcttgtcgacatcatcatgagttaaattatccaagtaggcttctatgtttgatctatcccgattcccgatgccttatcaatttatcatcgttggcaaatgttttgttggtaaaaccataggagcaaacggagattatttatatctgacgtataaaaccgtacccagtgtgttgcatttaacattcatctctccttgacacttcgacggtgtattggtcaaccagttctcgcttcagtctggaagcgttcccaattaggtcatgttccgttttcacggattggaggcttgaaacaatttctagccagcatttatataagttttaatgacttggaacaaattctggtcgaatcctggagaaacgaatgtatcggaatgagaccaagaactatttcagctcaaataaacatatcattcc

SEQ ID NO: 1170 - protein, 1495 aa, Zea mays
  misc_feature: PFam Name: RRM_1; PFam Description: RNA recognition motif.
  misc_feature: GI Number: 3550483; NR Description: cp31BHv [Hordeum vulgare subsp. vulgare] >gi|7446359|pir||T05727 nucleic acid-binding
  misc_feature: GI Number: 100903; NR Description: nucleic acid-binding protein - maize >gi|168526|gb|AAA33486.1| nucleic acid-binding
  misc_feature: GI Number: 3550467; NR Description: cp31AHv protein [Hordeum vulgare subsp. vulgare] >gi|7446358|pir||T05725 cp31AHv protein -
  misc_feature: GI Number: 52076131; NR Description: putative nucleic acid-binding protein [Oryza sativa (japonica cultivar-group)] gi|52076138|dbj|BAD46651.1| putative nucleic acid-binding protein
  misc_feature: GI Number: 7446356; NR Description: Ps16 protein - wheat
ATCGAAAAGAAAAACCTCACCGGCTCCATTCCAATCCATCTTTTCCTTATCCCCTCTCCCTCCCTTCGTTCGCCATGGCAACCGTGTTCCTCCGTTCCCTCGCCATGGCCATGGCCGACACCGCGCTCCCGCCCACCCACAAGCTCCTCCCTACGGTTTCCCTGCCGCTCCTCCCCTCGTCCACCCGCGCCGCGCCGCTCCTCCTCTGCGCCACNGCCGCCTGCCGCCCGCGCCCCTCGTTGCCTCCTCCGACGCCGTCGAGACGAGCATTGAATGGGTTGACGACGAGGAGGAGGAGGCTGGAGAAGCCTTCGACGAGGAGGGTGAGGATGTTGAGGAGGAGGTGCTGGCCTCAGGCGACGAGGGGGAAGGGGAGTACGCCGCGGTGGAGCCGCCCGAGGAGGCAAAGGTCTACGTTGGGAACCTCCCCTACGACATCGAAAGCGAGGGACTCGCGCAGCTCTTCGACCAGGCCGGCGTCGTCGAGGTCGCCGAGGTTATTTACAACAAAGAGACTGGCCAGAGCCGTGGGTTTGGCTTTGTTACCATGAGCACTATTGAGGAAGCTGATAAAGCCATTGAGATGTTCAACCGCTATGACATTAGTGGGAGGCTTCTGAATGTAAACAGGGCATCTCCTAGGGGCACTCGCATGGAAAGGCCTCCGAGACAATTTGCGCCTGCTTTCAGAGCTTATGTTGGCAACTTGCCATGGCAAGCTGATGACTCTAGGCTGGTGCAATTGTTCAGCGAGTACGGAGAAGTCGTTAATGCTGCGGTTGTCTATGATAGAGAAACCGGGCGCTCACGAGGATTCGGTTTTGTAACGATGGTGTCGAAGGAGGAACTCGACGACGCTATCTCTGCCCTGGATGGACAGGAATTGGACGGCCGCCCTCTTCGGGTGAACGTTGCAGCAGAGCGACCACAGAGGGGCTTTTGATGCGGCGGTACGAGAGAGATGGCTGCTTGTTTGTGATGAGAGCACGGAGACACAACGCAGGAGGAACGGTACAAATTAGCGGAAGCTGATGCTGTCACAAGTTGCTAGATCCCTCCCTTAGCTTCCTGATTTTGGTTCTTGTCGACATCATCATGAGTTAAATTATCCAAGTAGGCTTCTATGTTTGATCTATCCCGATTCCCGATGCCTTATCAATTTATCATCGTTGGCAAATGTTTTGTTGGTAAAACCATAGGAGCAAACGGAGATTATTTATATCTGACGTATAAAACCGTACCCAGTGTGTTGCATTTAACATTCATCTCTCCTTGACACTTCGACGGTGTATTGGTCAACCAGTTCTCGCTTCAGTCTGGAAGCGTTCCCAATTAGGTCATGTTCCGTTTTCACGGATTGGAGGCTTGAAACAATTTCTAGCCAGCATTTATATAAGTTTTAATGACTTGGAACAAATTCTGGTCGAATCCTGGAGAAACGAATGTATCGGAATGAGACCAAGAACTATTTCAGCTCAAATAAACATATCATTCC

SEQ ID NO: 1171 - DNA, 1592 bp, Zea mays
  misc_feature (1)..(1592): Ceres cDNA ID no. 12411477
  misc_feature (1)..(1592): Ceres CLONE  ID no. 265080
  misc_feature (1)..(1592): Also known as  Ceres CDNA ID no. 23766264
gtataccagtctagcaccgaactaccaaaaccgaccgagccgcgaacttcacccctgccttctctcccttctccgtccaggccctggtgcccgcgcgttctcgtgcggcaagtgggcgccgccgccggactacgacaggtgcccagttcctcgtcgggtccttcgtcgacgacgagcacccaccaaaaattcgagtattagactctacatgtcaagaaagtatggcgccaggaagcaaggcggagcggaaagcagcactagatgctggcgcatggatgttcaatgtcgtcacatctgttggtatcatcatggtcaacaaaggcttaatggcgactcatggctttagttttgctacaacactgactggacttcattttgcaatgacaaccttgatgacgttagtaatgaaatggctgggatatattcagccatcttatttaccattaccagaactagtaaagtttgccttttttgcaaacctgtcgatcgtcggaatgaacgttagtttgatgtggaactctgttggattctatcagatcgcgaagttgtgtatcattccagtcttatgcattctggaaatcatattcgacaaagttcgttactcaagagatacaaagctcagtatagtgcttgtcctcataggtgttgctgtgtgtactgtgactgatgttagcgtgaactctcaagggctattagctgcagtaatagctgtttggagcacagcactacaacaacattatgttcaccaccttcaatggaagtactcgcttggctcattcaatctcttaggccatactgctccagcgcaggcagcatcattgttaatagtggggccttttgtggacttctggctgactaacaaaagagttgatgcttttaactacacatcaatagttacgttctttatcgtgttgtcgtgcataattgccgttgggacgaatctaagccaattcatatgcatcggaagattcacagccgtctcgttccaagtcctaggccacatgaagacagttctggtgttgaccttggggttccttttctttgggaaagaggggctcaacttccatgtcgcccttggcatgcttctggctgtgatcggcatgatctggtacgggaacgcgtcgtcgaaatctggaggcaaagagcgccaggtctaccccacaccgagcgagaagactcagaagcatggggcgctgtcatcgcagtccgagctcgatcagaaggtctaaacgagacacacaaaggcatccgatgcttgttgagcaccggtcgacctggctttattttttagtacttatttttgagggatgagatgtttctataggattgtaggtggggccatagcagaaagagggtgcctgggtaaaatgcccacgagtttacttttgcagtgagtatgtcaatctaagctggcagatacttgatttgtaatagtctttgtgtgtgtttcgctcttcatgtggcatgttcagtttgatctatagttgtatctttcactttcacactgaaattgaaaagtaaagcgcaaatttccttgtatatgtattacaagtaattaatttggtgctatatatcgcatctgtccggttttt

SEQ ID NO: 1172 - protein, 1592 aa, Zea mays
  misc_feature: GI Number: 50933293; NR Description: putative transmembrane protein [Oryza sativa (japonica cultivar-group)] >gi|48843759|gb|AAT47018.1| putative transmembrane protein [Oryza
  misc_feature: GI Number: 30313364; NR Description: putative transmembrane
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
  misc_feature: GI Number: 21595054; NR Description: unknown [Arabidopsis thaliana]
  misc_feature: GI Number: 21593003; NR Description: unknown [Arabidopsis thaliana]
GTATACCAGTCTAGCACCGAACTACCAAAACCGACCGAGCCGCGAACTTCACCCCTGCCTTCTCTCCCTTCTCCGTCCAGGCCCTGGTGCCCGCGCGTTCTCGTGCGGCAAGTGGGCGCCGCCGCCGGACTACGACAGGTGCCCAGTTCCTCGTCGGGTCCTTCGTCGACGACGAGCACCCACCAAAAATTCGAGTATTAGACTCTACATGTCAAGAAAGTATGGCGCCAGGAAGCAAGGCGGAGCGGAAAGCAGCACTAGATGCTGGCGCATGGATGTTCAATGTCGTCACATCTGTTGGTATCATCATGGTCAACAAAGGCTTAATGGCGACTCATGGCTTTAGTTTTGCTACAACACTGACTGGACTTCATTTTGCAATGACAACCTTGATGACGTTAGTAATGAAATGGCTGGGATATATTCAGCCATCTTATTTACCATTACCAGAACTAGTAAAGTTTGCCTTTTTTGCAAACCTGTCGATCGTCGGAATGAACGTTAGTTTGATGTGGAACTCTGTTGGATTCTATCAGATCGCGAAGTTGTGTATCATTCCAGTCTTATGCATTCTGGAAATCATATTCGACAAAGTTCGTTACTCAAGAGATACAAAGCTCAGTATAGTGCTTGTCCTCATAGGTGTTGCTGTGTGTACTGTGACTGATGTTAGCGTGAACTCTCAAGGGCTATTAGCTGCAGTAATAGCTGTTTGGAGCACAGCACTACAACAACATTATGTTCACCACCTTCAATGGAAGTACTCGCTTGGCTCATTCAATCTCTTAGGCCATACTGCTCCAGCGCAGGCAGCATCATTGTTAATAGTGGGGCCTTTTGTGGACTTCTGGCTGACTAACAAAAGAGTTGATGCTTTTAACTACACATCAATAGTTACGTTCTTTATCGTGTTGTCGTGCATAATTGCCGTTGGGACGAATCTAAGCCAATTCATATGCATCGGAAGATTCACAGCCGTCTCGTTCCAAGTCCTAGGCCACATGAAGACAGTTCTGGTGTTGACCTTGGGGTTCCTTTTCTTTGGGAAAGAGGGGCTCAACTTCCATGTCGCCCTTGGCATGCTTCTGGCTGTGATCGGCATGATCTGGTACGGGAACGCGTCGTCGAAATCTGGAGGCAAAGAGCGCCAGGTCTACCCCACACCGAGCGAGAAGACTCAGAAGCATGGGGCGCTGTCATCGCAGTCCGAGCTCGATCAGAAGGTCTAAACGAGACACACAAAGGCATCCGATGCTTGTTGAGCACCGGTCGACCTGGCTTTATTTTTTAGTACTTATTTTTGAGGGATGAGATGTTTCTATAGGATTGTAGGTGGGGCCATAGCAGAAAGAGGGTGCCTGGGTAAAATGCCCACGAGTTTACTTTTGCAGTGAGTATGTCAATCTAAGCTGGCAGATACTTGATTTGTAATAGTCTTTGTGTGTGTTTCGCTCTTCATGTGGCATGTTCAGTTTGATCTATAGTTGTATCTTTCACTTTCACACTGAAATTGAAAAGTAAAGCGCAAATTTCCTTGTATATGTATTACAAGTAATTAATTTGGTGCTATATATCGCATCTGTCCGGTTTTT

SEQ ID NO: 1173 - DNA, 1462 bp, Zea mays
  misc_feature (1)..(1462): Ceres cDNA ID no. 12411546
  misc_feature (1)..(1462): Ceres CLONE  ID no. 230540
  misc_feature (1)..(1462): Also known as  Ceres CDNA ID no. 23764517
aactgtccaacagtcgcttcaccgtcggcgccgtcggagggacgctccaggtggctgcccccggcagcggaaagtttcctgcggcccctgccctctttcaccaccgcgggttctcaggcagagaaaccttacctgtgcatcatggagattgcagagctcctccaggagcttgtttcatggtcacgtcacctatgttggggccaattagggtatccttagtatgtagcgcgagccccaaccaccataggccaaggatttcggatatatcgcaactacaaaaggaggggtcctccagagggaaaggaaggtcgtaccaggataaagatgactctgagaacatcgatgaatatgatagcgatatcatgttctccaggaatggaccacctatctctttggcaagcacttcccgtcctcaagacacttcagctcctggggaaagagagatggagattgtggagctctttaaaagggttcaagcactgctgcgagctagggtgaaaggcagggaaaagaagcctgaacctgcaaaagtgcatggcgaaaggggcagtgttgattcacttattaagttgcttaggaagcactctgttgaccagagaaggaagagcggtgacgagaaagagcagaattttgatgtaatgaggagaagcaatgattctggaaatagacgaggttcaaccatctttggcacaaaaagtgacatccaggaagagcagaagaagcaacctccggcacccttcaaaaggccagcttcaaatttcaggcgaaggtctcctgttcctggagtgaagttccagcctgttatcaatgtggatgtagacacagatgccgatcgcaagtctatgcgcaataatgtcgccgatgctgtacagatggctaaagacagctcttgatgagaggactgctacagatgagcctgactacatgtctccatatgaacctgattctgtaatcgagccagaaaatattccgttggacgacctcgatgacatttcagacgatgacgaagaatctgatgctgatgaaccagacaacgagtatccagaactgtctttggaaatcgctgatgttacagatacagatgaattgcacgaaagttcatatctaaactctctgaaggttgcagagctgagggagcttgcaaagtcccgaggaatcaaaggctactgaaagatgaagaaaaacgagctgattgaagtcttgagcagcagcatggcatgatgataagtgggtgatgttgtcgacctgtcagcatggtggatgaagactgtcaattattggcctgcgctgcggtctcgacgccgtgcagaggtagctgcagctttgctcattgggtttgttgcttgcttttgtccagagactagggcaggacaggactgtgttaaggcaggcggccgcgttattgcctgtgcttctattgttaccttgtgctatgctatatgctaatcatttggcaggcgtc

SEQ ID NO: 1174 - protein, 1462 aa, Zea mays
  misc_feature: PFam Name: Rho_N; PFam Description: Rho termination factor,
  misc_feature: GI Number: 21727822; NR Description: SAP-like protein [Oryza sativa] >gi|21727820|emb|CAC86222.1| SAP-like protein [Oryza
  misc_feature: GI Number: 50920397; NR Description: Putative plasma membrane proton ATPase [Oryza sativa] >gi|15217290|gb|AAK92634.1| Putative
  misc_feature: GI Number: 21536878; NR Description: unknown [Arabidopsis thaliana]
  misc_feature: GI Number: 19347613; NR Description: Riaa1 [Oryza sativa]
AACTGTCCAACAGTCGCTTCACCGTCGGCGCCGTCGGAGGGACGCTCCAGGTGGCTGCCCCCGGCAGCGGAAAGTTTCCTGCGGCCCCTGCCCTCTTTCACCACCGCGGGTTCTCAGGCAGAGAAACCTTACCTGTGCATCATGGAGATTGCAGAGCTCCTCCAGGAGCTTGTTTCATGGTCACGTCACCTATGTTGGGGCCAATTAGGGTATCCTTAGTATGTAGCGCGAGCCCCAACCACCATAGGCCAAGGATTTCGGATATATCGCAACTACAAAAGGAGGGGTCCTCCAGAGGGAAAGGAAGGTCGTACCAGGATAAAGATGACTCTGAGAACATCGATGAATATGATAGCGATATCATGTTCTCCAGGAATGGACCACCTATCTCTTTGGCAAGCACTTCCCGTCCTCAAGACACTTCAGCTCCTGGGGAAAGAGAGATGGAGATTGTGGAGCTCTTTAAAAGGGTTCAAGCACTGCTGCGAGCTAGGGTGAAAGGCAGGGAAAAGAAGCCTGAACCTGCAAAAGTGCATGGCGAAAGGGGCAGTGTTGATTCACTTATTAAGTTGCTTAGGAAGCACTCTGTTGACCAGAGAAGGAAGAGCGGTGACGAGAAAGAGCAGAATTTTGATGTAATGAGGAGAAGCAATGATTCTGGAAATAGACGAGGTTCAACCATCTTTGGCACAAAAAGTGACATCCAGGAAGAGCAGAAGAAGCAACCTCCGGCACCCTTCAAAAGGCCAGCTTCAAATTTCAGGCGAAGGTCTCCTGTTCCTGGAGTGAAGTTCCAGCCTGTTATCAATGTGGATGTAGACACAGATGCCGATCGCAAGTCTATGCGCAATAATGTCGCCGATGCTGTACAGATGGCTAAAGACAGCTCTTGATGAGAGGACTGCTACAGATGAGCCTGACTACATGTCTCCATATGAACCTGATTCTGTAATCGAGCCAGAAAATATTCCGTTGGACGACCTCGATGACATTTCAGACGATGACGAAGAATCTGATGCTGATGAACCAGACAACGAGTATCCAGAACTGTCTTTGGAAATCGCTGATGTTACAGATACAGATGAATTGCACGAAAGTTCATATCTAAACTCTCTGAAGGTTGCAGAGCTGAGGGAGCTTGCAAAGTCCCGAGGAATCAAAGGCTACTGAAAGATGAAGAAAAACGAGCTGATTGAAGTCTTGAGCAGCAGCATGGCATGATGATAAGTGGGTGATGTTGTCGACCTGTCAGCATGGTGGATGAAGACTGTCAATTATTGGCCTGCGCTGCGGTCTCGACGCCGTGCAGAGGTAGCTGCAGCTTTGCTCATTGGGTTTGTTGCTTGCTTTTGTCCAGAGACTAGGGCAGGACAGGACTGTGTTAAGGCAGGCGGCCGCGTTATTGCCTGTGCTTCTATTGTTACCTTGTGCTATGCTATATGCTAATCATTTGGCAGGCGTC

SEQ ID NO: 1175 - DNA, 1438 bp, Zea mays
  misc_feature (1)..(1438): Ceres cDNA ID no. 12411586
  misc_feature (1)..(1438): Ceres CLONE  ID no. 229463
  misc_feature (1)..(1438): Also known as  Ceres CDNA ID no. 23752838
aaagaccgtgtgtgtcaaagagagaaccagcacacagcagagtagcacctgatcgatcgatctcctactactagctcgttcgctttcacaaccagggagcagcaatggcatctgctgctactactctcctcaagtcgtcattcctccccaagaaggctgaatggggatccaagcaccagctggttgccgctcatcccaggccgcgaccgtcgtcgtctccatggttgcccgcgctagcgcctacgctgacgagcttgtccagaccgcgaaaaccatcgcgtcgccgggaaggggcatcctcgccatggacgagtcgaacgcgacctgcgggaagaggctcgactccatcggcctcgagaacaccgaggccaaccgccaggcctacaggaccctcctcgtcagcgctccaggcctgggacagtacatctctggtgccatcctcttcgaggagaccctctaccagtcgaccgtcgacggcaagaagatcgtcgacgtgcttagtgagcagggaatcgtgcctggtatcaaggtcgacaagggtcttgtgccactcgctggctccaacaacgagtcatggtgccaaggtctcgatggccttgcttcacgtgaggcagcctactaccaggccggtgcccgcttcgccaaatggcgcactgttgtcagcatccccaacggtccatctcaactagccgtgaaggaagctgcctggggcctcgcccgctacgccgccatctcacaggaaaatggtctggtgccgatcgtggagcccgagatccttctggatggcgagcacggcatcgagaggaccttcgaggtggcgcagaaggtgtgggcggagaccttcttctacatggccgagaacagcgtgatgttcgagggcatcctgctgaagcccagcatggtgacccctggtgccgagtgcgaggagaaggccaccccggagcaagtagccgagtacaccctcaggctcctgcgcacaaggatccctcccgccgtgccgggcatcatgttcctgtccggcgggcagtctgaggtggaggcgacccagaacctgaacgccatgaaccagagccccaacccgtggcacgtgtccttctcctacgccagggcgctgcagaacacctgcctcaagacgtggggcggcaggcccgagaacgtcaaggcggcgcaggacgcgctgctgctgcgcgccaaggccaactccctggcgcagctcggcaagtacaccggcgatggcgaggccgcggcggcaaaggagggcatgttcgtcaagaactacagctactaattaaagacgacggcgatacaccactcctgctgctagtacgttcctcgatcgggggcggtcccgttacaggtttcagctggaaaacatacactactgcaaattttactgctaccctgagtgaaaacatggaacgggtcactggatttgggc

SEQ ID NO: 1176 - protein, 1438 aa, Zea mays
  misc_feature: PFam Name: Glycolytic; PFam Description:
  misc_feature: GI Number: 16226653; NR Description: AT4g38970/F19H22_70
  misc_feature: GI Number: 53828647; NR Description: At4g38970 [Arabidopsis thaliana] >gi|18420348|ref|NP_568049.1| fructose-bisphosphate
  misc_feature: GI Number: 8272480; NR Description: fructose 1,6-bisphosphate
  misc_feature: GI Number: 1781348; NR Description: homologous to plastidic aldolases [Solanum tuberosum] >gi|7436610|pir||T07418 probable fructose-bisphosphate aldolase (EC 4.1.2.13) precursor, chloroplast
  misc_feature: GI Number: 21311559; NR Description: latex plastidic
AAAGACCGTGTGTGTCAAAGAGAGAACCAGCACACAGCAGAGTAGCACCTGATCGATCGATCTCCTACTACTAGCTCGTTCGCTTTCACAACCAGGGAGCAGCAATGGCATCTGCTGCTACTACTCTCCTCAAGTCGTCATTCCTCCCCAAGAAGGCTGAATGGGGATCCAAGCACCAGCTGGTTGCCGCTCATCCCAGGCCGCGACCGTCGTCGTCTCCATGGTTGCCCGCGCTAGCGCCTACGCTGACGAGCTTGTCCAGACCGCGAAAACCATCGCGTCGCCGGGAAGGGGCATCCTCGCCATGGACGAGTCGAACGCGACCTGCGGGAAGAGGCTCGACTCCATCGGCCTCGAGAACACCGAGGCCAACCGCCAGGCCTACAGGACCCTCCTCGTCAGCGCTCCAGGCCTGGGACAGTACATCTCTGGTGCCATCCTCTTCGAGGAGACCCTCTACCAGTCGACCGTCGACGGCAAGAAGATCGTCGACGTGCTTAGTGAGCAGGGAATCGTGCCTGGTATCAAGGTCGACAAGGGTCTTGTGCCACTCGCTGGCTCCAACAACGAGTCATGGTGCCAAGGTCTCGATGGCCTTGCTTCACGTGAGGCAGCCTACTACCAGGCCGGTGCCCGCTTCGCCAAATGGCGCACTGTTGTCAGCATCCCCAACGGTCCATCTCAACTAGCCGTGAAGGAAGCTGCCTGGGGCCTCGCCCGCTACGCCGCCATCTCACAGGAAAATGGTCTGGTGCCGATCGTGGAGCCCGAGATCCTTCTGGATGGCGAGCACGGCATCGAGAGGACCTTCGAGGTGGCGCAGAAGGTGTGGGCGGAGACCTTCTTCTACATGGCCGAGAACAGCGTGATGTTCGAGGGCATCCTGCTGAAGCCCAGCATGGTGACCCCTGGTGCCGAGTGCGAGGAGAAGGCCACCCCGGAGCAAGTAGCCGAGTACACCCTCAGGCTCCTGCGCACAAGGATCCCTCCCGCCGTGCCGGGCATCATGTTCCTGTCCGGCGGGCAGTCTGAGGTGGAGGCGACCCAGAACCTGAACGCCATGAACCAGAGCCCCAACCCGTGGCACGTGTCCTTCTCCTACGCCAGGGCGCTGCAGAACACCTGCCTCAAGACGTGGGGCGGCAGGCCCGAGAACGTCAAGGCGGCGCAGGACGCGCTGCTGCTGCGCGCCAAGGCCAACTCCCTGGCGCAGCTCGGCAAGTACACCGGCGATGGCGAGGCCGCGGCGGCAAAGGAGGGCATGTTCGTCAAGAACTACAGCTACTAATTAAAGACGACGGCGATACACCACTCCTGCTGCTAGTACGTTCCTCGATCGGGGGCGGTCCCGTTACAGGTTTCAGCTGGAAAACATACACTACTGCAAATTTTACTGCTACCCTGAGTGAAAACATGGAACGGGTCACTGGATTTGGGC

SEQ ID NO: 1177 - DNA, 1673 bp, Zea mays
  misc_feature (1)..(1673): Ceres cDNA ID no. 12411672
  misc_feature (1)..(1673): Ceres CLONE  ID no. 228413
  misc_feature (1)..(1673): Also known as  Ceres CDNA ID no. 23777527
gtcgtcctcctccgcgcgccgccatgctgctccgccgccttctgcactccacacgccacttccggcacgcctccggaccgtaactccggccaccaccaccaccaccaccaccacttcctcctcctccaccccccttccatttcgctgcttcccggacctccccctctctcgcgtcctctccccgcggctcctctccacctccggccgcgacgacgaccgcaacaagccgtggagcttcgaggcggactcgggcgatccggaccccttcgccaatgaggacgccgcggccgctggcgctgccgaggggccgccggtaggacccacgcgcgccgccgacaagctctgggcgacggagttcggcggggaggacggcgagaacggcgacgtgttcgaggggatctacaaggaggctgcttcggcggcgcccgggcgcggagaggcggctccggtcggaaatgacgagcagtggacgctgagtggggaccacgaggataaggatccctttgccgagtccgtgctcggggaggggatcgaggggattcaaggcgagtgtgatgggctagatgacctcggtgctggggaggaccccgaggttgagctgaagcggcagcggaacaaggagagggagaaggagttgatggagatactcaaaggtccaaatcgtgcttttggtgatctcattgaggcctctgggatcacagatggaatgattgatagtttgatcctcttaaaggatgtcagagacgttccagggttgcctcccctaagagaaatagaagatgaagctatccagaatatgagtgtaacatcaagcagagctgaagttgagcgccaaaaccaagaggccattgctaaggcacgagtaagacaggttgatgagaaaggaagagcttatggaacagggaaaaggaaatgcagcattgctcgtgtttggattaagcctggtgatggtaaattcattgtcaatgaaaaggagtttgatgcttacttcccaatcctggaccatagagctgaacttcttcgtccatttaatgtgaccgatactttggggcgtttggatgtgacctgtactgtgaaaggtggtggcgtatcaggacaagttggagctatccgcttagggataagcagggccttggagaattgggaaccaggatggcgtccatatctcaaagcagctggatatttgacgagagattcacgtgtggtcgaaaggaaaaagcctggaaaagcgaaagcaagaaagagcttccagtgggtcaagcggtaacagagctatctgcatggctacgtattttgttgtggcgggtctctgccctttgactttgatgtgggttttctactcaacacagatcacttgatctgctgttattttttccgaaggtcctgtccttttcagcttctccaacctgtgtcgatacgaggaccatgctacactttggattccgtttccgaaacgttgtgacagcaaaattgatgtagaaaataccatttgacctaatcaagaccgagaagttgctttgcaatgagctgccaataaaacaggctgtgccaatgagactacatgttcgtctcatcagaaggaagacccttctcgacccttatgatttaatggctgggaaacgggtttcggatgccaactgatgattatgataatttgcttcgttattttcttc

SEQ ID NO: 1178 - protein, 1673 aa, Zea mays
  misc_feature: PFam Name: Ribosomal_S9; PFam Description: Ribosomal protein
  misc_feature: PFam Name: Vitellogenin_N; PFam Description: Lipoprotein
  misc_feature: PFam Name: Extensin_2; PFam Description: Extensin-like region
  misc_feature: PFam Name: FH2; PFam Description: Formin Homology 2 Domain
  misc_feature: PFam Name: Drf_FH1; PFam Description: Formin Homology Region 1
  misc_feature: GI Number: 50939755; NR Description: putative 30S ribosomal protein S9 [Oryza sativa (japonica cultivar-group)] >gi|33354201|dbj|BAC81159.1| putative 30S ribosomal protein S9 [Oryza sativa (japonica cultivar-group)]
  misc_feature: GI Number: 50939753; NR Description: putative 30S ribosomal protein S9 [Oryza sativa (japonica cultivar-group)] >gi|33354200|dbj|BAC81158.1| putative 30S ribosomal protein S9 [Oryza sativa (japonica cultivar-group)]
  misc_feature: GI Number: 62289740; NR Description: RpsI, ribosomal protein, S9 [Brucella abortus biovar 1 str. 9-941] >>gi|62195872|gb|AAX74172.1| RpsI, ribosomal protein, S9 [Brucella
  misc_feature: GI Number: 49475551; NR Description: 30S ribosomal protein s9 [Bartonella henselae str. Houston-1] >gi|49238357|emb|CAF27581.1|
GTCGTCCTCCTCCGCGCGCCGCCATGCTGCTCCGCCGCCTTCTGCACTCCACACGCCACTTCCGGCACGCCTCCGGACCGTAACTCCGGCCACCACCACCACCACCACCACCACTTCCTCCTCCTCCACCCCCCTTCCATTTCGCTGCTTCCCGGACCTCCCCCTCTCTCGCGTCCTCTCCCCGCGGCTCCTCTCCACCTCCGGCCGCGACGACGACCGCAACAAGCCGTGGAGCTTCGAGGCGGACTCGGGCGATCCGGACCCCTTCGCCAATGAGGACGCCGCGGCCGCTGGCGCTGCCGAGGGGCCGCCGGTAGGACCCACGCGCGCCGCCGACAAGCTCTGGGCGACGGAGTTCGGCGGGGAGGACGGCGAGAACGGCGACGTGTTCGAGGGGATCTACAAGGAGGCTGCTTCGGCGGCGCCCGGGCGCGGAGAGGCGGCTCCGGTCGGAAATGACGAGCAGTGGACGCTGAGTGGGGACCACGAGGATAAGGATCCCTTTGCCGAGTCCGTGCTCGGGGAGGGGATCGAGGGGATTCAAGGCGAGTGTGATGGGCTAGATGACCTCGGTGCTGGGGAGGACCCCGAGGTTGAGCTGAAGCGGCAGCGGAACAAGGAGAGGGAGAAGGAGTTGATGGAGATACTCAAAGGTCCAAATCGTGCTTTTGGTGATCTCATTGAGGCCTCTGGGATCACAGATGGAATGATTGATAGTTTGATCCTCTTAAAGGATGTCAGAGACGTTCCAGGGTTGCCTCCCCTAAGAGAAATAGAAGATGAAGCTATCCAGAATATGAGTGTAACATCAAGCAGAGCTGAAGTTGAGCGCCAAAACCAAGAGGCCATTGCTAAGGCACGAGTAAGACAGGTTGATGAGAAAGGAAGAGCTTATGGAACAGGGAAAAGGAAATGCAGCATTGCTCGTGTTTGGATTAAGCCTGGTGATGGTAAATTCATTGTCAATGAAAAGGAGTTTGATGCTTACTTCCCAATCCTGGACCATAGAGCTGAACTTCTTCGTCCATTTAATGTGACCGATACTTTGGGGCGTTTGGATGTGACCTGTACTGTGAAAGGTGGTGGCGTATCAGGACAAGTTGGAGCTATCCGCTTAGGGATAAGCAGGGCCTTGGAGAATTGGGAACCAGGATGGCGTCCATATCTCAAAGCAGCTGGATATTTGACGAGAGATTCACGTGTGGTCGAAAGGAAAAAGCCTGGAAAAGCGAAAGCAAGAAAGAGCTTCCAGTGGGTCAAGCGGTAACAGAGCTATCTGCATGGCTACGTATTTTGTTGTGGCGGGTCTCTGCCCTTTGACTTTGATGTGGGTTTTCTACTCAACACAGATCACTTGATCTGCTGTTATTTTTTCCGAAGGTCCTGTCCTTTTCAGCTTCTCCAACCTGTGTCGATACGAGGACCATGCTACACTTTGGATTCCGTTTCCGAAACGTTGTGACAGCAAAATTGATGTAGAAAATACCATTTGACCTAATCAAGACCGAGAAGTTGCTTTGCAATGAGCTGCCAATAAAACAGGCTGTGCCAATGAGACTACATGTTCGTCTCATCAGAAGGAAGACCCTTCTCGACCCTTATGATTTAATGGCTGGGAAACGGGTTTCGGATGCCAACTGATGATTATGATAATTTGCTTCGTTATTTTCTTC

SEQ ID NO: 1179 - DNA, 1485 bp, Zea mays
  misc_feature (1)..(1485): Ceres cDNA ID no. 12411721
  misc_feature (1)..(1485): Ceres CLONE  ID no. 227177
  misc_feature (1)..(1485): Also known as  Ceres CDNA ID no. 23768908
gcgctcagccgacacacacaccgcaaaaggcccacgagaagaccccgcgcggcccgccctctccctccccacctctactccacctccaatcctccccgttgctgtcccgccggcgtcgaagctcgagagaagggtgagcaccttgccgcgaggtgtgtccggtgagctagctagggacgcgccagctcgtgctgatctgacctggaagctctggaggcgatgaaagcgctcggacgggcgatgaggtgggcttcctgctgcaagctctcggacggggatgaaccaggtaggaggaagaaggacgcatcgtggcggatcttttcactgaaggagcttcagtcagcaacgaacaatttcaattacgataacaaggtcggcgagggtgggtttggcagtgtctattggggccagctctgggatgggtcacaggttgctgtgaagaggctcaagagttggagcaacaaagctgaaacagaatttgctgtcgaggtggagattctggcacgggtgaggcacaagagccttttaagcttgcgcggatattgtgctgaaggccaggaacgcttgatagtctatgattatatgccaaacctgagcatacacgcccaacttcatggacagcacgcagcagagtgcaatctcagttgggaaagaaggatgaagatcgccgtcgattccgcagaagggatcgcttatctgcatcaccatgcgacgccacacatcattcatagagatgtcaaggcgagcaacgttctcctggattcgaatttccaagctcgggttgctgactttgggttcgccaagctagttccagacggcgcgacgcatgtcaccacaagggtgaaaggcacactcggttatctcgcaccagagtacgcgatgcttgggaaggcctctgaaagctgcgatgtcttcagtctcggagtcatgctcctagagcttgccagcgggaaaaagccagtggagaagcttaaccccaccacgaagcgaaccatagctgagtgggctcttcctctagctcgggacaggaagttcaaggaaattgccgatccaaagctcaatggtagcttcgtcgaggacgagctgaagcgaatggtgctcgttgggctcgcctgttcccaggacaagccagagcagagacccgtaatgtctgaagtcgtcgagctgctcagaggagaatctaccgagaggctttccaggctggagaatggtgatctgttcaagcctgatatctcgttccatggctcatccggacctgatagctcggactgcgtcacggaggagaggagtcccaaggcagatgcgacagaggaggctgttgattcaagtgagacggttccctcagcaaggtagtgtgatgcacggtggtgtactgtcagtaggtgccctgagctccttgcctgggggaaatgtgtttatcagttcatttttgtggttattccttgctatttagcaagttaatctgggagcctccttgcccggttc

SEQ ID NO: 1180 - protein, 1485 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 9294592; NR Description: protein kinase-like protein [Arabidopsis thaliana] >gi|18400939|ref|NP_566530.1|
  misc_feature: GI Number: 21593950; NR Description: protein kinase, putative
  misc_feature: GI Number: 21554229; NR Description: somatic embryogenesis receptor-like kinase, putative [Arabidopsis thaliana] >gi|30695267|ref|NP_564609.3| protein kinase, putative [Arabidopsis
  misc_feature: GI Number: 34898392; NR Description: ESTs C22458(C62866),C22459(C62866) correspond to a region of the predicted gene.~Similar to genomic sequence of Arabidopsis thaliana BAC F8A5, complete sequence.(AC002292) [Oryza sativa
  misc_feature: GI Number: 51535606; NR Description: receptor protein kinase
GCGCTCAGCCGACACACACACCGCAAAAGGCCCACGAGAAGACCCCGCGCGGCCCGCCCTCTCCCTCCCCACCTCTACTCCACCTCCAATCCTCCCCGTTGCTGTCCCGCCGGCGTCGAAGCTCGAGAGAAGGGTGAGCACCTTGCCGCGAGGTGTGTCCGGTGAGCTAGCTAGGGACGCGCCAGCTCGTGCTGATCTGACCTGGAAGCTCTGGAGGCGATGAAAGCGCTCGGACGGGCGATGAGGTGGGCTTCCTGCTGCAAGCTCTCGGACGGGGATGAACCAGGTAGGAGGAAGAAGGACGCATCGTGGCGGATCTTTTCACTGAAGGAGCTTCAGTCAGCAACGAACAATTTCAATTACGATAACAAGGTCGGCGAGGGTGGGTTTGGCAGTGTCTATTGGGGCCAGCTCTGGGATGGGTCACAGGTTGCTGTGAAGAGGCTCAAGAGTTGGAGCAACAAAGCTGAAACAGAATTTGCTGTCGAGGTGGAGATTCTGGCACGGGTGAGGCACAAGAGCCTTTTAAGCTTGCGCGGATATTGTGCTGAAGGCCAGGAACGCTTGATAGTCTATGATTATATGCCAAACCTGAGCATACACGCCCAACTTCATGGACAGCACGCAGCAGAGTGCAATCTCAGTTGGGAAAGAAGGATGAAGATCGCCGTCGATTCCGCAGAAGGGATCGCTTATCTGCATCACCATGCGACGCCACACATCATTCATAGAGATGTCAAGGCGAGCAACGTTCTCCTGGATTCGAATTTCCAAGCTCGGGTTGCTGACTTTGGGTTCGCCAAGCTAGTTCCAGACGGCGCGACGCATGTCACCACAAGGGTGAAAGGCACACTCGGTTATCTCGCACCAGAGTACGCGATGCTTGGGAAGGCCTCTGAAAGCTGCGATGTCTTCAGTCTCGGAGTCATGCTCCTAGAGCTTGCCAGCGGGAAAAAGCCAGTGGAGAAGCTTAACCCCACCACGAAGCGAACCATAGCTGAGTGGGCTCTTCCTCTAGCTCGGGACAGGAAGTTCAAGGAAATTGCCGATCCAAAGCTCAATGGTAGCTTCGTCGAGGACGAGCTGAAGCGAATGGTGCTCGTTGGGCTCGCCTGTTCCCAGGACAAGCCAGAGCAGAGACCCGTAATGTCTGAAGTCGTCGAGCTGCTCAGAGGAGAATCTACCGAGAGGCTTTCCAGGCTGGAGAATGGTGATCTGTTCAAGCCTGATATCTCGTTCCATGGCTCATCCGGACCTGATAGCTCGGACTGCGTCACGGAGGAGAGGAGTCCCAAGGCAGATGCGACAGAGGAGGCTGTTGATTCAAGTGAGACGGTTCCCTCAGCAAGGTAGTGTGATGCACGGTGGTGTACTGTCAGTAGGTGCCCTGAGCTCCTTGCCTGGGGGAAATGTGTTTATCAGTTCATTTTTGTGGTTATTCCTTGCTATTTAGCAAGTTAATCTGGGAGCCTCCTTGCCCGGTTC

SEQ ID NO: 1181 - DNA, 1814 bp, Zea mays
  misc_feature (1)..(1814): Ceres cDNA ID no. 12411778
  misc_feature (1)..(1814): Ceres CLONE  ID no. 224830
  misc_feature (1)..(1814): Also known as  Ceres CDNA ID no. 23777226
acaggaagggaaggggaggaagcagcagcagcacacagctttgctctcgctctcggctccccgtccaccaaaggaggaaacgcgcagcccgcagcgctagccgtcgtctatctcgtctcctagtccaaggaaggaaagaggcgcttggcatgaagcgacctaccaagaatgagacgctgggctacccctggcacaagtagagcaagagccccagcaaccgagccacagtgaggaggactcgagggaagagatgggcaactgcggcacgcgggaggagaatgccgtcgtcgctgcgcacgcacaagttcaacagctccacttgttacaaaatcctgccaagaatgccattggagataggaagcacaaccgcacctcatcagatataagtgatccttccacacctaggaaagctgaagatgccaagaacatttccatatacaacgatgtgattgtcttcacattgtttgagctagagacaatcacaaagagcttccgtgccgattatgttctcggcgaaggaggatttgggaccgtttacaagggctacatagatgaaaatgtcagggtggggctgaagtcactgcctgttgcagtcaaggtgctcaacaaagatggacaccaagggcacagagaatggcttaccgaagttaactgcctggggcagttaaggcatccaaacttggtgaagttgatcggatattgctgcgaagatgaccatcggctgcttgtctacgagttcatgtttcgaggaagcctagaaaaccacctattccgaaagacagctacaccattaccctggggtactaggatgtcaatcgcactgggagctgctaaagggcttgcttgcctccacaatgctcaaaggcctgtcatctacagagatttcaagacatcaaatattctactggactctgattatactgctaagctgtctgactttggcctggcaaaagctggccctgaaggtgatcagacccatgtatcaacacgggtgatgggaacctacggttatgctgcccctgaatatgtgatgactggccacttgactgctagaagtgatgtctacagcttcggtgtggtccttctggagctcttgacagggcgcaagtcaatcgacaagtcgcggcccagcagggagcagagcctggttgactgggccctccccaagctgaacgacaagaggcggcttctccagatcatcgacccgagactggaggggcagtactcggccagagccgcccacaaagcctgcagccttgcgttctactgcctgagccagaaccccaaggccaggccactcatgagcgacgtcgtcgagaccctcgaaccgttgcagggcagcggtggaggcgacggacgcggccagccttctggccttcctgactataggggtcgccgcaggataaccgggaacagcgtccacttcagggccatcccgaaccccaagtgctcccccgccgtcccggccacggcttgccgagtgcggtgatgggtgctgtgtttcggttggagttgccggggtaggttccgttgtgtatattgcggccgtgggcggtggtgtgtgtgtgggtgcatgtgtgtgcttggcggcggcggggtttcggtttcttctcgggttttggccggcgttttgatgtgtaaatttgatctgcgtgctgcattgctgctgctgcttttgtaaggccctctaattttcactgtggtcttatgtatccttcgactgagcgagccctgctgaaactggcgggttcgggattaaccctagaaatgaaatgaaaggctgaaccgagagcgggttggatgattgatatggc

SEQ ID NO: 1182 - protein, 1814 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 9542860; NR Description: protein kinase-like
  misc_feature: GI Number: 30725688; NR Description: At5g56460 [Arabidopsis thaliana] >gi|10177845|dbj|BAB11274.1| protein kinase-like protein [Arabidopsis thaliana] >gi|22135984|gb|AAM91574.1| protein kinase-like protein [Arabidopsis thaliana]
  misc_feature: GI Number: 15238553; NR Description: protein kinase, putative
  misc_feature: GI Number: 10176804; NR Description: serine/threonine protein
  misc_feature: GI Number: 62319981; NR Description: serine/threonine protein
ACAGGAAGGGAAGGGGAGGAAGCAGCAGCAGCACACAGCTTTGCTCTCGCTCTCGGCTCCCCGTCCACCAAAGGAGGAAACGCGCAGCCCGCAGCGCTAGCCGTCGTCTATCTCGTCTCCTAGTCCAAGGAAGGAAAGAGGCGCTTGGCATGAAGCGACCTACCAAGAATGAGACGCTGGGCTACCCCTGGCACAAGTAGAGCAAGAGCCCCAGCAACCGAGCCACAGTGAGGAGGACTCGAGGGAAGAGATGGGCAACTGCGGCACGCGGGAGGAGAATGCCGTCGTCGCTGCGCACGCACAAGTTCAACAGCTCCACTTGTTACAAAATCCTGCCAAGAATGCCATTGGAGATAGGAAGCACAACCGCACCTCATCAGATATAAGTGATCCTTCCACACCTAGGAAAGCTGAAGATGCCAAGAACATTTCCATATACAACGATGTGATTGTCTTCACATTGTTTGAGCTAGAGACAATCACAAAGAGCTTCCGTGCCGATTATGTTCTCGGCGAAGGAGGATTTGGGACCGTTTACAAGGGCTACATAGATGAAAATGTCAGGGTGGGGCTGAAGTCACTGCCTGTTGCAGTCAAGGTGCTCAACAAAGATGGACACCAAGGGCACAGAGAATGGCTTACCGAAGTTAACTGCCTGGGGCAGTTAAGGCATCCAAACTTGGTGAAGTTGATCGGATATTGCTGCGAAGATGACCATCGGCTGCTTGTCTACGAGTTCATGTTTCGAGGAAGCCTAGAAAACCACCTATTCCGAAAGACAGCTACACCATTACCCTGGGGTACTAGGATGTCAATCGCACTGGGAGCTGCTAAAGGGCTTGCTTGCCTCCACAATGCTCAAAGGCCTGTCATCTACAGAGATTTCAAGACATCAAATATTCTACTGGACTCTGATTATACTGCTAAGCTGTCTGACTTTGGCCTGGCAAAAGCTGGCCCTGAAGGTGATCAGACCCATGTATCAACACGGGTGATGGGAACCTACGGTTATGCTGCCCCTGAATATGTGATGACTGGCCACTTGACTGCTAGAAGTGATGTCTACAGCTTCGGTGTGGTCCTTCTGGAGCTCTTGACAGGGCGCAAGTCAATCGACAAGTCGCGGCCCAGCAGGGAGCAGAGCCTGGTTGACTGGGCCCTCCCCAAGCTGAACGACAAGAGGCGGCTTCTCCAGATCATCGACCCGAGACTGGAGGGGCAGTACTCGGCCAGAGCCGCCCACAAAGCCTGCAGCCTTGCGTTCTACTGCCTGAGCCAGAACCCCAAGGCCAGGCCACTCATGAGCGACGTCGTCGAGACCCTCGAACCGTTGCAGGGCAGCGGTGGAGGCGACGGACGCGGCCAGCCTTCTGGCCTTCCTGACTATAGGGGTCGCCGCAGGATAACCGGGAACAGCGTCCACTTCAGGGCCATCCCGAACCCCAAGTGCTCCCCCGCCGTCCCGGCCACGGCTTGCCGAGTGCGGTGATGGGTGCTGTGTTTCGGTTGGAGTTGCCGGGGTAGGTTCCGTTGTGTATATTGCGGCCGTGGGCGGTGGTGTGTGTGTGGGTGCATGTGTGTGCTTGGCGGCGGCGGGGTTTCGGTTTCTTCTCGGGTTTTGGCCGGCGTTTTGATGTGTAAATTTGATCTGCGTGCTGCATTGCTGCTGCTGCTTTTGTAAGGCCCTCTAATTTTCACTGTGGTCTTATGTATCCTTCGACTGAGCGAGCCCTGCTGAAACTGGCGGGTTCGGGATTAACCCTAGAAATGAAATGAAAGGCTGAACCGAGAGCGGGTTGGATGATTGATATGGC

SEQ ID NO: 1183 - DNA, 2072 bp, Zea mays
  misc_feature (1)..(2072): Ceres cDNA ID no. 12411849
  misc_feature (1)..(2072): Ceres CLONE  ID no. 222084
  misc_feature (1)..(2072): Also known as  Ceres CDNA ID no. 23776877
gtcgctctcctcctcctcctcctcctcctccgtaggcaaggcaaggggggcaaggctctaacggagatcggatcgaactgcctgtgcagtctccctccctccctccctccctcatgtccatatataccaaaaaatctccgccgcgccgccattagctagctctcgtcgtcttcgttcctccgcaaataatttgttactcaagccgaaggaggacgagggcgacgggattggctaatcaaatcgaccgatctagtggctggtgcccaggagaagggacgcgggcagtgcggctcgtcgtggtcagcagcttgtggcgaccggtcgccagggaatcaatcaattcaatcagaaagttgcaattttgattgagctcgattcgtcatccacaagacattagggaatcgaaccaccacaaagcaagaaggcagtccagtgcagagagagagagagagaccaagaagagaaagagaaagggaaagagaagcaaagcaatggatccaccgcatcaccgtgctgtgctgcggcggcctcgtcctcctcctccctcctgccctttttataggccgcctccgcttcgtcgtcttggcaagacctgcccccgcgcctgcaatcctacgacaacagggcgccgctcctcctgcccgtcaagatcatggacaccgccgccgacgacaagccggaaatctccgacgatacggcccaccagattagcgttgatccttggtatcaagttggcttcgtcctcacaaccggggtcaacagcgcatacgttctaggatactctggatcaatcatggtccctctaggctggatcggcggcacatgcggcctcctcctagctgccgccatatccatgtacgctaatgctcttcttgcacggcttcatgaagtcggtggcaaacgccatatcagatacagagaccttgctggacacatatatggaccgaaaatttacgggcttacatgggctctgcagtacattaaccttttcatgatcaacactggctttatcatcttagctggacaagctctcaaggccacgtatggactgttcagtgatgatggagttctgaaactcccttactgcattgcgatatcaggattcgtctgtgctcttttcgccattggaatcccttatttatctgccctcaggatttggttggggttctccacgcttttcagcctcatgtatattgtgatagcagttgtgctgtcgtcgagagatgggataaccgcacctgcaagggattacagcatccccaaatcatcgcagtcaactcgagtcttcactacgataggttccatagcagaccttgtgtttgcttacaacaccggcatgctgccagaaattcaggcaaccatcaggcctcctgtggtgaagaacatggagaaagctctatggttccagttcaccattggctccttgcctctctatgctgtagtttttgtgggttactgggcttatgggtcctcaacatcaggctacctcctcaacagtgtcacaggcccagtctgggtgaaagcggttgcaaatctgtcggcattttttcagacagtcatagcgctgcacatctttgctagccccatgtatgaattcctggacacaaaatatggaagtgggcgtggccccttttgagatccacaacgtggcgttcagagtagcagtcagaggaggctacctgacggtgaacacgctggtggccgcggtgctcccattcctcggcgacttcatgagcctgacgggcgccctcagcaccttcccgctgacgtttgtgctcgcaaatcacatgtacctgatggtgaaggggcctaagctgggtgccatccagaaatcatggcactggctcaatgttcttgggttcactgcgctggctgttgcagcggcggtctccgcaataaggctcatcatgcgtgattccagcacctaccacttcttcgctgatctttgagatcgatcgttttcttttctttttgttggaatgctgagccagagctagtattttttcattttcagagaattattatccatgtatgtaaggatgacgcatatatatatattgaatagatgattt

SEQ ID NO: 1184 - protein, 2072 aa, Zea mays
  misc_feature: PFam Name: Aa_trans; PFam Description: Transmembrane amino
  misc_feature: GI Number: 31376371; NR Description: At3g55740 [Arabidopsis thaliana] >gi|7263562|emb|CAB81599.1| proline transporter 2 [Arabidopsis thaliana] >gi|1769903|emb|CAA65053.1| proline transporter 2 [Arabidopsis thaliana] >gi|19698891|gb|AAL91181.1|
  misc_feature: GI Number: 21069018; NR Description: betaine/proline
  misc_feature: GI Number: 21593453; NR Description: proline transporter 1
  misc_feature: GI Number: 42572697; NR Description: proline transporter 2
  misc_feature: GI Number: 16215723; NR Description: proline transporter
GTCGCTCTCCTCCTCCTCCTCCTCCTCCTCCGTAGGCAAGGCAAGGGGGGCAAGGCTCTAACGGAGATCGGATCGAACTGCCTGTGCAGTCTCCCTCCCTCCCTCCCTCCCTCATGTCCATATATACCAAAAAATCTCCGCCGCGCCGCCATTAGCTAGCTCTCGTCGTCTTCGTTCCTCCGCAAATAATTTGTTACTCAAGCCGAAGGAGGACGAGGGCGACGGGATTGGCTAATCAAATCGACCGATCTAGTGGCTGGTGCCCAGGAGAAGGGACGCGGGCAGTGCGGCTCGTCGTGGTCAGCAGCTTGTGGCGACCGGTCGCCAGGGAATCAATCAATTCAATCAGAAAGTTGCAATTTTGATTGAGCTCGATTCGTCATCCACAAGACATTAGGGAATCGAACCACCACAAAGCAAGAAGGCAGTCCAGTGCAGAGAGAGAGAGAGAGACCAAGAAGAGAAAGAGAAAGGGAAAGAGAAGCAAAGCAATGGATCCACCGCATCACCGTGCTGTGCTGCGGCGGCCTCGTCCTCCTCCTCCCTCCTGCCCTTTTTATAGGCCGCCTCCGCTTCGTCGTCTTGGCAAGACCTGCCCCCGCGCCTGCAATCCTACGACAACAGGGCGCCGCTCCTCCTGCCCGTCAAGATCATGGACACCGCCGCCGACGACAAGCCGGAAATCTCCGACGATACGGCCCACCAGATTAGCGTTGATCCTTGGTATCAAGTTGGCTTCGTCCTCACAACCGGGGTCAACAGCGCATACGTTCTAGGATACTCTGGATCAATCATGGTCCCTCTAGGCTGGATCGGCGGCACATGCGGCCTCCTCCTAGCTGCCGCCATATCCATGTACGCTAATGCTCTTCTTGCACGGCTTCATGAAGTCGGTGGCAAACGCCATATCAGATACAGAGACCTTGCTGGACACATATATGGACCGAAAATTTACGGGCTTACATGGGCTCTGCAGTACATTAACCTTTTCATGATCAACACTGGCTTTATCATCTTAGCTGGACAAGCTCTCAAGGCCACGTATGGACTGTTCAGTGATGATGGAGTTCTGAAACTCCCTTACTGCATTGCGATATCAGGATTCGTCTGTGCTCTTTTCGCCATTGGAATCCCTTATTTATCTGCCCTCAGGATTTGGTTGGGGTTCTCCACGCTTTTCAGCCTCATGTATATTGTGATAGCAGTTGTGCTGTCGTCGAGAGATGGGATAACCGCACCTGCAAGGGATTACAGCATCCCCAAATCATCGCAGTCAACTCGAGTCTTCACTACGATAGGTTCCATAGCAGACCTTGTGTTTGCTTACAACACCGGCATGCTGCCAGAAATTCAGGCAACCATCAGGCCTCCTGTGGTGAAGAACATGGAGAAAGCTCTATGGTTCCAGTTCACCATTGGCTCCTTGCCTCTCTATGCTGTAGTTTTTGTGGGTTACTGGGCTTATGGGTCCTCAACATCAGGCTACCTCCTCAACAGTGTCACAGGCCCAGTCTGGGTGAAAGCGGTTGCAAATCTGTCGGCATTTTTTCAGACAGTCATAGCGCTGCACATCTTTGCTAGCCCCATGTATGAATTCCTGGACACAAAATATGGAAGTGGGCGTGGCCCCTTTTGAGATCCACAACGTGGCGTTCAGAGTAGCAGTCAGAGGAGGCTACCTGACGGTGAACACGCTGGTGGCCGCGGTGCTCCCATTCCTCGGCGACTTCATGAGCCTGACGGGCGCCCTCAGCACCTTCCCGCTGACGTTTGTGCTCGCAAATCACATGTACCTGATGGTGAAGGGGCCTAAGCTGGGTGCCATCCAGAAATCATGGCACTGGCTCAATGTTCTTGGGTTCACTGCGCTGGCTGTTGCAGCGGCGGTCTCCGCAATAAGGCTCATCATGCGTGATTCCAGCACCTACCACTTCTTCGCTGATCTTTGAGATCGATCGTTTTCTTTTCTTTTTGTTGGAATGCTGAGCCAGAGCTAGTATTTTTTCATTTTCAGAGAATTATTATCCATGTATGTAAGGATGACGCATATATATATATTGAATAGATGATTT

SEQ ID NO: 1185 - DNA, 1310 bp, Zea mays
  misc_feature (1)..(1310): Ceres cDNA ID no. 12411905
  misc_feature (1)..(1310): Ceres CLONE  ID no. 220920
  misc_feature (1)..(1310): Also known as  Ceres CDNA ID no. 23780540
aaaaacaccacacaacacaacacaataatacagcaaaggaggctagcagaagtgcaggattaataagctaagctagtagaaattaagcaaagcataggcacagccatggctacctcctctggttcttgccttattattagcctgttggtggtggtggtggcggcggcgctgtcggcctcaacggcgtcggcacagctgtcgtcgacgttctacgacacgtcgtgccccagcgcgatgtccaccatcagcagcggcgtgaactccgccgtggcgcagcaggctcgtgtgggggcgtcgctgctccggctccacttccacgactgcttcgtccaaggctgcgacgcgtccattctgctgaacgacacgtccggggagcagacccagccgccgaacctaactctgaacccgagggccttcgacgtcgtcaacagcatcaaggcgcaggtggaggcggcgtgcccgggcgtcgtctcctgcgccgacatcctcgccgtcgccgcccgcgacggagttgtcgcgctcggcgggccttcgtggaccgtgcttctgggcagaagggactcgaccggttcgttccctagccagacaagcgacctcccacctccgacgtcgagcctccaagcactgttagccgcgtacagcaagaagaacctcgacgcgaccgacatggtcgctctctcaggcgctcacacaatcgggcaggcccagtgctcgagcttcaacggccacatctacaacgacacgaacatcaacgcggccttcgcgacgtcgctcaaggccaactgccccatgtccggcggcagcagccctggcgccgctggacaccatgaccccgaccgtgttcgacaacgactactacaagaacctgctgtcgcagaaggggctgctgcactcggaccaggagctgttcaacaacggcagcaccgacagcacggtcagcaactttgcgtccagctcggccgccttcaccagcgccttcacggcggccatggtgaagatggggaacctcggcccgctcaccgggaccagtgggcagatcaggctcacctgctggaagctcaactcgtcctaataattaaggacggacgtccgatagacgatcctgcgcaatcgtatcgtacgtgcatgatacgcatacatctggaaactactataccaatgcaaacagagatctatacgtacgagtatgtataacgacgagtgatgtttgtatggatctacgtatgtaacaaggacctctcgtagcgcaaaggcgcgcgttgggagattaattaggtacacaagctattaccacattatatatcactcgc

SEQ ID NO: 1186 - protein, 1310 aa, Zea mays
  misc_feature: PFam Name: peroxidase; PFam Description: Peroxidase
  misc_feature: PFam Name: Mucin; PFam Description: Mucin-like glycoprotein
  misc_feature: GI Number: 15011986; NR Description: putative peroxidase P7X
  misc_feature: GI Number: 3411221; NR Description: peroxidase PXC2 precursor
  misc_feature: GI Number: 50939971; NR Description: peroxidase [Oryza sativa (japonica cultivar-group)] >gi|585662|sp|P37835|PER2_ORYSA Peroxidase 2 precursor >gi|7433040|pir||T03929 peroxidase (EC 1.11.1.7) - rice >gi|303851|dbj|BAA03911.1| peroxidase [Oryza
  misc_feature: GI Number: 20286; NR Description: peroxidase [Oryza sativa] >gi|100694|pir||S22087 peroxidase (EC 1.11.1.7) precursor - rice
  misc_feature: GI Number: 2429292; NR Description: peroxidase [Oryza sativa]
AAAAACACCACACAACACAACACAATAATACAGCAAAGGAGGCTAGCAGAAGTGCAGGATTAATAAGCTAAGCTAGTAGAAATTAAGCAAAGCATAGGCACAGCCATGGCTACCTCCTCTGGTTCTTGCCTTATTATTAGCCTGTTGGTGGTGGTGGTGGCGGCGGCGCTGTCGGCCTCAACGGCGTCGGCACAGCTGTCGTCGACGTTCTACGACACGTCGTGCCCCAGCGCGATGTCCACCATCAGCAGCGGCGTGAACTCCGCCGTGGCGCAGCAGGCTCGTGTGGGGGCGTCGCTGCTCCGGCTCCACTTCCACGACTGCTTCGTCCAAGGCTGCGACGCGTCCATTCTGCTGAACGACACGTCCGGGGAGCAGACCCAGCCGCCGAACCTAACTCTGAACCCGAGGGCCTTCGACGTCGTCAACAGCATCAAGGCGCAGGTGGAGGCGGCGTGCCCGGGCGTCGTCTCCTGCGCCGACATCCTCGCCGTCGCCGCCCGCGACGGAGTTGTCGCGCTCGGCGGGCCTTCGTGGACCGTGCTTCTGGGCAGAAGGGACTCGACCGGTTCGTTCCCTAGCCAGACAAGCGACCTCCCACCTCCGACGTCGAGCCTCCAAGCACTGTTAGCCGCGTACAGCAAGAAGAACCTCGACGCGACCGACATGGTCGCTCTCTCAGGCGCTCACACAATCGGGCAGGCCCAGTGCTCGAGCTTCAACGGCCACATCTACAACGACACGAACATCAACGCGGCCTTCGCGACGTCGCTCAAGGCCAACTGCCCCATGTCCGGCGGCAGCAGCCCTGGCGCCGCTGGACACCATGACCCCGACCGTGTTCGACAACGACTACTACAAGAACCTGCTGTCGCAGAAGGGGCTGCTGCACTCGGACCAGGAGCTGTTCAACAACGGCAGCACCGACAGCACGGTCAGCAACTTTGCGTCCAGCTCGGCCGCCTTCACCAGCGCCTTCACGGCGGCCATGGTGAAGATGGGGAACCTCGGCCCGCTCACCGGGACCAGTGGGCAGATCAGGCTCACCTGCTGGAAGCTCAACTCGTCCTAATAATTAAGGACGGACGTCCGATAGACGATCCTGCGCAATCGTATCGTACGTGCATGATACGCATACATCTGGAAACTACTATACCAATGCAAACAGAGATCTATACGTACGAGTATGTATAACGACGAGTGATGTTTGTATGGATCTACGTATGTAACAAGGACCTCTCGTAGCGCAAAGGCGCGCGTTGGGAGATTAATTAGGTACACAAGCTATTACCACATTATATATCACTCGC

SEQ ID NO: 1187 - DNA, 1652 bp, Zea mays
  misc_feature (1)..(1652): Ceres cDNA ID no. 12411954
  misc_feature (1)..(1652): Ceres CLONE  ID no. 219960
  misc_feature (1)..(1652): Also known as  Ceres CDNA ID no. 23753820
aggtttgtgtgaccgttgcaacgaaacaaaaaaagccaaagggatcccaaacgaaaacgagccagctgagcaaacacaacactcgcatcggcacccacactgccactcatcacattggcacccctccgacacgggccgggacttctcggactgcaggcagccaggcacgcaccagcaacaccccccacccgccggctcggagcggggccccacccgaatcacacagatcgggacgccggaggaggagcaacgccgtcccgcatcaccggagcaacgcgggcgcggagaggccagccagcgcaggcgcagttcaagctttggattcccggatcccacaccaccggtctctctcggggagtgtaatccagcgagcgttgagttgaaagccgcgcaagtggagatgagtactctgaagaaatccgacaagaaggctgccctcgacttcgcagcatggagtttcaatgtcaccacatcggttggactcatcatggtcaacaaggccttgatggctacgtatgggttcagtttcgccacaacattaaccgggcttcattttgtgactactaccttgatgactatcttatttcgttggttaggcctgagtcagccatcccacttacccctagcagatctagttaaatttgtgatattttcgaacttgtcaattgttgggatgaatgtgagcttgatgtggaactctgttggcttttatcagatagcaaagctgtgcatgatacctgcatcatgtcttctggaggttgtttttgatcatgtacattattcccgggacacaaagctgagcataatggtcgtgcttataggagttgcagtctgcacggttactgatgtcagtgtgaatgcaagaggtctaattgctgctgttatagctgtctggagcacagctttgcaacaatactatgtccattttctccaacgcaagtactccctgaactcattcaacctcctgggccacacagctccagcccaagctgggtcactgctgctagtgggaccatttgcggattacttgttgacaggcaaaagggtggatcagttcagtttgtcatcgcttgctctgtttttcctggcactctcatgcttcatcgccattggtgttaatctgagccaattcatctgcatcgggcggttctccgccgtatccttccaagtcctaggccatatgaagaccgtacttgttctgtcccttgggttccttttctttggcaaggagggcctgaaccttcaggtagtccttgggatggtcctggccgttctcggaatgatatggtacgggaacgcgtctgctaaaccaggtggcaaagagcggcgcagcatcctgccggtgaggtctgcgagtctcaagggaagttccgaagaaaaggccggtgccgagaaatagtcttgctatatctgactgcaaacattttattagatggggaatttttcgttccgaaggttaaatctctggtgaggtgacgcgagtatcacagattggaagctctgcattatgtctgacgcgcacaaaacaaacgcgtcccttgtagagactctggattgttatagttacaggtatactgtaaagcttcattttttttggcgctctgaatcgtttgcagtgagggggaaagacggacatggtttacggagggttc

SEQ ID NO: 1188 - protein, 1652 aa, Zea mays
  misc_feature: GI Number: 30313364; NR Description: putative transmembrane
  misc_feature: GI Number: 21593003; NR Description: unknown [Arabidopsis thaliana]
  misc_feature: GI Number: 50933293; NR Description: putative transmembrane protein [Oryza sativa (japonica cultivar-group)] >gi|48843759|gb|AAT47018.1| putative transmembrane protein [Oryza
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
  misc_feature: GI Number: 21595054; NR Description: unknown [Arabidopsis thaliana]
AGGTTTGTGTGACCGTTGCAACGAAACAAAAAAAGCCAAAGGGATCCCAAACGAAAACGAGCCAGCTGAGCAAACACAACACTCGCATCGGCACCCACACTGCCACTCATCACATTGGCACCCCTCCGACACGGGCCGGGACTTCTCGGACTGCAGGCAGCCAGGCACGCACCAGCAACACCCCCCACCCGCCGGCTCGGAGCGGGGCCCCACCCGAATCACACAGATCGGGACGCCGGAGGAGGAGCAACGCCGTCCCGCATCACCGGAGCAACGCGGGCGCGGAGAGGCCAGCCAGCGCAGGCGCAGTTCAAGCTTTGGATTCCCGGATCCCACACCACCGGTCTCTCTCGGGGAGTGTAATCCAGCGAGCGTTGAGTTGAAAGCCGCGCAAGTGGAGATGAGTACTCTGAAGAAATCCGACAAGAAGGCTGCCCTCGACTTCGCAGCATGGAGTTTCAATGTCACCACATCGGTTGGACTCATCATGGTCAACAAGGCCTTGATGGCTACGTATGGGTTCAGTTTCGCCACAACATTAACCGGGCTTCATTTTGTGACTACTACCTTGATGACTATCTTATTTCGTTGGTTAGGCCTGAGTCAGCCATCCCACTTACCCCTAGCAGATCTAGTTAAATTTGTGATATTTTCGAACTTGTCAATTGTTGGGATGAATGTGAGCTTGATGTGGAACTCTGTTGGCTTTTATCAGATAGCAAAGCTGTGCATGATACCTGCATCATGTCTTCTGGAGGTTGTTTTTGATCATGTACATTATTCCCGGGACACAAAGCTGAGCATAATGGTCGTGCTTATAGGAGTTGCAGTCTGCACGGTTACTGATGTCAGTGTGAATGCAAGAGGTCTAATTGCTGCTGTTATAGCTGTCTGGAGCACAGCTTTGCAACAATACTATGTCCATTTTCTCCAACGCAAGTACTCCCTGAACTCATTCAACCTCCTGGGCCACACAGCTCCAGCCCAAGCTGGGTCACTGCTGCTAGTGGGACCATTTGCGGATTACTTGTTGACAGGCAAAAGGGTGGATCAGTTCAGTTTGTCATCGCTTGCTCTGTTTTTCCTGGCACTCTCATGCTTCATCGCCATTGGTGTTAATCTGAGCCAATTCATCTGCATCGGGCGGTTCTCCGCCGTATCCTTCCAAGTCCTAGGCCATATGAAGACCGTACTTGTTCTGTCCCTTGGGTTCCTTTTCTTTGGCAAGGAGGGCCTGAACCTTCAGGTAGTCCTTGGGATGGTCCTGGCCGTTCTCGGAATGATATGGTACGGGAACGCGTCTGCTAAACCAGGTGGCAAAGAGCGGCGCAGCATCCTGCCGGTGAGGTCTGCGAGTCTCAAGGGAAGTTCCGAAGAAAAGGCCGGTGCCGAGAAATAGTCTTGCTATATCTGACTGCAAACATTTTATTAGATGGGGAATTTTTCGTTCCGAAGGTTAAATCTCTGGTGAGGTGACGCGAGTATCACAGATTGGAAGCTCTGCATTATGTCTGACGCGCACAAAACAAACGCGTCCCTTGTAGAGACTCTGGATTGTTATAGTTACAGGTATACTGTAAAGCTTCATTTTTTTTGGCGCTCTGAATCGTTTGCAGTGAGGGGGAAAGACGGACATGGTTTACGGAGGGTTC

SEQ ID NO: 1189 - DNA, 1481 bp, Zea mays
  misc_feature (1)..(1481): Ceres cDNA ID no. 12412078
  misc_feature (1)..(1481): Ceres CLONE  ID no. 218789
  misc_feature (1)..(1481): Also known as  Ceres CDNA ID no. 23776375
gacactcgtctccagcgtttggcaatgtcgctccaccagcggccgcaccagaagccgccggccgcgggcgactctctcccagtttcctccccaaccgcctccaccgccgcatcacgcccgcaccccctcctcacactcccctacctcttctccctccttgcggttctcctgttcgttgcactcctcgtgccctggggcccagcagcgcgcccgccctcgtcctcgtcctcgtggcgttcctacaccctccaggatgccgccgcctcggctgccgcagcgggaaacggcaccgtgctcctcgctgctgtctccggaccgtacctccccttcctctccaattggctcatcagcgtccgtcgcgccggccgcgcggatcaggtgctcgtcatcgccgaggactacgagaccctcgaccgcatcaatgccgcctggccaggacacgccgtcctcgtgccccccgcgcccgatgcccagaccgcccacaaattcggatctcaggggttcttcaacttcacctcgcgccgtccacggcacctgctgcagatccttgagctcgggtacagcgtcatgtacaacgatgtcgacatggtgtggcttgccgacccgttcgcttacatcgtcgagaatcacgacgtgtactttatggacgatatgactcctgtgaaaccacttgatcattcacatgaattgccaccacccgggaagaaagggcgcacatatatttgcagctgcatgctattcctcaggcccactgaaggtgccaagctcctgttaaggaagtggatcgaggagcttaaggagcagccctggtcgaagcaaatgaagtcaaatgatcagccagcattcaactgggctttgaacaagactgccgggcaggttgatgtttacctcctgcctcagtctgcatttccaaccggaggcctatatttcaagaataaaaaatgggtcaaggagacaaagggcaagcatgtcattatacataataactacatcacagggtttgagaagaagataaagcggttccgggatcatgggttgtggttggtagatgagcacagcgatgagtcaccgcttggcagaatctgagcgatcaaggctgaaacacatttcttcttgctgcagcatcacaattttgtaattggtatttgactattgaagccagtatccatctaaaccaaacggtgtatgcagcagccaaaaatcaaacgcagaagatattacttgccaacatctttttttggctgtatgtcaagcgcttgtagagtatcctttaccatgtggccatgatgattgttttttattgtatttgttctttactgaaaatgatgtatttgagagcagttaagatcttagggtgtggcgaaacagacccttagtacattggctgatgattcacttattgtatagcataaagtttgatagcttgcatagccatttctgaaagaaaattgtactttttgcctctatatcaatgattcgtc

SEQ ID NO: 1190 - protein, 1481 aa, Zea mays
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: Atrophin-1; PFam Description: Atrophin-1 family
  misc_feature: PFam Name: Drf_FH1; PFam Description: Formin Homology Region 1
  misc_feature: GI Number: 28466905; NR Description: At1g56550 [Arabidopsis
  misc_feature: GI Number: 12018147; NR Description: vegetative cell wall protein gp1 [Chlamydomonas reinhardtii] >gi|20138131|sp|Q9FPQ6|GP1_CHLRE Vegetative cell wall protein gp1
  misc_feature: GI Number: 41400384; NR Description: plus agglutinin
  misc_feature: GI Number: 14599404; NR Description: protease 1 [Pneumocystis
  misc_feature: GI Number: 14253159; NR Description: VMP3 protein [Volvox
GACACTCGTCTCCAGCGTTTGGCAATGTCGCTCCACCAGCGGCCGCACCAGAAGCCGCCGGCCGCGGGCGACTCTCTCCCAGTTTCCTCCCCAACCGCCTCCACCGCCGCATCACGCCCGCACCCCCTCCTCACACTCCCCTACCTCTTCTCCCTCCTTGCGGTTCTCCTGTTCGTTGCACTCCTCGTGCCCTGGGGCCCAGCAGCGCGCCCGCCCTCGTCCTCGTCCTCGTGGCGTTCCTACACCCTCCAGGATGCCGCCGCCTCGGCTGCCGCAGCGGGAAACGGCACCGTGCTCCTCGCTGCTGTCTCCGGACCGTACCTCCCCTTCCTCTCCAATTGGCTCATCAGCGTCCGTCGCGCCGGCCGCGCGGATCAGGTGCTCGTCATCGCCGAGGACTACGAGACCCTCGACCGCATCAATGCCGCCTGGCCAGGACACGCCGTCCTCGTGCCCCCCGCGCCCGATGCCCAGACCGCCCACAAATTCGGATCTCAGGGGTTCTTCAACTTCACCTCGCGCCGTCCACGGCACCTGCTGCAGATCCTTGAGCTCGGGTACAGCGTCATGTACAACGATGTCGACATGGTGTGGCTTGCCGACCCGTTCGCTTACATCGTCGAGAATCACGACGTGTACTTTATGGACGATATGACTCCTGTGAAACCACTTGATCATTCACATGAATTGCCACCACCCGGGAAGAAAGGGCGCACATATATTTGCAGCTGCATGCTATTCCTCAGGCCCACTGAAGGTGCCAAGCTCCTGTTAAGGAAGTGGATCGAGGAGCTTAAGGAGCAGCCCTGGTCGAAGCAAATGAAGTCAAATGATCAGCCAGCATTCAACTGGGCTTTGAACAAGACTGCCGGGCAGGTTGATGTTTACCTCCTGCCTCAGTCTGCATTTCCAACCGGAGGCCTATATTTCAAGAATAAAAAATGGGTCAAGGAGACAAAGGGCAAGCATGTCATTATACATAATAACTACATCACAGGGTTTGAGAAGAAGATAAAGCGGTTCCGGGATCATGGGTTGTGGTTGGTAGATGAGCACAGCGATGAGTCACCGCTTGGCAGAATCTGAGCGATCAAGGCTGAAACACATTTCTTCTTGCTGCAGCATCACAATTTTGTAATTGGTATTTGACTATTGAAGCCAGTATCCATCTAAACCAAACGGTGTATGCAGCAGCCAAAAATCAAACGCAGAAGATATTACTTGCCAACATCTTTTTTTGGCTGTATGTCAAGCGCTTGTAGAGTATCCTTTACCATGTGGCCATGATGATTGTTTTTTATTGTATTTGTTCTTTACTGAAAATGATGTATTTGAGAGCAGTTAAGATCTTAGGGTGTGGCGAAACAGACCCTTAGTACATTGGCTGATGATTCACTTATTGTATAGCATAAAGTTTGATAGCTTGCATAGCCATTTCTGAAAGAAAATTGTACTTTTTGCCTCTATATCAATGATTCGTC

SEQ ID NO: 1191 - DNA, 1792 bp, Zea mays
  misc_feature (1)..(1792): Ceres cDNA ID no. 12412110
  misc_feature (1)..(1792): Ceres CLONE  ID no. 218626
  misc_feature (1)..(1792): Also known as  Ceres CDNA ID no. 23780174
aaatcctcctcctcctcctgccgcagcccgcagggaggtggagttgtcaacgtgccgaggactggagcgcccgcgtccggcgtctctataaacgagaccgcccggccatttggtctgctcctctctgttctcccctgcctgcctgcttccagctgcatctctctccgccgagaccgagaggaggaggaggcaagggaggcatccctgacgtacggacggcggccatggggacgcaggcgccggagaactaccccgccgagaaggtacaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagcttggctggggccctggcatcgcggtgctggtggtgtcgtgggtgatcacgctgtacacgctgtggcagatggtggagatgcacgagatggtccccgggaagcggttcgaccgttaccacgagctggggcagcacgcgttcggggaccggctgggcctgtggatcgtggtgccgcagcagctggtcgtcgaggtgggcgtgaacatcgtgtacatggtgaccggcggcaagtccctgaagaagttccacgacgtggctggtgtgcggcgacacgggggtgtgcgaggggaaggacaacatcaagaccacctacttcatcatgatcttcgcgtccgtccacttcgtcctctcgcagctccccaacttcaactccatctccggcgtctccctcgccgccgccgtcatgtcgctcagctactccaccatcgcgtggggcgcgtcggtgcacaaggggaggatgtcgggcgtcgactaccacctgcgcgcgaccaccacgccggggaaggtgttcggcttcttcggcgcgctgggggacgtggcgttcgcctacgccggccacaacgtggtgctggagatccaggccaccatcccgtccacccccgacaagccgtccaagaagcccatgtggaagggcgtggtggtcgcctacgtcgtggtggcgctctgctacttccccgtcgcgctcatcggctactgggcgttcggaaacacggtcgaggacaacatcctcatcacgctcagcaagcccaagtggctcatcgcgctcgccaacatgatggtcgtcgtccatgtcatcggcagctaccagatctatgccatgccggtgtttgacatgatagagaccgtgctggtgaagaagctgcgcttccctcccggcctcacgctgcgtctgatcgctcggaccctctatgttgcgttcacgatgttcatagccatcaccttccccttcttcggtgggctgctcggtttcttcggcgggttcgccttcgcgccgaccacctatttccttccctgcgtcatgtggctcgcaatctacaagcccaagaggttcagcctctcctggttgaccaactggatgtgcatcattcttggggtgctcctgatgattctgtcgcccatcggagggctccggcaaataataatggacgcgaaaacctaccagttctactcgtgagctaccaccagccatgacttgtaagcacgattggagaaatctgtcaaagcctcaaccacgagtttttgtttttgttttttgtcatgccaaacacatacatatacgtactgtttttttaatattcaaaggtgttcttcgtggcttgcgtgtgtacagtattatgtgtatgagggagacataagtttaatgatgctggctgtct

SEQ ID NO: 1192 - protein, 1792 aa, Zea mays
  misc_feature: PFam Name: Aa_trans; PFam Description: Transmembrane amino
  misc_feature: GI Number: 22137070; NR Description: At5g40780/K1B16_3 [Arabidopsis thaliana] >gi|14194151|gb|AAK56270.1| AT5g40780/K1B16_3 [Arabidopsis thaliana] >gi|30693663|ref|NP_851109.1| lysine and histidine specific
  misc_feature: GI Number: 1906549; NR Description: amino acid permease [Nicotiana sylvestris] >gi|976402|gb|AAB48944.1| amino acid permease 1 >gi|7489096|pir||T15052 amino acid permease 1 - wood
  misc_feature: GI Number: 9293860; NR Description: amino acid transporter-like protein 2 [Arabidopsis thaliana] >gi|18395471|ref|NP_564217.1| lysine and histidine specific transporter, putative [Arabidopsis thaliana]
  misc_feature: GI Number: 30409136; NR Description: histidine amino acid
  misc_feature: GI Number: 2576361; NR Description: lysine and histidine
AAATCCTCCTCCTCCTCCTGCCGCAGCCCGCAGGGAGGTGGAGTTGTCAACGTGCCGAGGACTGGAGCGCCCGCGTCCGGCGTCTCTATAAACGAGACCGCCCGGCCATTTGGTCTGCTCCTCTCTGTTCTCCCCTGCCTGCCTGCTTCCAGCTGCATCTCTCTCCGCCGAGACCGAGAGGAGGAGGAGGCAAGGGAGGCATCCCTGACGTACGGACGGCGGCCATGGGGACGCAGGCGCCGGAGAACTACCCCGCCGAGAAGGTACAGGACGCGAGGAGCGCGCGGGAGAAGGCCATCGACGACTGGCTCCCGATCACCTCGTCGCGGAACGCCAAGTGGTGGTACTCCGCCTTCCACAATGTCACCGCCATGGTCGGCGCCGGCGTGCTCAGCCTGCCCTACGCCATGTCCGAGCTTGGCTGGGGCCCTGGCATCGCGGTGCTGGTGGTGTCGTGGGTGATCACGCTGTACACGCTGTGGCAGATGGTGGAGATGCACGAGATGGTCCCCGGGAAGCGGTTCGACCGTTACCACGAGCTGGGGCAGCACGCGTTCGGGGACCGGCTGGGCCTGTGGATCGTGGTGCCGCAGCAGCTGGTCGTCGAGGTGGGCGTGAACATCGTGTACATGGTGACCGGCGGCAAGTCCCTGAAGAAGTTCCACGACGTGGCTGGTGTGCGGCGACACGGGGGTGTGCGAGGGGAAGGACAACATCAAGACCACCTACTTCATCATGATCTTCGCGTCCGTCCACTTCGTCCTCTCGCAGCTCCCCAACTTCAACTCCATCTCCGGCGTCTCCCTCGCCGCCGCCGTCATGTCGCTCAGCTACTCCACCATCGCGTGGGGCGCGTCGGTGCACAAGGGGAGGATGTCGGGCGTCGACTACCACCTGCGCGCGACCACCACGCCGGGGAAGGTGTTCGGCTTCTTCGGCGCGCTGGGGGACGTGGCGTTCGCCTACGCCGGCCACAACGTGGTGCTGGAGATCCAGGCCACCATCCCGTCCACCCCCGACAAGCCGTCCAAGAAGCCCATGTGGAAGGGCGTGGTGGTCGCCTACGTCGTGGTGGCGCTCTGCTACTTCCCCGTCGCGCTCATCGGCTACTGGGCGTTCGGAAACACGGTCGAGGACAACATCCTCATCACGCTCAGCAAGCCCAAGTGGCTCATCGCGCTCGCCAACATGATGGTCGTCGTCCATGTCATCGGCAGCTACCAGATCTATGCCATGCCGGTGTTTGACATGATAGAGACCGTGCTGGTGAAGAAGCTGCGCTTCCCTCCCGGCCTCACGCTGCGTCTGATCGCTCGGACCCTCTATGTTGCGTTCACGATGTTCATAGCCATCACCTTCCCCTTCTTCGGTGGGCTGCTCGGTTTCTTCGGCGGGTTCGCCTTCGCGCCGACCACCTATTTCCTTCCCTGCGTCATGTGGCTCGCAATCTACAAGCCCAAGAGGTTCAGCCTCTCCTGGTTGACCAACTGGATGTGCATCATTCTTGGGGTGCTCCTGATGATTCTGTCGCCCATCGGAGGGCTCCGGCAAATAATAATGGACGCGAAAACCTACCAGTTCTACTCGTGAGCTACCACCAGCCATGACTTGTAAGCACGATTGGAGAAATCTGTCAAAGCCTCAACCACGAGTTTTTGTTTTTGTTTTTTGTCATGCCAAACACATACATATACGTACTGTTTTTTTAATATTCAAAGGTGTTCTTCGTGGCTTGCGTGTGTACAGTATTATGTGTATGAGGGAGACATAAGTTTAATGATGCTGGCTGTCT

SEQ ID NO: 1193 - DNA, 1434 bp, Zea mays
  misc_feature (1)..(1434): Ceres cDNA ID no. 12412606
  misc_feature (1)..(1434): Ceres CLONE  ID no. 298309
  misc_feature (1)..(1434): Also known as  Ceres CDNA ID no. 23768194
gtgggcgttgtgtgcgcggccgcagtgtgcggatcaagctgcatgtgtggaaggcagcgctgagttagtgcccagcgtcagcagctataaaagcacttgtactcatcgattatcaacagggaatagagaaaggcagtgtcggagcgctgcaggtgtttgggcgccgaactctttgtgtttagctactgttcattcgtcttcctcctctcaccaatctgtgtcctgtgcttgtgagcgttttagagttccaacaattggtatcagaggcagtttatgcccaagatcttacgctactacctcgagtccgagtccatggcgatggttccgcacggcgccggggggagttcggtctccatgtcatacccggtgctgtcgccggcgagctacacggcgtgggcaatcaaggtggagtcgatcctcgacgcgcaaggtctctgggaggccgtgtctccaccagataatggcgaggtgaacgcggtgaagaacaagacggcgcgggcacagcttctccaagctctgcccgatgacatcttgatgcaggtctccatcaagaaaacggcagcggaggtgtgggcgagcctcaagactcgtttcgtcggtgcggatcgggtcaagacggcacgcctcgccacgctcaagggggagttcgacaagctgtacatggaggacgaggaggcattggacgactacgcaggcaaaatcagcggtatggcagcgcgttacgccgggcttggcgcaacgctcgacgacgctgccatggtgaagaagctcctcgacaccgttccagatcggctcttccccgtcgtcgcgggcatcgagcagttctgcgacgtcgagacgatgccgttcgaggaggcgctcggacgtctcaaggcgttcgatgagcgttctcggcggcgtactcatgccggcggtgaacggcgcgacgatcagctccttctcacggaggccgagtggaaagctcgaaaaaagaagaagtcgacgatcggcaaatgcttcaactgtggcaatcgcggccatttcgcccgggactgccccaagaagaaggaggaggaggcgctgctcgccaacgccaacgaggagccggcgctgttctgagcagcggcgctgggtttagggggagtttgttgggaataaacccagctgcgtgtgcgtgcacacagcgggtggcgtgagtgcgtcgtgttgtctagtgtgtgcgtctgtgtccgagtcgtgcggcggacggagcaattcgtgccgagtacgtgttcttgccgcgtacgttgcgtggtggtagttgcatgcagtcgtggtgatctgttggaggccagccgcagtgtacgcgttcgtgggcgttgtgtgcgcggccgcagtgtgcggatcaagctgcatgtgtggaaggcagcgctgagttagtgcccagcgtcagcagctataaaagcacttgtaccc

SEQ ID NO: 1194 - protein, 1434 aa, Zea mays
  misc_feature: PFam Name: Retrotrans_gag; PFam Description: Retrotransposon
  misc_feature: GI Number: 34907386; NR Description: P0471B04.27 [Oryza sativa (japonica cultivar-group)] >gi|21952802|dbj|BAC06218.1| P0018C10.19 [Oryza sativa (japonica cultivar-group)] >gi|22202685|dbj|BAC07343.1| P0471B04.27 [Oryza sativa (japonica
  misc_feature: GI Number: 34910624; NR Description: putative copia-type polyprotein [Oryza sativa (japonica cultivar-group)] >gi|15623989|dbj|BAB68043.1| putative copia-type polyprotein [Oryza sativa (japonica cultivar-group)]
  misc_feature: GI Number: 51964644; NR Description: PREDICTED OJ1499_A07.20
  misc_feature: GI Number: 50921055; NR Description: putative gag-pol polyprotein [Oryza sativa (japonica cultivar-group)] >gi|30017513|gb|AAP12935.1| putative gag-pol polyprotein [Oryza
  misc_feature: GI Number: 50917767; NR Description: gag-pol polyprotein [Oryza sativa (japonica cultivar-group)] >gi|29150404|gb|AAO72413.1| gag-pol polyprotein [Oryza sativa
GTGGGCGTTGTGTGCGCGGCCGCAGTGTGCGGATCAAGCTGCATGTGTGGAAGGCAGCGCTGAGTTAGTGCCCAGCGTCAGCAGCTATAAAAGCACTTGTACTCATCGATTATCAACAGGGAATAGAGAAAGGCAGTGTCGGAGCGCTGCAGGTGTTTGGGCGCCGAACTCTTTGTGTTTAGCTACTGTTCATTCGTCTTCCTCCTCTCACCAATCTGTGTCCTGTGCTTGTGAGCGTTTTAGAGTTCCAACAATTGGTATCAGAGGCAGTTTATGCCCAAGATCTTACGCTACTACCTCGAGTCCGAGTCCATGGCGATGGTTCCGCACGGCGCCGGGGGGAGTTCGGTCTCCATGTCATACCCGGTGCTGTCGCCGGCGAGCTACACGGCGTGGGCAATCAAGGTGGAGTCGATCCTCGACGCGCAAGGTCTCTGGGAGGCCGTGTCTCCACCAGATAATGGCGAGGTGAACGCGGTGAAGAACAAGACGGCGCGGGCACAGCTTCTCCAAGCTCTGCCCGATGACATCTTGATGCAGGTCTCCATCAAGAAAACGGCAGCGGAGGTGTGGGCGAGCCTCAAGACTCGTTTCGTCGGTGCGGATCGGGTCAAGACGGCACGCCTCGCCACGCTCAAGGGGGAGTTCGACAAGCTGTACATGGAGGACGAGGAGGCATTGGACGACTACGCAGGCAAAATCAGCGGTATGGCAGCGCGTTACGCCGGGCTTGGCGCAACGCTCGACGACGCTGCCATGGTGAAGAAGCTCCTCGACACCGTTCCAGATCGGCTCTTCCCCGTCGTCGCGGGCATCGAGCAGTTCTGCGACGTCGAGACGATGCCGTTCGAGGAGGCGCTCGGACGTCTCAAGGCGTTCGATGAGCGTTCTCGGCGGCGTACTCATGCCGGCGGTGAACGGCGCGACGATCAGCTCCTTCTCACGGAGGCCGAGTGGAAAGCTCGAAAAAAGAAGAAGTCGACGATCGGCAAATGCTTCAACTGTGGCAATCGCGGCCATTTCGCCCGGGACTGCCCCAAGAAGAAGGAGGAGGAGGCGCTGCTCGCCAACGCCAACGAGGAGCCGGCGCTGTTCTGAGCAGCGGCGCTGGGTTTAGGGGGAGTTTGTTGGGAATAAACCCAGCTGCGTGTGCGTGCACACAGCGGGTGGCGTGAGTGCGTCGTGTTGTCTAGTGTGTGCGTCTGTGTCCGAGTCGTGCGGCGGACGGAGCAATTCGTGCCGAGTACGTGTTCTTGCCGCGTACGTTGCGTGGTGGTAGTTGCATGCAGTCGTGGTGATCTGTTGGAGGCCAGCCGCAGTGTACGCGTTCGTGGGCGTTGTGTGCGCGGCCGCAGTGTGCGGATCAAGCTGCATGTGTGGAAGGCAGCGCTGAGTTAGTGCCCAGCGTCAGCAGCTATAAAAGCACTTGTACCC

SEQ ID NO: 1195 - DNA, 1689 bp, Zea mays
  misc_feature (1)..(1689): Ceres cDNA ID no. 12413080
  misc_feature (1)..(1689): Ceres CLONE  ID no. 226421
  misc_feature (1)..(1689): Also known as  Ceres CDNA ID no. 23753714
attttccttcgcctcttctcctctatcggcggtcgcggccaaggccaacgaaccaaattcctctacggcccaccttcttcctacctgccattctcccatccaacacagcaggacgtctcctcctcctccctcccgcttctatcgccgtcttcatttccaggacgcgtcgaattcctccatctaccgcgccggccgccgaggcccgagggggaggaggatgctgggcgccgcgaggaggcagcttggatccggtcccatgctgggacaggttttgcgaaggctccgcccggcggcggcggctgaggtggcgaggggctactccgctgcggcgaaggagatgactgtccgtgatgcattgaactctgcactggatgaagagatgtctgctgatccttcagtttttctgatgggagaagaggttggagagtatcaaggtgcatacaagatttctaagggcttgcttgacaagtatggtcccgatagggttcttgacacacctatcacagaggctggctttactggcattggtgttggtgcagcttaccaaggtcttcggcctgttatagaatttatgacatttaatttctcgatgcaggctattgatcatatcatcaattcagctgctaagtcaaactacatgtcagccggtcagatatctgttcctattgtttttagaggaccaaatggagctgctgctggagttggtgctcaacactcacagtgttatgcagcttggtatgcacatgttccaggacttaaggttctcacaccatactcttcagaagatgcccgaggcttgcttaaagctgctattagagatcctgatcctgttattttcttggaaaatgaattgctttatggagaatctttcccagtttctgctgaagtgcttgattctagtttttgcctaccgattggcaaagctaagatagaacgtgggggtaaagatgttaccattactgcattctccaagatggttggctatgctctccaggctgcagagatactgtccaaggaaggaatcagtgctgaggtgatcaaccttcgatcgatcagaccacttgatagagctgctattaatgcatctgtcaggaaaaccaaccgattggtgactgttgaagaagggttccctcaacatgggattggtgccgagatatgcatgtctgttgtagaagaaagctttgagtaccttgatgccccagttgagaggatcgctggagctgatgtacctatgccctatgctgccaaccttgagagaatggctgttccacaggtcgatgacattgtgcgggcagcaaagcgggcctgctacagggcagtaccaatggccgcagctgcctgattggtgtacagacctttctgtttttcttcctcagttttcgctctctggcagcaagaaacatgtagtattcataaagtgccggcaaattggccggaccccagactccaagcgagctagtttttgtagatctgctatggtgtgctttattccgttagtcgatatatgttgcattgtttctagtttcgaagtccatttatttacttctctatgatttctacacacggcctaataatcttgctaaggccctgattgaatggaaaatattttttgggagttttaggaaaatactacatttttgtgaaataccttggttttgagtaacagtaatatgaaggggatgtttggtt

SEQ ID NO: 1196 - protein, 1689 aa, Zea mays
  misc_feature: PFam Name: Transket_pyr; PFam Description: Transketolase,
  misc_feature: PFam Name: Transketolase_C; PFam Description: Transketolase,
  misc_feature: GI Number: 23507745; NR Description: At5g50850/K16E14_1 [Arabidopsis thaliana] >gi|8953766|dbj|BAA98121.1| pyruvate dehydrogenase E1 component beta subunit, mitochondrial precursor (PDHE1-B) [Arabidopsis thaliana] >gi|17979466|gb|AAL50070.1|
  misc_feature: GI Number: 520478; NR Description: pyruvate dehydrogenase E1
  misc_feature: GI Number: 3850999; NR Description: pyruvate dehydrogenase E1
  misc_feature: GI Number: 3851001; NR Description: pyruvate dehydrogenase E1
  misc_feature: GI Number: 3851003; NR Description: pyruvate dehydrogenase E1
ATTTTCCTTCGCCTCTTCTCCTCTATCGGCGGTCGCGGCCAAGGCCAACGAACCAAATTCCTCTACGGCCCACCTTCTTCCTACCTGCCATTCTCCCATCCAACACAGCAGGACGTCTCCTCCTCCTCCCTCCCGCTTCTATCGCCGTCTTCATTTCCAGGACGCGTCGAATTCCTCCATCTACCGCGCCGGCCGCCGAGGCCCGAGGGGGAGGAGGATGCTGGGCGCCGCGAGGAGGCAGCTTGGATCCGGTCCCATGCTGGGACAGGTTTTGCGAAGGCTCCGCCCGGCGGCGGCGGCTGAGGTGGCGAGGGGCTACTCCGCTGCGGCGAAGGAGATGACTGTCCGTGATGCATTGAACTCTGCACTGGATGAAGAGATGTCTGCTGATCCTTCAGTTTTTCTGATGGGAGAAGAGGTTGGAGAGTATCAAGGTGCATACAAGATTTCTAAGGGCTTGCTTGACAAGTATGGTCCCGATAGGGTTCTTGACACACCTATCACAGAGGCTGGCTTTACTGGCATTGGTGTTGGTGCAGCTTACCAAGGTCTTCGGCCTGTTATAGAATTTATGACATTTAATTTCTCGATGCAGGCTATTGATCATATCATCAATTCAGCTGCTAAGTCAAACTACATGTCAGCCGGTCAGATATCTGTTCCTATTGTTTTTAGAGGACCAAATGGAGCTGCTGCTGGAGTTGGTGCTCAACACTCACAGTGTTATGCAGCTTGGTATGCACATGTTCCAGGACTTAAGGTTCTCACACCATACTCTTCAGAAGATGCCCGAGGCTTGCTTAAAGCTGCTATTAGAGATCCTGATCCTGTTATTTTCTTGGAAAATGAATTGCTTTATGGAGAATCTTTCCCAGTTTCTGCTGAAGTGCTTGATTCTAGTTTTTGCCTACCGATTGGCAAAGCTAAGATAGAACGTGGGGGTAAAGATGTTACCATTACTGCATTCTCCAAGATGGTTGGCTATGCTCTCCAGGCTGCAGAGATACTGTCCAAGGAAGGAATCAGTGCTGAGGTGATCAACCTTCGATCGATCAGACCACTTGATAGAGCTGCTATTAATGCATCTGTCAGGAAAACCAACCGATTGGTGACTGTTGAAGAAGGGTTCCCTCAACATGGGATTGGTGCCGAGATATGCATGTCTGTTGTAGAAGAAAGCTTTGAGTACCTTGATGCCCCAGTTGAGAGGATCGCTGGAGCTGATGTACCTATGCCCTATGCTGCCAACCTTGAGAGAATGGCTGTTCCACAGGTCGATGACATTGTGCGGGCAGCAAAGCGGGCCTGCTACAGGGCAGTACCAATGGCCGCAGCTGCCTGATTGGTGTACAGACCTTTCTGTTTTTCTTCCTCAGTTTTCGCTCTCTGGCAGCAAGAAACATGTAGTATTCATAAAGTGCCGGCAAATTGGCCGGACCCCAGACTCCAAGCGAGCTAGTTTTTGTAGATCTGCTATGGTGTGCTTTATTCCGTTAGTCGATATATGTTGCATTGTTTCTAGTTTCGAAGTCCATTTATTTACTTCTCTATGATTTCTACACACGGCCTAATAATCTTGCTAAGGCCCTGATTGAATGGAAAATATTTTTTGGGAGTTTTAGGAAAATACTACATTTTTGTGAAATACCTTGGTTTTGAGTAACAGTAATATGAAGGGGATGTTTGGTT

SEQ ID NO: 1197 - DNA, 1753 bp, Zea mays
  misc_feature (1)..(1753): Ceres cDNA ID no. 12413795
  misc_feature (1)..(1753): Ceres CLONE  ID no. 218967
  misc_feature (1)..(1753): Also known as  Ceres CDNA ID no. 24370051
ccccctgccccacactttagcccaaggaggccggcctcgcctcgcctcgcttcatacgcccgcccgcccctgccgatccatccacctaataaagcgcctgtacagatccaacccttaggatccggatcgccttacccccccgcgacgatttgcgcgattcgattcgattatcctccgattttccccggtttttgtaggtttcctctctttttcgatcggtgtgctagggtttggacgcgcggaggcgtcgcattccagggtaatcattggttcgacgggctagggtgctttctcacccggggaacggaagcgaatccagacgatggagaagaagaaggtggcgataccgctggtgtgccacggccactcgcggccggtggtggacctcttctacagccccgtcacacccgatggctacttcctcatcagcgccagcaaggatacaaatccaatgcttcgtaatggtgagactggcgactggattgggacttttcaaggtcataaaggagctgtttggagctgttgccttgacaggaatgctctgagggctgcatctgcttctgctgacttttcagctaaagtatgggatgcacttactggggatgagctacattcatttgaacacaagcatatagttcgggcgtgtgccttctctgaggatacacaccttttactcactggaggcatggaaaagattttgcgtgtgtatgatatgaatcgtcctgatgcagctccaagagagcttgacaaatcacctggttccgttcgaactgctgcttggcttcatagtgaccaaactatattgagttcctgcactgacatgggtggagtaaggctgtgggatgtgagaactggaaaaaatgtccaaactcttgaaaccaaggcttctgtcactagtgcagaagtaagccaggatggcaggttcatcactactgctgatggctcaagtgtaaaattctgggacgcgaatcactttggccttgttaaaagctatgatatgccatgcaatgtggaatcggcttcacttgaacctaagtctgggagtaaatttgtcgctggaggagaagatttatgggttcatgtatttgatttcttcactggtgaagaaatagcttgtaacaaaggacatcatggtccagtccactgtgtccggtttgcaccttgtggtgaatcatacgcatcgggttcagaagatggcaccattcggatctggcagcttagcccggctaatgctgatgacaatgaggtggccaatgcaaatggcaagacaactgctggggtaaacgaagttacaaccaagatcgaaggcttccacattcccaaggaggggcagaccgaggggtaggatctcatgtgttttgtggtgcttgtggttcttattgcgaggagattgccaccagagctgcagtggtcattcagtttccctctgcggagtcatcatgtctgcgatccaagggtatcctggcttcatgagtcatcatccactggggaaaaacaagcaagcaaatggtggtgggtttttggatggggccctcgctttgatagaacatagcaattgtagcgtcaaaaataaacaatagttgggtagtttaggtaccgtgtttgcgttcattaaagtgaagtattctgtatcccctaaaaaaaacacttgaggccttcatcgttggaacaccgaccttcaaagctgtagaccacttcttgatcctgaggtagttctggagcgtcatgcctatcaaatgacagatttctgtcc

SEQ ID NO: 1198 - protein, 1753 aa, Zea mays
  misc_feature: PFam Name: WD40; PFam Description: WD domain, G-beta repeat
  misc_feature: GI Number: 30725304; NR Description: At1g52730 [Arabidopsis thaliana] >gi|5903032|gb|AAD55591.1| Similar to gb|AJ010025 unr-interacting protein from Homo sapiens and contains 3 PF|00400
  misc_feature: GI Number: 50725469; NR Description: putative WD-40 repeat
  misc_feature: GI Number: 50906147; NR Description: putative serine-threonine kinase receptor-associated protein [Oryza sativa (japonica cultivar-group)] >gi|51536270|dbj|BAD38438.1| putative serine-threonine kinase receptor-associated protein [Oryza sativa
  misc_feature: GI Number: 41053501; NR Description: serine/threonine kinase receptor associated protein [Danio rerio] >gi|41107550|gb|AAH65428.1| Serine/threonine kinase receptor
  misc_feature: GI Number: 51895969; NR Description: MGC86380 protein
CCCCCTGCCCCACACTTTAGCCCAAGGAGGCCGGCCTCGCCTCGCCTCGCTTCATACGCCCGCCCGCCCCTGCCGATCCATCCACCTAATAAAGCGCCTGTACAGATCCAACCCTTAGGATCCGGATCGCCTTACCCCCCCGCGACGATTTGCGCGATTCGATTCGATTATCCTCCGATTTTCCCCGGTTTTTGTAGGTTTCCTCTCTTTTTCGATCGGTGTGCTAGGGTTTGGACGCGCGGAGGCGTCGCATTCCAGGGTAATCATTGGTTCGACGGGCTAGGGTGCTTTCTCACCCGGGGAACGGAAGCGAATCCAGACGATGGAGAAGAAGAAGGTGGCGATACCGCTGGTGTGCCACGGCCACTCGCGGCCGGTGGTGGACCTCTTCTACAGCCCCGTCACACCCGATGGCTACTTCCTCATCAGCGCCAGCAAGGATACAAATCCAATGCTTCGTAATGGTGAGACTGGCGACTGGATTGGGACTTTTCAAGGTCATAAAGGAGCTGTTTGGAGCTGTTGCCTTGACAGGAATGCTCTGAGGGCTGCATCTGCTTCTGCTGACTTTTCAGCTAAAGTATGGGATGCACTTACTGGGGATGAGCTACATTCATTTGAACACAAGCATATAGTTCGGGCGTGTGCCTTCTCTGAGGATACACACCTTTTACTCACTGGAGGCATGGAAAAGATTTTGCGTGTGTATGATATGAATCGTCCTGATGCAGCTCCAAGAGAGCTTGACAAATCACCTGGTTCCGTTCGAACTGCTGCTTGGCTTCATAGTGACCAAACTATATTGAGTTCCTGCACTGACATGGGTGGAGTAAGGCTGTGGGATGTGAGAACTGGAAAAAATGTCCAAACTCTTGAAACCAAGGCTTCTGTCACTAGTGCAGAAGTAAGCCAGGATGGCAGGTTCATCACTACTGCTGATGGCTCAAGTGTAAAATTCTGGGACGCGAATCACTTTGGCCTTGTTAAAAGCTATGATATGCCATGCAATGTGGAATCGGCTTCACTTGAACCTAAGTCTGGGAGTAAATTTGTCGCTGGAGGAGAAGATTTATGGGTTCATGTATTTGATTTCTTCACTGGTGAAGAAATAGCTTGTAACAAAGGACATCATGGTCCAGTCCACTGTGTCCGGTTTGCACCTTGTGGTGAATCATACGCATCGGGTTCAGAAGATGGCACCATTCGGATCTGGCAGCTTAGCCCGGCTAATGCTGATGACAATGAGGTGGCCAATGCAAATGGCAAGACAACTGCTGGGGTAAACGAAGTTACAACCAAGATCGAAGGCTTCCACATTCCCAAGGAGGGGCAGACCGAGGGGTAGGATCTCATGTGTTTTGTGGTGCTTGTGGTTCTTATTGCGAGGAGATTGCCACCAGAGCTGCAGTGGTCATTCAGTTTCCCTCTGCGGAGTCATCATGTCTGCGATCCAAGGGTATCCTGGCTTCATGAGTCATCATCCACTGGGGAAAAACAAGCAAGCAAATGGTGGTGGGTTTTTGGATGGGGCCCTCGCTTTGATAGAACATAGCAATTGTAGCGTCAAAAATAAACAATAGTTGGGTAGTTTAGGTACCGTGTTTGCGTTCATTAAAGTGAAGTATTCTGTATCCCCTAAAAAAAACACTTGAGGCCTTCATCGTTGGAACACCGACCTTCAAAGCTGTAGACCACTTCTTGATCCTGAGGTAGTTCTGGAGCGTCATGCCTATCAAATGACAGATTTCTGTCC

SEQ ID NO: 1199 - DNA, 1433 bp, Zea mays
  misc_feature (1)..(1433): Ceres cDNA ID no. 12413803
  misc_feature (1)..(1433): Ceres CLONE  ID no. 219393
  misc_feature (1)..(1433): Also known as  Ceres CDNA ID no. 23769764
atgcctctcatcttcttctccgccgcagcccccctcgtcgccgtctccctgctgcccctccccacccactgctgcctccgcctcaccgccacccgcgcggccgccacgagcacaaccgccaccccgggtcccgctcccgcgagcaccttcgccgtcgaggactacctcatcgccagctgccacctcaccccaccgcaggcgctcaaggcgtccaagagcctggcgcacctcaagtccgcatccaacgcggacgcggtgctcgccttccttgcggacctcgggctctccccaaaggaggtggccgccgttgtggcgtccaatccgcgtgtcctctgcgctcgcatcgaccgttccctggctcctatctccacggagctccgcgcgctcggcctctccccgtcccagatcgcgcgcctcgcgcagatcgccggccgctacttcctctgccgcagcttcgtctccaaggtacggttctggctcccgctcttcggctcccccgagcggctcctccaggccagcgactggaactactggctcctcagctccgacctcgagaaggtggtggagcccaacgtggccttcctcaggaagtgcggcctcagcgcagtcgacatcgccaagctgctcgtggccgcgccgcggctcgtcaccatgcctccggagtatgtccaggacgcggtgcggcgtgccacgcagctcggcgtggcgccgggctcccagatgtttcgccacgcgctctccaccgcgggatgtatcgggcaggagaaggtcgactccaaggtcgccgtcctcaaggagacgctcgggtggtcgcaggaggaggtgagcctggccatcagtaaggcgccgcggatcctggttgcgtccgaggagaggctgcgccggaacgcggagttcctgctcaatgaggtcgggctgccgccgcagtacatcgcccgccgttcggtgcttctcatgtacagcctggagaggcggatagtgccccggcacctcgtgctggtggttctcaaagagaaggggttggttgagcaggaccggtgcttcttcaacgtggtggcaccaacagaagagaaattcttggagaaattcgttgctccctacgaggaatccatccctggtcttgccgatgcttacgagtctgcttgtatggggaaagtgacccggggtctatgactggaatgtcgaggagaatttcgaaggtgtgtgttccctccattgtgcatttgtgtaacctcattctactgatctcgcttcaacagaaaaattattccactgatgaactatcgaagacaaaggcagtttcgtggacattagcttaggtccacactagtaacagcataaattcatgttatagccatgaaaatgttcatttctaacttaaggatcgtttcatatgaaagtgcaagcaataaaattttttcccatgagatttt

SEQ ID NO: 1200 - protein, 1433 aa, Zea mays
  misc_feature: PFam Name: mTERF; PFam Description: mTERF
  misc_feature: PFam Name: Pkinase; PFam Description: Protein kinase domain
  misc_feature: PFam Name: FH2; PFam Description: Formin Homology 2 Domain
  misc_feature: PFam Name: Pyr_redox_2; PFam Description: Pyridine
  misc_feature: PFam Name: Atrophin-1; PFam Description: Atrophin-1 family
  misc_feature: GI Number: 50912803; NR Description: mitochondrial transcription termination factor-like [Oryza sativa (japonica cultivar-group)] >gi|46390202|dbj|BAD15633.1| mitochondrial transcription termination factor-like [Oryza sativa (japonica
  misc_feature: GI Number: 51536072; NR Description: mitochondrial transcription termination factor-like [Oryza sativa (japonica cultivar-group)] >gi|51535002|dbj|BAD37286.1| mitochondrial transcription termination factor-like [Oryza sativa (japonica
  misc_feature: GI Number: 51536063; NR Description: mitochondrial transcription termination factor-like [Oryza sativa (japonica
  misc_feature: GI Number: 51536066; NR Description: mitochondrial transcription termination factor-like [Oryza sativa (japonica
  misc_feature: GI Number: 51536068; NR Description: mitochondrial transcription termination factor-like [Oryza sativa (japonica
ATGCCTCTCATCTTCTTCTCCGCCGCAGCCCCCCTCGTCGCCGTCTCCCTGCTGCCCCTCCCCACCCACTGCTGCCTCCGCCTCACCGCCACCCGCGCGGCCGCCACGAGCACAACCGCCACCCCGGGTCCCGCTCCCGCGAGCACCTTCGCCGTCGAGGACTACCTCATCGCCAGCTGCCACCTCACCCCACCGCAGGCGCTCAAGGCGTCCAAGAGCCTGGCGCACCTCAAGTCCGCATCCAACGCGGACGCGGTGCTCGCCTTCCTTGCGGACCTCGGGCTCTCCCCAAAGGAGGTGGCCGCCGTTGTGGCGTCCAATCCGCGTGTCCTCTGCGCTCGCATCGACCGTTCCCTGGCTCCTATCTCCACGGAGCTCCGCGCGCTCGGCCTCTCCCCGTCCCAGATCGCGCGCCTCGCGCAGATCGCCGGCCGCTACTTCCTCTGCCGCAGCTTCGTCTCCAAGGTACGGTTCTGGCTCCCGCTCTTCGGCTCCCCCGAGCGGCTCCTCCAGGCCAGCGACTGGAACTACTGGCTCCTCAGCTCCGACCTCGAGAAGGTGGTGGAGCCCAACGTGGCCTTCCTCAGGAAGTGCGGCCTCAGCGCAGTCGACATCGCCAAGCTGCTCGTGGCCGCGCCGCGGCTCGTCACCATGCCTCCGGAGTATGTCCAGGACGCGGTGCGGCGTGCCACGCAGCTCGGCGTGGCGCCGGGCTCCCAGATGTTTCGCCACGCGCTCTCCACCGCGGGATGTATCGGGCAGGAGAAGGTCGACTCCAAGGTCGCCGTCCTCAAGGAGACGCTCGGGTGGTCGCAGGAGGAGGTGAGCCTGGCCATCAGTAAGGCGCCGCGGATCCTGGTTGCGTCCGAGGAGAGGCTGCGCCGGAACGCGGAGTTCCTGCTCAATGAGGTCGGGCTGCCGCCGCAGTACATCGCCCGCCGTTCGGTGCTTCTCATGTACAGCCTGGAGAGGCGGATAGTGCCCCGGCACCTCGTGCTGGTGGTTCTCAAAGAGAAGGGGTTGGTTGAGCAGGACCGGTGCTTCTTCAACGTGGTGGCACCAACAGAAGAGAAATTCTTGGAGAAATTCGTTGCTCCCTACGAGGAATCCATCCCTGGTCTTGCCGATGCTTACGAGTCTGCTTGTATGGGGAAAGTGACCCGGGGTCTATGACTGGAATGTCGAGGAGAATTTCGAAGGTGTGTGTTCCCTCCATTGTGCATTTGTGTAACCTCATTCTACTGATCTCGCTTCAACAGAAAAATTATTCCACTGATGAACTATCGAAGACAAAGGCAGTTTCGTGGACATTAGCTTAGGTCCACACTAGTAACAGCATAAATTCATGTTATAGCCATGAAAATGTTCATTTCTAACTTAAGGATCGTTTCATATGAAAGTGCAAGCAATAAAATTTTTTCCCATGAGATTTT

SEQ ID NO: 1201 - DNA, 1517 bp, Zea mays
  misc_feature (1)..(1517): Ceres cDNA ID no. 12414097
  misc_feature (1)..(1517): Ceres CLONE  ID no. 282766
  misc_feature (1)..(1517): Also known as  Ceres CDNA ID no. 23775623
aacacacaaacccacaccaattgatgtgaaacccacacaatcccatcgtcacgacgccaagatcgtgtgcgagtgcgactgtgcgcacgtctccgtctcgcttgttttaagcacggcaagggaagaggacgacgacgggtggacgcttggacaaacagccttgtcgtgtactctctctttctctcctcccacagttccgctcgattcgaagagtccagcgccacacgacatcctccgcgcggccggccatgggggaagctgcggatccagcgacggggagggtgtcaccgccgatgtcgtggcgtacgcggctctccgtgctcgccgcggggtacctcaccgacgccacgcgccgcgccgacggcacagtcaaccgccgcctgctcggcatgctcgacaagggcgtggcggcgtccgcggtcccgcgcaacggcgtcgcctcgcgggacgtgaccatcgacccggccgtgcccctccgcgcgcgcctcttctacccctgcgctcccgccgccgccgaggacgacgacgcgggggcggagcgtccggcggtgcccgtcgtcgtgttcttccacggcggcggcttcgcgtacctctccgcggcatcccccgcctacgacgctgcgtgccgccgcatcgccaggtacgccggcgcggcggtgctgtccgtcgactaccgccgctcgcccgagcaccggttccccgccgcctacgacgacggcttcgcggccctccgcttcctcgacggcgggcccgaccccgaccccggcgcgatcgcgggcgccccgccgatcgacgccgcgcgctgcttcctcgcgggggacagcgctggcggtaacatcgcgcaccacgtcgcccgccgctacgcgctggacccttccgccttcgcgaacctccgcctcgccggcctcatcgccatccagcccttcttcggcggccaggagcgcacgcccgccgagctgcggctcgtcggcgcgcccatcgtctccgttccgcgcaccgactggatgtggcgcgcgttccttccccacggcgcggaccgcacccacgaggcgtcatcccccgacgtcgccaccgcgggcatcgacggcgcccctgatttcccgcctgccacggtcgtcatcggcgggtacgacccgctgcaggactggcagcgccggtactgcgacgcgttgcgcggtaaggggaaggaggtgcgggtgctcgagtaccccgacgccatccacgccttctacgtgttcccggagttcgcggagtccaaggacctcatgctacggatcaaggagatcgtcgccagcagcgagtgatgggggacggacggcgtgggcgcgcgcagctgtcgctcagatgcgtggtggatgtatctgcgactgtgctaagtggctagggtcagtgttgtggttgtggactggacggtgctgtctagtgtgtgacgtggttcgtcgtgtgggacgcgccacaattaaactagtgttaaataatgatgcgatcggcaatgataattctaattttcgtgtttg

SEQ ID NO: 1202 - protein, 1517 aa, Zea mays
  misc_feature: PFam Name: Abhydrolase_3; PFam Description: alpha/beta
  misc_feature: PFam Name: Pyr_redox_2; PFam Description: Pyridine
  misc_feature: PFam Name: Pkinase; PFam Description: Protein kinase domain
  misc_feature: PFam Name: Podocalyxin; PFam Description: Podocalyxin
  misc_feature: PFam Name: COesterase; PFam Description: Carboxylesterase
  misc_feature: GI Number: 34904770; NR Description: putative esterase [Oryza sativa (japonica cultivar-group)] >gi|23495727|dbj|BAC19939.1|
  misc_feature: GI Number: 50939573; NR Description: putative esterase [Oryza sativa (japonica cultivar-group)] >gi|34393714|dbj|BAC83026.1|
  misc_feature: GI Number: 54290733; NR Description: putative esterase [Oryza
  misc_feature: GI Number: 34904760; NR Description: putative esterase [Oryza sativa (japonica cultivar-group)] >gi|23495723|dbj|BAC19935.1|
  misc_feature: GI Number: 50939571; NR Description: carboxylesterase-like protein [Oryza sativa (japonica cultivar-group)] >gi|23237915|dbj|BAC16489.1| carboxylesterase-like protein [Oryza sativa (japonica cultivar-group)] >gi|50509937|dbj|BAD30258.1|
AACACACAAACCCACACCAATTGATGTGAAACCCACACAATCCCATCGTCACGACGCCAAGATCGTGTGCGAGTGCGACTGTGCGCACGTCTCCGTCTCGCTTGTTTTAAGCACGGCAAGGGAAGAGGACGACGACGGGTGGACGCTTGGACAAACAGCCTTGTCGTGTACTCTCTCTTTCTCTCCTCCCACAGTTCCGCTCGATTCGAAGAGTCCAGCGCCACACGACATCCTCCGCGCGGCCGGCCATGGGGGAAGCTGCGGATCCAGCGACGGGGAGGGTGTCACCGCCGATGTCGTGGCGTACGCGGCTCTCCGTGCTCGCCGCGGGGTACCTCACCGACGCCACGCGCCGCGCCGACGGCACAGTCAACCGCCGCCTGCTCGGCATGCTCGACAAGGGCGTGGCGGCGTCCGCGGTCCCGCGCAACGGCGTCGCCTCGCGGGACGTGACCATCGACCCGGCCGTGCCCCTCCGCGCGCGCCTCTTCTACCCCTGCGCTCCCGCCGCCGCCGAGGACGACGACGCGGGGGCGGAGCGTCCGGCGGTGCCCGTCGTCGTGTTCTTCCACGGCGGCGGCTTCGCGTACCTCTCCGCGGCATCCCCCGCCTACGACGCTGCGTGCCGCCGCATCGCCAGGTACGCCGGCGCGGCGGTGCTGTCCGTCGACTACCGCCGCTCGCCCGAGCACCGGTTCCCCGCCGCCTACGACGACGGCTTCGCGGCCCTCCGCTTCCTCGACGGCGGGCCCGACCCCGACCCCGGCGCGATCGCGGGCGCCCCGCCGATCGACGCCGCGCGCTGCTTCCTCGCGGGGGACAGCGCTGGCGGTAACATCGCGCACCACGTCGCCCGCCGCTACGCGCTGGACCCTTCCGCCTTCGCGAACCTCCGCCTCGCCGGCCTCATCGCCATCCAGCCCTTCTTCGGCGGCCAGGAGCGCACGCCCGCCGAGCTGCGGCTCGTCGGCGCGCCCATCGTCTCCGTTCCGCGCACCGACTGGATGTGGCGCGCGTTCCTTCCCCACGGCGCGGACCGCACCCACGAGGCGTCATCCCCCGACGTCGCCACCGCGGGCATCGACGGCGCCCCTGATTTCCCGCCTGCCACGGTCGTCATCGGCGGGTACGACCCGCTGCAGGACTGGCAGCGCCGGTACTGCGACGCGTTGCGCGGTAAGGGGAAGGAGGTGCGGGTGCTCGAGTACCCCGACGCCATCCACGCCTTCTACGTGTTCCCGGAGTTCGCGGAGTCCAAGGACCTCATGCTACGGATCAAGGAGATCGTCGCCAGCAGCGAGTGATGGGGGACGGACGGCGTGGGCGCGCGCAGCTGTCGCTCAGATGCGTGGTGGATGTATCTGCGACTGTGCTAAGTGGCTAGGGTCAGTGTTGTGGTTGTGGACTGGACGGTGCTGTCTAGTGTGTGACGTGGTTCGTCGTGTGGGACGCGCCACAATTAAACTAGTGTTAAATAATGATGCGATCGGCAATGATAATTCTAATTTTCGTGTTTG

SEQ ID NO: 1203 - DNA, 1250 bp, Zea mays
  misc_feature (1)..(1250): Ceres cDNA ID no. 12414165
  misc_feature (1)..(1250): Ceres CLONE  ID no. 272278
  misc_feature (1)..(1250): Also known as  Ceres CDNA ID no. 23778467
tccactccactccagccaggcgccagcactcacccacccatggcgtccgaagccgcgccgcgggtcgtcgtggacgagtgccggggcgtgctgtccgtgtacagcgacggcacggtggtgcggcgcgcgcagccggggttcgcgacgccggtgcgggacgacggcacggtcgactggaaggacgtgacgttcgacgaggccccgcgggctggcgctccgcctctacctcccccgggaccgcggggccgcggccgggcggcgcctgccggtcttcttctactaccacggcggcggcttctgcatcgggtcccgcgcctggcccaactgccagaactactgcctgcgcctggcctccgacctgggcgcgctcgtggtggcgccggactaccgcctcgcgcccgagcaccgcctccccgccgccatcgacgacggcgcggcggcggtcctgtggctggcgaggcagggcggcggggacccctgggtcgccgaggccgccgacctcggccgcgtcttcgtgtcgggcgactcggccggcggcaccatcgcgcaccacctcgccgtgcgcttcggtggctcgcccgcggacctggcccccgtcgccgtgcggggatacgtccagctcatgccattcttcggcggcgtggcgcgcacgcggtcggaggccgagtgccccgccgacgctttcctcgaccggcccctcaacgaccgctactggcgcctgtcgctgccggagggcgccacgcccgaccaccccgtggccaacccgttcggccccggcgcgccgccgctggacgccgtcgagttcgcgcccaccctggtcgtcgtcggcggccgcgacctcctccacgaccgcgccgtcgactacgccgccaggctcagggccgccgggaagcccgtcgtggtcagggacttccacggccagcagcacggcttcttcaccatcgacccctggtccgacgcctccgccgagctcatgcgcgtcatcaagcgcttcgtcgacgccgacggccgcttcgacttcgactgacacgtcggtgtcgaactctagtattaaatccgagggagcgagcagaatggtctgcgtcgagccgtcgagtagttcccgggttgaaatcaatgtggtttggtgattgtgatatttttcttgctcgtttgtttttattatggacggttctcctgttaaaaagtagtagcccggtgtgtttagtaggaatcttgtatctagattcgctcgaggaacattctagatg

SEQ ID NO: 1204 - protein, 1250 aa, Zea mays
  misc_feature: PFam Name: Abhydrolase_3; PFam Description: alpha/beta
  misc_feature: PFam Name: COesterase; PFam Description: Carboxylesterase
  misc_feature: PFam Name: Peptidase_S8; PFam Description: Subtilase family
  misc_feature: PFam Name: Pyr_redox_2; PFam Description: Pyridine
  misc_feature: PFam Name: MAGE; PFam Description: MAGE family
  misc_feature: GI Number: 34899936; NR Description: putative cell death associated protein [Oryza sativa (japonica cultivar-group)] >gi|23617085|dbj|BAC20768.1| putative cell death associated protein
  misc_feature: GI Number: 34899932; NR Description: putative cell death associated protein [Oryza sativa (japonica cultivar-group)] >gi|23617083|dbj|BAC20766.1| putative cell death associated protein
  misc_feature: GI Number: 50919067; NR Description: putative esterase [Oryza sativa (japonica cultivar-group)] >gi|27819508|gb|AAO24912.1|
  misc_feature: GI Number: 34899924; NR Description: putative cell death associated protein [Oryza sativa (japonica cultivar-group)] >gi|22831101|dbj|BAC15963.1| putative cell death associated protein [Oryza sativa (japonica cultivar-group)] [Oryza sativa
  misc_feature: GI Number: 34895938; NR Description: P0030H07.40 [Oryza sativa (japonica cultivar-group)] >gi|13872965|dbj|BAB44070.1| P0030H07.40 [Oryza sativa (japonica cultivar-group)] >gi|15528618|dbj|BAB64639.1| P0011G08.10 [Oryza sativa (japonica
TCCACTCCACTCCAGCCAGGCGCCAGCACTCACCCACCCATGGCGTCCGAAGCCGCGCCGCGGGTCGTCGTGGACGAGTGCCGGGGCGTGCTGTCCGTGTACAGCGACGGCACGGTGGTGCGGCGCGCGCAGCCGGGGTTCGCGACGCCGGTGCGGGACGACGGCACGGTCGACTGGAAGGACGTGACGTTCGACGAGGCCCCGCGGGCTGGCGCTCCGCCTCTACCTCCCCCGGGACCGCGGGGCCGCGGCCGGGCGGCGCCTGCCGGTCTTCTTCTACTACCACGGCGGCGGCTTCTGCATCGGGTCCCGCGCCTGGCCCAACTGCCAGAACTACTGCCTGCGCCTGGCCTCCGACCTGGGCGCGCTCGTGGTGGCGCCGGACTACCGCCTCGCGCCCGAGCACCGCCTCCCCGCCGCCATCGACGACGGCGCGGCGGCGGTCCTGTGGCTGGCGAGGCAGGGCGGCGGGGACCCCTGGGTCGCCGAGGCCGCCGACCTCGGCCGCGTCTTCGTGTCGGGCGACTCGGCCGGCGGCACCATCGCGCACCACCTCGCCGTGCGCTTCGGTGGCTCGCCCGCGGACCTGGCCCCCGTCGCCGTGCGGGGATACGTCCAGCTCATGCCATTCTTCGGCGGCGTGGCGCGCACGCGGTCGGAGGCCGAGTGCCCCGCCGACGCTTTCCTCGACCGGCCCCTCAACGACCGCTACTGGCGCCTGTCGCTGCCGGAGGGCGCCACGCCCGACCACCCCGTGGCCAACCCGTTCGGCCCCGGCGCGCCGCCGCTGGACGCCGTCGAGTTCGCGCCCACCCTGGTCGTCGTCGGCGGCCGCGACCTCCTCCACGACCGCGCCGTCGACTACGCCGCCAGGCTCAGGGCCGCCGGGAAGCCCGTCGTGGTCAGGGACTTCCACGGCCAGCAGCACGGCTTCTTCACCATCGACCCCTGGTCCGACGCCTCCGCCGAGCTCATGCGCGTCATCAAGCGCTTCGTCGACGCCGACGGCCGCTTCGACTTCGACTGACACGTCGGTGTCGAACTCTAGTATTAAATCCGAGGGAGCGAGCAGAATGGTCTGCGTCGAGCCGTCGAGTAGTTCCCGGGTTGAAATCAATGTGGTTTGGTGATTGTGATATTTTTCTTGCTCGTTTGTTTTTATTATGGACGGTTCTCCTGTTAAAAAGTAGTAGCCCGGTGTGTTTAGTAGGAATCTTGTATCTAGATTCGCTCGAGGAACATTCTAGATG

SEQ ID NO: 1205 - DNA, 1291 bp, Zea mays
  misc_feature (1)..(1291): Ceres cDNA ID no. 12414321
  misc_feature (1)..(1291): Ceres CLONE  ID no. 240603
  misc_feature (1)..(1291): Also known as  Ceres CDNA ID no. 23773357
gccaagcaggtctcagcgaggttttctgctataaataaggcatcgtccaggcaaacaattaatagggcaaagcaaatcaaggacgctctgcacgtactattcatcttccattgttgctttgctttgctttgcttaccggcaaccatggccagcactcgtgcagcagcaactctccttttgctcctcgcgctcgccggcacctcgtcggcgcagctgttccacgggcttctactcctactcgtgccccggcgtgtacggcgccgtcaagtcggtgatgcagtccgccatcgccagggagaagcgcatgggggccctccatcctccgcctcttcttccacgactgcttcgtccagggctgcgacgcgtcgctgctgctggacgacacgcccagcttccagggcgagaagatggccaaccctaacaacggctccgtcaggggattcgaggtcatcgacgccgtcaagtccgccgtcgaaaagctgtgccccggcgtcgtctcctgcgccgacatcctcgccatcgccgccagggacagcgtcgtcatcctgggtggtccgacctgggacgtgaaggtcgggcggcgggactccacgacggcgagcttcagcggcgccaacaacaacatcccgccgccgacgtcgggcctcgccaacctcacgtcgctcttcgccgcgcagggactttctcagaaggacatggtcgcgctctctggtgctcacaccatcgggcaggcacgctgcaccaacttcagagcccacatctacaacgacaccgacatcgacgctgccttcgcgagaacgaggcagtcaggctgcccaagcacctcaggcgccggcggcgacaacaacctggcgccattggacctccagacccctaccgtcttcgagaacaactactacaggaacctcctcgccaagaaggggctcctgcactccgaccaggagctcttcaatggcggagccaccgacgcgctggtccagtcctacgtcgggagccagagcgcgttcttcgcggatttcgtggcgggcatgatcaagatgggcgacatcacaccgctgaccggctccaacaacggacagataaggaagaactgcagaagagtcaattagcagatagctagctagggtcactaattaagacccatgcatggctgttgaactgcaagctaagtaaacactatgtgagatcgtcgcgttgatgtgctcacatgtcgtctttttatttgggtgaaggatggatgcatgtatcagatcacttgttgtttaattaatgccatttcagtctttgtccg

SEQ ID NO: 1206 - protein, 1291 aa, Zea mays
  misc_feature: PFam Name: peroxidase; PFam Description: Peroxidase
  misc_feature: PFam Name: Cation_efflux; PFam Description: Cation efflux family
  misc_feature: PFam Name: Podocalyxin; PFam Description: Podocalyxin
  misc_feature: PFam Name: MAGE; PFam Description: MAGE family
  misc_feature: PFam Name: Pkinase; PFam Description: Protein kinase domain
  misc_feature: GI Number: 55701127; NR Description: TPA: class III
  misc_feature: GI Number: 55701137; NR Description: TPA: class III
  misc_feature: GI Number: 28400798; NR Description: peroxidase [Asparagus
  misc_feature: GI Number: 28400794; NR Description: peroxidase [Asparagus
  misc_feature: GI Number: 28400796; NR Description: peroxidase [Asparagus
GCCAAGCAGGTCTCAGCGAGGTTTTCTGCTATAAATAAGGCATCGTCCAGGCAAACAATTAATAGGGCAAAGCAAATCAAGGACGCTCTGCACGTACTATTCATCTTCCATTGTTGCTTTGCTTTGCTTTGCTTACCGGCAACCATGGCCAGCACTCGTGCAGCAGCAACTCTCCTTTTGCTCCTCGCGCTCGCCGGCACCTCGTCGGCGCAGCTGTTCCACGGGCTTCTACTCCTACTCGTGCCCCGGCGTGTACGGCGCCGTCAAGTCGGTGATGCAGTCCGCCATCGCCAGGGAGAAGCGCATGGGGGCCCTCCATCCTCCGCCTCTTCTTCCACGACTGCTTCGTCCAGGGCTGCGACGCGTCGCTGCTGCTGGACGACACGCCCAGCTTCCAGGGCGAGAAGATGGCCAACCCTAACAACGGCTCCGTCAGGGGATTCGAGGTCATCGACGCCGTCAAGTCCGCCGTCGAAAAGCTGTGCCCCGGCGTCGTCTCCTGCGCCGACATCCTCGCCATCGCCGCCAGGGACAGCGTCGTCATCCTGGGTGGTCCGACCTGGGACGTGAAGGTCGGGCGGCGGGACTCCACGACGGCGAGCTTCAGCGGCGCCAACAACAACATCCCGCCGCCGACGTCGGGCCTCGCCAACCTCACGTCGCTCTTCGCCGCGCAGGGACTTTCTCAGAAGGACATGGTCGCGCTCTCTGGTGCTCACACCATCGGGCAGGCACGCTGCACCAACTTCAGAGCCCACATCTACAACGACACCGACATCGACGCTGCCTTCGCGAGAACGAGGCAGTCAGGCTGCCCAAGCACCTCAGGCGCCGGCGGCGACAACAACCTGGCGCCATTGGACCTCCAGACCCCTACCGTCTTCGAGAACAACTACTACAGGAACCTCCTCGCCAAGAAGGGGCTCCTGCACTCCGACCAGGAGCTCTTCAATGGCGGAGCCACCGACGCGCTGGTCCAGTCCTACGTCGGGAGCCAGAGCGCGTTCTTCGCGGATTTCGTGGCGGGCATGATCAAGATGGGCGACATCACACCGCTGACCGGCTCCAACAACGGACAGATAAGGAAGAACTGCAGAAGAGTCAATTAGCAGATAGCTAGCTAGGGTCACTAATTAAGACCCATGCATGGCTGTTGAACTGCAAGCTAAGTAAACACTATGTGAGATCGTCGCGTTGATGTGCTCACATGTCGTCTTTTTATTTGGGTGAAGGATGGATGCATGTATCAGATCACTTGTTGTTTAATTAATGCCATTTCAGTCTTTGTCCG

SEQ ID NO: 1207 - DNA, 1164 bp, Zea mays
  misc_feature (1)..(1164): Ceres cDNA ID no. 12414536
  misc_feature (1)..(1164): Ceres CLONE  ID no. 234748
  misc_feature (1)..(1164): Also known as  Ceres CDNA ID no. 23784827
gaccccgcacaccgacgacgaagagaggagaggaggcggagccgagagctcgagcccaaccgcgcaactcacttccccgtcgcgatttgcattgccctcctcttggcccccgatctcgccgtgccctacccccagacccgctccgccgccaccggagagatcgcgccccccattcccacaatctaatgcttccgtccctcgaggagccgagccctccgcgcggccgtgggatggggcggtgacaacaccggtgagtggcgtggggcagggagccggtggcgaggggcatatcatggtgcagtgcctggacggggtgaggcagctgctcgcggtcctgctcaagtgctgcgacgtcgagctcaagcagccgcccgggctcgaggaccctcaggttctcgcgagggagaccgtcttcagcgtgagcgaagtcgaggctctctacgagctgttcaagaagataagcagtgctgtcatcgatgatgggctgattaacaaggaggagtttcagttggcactatttaagaccagcaagaaggagagcctgttcgcagaccgcgtatttgatttgtttgacacaaagcacaatggaattttaggatttgaagaatttgctcgtgctctctcagtatttcatcctaatgctccccttgatgagaaaattgacttttcattccggctgtatgatctcaagcagcaaggctacattgagagacaagaggttaagcagatggttgttgctacacttgctgagtcaggaatgaatctttcagatgaaattgtagagagtataattgacaagacatttgaggaggcagacacaaaacatgatggaaggattgacaaggaagagtggcgcagtctagtcagtcggcatccatctttgctgaagaacatgactcttcagtacctcaaggacatcaccacaacatttccaagctttgtctttcactcccaagttgatgataactgattttcatgggattattttggcaagaagcattagaagatattctcgtggggttctgatatggttttctttttcaattattgggttgttggattgactgagatcgtagtgctcataagtatgttggatgttggattcgagaactcaaatcttttgtcaaccatgtttctttcatttgcatgtctggatgcgcttgg

SEQ ID NO: 1208 - protein, 1164 aa, Zea mays
  misc_feature: PFam Name: efhand; PFam Description: EF hand
  misc_feature: GI Number: 57472399; NR Description: calcineurin B [Pisum sativum] gi|58397762|gb|AAW73072.1| calcineurin B-like protein
  misc_feature: GI Number: 22137326; NR Description: calcineurin B [Pisum sativum]
  misc_feature: GI Number: 60460514; NR Description: calcineurin B-like
  misc_feature: GI Number: 22136404; NR Description: calcineurin B-like protein 3 [Arabidopsis thaliana] >gi|7269509|emb|CAB79512.1| calcineurin B-like protein 3 [Arabidopsis thaliana] >gi|4938495|emb|CAB43853.1| calcineurin B-like protein 3
  misc_feature: GI Number: 56748808; NR Description: Calcineurin B-like protein 3 (SOS3-like calcium binding protein 6) gi|22136404|gb|AAM91280.1| calcineurin B-like protein 3 [Arabidopsis thaliana] gi|7269509|emb|CAB79512.1| calcineurin
GACCCCGCACACCGACGACGAAGAGAGGAGAGGAGGCGGAGCCGAGAGCTCGAGCCCAACCGCGCAACTCACTTCCCCGTCGCGATTTGCATTGCCCTCCTCTTGGCCCCCGATCTCGCCGTGCCCTACCCCCAGACCCGCTCCGCCGCCACCGGAGAGATCGCGCCCCCCATTCCCACAATCTAATGCTTCCGTCCCTCGAGGAGCCGAGCCCTCCGCGCGGCCGTGGGATGGGGCGGTGACAACACCGGTGAGTGGCGTGGGGCAGGGAGCCGGTGGCGAGGGGCATATCATGGTGCAGTGCCTGGACGGGGTGAGGCAGCTGCTCGCGGTCCTGCTCAAGTGCTGCGACGTCGAGCTCAAGCAGCCGCCCGGGCTCGAGGACCCTCAGGTTCTCGCGAGGGAGACCGTCTTCAGCGTGAGCGAAGTCGAGGCTCTCTACGAGCTGTTCAAGAAGATAAGCAGTGCTGTCATCGATGATGGGCTGATTAACAAGGAGGAGTTTCAGTTGGCACTATTTAAGACCAGCAAGAAGGAGAGCCTGTTCGCAGACCGCGTATTTGATTTGTTTGACACAAAGCACAATGGAATTTTAGGATTTGAAGAATTTGCTCGTGCTCTCTCAGTATTTCATCCTAATGCTCCCCTTGATGAGAAAATTGACTTTTCATTCCGGCTGTATGATCTCAAGCAGCAAGGCTACATTGAGAGACAAGAGGTTAAGCAGATGGTTGTTGCTACACTTGCTGAGTCAGGAATGAATCTTTCAGATGAAATTGTAGAGAGTATAATTGACAAGACATTTGAGGAGGCAGACACAAAACATGATGGAAGGATTGACAAGGAAGAGTGGCGCAGTCTAGTCAGTCGGCATCCATCTTTGCTGAAGAACATGACTCTTCAGTACCTCAAGGACATCACCACAACATTTCCAAGCTTTGTCTTTCACTCCCAAGTTGATGATAACTGATTTTCATGGGATTATTTTGGCAAGAAGCATTAGAAGATATTCTCGTGGGGTTCTGATATGGTTTTCTTTTTCAATTATTGGGTTGTTGGATTGACTGAGATCGTAGTGCTCATAAGTATGTTGGATGTTGGATTCGAGAACTCAAATCTTTTGTCAACCATGTTTCTTTCATTTGCATGTCTGGATGCGCTTGG

SEQ ID NO: 1209 - DNA, 1324 bp, Zea mays
  misc_feature (1)..(1324): Ceres cDNA ID no. 12414692
  misc_feature (1)..(1324): Ceres CLONE  ID no. 234890
  misc_feature (1)..(1324): Also known as  Ceres CDNA ID no. 23784602
atctcctccacttccttcctgggctctgggctacgtattatccatccgtctcagtcacctcgcctcctcctcctcctcccccagtccccctccctcatcctcgattgcgcccctcactcgccatgtcggggctctacagccaggggttctcccctgcgcgaaacctctcccctcagattagaagcaatccggacgctgatagtcagtacctggccgagctgctcgccgaacaccacaaactggggcccttcatgcaggtgctgcccgtatgcaacaagctgctgagccaagagattatgcgggtatcaagcattgtgcacaaccatggatttggcgatttcgacaggcatcggtttagaagtcctagtccaatgtcttctccaaaccctagagctaatctccctggcaatgggttcagtccttggagcggactacaagagagattaggttttcctcaaggaaccagcatggactggcaaggagcacccccaagtcctagctcccatgttgtaaagaagattcttcgtctggaggttccagttgattcttatccgaatttcaattttgtggggcgcattttaggacctagaggtaattctctaaagcgagtagaagcatccactgggtgtcgtgttttcattagaggaaagggttccatcaaagattcagggaaggaggacaaactacggggaaaaccgggctatgagcacctgagtgatccgctgcatatcttgatagaggccgagttccctgccagtatcatcgatgcaaggctgagacaagcacaggagattatagaagaattgcttaaaccagtggacgagtcccaagatctctacaaaaggcagcagctcagggagctggcaatgctgaactcaaccctgagagaggacagccctcatccggggagtgtctctccattcagcaacggtggcatgaagcgtgcgaaaacaggacagtagagaaaacaactatgctcccatatctggccccgtcgtcatgggaacgccatgggcatgcgtgaaggaaggccatgcgccttcgctggcggagtccggtatcttctgctagctttcacctccggacaggggaaagatgagatgagatgagatgagatagtcgcggacccttggttggatccggcgttggttgttgtatggtctagaacattcgttctatttgttattgacggttaaccctagtatgttggtgagctgcaacctgcaaactgcatggtaaactagctagagaggcctgctgagtatgtgagctttaggtcttttcttgacattgtattataacctttttaacattatggagttgc

SEQ ID NO: 1210 - protein, 1324 aa, Zea mays
  misc_feature: PFam Name: KH_1; PFam Description: KH domain
  misc_feature: GI Number: 34900448; NR Description: KH domain-like protein [Oryza sativa (japonica cultivar-group)] >gi|24060154|dbj|BAC21599.1| KH domain-like protein [Oryza sativa
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
  misc_feature: GI Number: 34909270; NR Description: P0454H12.18 [Oryza sativa (japonica cultivar-group)] >gi|15128399|dbj|BAB62585.1|
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 24030184; NR Description: putative RNA-binding protein [Arabidopsis thaliana] >gi|9758634|dbj|BAB09296.1| RNA-binding protein-like [Arabidopsis thaliana] >gi|15241136|ref|NP_200425.1| KH domain-containing protein
ATCTCCTCCACTTCCTTCCTGGGCTCTGGGCTACGTATTATCCATCCGTCTCAGTCACCTCGCCTCCTCCTCCTCCTCCCCCAGTCCCCCTCCCTCATCCTCGATTGCGCCCCTCACTCGCCATGTCGGGGCTCTACAGCCAGGGGTTCTCCCCTGCGCGAAACCTCTCCCCTCAGATTAGAAGCAATCCGGACGCTGATAGTCAGTACCTGGCCGAGCTGCTCGCCGAACACCACAAACTGGGGCCCTTCATGCAGGTGCTGCCCGTATGCAACAAGCTGCTGAGCCAAGAGATTATGCGGGTATCAAGCATTGTGCACAACCATGGATTTGGCGATTTCGACAGGCATCGGTTTAGAAGTCCTAGTCCAATGTCTTCTCCAAACCCTAGAGCTAATCTCCCTGGCAATGGGTTCAGTCCTTGGAGCGGACTACAAGAGAGATTAGGTTTTCCTCAAGGAACCAGCATGGACTGGCAAGGAGCACCCCCAAGTCCTAGCTCCCATGTTGTAAAGAAGATTCTTCGTCTGGAGGTTCCAGTTGATTCTTATCCGAATTTCAATTTTGTGGGGCGCATTTTAGGACCTAGAGGTAATTCTCTAAAGCGAGTAGAAGCATCCACTGGGTGTCGTGTTTTCATTAGAGGAAAGGGTTCCATCAAAGATTCAGGGAAGGAGGACAAACTACGGGGAAAACCGGGCTATGAGCACCTGAGTGATCCGCTGCATATCTTGATAGAGGCCGAGTTCCCTGCCAGTATCATCGATGCAAGGCTGAGACAAGCACAGGAGATTATAGAAGAATTGCTTAAACCAGTGGACGAGTCCCAAGATCTCTACAAAAGGCAGCAGCTCAGGGAGCTGGCAATGCTGAACTCAACCCTGAGAGAGGACAGCCCTCATCCGGGGAGTGTCTCTCCATTCAGCAACGGTGGCATGAAGCGTGCGAAAACAGGACAGTAGAGAAAACAACTATGCTCCCATATCTGGCCCCGTCGTCATGGGAACGCCATGGGCATGCGTGAAGGAAGGCCATGCGCCTTCGCTGGCGGAGTCCGGTATCTTCTGCTAGCTTTCACCTCCGGACAGGGGAAAGATGAGATGAGATGAGATGAGATAGTCGCGGACCCTTGGTTGGATCCGGCGTTGGTTGTTGTATGGTCTAGAACATTCGTTCTATTTGTTATTGACGGTTAACCCTAGTATGTTGGTGAGCTGCAACCTGCAAACTGCATGGTAAACTAGCTAGAGAGGCCTGCTGAGTATGTGAGCTTTAGGTCTTTTCTTGACATTGTATTATAACCTTTTTAACATTATGGAGTTGC

SEQ ID NO: 1211 - DNA, 1657 bp, Zea mays
  misc_feature (1)..(1657): Ceres cDNA ID no. 12415416
  misc_feature (1)..(1657): Ceres CLONE  ID no. 343432
  misc_feature (1)..(1657): Also known as  Ceres CDNA ID no. 23789093
aaaaccaagcaatccgcctcatcccagctcgtcacgatgctcgcgaccgcctcgccgcaccttcaggcggccgcgcgccgcctcttcctggctgtacccgtgaatcagggctgcagtagcatccgcctcccgcgcagatgcttcggccggtacgcgtcggtgcgcgcggcgtcggtgaccgccccgcccgcgaaggagggggcggacgacctggggttcctggagatgtcgtccgggacgcggcgacggtactacatgcttgggggcaagggtggggtcgggaagacgagctgcgcggcgtcgttggccgtgcggttcgccaacaacggccacccgaccctcgtcgtctccaccgaccctgcgcactcgctcagcgattccttcgcacaggatttgagtggcgggacgctcgtgcaggtcgagggccctgattcacctctgtttgcgcttgagataaatcctgaaaaggcccgggaggagtttcggacagtaagtcaaaaaaatggaggaacaggagtaaaagatttcatggatagcatgggccttggggtgcttgttgagcagcttggagagttaaaattgggggaattgttggacacaccaccacctggcttggatgaagcaattgcaatttctaaggttatgcaattccttgaagcacaagaatacagcatgtttagtcgcattgtatttgacactgcccctacgggccatacactccggttattatccttgccagatttcttggatgcgtccattgggaaaatcttgaagctgaggagtaagattgcttctgcaacatcagctattaaatcagtatttggacaagaggtccaacagcaggatgcagcgaacaaattagagcaactcagagaaaggatggtcaaagtaagaaagcttttccgcgacacggaatcaacagagtttataatcgtgacaatcccaacggtgatggcaatcagtgagtcatcaagactgcattcttcgttgcaaaaggaaagtgttcctgtaaggagactcattgtgaaccaagttctgccaccttcaacatcggactgtaaattctgttctataaaaagaaaggatcaaacgcgtgcattggatatgatacggactgacccagagttaaaaggtttgaacattatccaagcacctcttgtggacatggagattagaggtgttccggctctcaattttttgggtgatatactgtggaagtaacttcagttatgggaaacatgatcgcttataagggtgcttaattggccaatatcactgttagcctgctgcacaattgcactgctctgcaactagcaatctgtgggctcttctggttgtttccagctaacaattgcacaataagcttaagttgtttccagctacaatacagcacaacacattctccatggtgcgttaaatctgagtagaaagcaccaaattggagggttttgctgcactcctgcactagcatttgatgacctgttactcttggcagtgatgcagattggatttagccccaaattaggctaattgaagtgaaatgctgtaatatttatccttttatcaattatccccaagattaatagcaacacttgtggccttttggttcggcgactttgtaaaactcttcgtttcttatgtgccatctcaattttgt

SEQ ID NO: 1212 - protein, 1657 aa, Zea mays
  misc_feature: PFam Name: ArsA_ATPase; PFam Description: Anion-transporting
  misc_feature: GI Number: 5824321; NR Description: ATPase [Solanum tuberosum]
  misc_feature: GI Number: 30681260; NR Description: anion-transporting
  misc_feature: GI Number: 50912707; NR Description: putative ATPase [Oryza sativa (japonica cultivar-group)] >gi|46390107|dbj|BAD15543.1| putative ATPase [Oryza sativa (japonica cultivar-group)] >gi|46390644|dbj|BAD16127.1| putative ATPase [Oryza sativa
  misc_feature: GI Number: 9759337; NR Description: arsenite translocating
  misc_feature: GI Number: 6056208; NR Description: putative ATPase
AAAACCAAGCAATCCGCCTCATCCCAGCTCGTCACGATGCTCGCGACCGCCTCGCCGCACCTTCAGGCGGCCGCGCGCCGCCTCTTCCTGGCTGTACCCGTGAATCAGGGCTGCAGTAGCATCCGCCTCCCGCGCAGATGCTTCGGCCGGTACGCGTCGGTGCGCGCGGCGTCGGTGACCGCCCCGCCCGCGAAGGAGGGGGCGGACGACCTGGGGTTCCTGGAGATGTCGTCCGGGACGCGGCGACGGTACTACATGCTTGGGGGCAAGGGTGGGGTCGGGAAGACGAGCTGCGCGGCGTCGTTGGCCGTGCGGTTCGCCAACAACGGCCACCCGACCCTCGTCGTCTCCACCGACCCTGCGCACTCGCTCAGCGATTCCTTCGCACAGGATTTGAGTGGCGGGACGCTCGTGCAGGTCGAGGGCCCTGATTCACCTCTGTTTGCGCTTGAGATAAATCCTGAAAAGGCCCGGGAGGAGTTTCGGACAGTAAGTCAAAAAAATGGAGGAACAGGAGTAAAAGATTTCATGGATAGCATGGGCCTTGGGGTGCTTGTTGAGCAGCTTGGAGAGTTAAAATTGGGGGAATTGTTGGACACACCACCACCTGGCTTGGATGAAGCAATTGCAATTTCTAAGGTTATGCAATTCCTTGAAGCACAAGAATACAGCATGTTTAGTCGCATTGTATTTGACACTGCCCCTACGGGCCATACACTCCGGTTATTATCCTTGCCAGATTTCTTGGATGCGTCCATTGGGAAAATCTTGAAGCTGAGGAGTAAGATTGCTTCTGCAACATCAGCTATTAAATCAGTATTTGGACAAGAGGTCCAACAGCAGGATGCAGCGAACAAATTAGAGCAACTCAGAGAAAGGATGGTCAAAGTAAGAAAGCTTTTCCGCGACACGGAATCAACAGAGTTTATAATCGTGACAATCCCAACGGTGATGGCAATCAGTGAGTCATCAAGACTGCATTCTTCGTTGCAAAAGGAAAGTGTTCCTGTAAGGAGACTCATTGTGAACCAAGTTCTGCCACCTTCAACATCGGACTGTAAATTCTGTTCTATAAAAAGAAAGGATCAAACGCGTGCATTGGATATGATACGGACTGACCCAGAGTTAAAAGGTTTGAACATTATCCAAGCACCTCTTGTGGACATGGAGATTAGAGGTGTTCCGGCTCTCAATTTTTTGGGTGATATACTGTGGAAGTAACTTCAGTTATGGGAAACATGATCGCTTATAAGGGTGCTTAATTGGCCAATATCACTGTTAGCCTGCTGCACAATTGCACTGCTCTGCAACTAGCAATCTGTGGGCTCTTCTGGTTGTTTCCAGCTAACAATTGCACAATAAGCTTAAGTTGTTTCCAGCTACAATACAGCACAACACATTCTCCATGGTGCGTTAAATCTGAGTAGAAAGCACCAAATTGGAGGGTTTTGCTGCACTCCTGCACTAGCATTTGATGACCTGTTACTCTTGGCAGTGATGCAGATTGGATTTAGCCCCAAATTAGGCTAATTGAAGTGAAATGCTGTAATATTTATCCTTTTATCAATTATCCCCAAGATTAATAGCAACACTTGTGGCCTTTTGGTTCGGCGACTTTGTAAAACTCTTCGTTTCTTATGTGCCATCTCAATTTTGT

SEQ ID NO: 1213 - DNA, 1059 bp, Zea mays
  misc_feature (1)..(1059): Ceres cDNA ID no. 12415963
  misc_feature (1)..(1059): Ceres CLONE  ID no. 324760
  misc_feature (1)..(1059): Also known as  Ceres CDNA ID no. 24355694
cacgagaccattacctagaacatcctaatcgaaaagttttgacgtgtgttcgatcttccggatgcgccggcccactgcaggaatggcggcgaccggaggagcgatggggagctacacgcaggcgggcagcgacgccgcgctgggccccggccacggccacggccacgcgcacgtcagctcgcagtggagcttctccaggcaggacctgccgcagatctcggagatggggatgataccggccgacatcgggggagagcatcgtgggcgccggcgggtgcaacagctccagcgacgccgcgcagtcctcctcctacctctccaggaccttctccgtcggctcctgggacgacaccaactccatcatgttctcgtccgcccccagcaagaagcccaaggtggaccccgccgacgacatggtcgccagcttcagcaccattgacccgcagttcggcctttccaactcgtccctggagctgcccggcatggacgactacctgcagctgcagcaggactccgtcgcctgcagagtgcgtgcgaagcgtggctgcgcgactcaccctcggagcattgccgagagggaaagaaggacgaggatcagcaagaggctgaagaagctgcaagacctcgtgcccaacatggacaagcaaacgaatacgtcggacatgttggaccttgctgtggattacatcaaagagctcaaggaccaagtcgagaagctaaaacacgaccaagcaaactgttgttgcctaggcaacaagagctgctgctgatgctggagaagcagacggaggagggtttttacgccgtaacaatgtaacatgtggagcggcttccatgactcagcttcctcttttcttggttgttccacggactagcgacccggccggtgccaacggcttgaagactaggagataacaagtaggacgatgttgtaatttagctaccacgacgcggtggctctggcttgcgtgtaaagaagtcctccctttcaacgcgactgggattgttgttgctggtaaaattgttgtaggaatatcatctgcgctccatttttcatcc

SEQ ID NO: 1214 - protein, 1059 aa, Zea mays
  misc_feature: PFam Name: HLH; PFam Description: Helix-loop-helix
  misc_feature: PFam Name: Sporozoite_P67; PFam Description: Sporozoite P67
  misc_feature: PFam Name: Extensin_2; PFam Description: Extensin-like region
  misc_feature: GI Number: 34907702; NR Description: P0035F12.11 [Oryza sativa (japonica cultivar-group)] >gi|20161021|dbj|BAB89954.1| P0035F12.11 [Oryza sativa (japonica cultivar-group)] >gi|20161601|dbj|BAB90521.1| B1065G12.3 [Oryza sativa (japonica
  misc_feature: GI Number: 56784863; NR Description: putative helix-loop-helix protein 1A [Oryza sativa (japonica
  misc_feature: GI Number: 50947455; NR Description: putative transcription factor RAU1 [Oryza sativa (japonica cultivar-group)] >gi|42408931|dbj|BAD10188.1| putative transcription factor RAU1
  misc_feature: GI Number: 21554238; NR Description: Contains similarity to bHLH transcription factor GBOF-1 from Tulipa gesneriana gb|AF185269
  misc_feature: GI Number: 19401700; NR Description: transcription factor
CACGAGACCATTACCTAGAACATCCTAATCGAAAAGTTTTGACGTGTGTTCGATCTTCCGGATGCGCCGGCCCACTGCAGGAATGGCGGCGACCGGAGGAGCGATGGGGAGCTACACGCAGGCGGGCAGCGACGCCGCGCTGGGCCCCGGCCACGGCCACGGCCACGCGCACGTCAGCTCGCAGTGGAGCTTCTCCAGGCAGGACCTGCCGCAGATCTCGGAGATGGGGATGATACCGGCCGACATCGGGGGAGAGCATCGTGGGCGCCGGCGGGTGCAACAGCTCCAGCGACGCCGCGCAGTCCTCCTCCTACCTCTCCAGGACCTTCTCCGTCGGCTCCTGGGACGACACCAACTCCATCATGTTCTCGTCCGCCCCCAGCAAGAAGCCCAAGGTGGACCCCGCCGACGACATGGTCGCCAGCTTCAGCACCATTGACCCGCAGTTCGGCCTTTCCAACTCGTCCCTGGAGCTGCCCGGCATGGACGACTACCTGCAGCTGCAGCAGGACTCCGTCGCCTGCAGAGTGCGTGCGAAGCGTGGCTGCGCGACTCACCCTCGGAGCATTGCCGAGAGGGAAAGAAGGACGAGGATCAGCAAGAGGCTGAAGAAGCTGCAAGACCTCGTGCCCAACATGGACAAGCAAACGAATACGTCGGACATGTTGGACCTTGCTGTGGATTACATCAAAGAGCTCAAGGACCAAGTCGAGAAGCTAAAACACGACCAAGCAAACTGTTGTTGCCTAGGCAACAAGAGCTGCTGCTGATGCTGGAGAAGCAGACGGAGGAGGGTTTTTACGCCGTAACAATGTAACATGTGGAGCGGCTTCCATGACTCAGCTTCCTCTTTTCTTGGTTGTTCCACGGACTAGCGACCCGGCCGGTGCCAACGGCTTGAAGACTAGGAGATAACAAGTAGGACGATGTTGTAATTTAGCTACCACGACGCGGTGGCTCTGGCTTGCGTGTAAAGAAGTCCTCCCTTTCAACGCGACTGGGATTGTTGTTGCTGGTAAAATTGTTGTAGGAATATCATCTGCGCTCCATTTTTCATCC

SEQ ID NO: 1215 - DNA, 2061 bp, Zea mays
  misc_feature (1)..(2061): Ceres cDNA ID no. 12416040
  misc_feature (1)..(2061): Ceres CLONE  ID no. 324670
  misc_feature (1)..(2061): Also known as  Ceres CDNA ID no. 23793212
cattgttgattacacggtatgcgcagagtggttattctgatgaggctgtagaattgtttcttgacatgctggagaacggatttcagccggaccagtacaccttgagcagtatgttatcggcctgtacagagttgggatcattcaggttggggcagcaactgcactctctagcgctcaggcttggactggaatcagacagttgcgtgagctgtgggcttgtggacatgtatgcaaagtctcacaatggacagtccttgcacaatgcgagagaagtcttcaatcggatgccaaagcataatgtgatgtcgtggacggcacttttgtcagggtatgtgcagcgtggatcgcaggacaaccaggttatgatactgttttgcaagatgttaaatgaaggcatcagaccaaaccatatcacatattctagtatgcttaaggcatgtgcaaaccttggtgatcaagattcaggcaggcaaattcatactcattgcgtcaaatctaacctagctgacttaaacgttgttgggaatgctttagtaagcatgtatgctgaatctggttccatagaggaagctagacatgcgttcgaccagctatatgaaaagaacatggtatccttcagcggcaatttagacggagatgggaggagcaacacttatcaagactatcagattgaaagaatggagttaggaatcagcactttcacatttggtagtctgatcagtgctgccgcttgtgtagggatgctaaccaaaggccagcagctgcatgccctctcactgaaggctggatttgggtcagatagagccataggaaactctcttgtatctatgtattctaggtgtggatacctagtagatgcttgccaagtctttgatgaaatgaatgaccataatgtgatctcatggacttcaatgatcagtggtttggcaaaacatgggtatgcagcaagagctctggaattgtttcacgatatgatcgcagctggggtgaaaccaaatgatgtcacatacattgctgttttatctgcatgtagccatgccggtctagttaaagaagggaaggaacactttagaatgatgcagaagcatcatggactcataccaaggatggagcattatgcttgcatggttgatctccttgggcgatcaggccttgttgaagatgcactagattttatcaacgaaatgccttgtcaagtagacgcattggtctggaagacacttcttggtgcctgtaagacccacaacaacatggatattggtgagattgctgctaaccatgtcatacagctcgaaccacaagatccagccccctatgtcttgctttccaacttatacgcagaggctggtttgtgggatcaagtagctaggataaggagtctaatgagggataaaaacttgatgaaagaaaaagggttgagctggatgcatgttgacaataccattcacgagtttcgagctggtgataccagccatccacaagcagaggagatctatacaaagttggagacactgataagagaaatcaaagtcatgggctatgtaccagacaccagcgtagtgctccatgacatgtcggatgagcttaaggaactgtgtctgcttcagcacagcgagaagattgctgttgcattcggtttgatcagttgtacatcagcaacaaagccaataaggatatttaagaacctccgtgtatgcgttgattgtcattcagcactcaagtatgtctccaaggccaccggtagggagataatattgagagatagcaacagattccacaggatgaaggatggggaatgctcgtgcggagaatactggtaacaagcaagctagctagctcacgtagtcacgtttagctgaagagccatgtacagagttctggcgcaccacaacattattgacagtgagtgtccatgttcatattttctgtaggaccttcacaaaatcatagtttatacaaagcatgagttgttgtgatagtttatactttatactagggtcagagtttgtacagttgtatgcactctcctatcaccataaatgcaaattgttttgagtggtc

SEQ ID NO: 1216 - protein, 2061 aa, Zea mays
  misc_feature: PFam Name: PPR; PFam Description: PPR repeat
  misc_feature: PFam Name: FBA_1; PFam Description: F-box associated
  misc_feature: GI Number: 30693150; NR Description: pentatricopeptide (PPR)
  misc_feature: GI Number: 34915012; NR Description: P0458A05.10 [Oryza
  misc_feature: GI Number: 53791352; NR Description: pentatricopeptide (PPR) repeat-containing protein-like [Oryza sativa (japonica
  misc_feature: GI Number: 50899006; NR Description: pentatricopeptide (PPR) repeat-containing protein-like [Oryza sativa (japonica cultivar-group)] >gi|47848472|dbj|BAD22327.1| pentatricopeptide (PPR) repeat-containing protein-like [Oryza sativa (japonica
  misc_feature: GI Number: 42566761; NR Description: pentatricopeptide (PPR)
CATTGTTGATTACACGGTATGCGCAGAGTGGTTATTCTGATGAGGCTGTAGAATTGTTTCTTGACATGCTGGAGAACGGATTTCAGCCGGACCAGTACACCTTGAGCAGTATGTTATCGGCCTGTACAGAGTTGGGATCATTCAGGTTGGGGCAGCAACTGCACTCTCTAGCGCTCAGGCTTGGACTGGAATCAGACAGTTGCGTGAGCTGTGGGCTTGTGGACATGTATGCAAAGTCTCACAATGGACAGTCCTTGCACAATGCGAGAGAAGTCTTCAATCGGATGCCAAAGCATAATGTGATGTCGTGGACGGCACTTTTGTCAGGGTATGTGCAGCGTGGATCGCAGGACAACCAGGTTATGATACTGTTTTGCAAGATGTTAAATGAAGGCATCAGACCAAACCATATCACATATTCTAGTATGCTTAAGGCATGTGCAAACCTTGGTGATCAAGATTCAGGCAGGCAAATTCATACTCATTGCGTCAAATCTAACCTAGCTGACTTAAACGTTGTTGGGAATGCTTTAGTAAGCATGTATGCTGAATCTGGTTCCATAGAGGAAGCTAGACATGCGTTCGACCAGCTATATGAAAAGAACATGGTATCCTTCAGCGGCAATTTAGACGGAGATGGGAGGAGCAACACTTATCAAGACTATCAGATTGAAAGAATGGAGTTAGGAATCAGCACTTTCACATTTGGTAGTCTGATCAGTGCTGCCGCTTGTGTAGGGATGCTAACCAAAGGCCAGCAGCTGCATGCCCTCTCACTGAAGGCTGGATTTGGGTCAGATAGAGCCATAGGAAACTCTCTTGTATCTATGTATTCTAGGTGTGGATACCTAGTAGATGCTTGCCAAGTCTTTGATGAAATGAATGACCATAATGTGATCTCATGGACTTCAATGATCAGTGGTTTGGCAAAACATGGGTATGCAGCAAGAGCTCTGGAATTGTTTCACGATATGATCGCAGCTGGGGTGAAACCAAATGATGTCACATACATTGCTGTTTTATCTGCATGTAGCCATGCCGGTCTAGTTAAAGAAGGGAAGGAACACTTTAGAATGATGCAGAAGCATCATGGACTCATACCAAGGATGGAGCATTATGCTTGCATGGTTGATCTCCTTGGGCGATCAGGCCTTGTTGAAGATGCACTAGATTTTATCAACGAAATGCCTTGTCAAGTAGACGCATTGGTCTGGAAGACACTTCTTGGTGCCTGTAAGACCCACAACAACATGGATATTGGTGAGATTGCTGCTAACCATGTCATACAGCTCGAACCACAAGATCCAGCCCCCTATGTCTTGCTTTCCAACTTATACGCAGAGGCTGGTTTGTGGGATCAAGTAGCTAGGATAAGGAGTCTAATGAGGGATAAAAACTTGATGAAAGAAAAAGGGTTGAGCTGGATGCATGTTGACAATACCATTCACGAGTTTCGAGCTGGTGATACCAGCCATCCACAAGCAGAGGAGATCTATACAAAGTTGGAGACACTGATAAGAGAAATCAAAGTCATGGGCTATGTACCAGACACCAGCGTAGTGCTCCATGACATGTCGGATGAGCTTAAGGAACTGTGTCTGCTTCAGCACAGCGAGAAGATTGCTGTTGCATTCGGTTTGATCAGTTGTACATCAGCAACAAAGCCAATAAGGATATTTAAGAACCTCCGTGTATGCGTTGATTGTCATTCAGCACTCAAGTATGTCTCCAAGGCCACCGGTAGGGAGATAATATTGAGAGATAGCAACAGATTCCACAGGATGAAGGATGGGGAATGCTCGTGCGGAGAATACTGGTAACAAGCAAGCTAGCTAGCTCACGTAGTCACGTTTAGCTGAAGAGCCATGTACAGAGTTCTGGCGCACCACAACATTATTGACAGTGAGTGTCCATGTTCATATTTTCTGTAGGACCTTCACAAAATCATAGTTTATACAAAGCATGAGTTGTTGTGATAGTTTATACTTTATACTAGGGTCAGAGTTTGTACAGTTGTATGCACTCTCCTATCACCATAAATGCAAATTGTTTTGAGTGGTC

SEQ ID NO: 1217 - DNA, 1536 bp, Zea mays
  misc_feature (1)..(1536): Ceres cDNA ID no. 12416469
  misc_feature (1)..(1536): Ceres CLONE  ID no. 325958
  misc_feature (1)..(1536): Also known as  Ceres CDNA ID no. 23795269
  misc_feature (355)..(355): n is a, c, t, g, unknown, or other
  misc_feature (787)..(787): n is a, c, t, g, unknown, or other
  misc_feature (806)..(806): n is a, c, t, g, unknown, or other
  misc_feature (1421)..(1421): n is a, c, t, g, unknown, or other
  misc_feature (1481)..(1481): n is a, c, t, g, unknown, or other
  misc_feature (1530)..(1530): n is a, c, t, g, unknown, or other
aatccgctccgggcgtcatcgttgtatccaaagcgccgtgctagattccacacctagacaggacgccgcacacggcagccacccccttgtgtgcgtgactgcgtctcgcgcgggcaagagtgcacgggcagagccatggacgtagaagcgcgcaaggccgacgcgccgctcgcgcaaggcaaggcgatgcaccgctttctcgtagcgctcaactgcgggatgctggcggtgggagccatcggcgggccgctcctgagccggctctacttcagcaagggtgggcaccggcagtggctgtccgcgtggctggagaccggcgggtggccgctgctggtgattcccgtggcggcgtcgntcgtggcccgccgcgcgcgcgacaggggcgccccggttcctgctcgcgccgccgcggatcctgctggccgccgcgggcctcggcgtggccacgggcgcggacgacttcatctacgcctacgggctcgcgtacctcccggtgtccacgtccgcgatcctgatctcgacgcagctggcgttcacggtgttcttcgcgttcctcgtggtgcggcagcgcctgacggccgcgtccgtgaacgccgtggcgctgctgacggtgggcaccgtggtgctgggcctgcacgtctcgtcggaccggcccccgggcgtcaccaggggccagtactggctgggcttcgtgctgacgctcggcgccgcggcgctctacggcctcgtcctgccgctcgtggagctcgcctacaggcgcgccgcgggcgccggcggccgcgccgtnacgtacgcgctggtggtgnagatgcagctggtgatgggcttcttcgccaccgcgttctgcaccgtcggcatggtcgtcaacaaggatttccaggcgatcccgagggaggcgaggcggtacgcgctgggggaggcgcggtactacgcggtgctggcgtggtcggcggtgatgtggcagtgcttcttcctgggcgcggtgggcgtcatcttctgcgtgcacacgctgctggcgggcatcctcatcgcggtgttcatcccggtgacggaggtggcggccgtcatcttcctgcgcgagaggttcagcagcgagaaaggcgtggcgctggtgctctcgctctggggcctcgcgtcctactcctacggcgagtggagcgaggccagggccaagaagaggaagaggacgaggacggaggagggcgccgccgccgcggaggccctgcagcaggcgaacccgtgatgctgctgcggactttggcctggcctcttcgatcttccccgttgtgtgtatatcagtatatgttgtgattgtgatcgctgctgtgtgctacgtggatagcgtcctgaatcgtcgtcacctgcagctgtcgcttctggtgtgggtgctcttctgttcggcggtggacgttggccaatantgtgctgcatggtgtgtagatgtaccttggcagtaccacgttcggttcggacagtaagtntggaccggcgcactttgtgggccgatcccagtacaggactgatctaatntgaacg

SEQ ID NO: 1218 - protein, 1536 aa, Zea mays
  misc_feature: GI Number: 50900308; NR Description: putative purine permease [Oryza sativa (japonica cultivar-group)] >gi|47497669|dbj|BAD19736.1| putative purine permease [Oryza sativa
  misc_feature: GI Number: 50900310; NR Description: putative purine permease [Oryza sativa (japonica cultivar-group)] >gi|47497670|dbj|BAD19737.1| putative purine permease [Oryza sativa
  misc_feature: GI Number: 50900306; NR Description: putative purine permease [Oryza sativa (japonica cultivar-group)] >gi|46806332|dbj|BAD17524.1| putative purine permease [Oryza sativa (japonica cultivar-group)] >gi|47497668|dbj|BAD19735.1|
  misc_feature: GI Number: 9795615; NR Description: Similar to purine permease [Arabidopsis thaliana] >gi|15217872|ref|NP_174143.1| purine permease, putative [Arabidopsis thaliana]
  misc_feature: GI Number: 9795614; NR Description: purine permease [Arabidopsis thaliana] >gi|26450405|dbj|BAC42317.1| putative purine permease [Arabidopsis thaliana] >gi|28973199|gb|AAO63924.1| putative purine permease [Arabidopsis thaliana]
AATCCGCTCCGGGCGTCATCGTTGTATCCAAAGCGCCGTGCTAGATTCCACACCTAGACAGGACGCCGCACACGGCAGCCACCCCCTTGTGTGCGTGACTGCGTCTCGCGCGGGCAAGAGTGCACGGGCAGAGCCATGGACGTAGAAGCGCGCAAGGCCGACGCGCCGCTCGCGCAAGGCAAGGCGATGCACCGCTTTCTCGTAGCGCTCAACTGCGGGATGCTGGCGGTGGGAGCCATCGGCGGGCCGCTCCTGAGCCGGCTCTACTTCAGCAAGGGTGGGCACCGGCAGTGGCTGTCCGCGTGGCTGGAGACCGGCGGGTGGCCGCTGCTGGTGATTCCCGTGGCGGCGTCGNTCGTGGCCCGCCGCGCGCGCGACAGGGGCGCCCCGGTTCCTGCTCGCGCCGCCGCGGATCCTGCTGGCCGCCGCGGGCCTCGGCGTGGCCACGGGCGCGGACGACTTCATCTACGCCTACGGGCTCGCGTACCTCCCGGTGTCCACGTCCGCGATCCTGATCTCGACGCAGCTGGCGTTCACGGTGTTCTTCGCGTTCCTCGTGGTGCGGCAGCGCCTGACGGCCGCGTCCGTGAACGCCGTGGCGCTGCTGACGGTGGGCACCGTGGTGCTGGGCCTGCACGTCTCGTCGGACCGGCCCCCGGGCGTCACCAGGGGCCAGTACTGGCTGGGCTTCGTGCTGACGCTCGGCGCCGCGGCGCTCTACGGCCTCGTCCTGCCGCTCGTGGAGCTCGCCTACAGGCGCGCCGCGGGCGCCGGCGGCCGCGCCGTNACGTACGCGCTGGTGGTGNAGATGCAGCTGGTGATGGGCTTCTTCGCCACCGCGTTCTGCACCGTCGGCATGGTCGTCAACAAGGATTTCCAGGCGATCCCGAGGGAGGCGAGGCGGTACGCGCTGGGGGAGGCGCGGTACTACGCGGTGCTGGCGTGGTCGGCGGTGATGTGGCAGTGCTTCTTCCTGGGCGCGGTGGGCGTCATCTTCTGCGTGCACACGCTGCTGGCGGGCATCCTCATCGCGGTGTTCATCCCGGTGACGGAGGTGGCGGCCGTCATCTTCCTGCGCGAGAGGTTCAGCAGCGAGAAAGGCGTGGCGCTGGTGCTCTCGCTCTGGGGCCTCGCGTCCTACTCCTACGGCGAGTGGAGCGAGGCCAGGGCCAAGAAGAGGAAGAGGACGAGGACGGAGGAGGGCGCCGCCGCCGCGGAGGCCCTGCAGCAGGCGAACCCGTGATGCTGCTGCGGACTTTGGCCTGGCCTCTTCGATCTTCCCCGTTGTGTGTATATCAGTATATGTTGTGATTGTGATCGCTGCTGTGTGCTACGTGGATAGCGTCCTGAATCGTCGTCACCTGCAGCTGTCGCTTCTGGTGTGGGTGCTCTTCTGTTCGGCGGTGGACGTTGGCCAATANTGTGCTGCATGGTGTGTAGATGTACCTTGGCAGTACCACGTTCGGTTCGGACAGTAAGTNTGGACCGGCGCACTTTGTGGGCCGATCCCAGTACAGGACTGATCTAATNTGAACG

SEQ ID NO: 1219 - DNA, 1768 bp, Zea mays
  misc_feature (1)..(1768): Ceres cDNA ID no. 12416821
  misc_feature (1)..(1768): Ceres CLONE  ID no. 324323
  misc_feature (1)..(1768): Also known as  Ceres CDNA ID no. 23795096
ctttagagaaggtgtacccccaatattccattaccggcccactgacgagagagagagagagagattttggcgtgactatccagagtccccaatcttacacctaaaaactcttctcagctaccggtgcggcatatcgcccctatcggcggcgaacatttgagttctcgcgacgtgtcctcgaggattctgtggtggaagatcggatcttttgctgcgggttccagttgccaaccagagatgtcggctctcctcgatctactgatggggatctttcgccagcagaccctcggcggcgccgccctggagctcgccgcgctggcggcgccgctctcgctcgccgccctcgtcggccttctcatcgggtgggcatggcgcccgaggtgggcgggggtcgtcgtcttcgacaacgcccaacagatggcgcagctccccgcggcggcggcgcctccggaccgcgccaccgccaccaccaccgcggtggtatctcgcaacgaggcggccgccgtcgtaccgagaactgtggtggctcatgcggcggccgaggacgagcagcagcagctggcggtcaacaccggtgacttgattcacctctggcggctcgtcgacgagaaggacggtggcccgtcgtggattcacatgatggaccgcaccttaccaaccatgaggtaccaagcctggcggagagacccaccgagtggtccaccacagtaccgcagcagcacaatcttggaagatgcgtcaccagaggttgtgagagatttcttctgggacgacgagttccggatgaacaacagctgggacgacatgcttcttcagcacgagacgctggaggagtgcaccgagactggaaccatggttgtccggtgggtcaggaagttcccgttcttctgcagcgacagggagtacatcataggccgcaggatatgggcgtctgggaagacattttactgtgtgaccaagggtgttcctcgtccctccgttccaagacaaaacaaacctcgccgtgtggacttgtactactctagctggtgcatccgtccagttgagtcgagaaaaggcgacggtgcaatgagtgcatgcgaggtgctcttgttccaccacgaggacatggggattccatgggagatcgcgaagcttggcgtccggcaggggatgtggggctgcgtcaagaggatagagcctggccttcgggcgtaccaggttgggaggaccgccggagaggctgtttccaagtgtgctgccatggcacaggtcaccaccaggttcagtgccgacgagctcgtcatcgcagggccgggcaacacggaggccagttcttcttcgtccggcgacggcgcagaggttgacaaggcgacgaagcactgggcgaacagcatacccaaggttctcatggtcggtggcgctgtggccctggcctgctgcaccttcgacggtgggttgttgaccaaggccgtcatcttcggcactgccaggaggtttgcaggagggccaggaaggcggtaggtacggtgtaacggtggacggaaagatccagcggcacaacacaaaacaagtgttgctgcactgcagcccgctgcgggttaataggttagaaatatagcatttgttacgaggaaacatagaagtattatgcaagaaaaccgctgttagataagaaatacactgctgtgtattagtagttaataacaagagttcttggtttttgtatgtaaccatattgtggatcggatccattgttcttccccatggacactactactaccagtct

SEQ ID NO: 1220 - protein, 1768 aa, Zea mays
  misc_feature: PFam Name: START; PFam Description: START domain
  misc_feature: GI Number: 46798907; NR Description: membrane related protein
  misc_feature: GI Number: 23197608; NR Description: membrane related protein CP5, putative [Arabidopsis thaliana] >gi|22135902|gb|AAM91533.1|
  misc_feature: GI Number: 50904921; NR Description: putative membrane related protein CP5 [Oryza sativa (japonica cultivar-group)] >gi|41053035|dbj|BAD07966.1| putative membrane related protein CP5
  misc_feature: GI Number: 4741929; NR Description: membrane related protein
  misc_feature: GI Number: 18033654; NR Description: putative nodule membrane
CTTTAGAGAAGGTGTACCCCCAATATTCCATTACCGGCCCACTGACGAGAGAGAGAGAGAGAGATTTTGGCGTGACTATCCAGAGTCCCCAATCTTACACCTAAAAACTCTTCTCAGCTACCGGTGCGGCATATCGCCCCTATCGGCGGCGAACATTTGAGTTCTCGCGACGTGTCCTCGAGGATTCTGTGGTGGAAGATCGGATCTTTTGCTGCGGGTTCCAGTTGCCAACCAGAGATGTCGGCTCTCCTCGATCTACTGATGGGGATCTTTCGCCAGCAGACCCTCGGCGGCGCCGCCCTGGAGCTCGCCGCGCTGGCGGCGCCGCTCTCGCTCGCCGCCCTCGTCGGCCTTCTCATCGGGTGGGCATGGCGCCCGAGGTGGGCGGGGGTCGTCGTCTTCGACAACGCCCAACAGATGGCGCAGCTCCCCGCGGCGGCGGCGCCTCCGGACCGCGCCACCGCCACCACCACCGCGGTGGTATCTCGCAACGAGGCGGCCGCCGTCGTACCGAGAACTGTGGTGGCTCATGCGGCGGCCGAGGACGAGCAGCAGCAGCTGGCGGTCAACACCGGTGACTTGATTCACCTCTGGCGGCTCGTCGACGAGAAGGACGGTGGCCCGTCGTGGATTCACATGATGGACCGCACCTTACCAACCATGAGGTACCAAGCCTGGCGGAGAGACCCACCGAGTGGTCCACCACAGTACCGCAGCAGCACAATCTTGGAAGATGCGTCACCAGAGGTTGTGAGAGATTTCTTCTGGGACGACGAGTTCCGGATGAACAACAGCTGGGACGACATGCTTCTTCAGCACGAGACGCTGGAGGAGTGCACCGAGACTGGAACCATGGTTGTCCGGTGGGTCAGGAAGTTCCCGTTCTTCTGCAGCGACAGGGAGTACATCATAGGCCGCAGGATATGGGCGTCTGGGAAGACATTTTACTGTGTGACCAAGGGTGTTCCTCGTCCCTCCGTTCCAAGACAAAACAAACCTCGCCGTGTGGACTTGTACTACTCTAGCTGGTGCATCCGTCCAGTTGAGTCGAGAAAAGGCGACGGTGCAATGAGTGCATGCGAGGTGCTCTTGTTCCACCACGAGGACATGGGGATTCCATGGGAGATCGCGAAGCTTGGCGTCCGGCAGGGGATGTGGGGCTGCGTCAAGAGGATAGAGCCTGGCCTTCGGGCGTACCAGGTTGGGAGGACCGCCGGAGAGGCTGTTTCCAAGTGTGCTGCCATGGCACAGGTCACCACCAGGTTCAGTGCCGACGAGCTCGTCATCGCAGGGCCGGGCAACACGGAGGCCAGTTCTTCTTCGTCCGGCGACGGCGCAGAGGTTGACAAGGCGACGAAGCACTGGGCGAACAGCATACCCAAGGTTCTCATGGTCGGTGGCGCTGTGGCCCTGGCCTGCTGCACCTTCGACGGTGGGTTGTTGACCAAGGCCGTCATCTTCGGCACTGCCAGGAGGTTTGCAGGAGGGCCAGGAAGGCGGTAGGTACGGTGTAACGGTGGACGGAAAGATCCAGCGGCACAACACAAAACAAGTGTTGCTGCACTGCAGCCCGCTGCGGGTTAATAGGTTAGAAATATAGCATTTGTTACGAGGAAACATAGAAGTATTATGCAAGAAAACCGCTGTTAGATAAGAAATACACTGCTGTGTATTAGTAGTTAATAACAAGAGTTCTTGGTTTTTGTATGTAACCATATTGTGGATCGGATCCATTGTTCTTCCCCATGGACACTACTACTACCAGTCT

SEQ ID NO: 1221 - DNA, 1753 bp, Zea mays
  misc_feature (1)..(1753): Ceres cDNA ID no. 12417068
  misc_feature (1)..(1753): Ceres CLONE  ID no. 350303
  misc_feature (1)..(1753): Also known as  Ceres CDNA ID no. 23797762
gcacgagaccattacctagaacatcctaatcgaaaaacagcgacagcaacacagcctcgcaagagaaagcaaagcaaagccaggagggaaagaaagaaatccttttcctacacctaaagagaccaccaaaccctgcgagcccaaaaaaaagccatggagtacaagagatcatcgcatgcggaagaggaagaagaggatgaggaggaagaagaagacgacgagaacgaggaagaagaggaggatgaggatgaggccagaggccttcgctacaccacggcggcggtggcacccgtaggcgctccgcagcagcagcggcagcaggtgcacgcccaagctcttggcctcggctcacacccctcccagctgatggattctgccgccttctcgaggccgctcttgcctcccaactcatctctggtgatgcagccaccgctgcctccaccaggcttcccgccggctcaccgccaacaaccgccgcatgcgcagctccatccgaggaaagcggagagggagagggacagagccgcgggagcgcagccccatgtccggcgccaccaccaagaaccagccaagaatggcgttctcggcggtggcgccgcgccaacgtcggcaccctctacgctcggcctcgtgcccgtggtggaagcggcccagctgtggaggtaccgggagtgcctgcggaaccacgcggcgcggcttggcgcgcacgtgctcgacggctgctgcgagttcatgccgtccgggggcgaaggggccgccgcgctggcctgcgccgcctgcggctgccaccgcagcttccaccggcgcgaggcggtccccggcggcggcgtggcggtgtcgccctcggcggcagtaacccccaccgccggcgccggcgccaactcctcccgcgccattccgctgctgctggccccgccgcacatgcacacgcgcccgccgcaccacgtgccggcgtccccggcgtccgcgcccgccgcgctggccgagtcgtccagcgaggagctgcgcggccccgcgcccccgacgcacgcgcacgcgcacccgccccacgcgcaggtggccgtagtaggagggtcggcctccgctccccccgcgccgagcaagaagcgtttccggaccaagttcacggcggagcagaaggacctcatgcgcgagttcgcgcaccgcgtcgggtggcgcgtccacaagcccgacgccgacgccgtggacgccttctgcgcccaggtcggcgtctcccggcgcgtcctcaaggtgtggatgcacaacaacaagcacctcgccaaggtcccgccctcgcccccatcctcctcctacccacagccactgcctcgccaccacccgcctccacctccgctccacatccaccatcacccgccgccgccgccgcagcagcagccgcagcagcagcagcatgatgcatgagtaccgagtagccgcagagcaacgcgagaggatcagacgatgccattagcttattagctcctttatttatccttcttcttcttcttcccttgtaatttcagtgacatcccagttgttaaggagttgactcatcatgcagcagttaggagggattaatatgattgtgtgacctaatctcatctcagccatactcctactacaagtcatcccctcgtcctcgttgctttcttggacgacctacctccattattaggttattagcatcagtggcgcttgcattggtatcttgcttatggtaatgacctaataatgatcactgtgttttagagct

SEQ ID NO: 1222 - protein, 1753 aa, Zea mays
  misc_feature: PFam Name: Homeobox; PFam Description: Homeobox domain
  misc_feature: PFam Name: ZF-HD_dimer; PFam Description: ZF-HD protein
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: GI Number: 50900288; NR Description: putative ZF-HD homeobox protein [Oryza sativa (japonica cultivar-group)] >gi|46806323|dbj|BAD17515.1| putative ZF-HD homeobox protein [Oryza
  misc_feature: GI Number: 50251525; NR Description: putative ZF-HD homeobox
  misc_feature: GI Number: 13277220; NR Description: ZF-HD homeobox protein
  misc_feature: GI Number: 21554149; NR Description: unknown [Arabidopsis thaliana]
  misc_feature: GI Number: 21592512; NR Description: unknown [Arabidopsis thaliana]
GCACGAGACCATTACCTAGAACATCCTAATCGAAAAACAGCGACAGCAACACAGCCTCGCAAGAGAAAGCAAAGCAAAGCCAGGAGGGAAAGAAAGAAATCCTTTTCCTACACCTAAAGAGACCACCAAACCCTGCGAGCCCAAAAAAAAGCCATGGAGTACAAGAGATCATCGCATGCGGAAGAGGAAGAAGAGGATGAGGAGGAAGAAGAAGACGACGAGAACGAGGAAGAAGAGGAGGATGAGGATGAGGCCAGAGGCCTTCGCTACACCACGGCGGCGGTGGCACCCGTAGGCGCTCCGCAGCAGCAGCGGCAGCAGGTGCACGCCCAAGCTCTTGGCCTCGGCTCACACCCCTCCCAGCTGATGGATTCTGCCGCCTTCTCGAGGCCGCTCTTGCCTCCCAACTCATCTCTGGTGATGCAGCCACCGCTGCCTCCACCAGGCTTCCCGCCGGCTCACCGCCAACAACCGCCGCATGCGCAGCTCCATCCGAGGAAAGCGGAGAGGGAGAGGGACAGAGCCGCGGGAGCGCAGCCCCATGTCCGGCGCCACCACCAAGAACCAGCCAAGAATGGCGTTCTCGGCGGTGGCGCCGCGCCAACGTCGGCACCCTCTACGCTCGGCCTCGTGCCCGTGGTGGAAGCGGCCCAGCTGTGGAGGTACCGGGAGTGCCTGCGGAACCACGCGGCGCGGCTTGGCGCGCACGTGCTCGACGGCTGCTGCGAGTTCATGCCGTCCGGGGGCGAAGGGGCCGCCGCGCTGGCCTGCGCCGCCTGCGGCTGCCACCGCAGCTTCCACCGGCGCGAGGCGGTCCCCGGCGGCGGCGTGGCGGTGTCGCCCTCGGCGGCAGTAACCCCCACCGCCGGCGCCGGCGCCAACTCCTCCCGCGCCATTCCGCTGCTGCTGGCCCCGCCGCACATGCACACGCGCCCGCCGCACCACGTGCCGGCGTCCCCGGCGTCCGCGCCCGCCGCGCTGGCCGAGTCGTCCAGCGAGGAGCTGCGCGGCCCCGCGCCCCCGACGCACGCGCACGCGCACCCGCCCCACGCGCAGGTGGCCGTAGTAGGAGGGTCGGCCTCCGCTCCCCCCGCGCCGAGCAAGAAGCGTTTCCGGACCAAGTTCACGGCGGAGCAGAAGGACCTCATGCGCGAGTTCGCGCACCGCGTCGGGTGGCGCGTCCACAAGCCCGACGCCGACGCCGTGGACGCCTTCTGCGCCCAGGTCGGCGTCTCCCGGCGCGTCCTCAAGGTGTGGATGCACAACAACAAGCACCTCGCCAAGGTCCCGCCCTCGCCCCCATCCTCCTCCTACCCACAGCCACTGCCTCGCCACCACCCGCCTCCACCTCCGCTCCACATCCACCATCACCCGCCGCCGCCGCCGCAGCAGCAGCCGCAGCAGCAGCAGCATGATGCATGAGTACCGAGTAGCCGCAGAGCAACGCGAGAGGATCAGACGATGCCATTAGCTTATTAGCTCCTTTATTTATCCTTCTTCTTCTTCTTCCCTTGTAATTTCAGTGACATCCCAGTTGTTAAGGAGTTGACTCATCATGCAGCAGTTAGGAGGGATTAATATGATTGTGTGACCTAATCTCATCTCAGCCATACTCCTACTACAAGTCATCCCCTCGTCCTCGTTGCTTTCTTGGACGACCTACCTCCATTATTAGGTTATTAGCATCAGTGGCGCTTGCATTGGTATCTTGCTTATGGTAATGACCTAATAATGATCACTGTGTTTTAGAGCT

SEQ ID NO: 1223 - DNA, 987 bp, Zea mays
  misc_feature (1)..(987): Ceres cDNA ID no. 12417174
  misc_feature (1)..(987): Ceres CLONE  ID no. 364823
  misc_feature (1)..(987): Also known as  Ceres CDNA ID no. 24371796
  misc_feature (444)..(444): n is a, c, t, g, unknown, or other
  misc_feature (498)..(498): n is a, c, t, g, unknown, or other
agtcttactgcctgcacattcctcttccagctccagctatttccaccgcacattgtccacgtctgccattggcccattgccggttcctctcgtcaagccctagctccaaccaacccgtttccatgggagccatacgagttgcaagccttctactcctcgctggggtaatctggctgtcgcgggcgatgttcggcgcggaggccgccggcacgacggtgttcacgctgcacaacaactgcacccacacggtctggccggccacactgtccgggaacagcgcggcggccgtcgggggcgggggcttcgagctgtcgcccggcgccaccgtctcgttcccggcgccggcgggctggtcgggccgcctgtgggcgcgcacgggctgcgtcgcgtcgtcgtcgtcccccgccggccgcctctcgtgcgccacgggcgactgcagcggcnccgcgagctgctccctgggcggggcgccgcccgtcacgctggcggagttcaccntgggcagcgccgacggcaaggacttctacgacgtgagcctggtggacgggtacaacgtcggcatcggcgtggcggcggcgggcgccagggtcaaccgcgccacgtgcgggtacgccggctgcgtcggggacgtgaacgcgctgtgcccgcccgagctgcggacggccgcggcggcgggcggcgagggggcgccggcggtggcgtgccggagcgcgtgcgaggcgttcgggtcgcccgagtactgctgcacgggggcgcacggtgggccgaacacctgcgggcccaccaagtactcgaggctgttcaaggcggcctgccccgcggcctacagctacgcgtacgacgaccccaccagcaccttcacgtgcggcaccggcgcgcagtacctcgtcaccttctgcccgggtcgccagtagtgggcggagttgtgtccgtgcccgttgatcgttctgttcatcttatgtcttaaaaagatgctttctaatttgc

SEQ ID NO: 1224 - protein, 987 aa, Zea mays
  misc_feature: PFam Name: Thaumatin; PFam Description: Thaumatin family
  misc_feature: GI Number: 50920531; NR Description: Putative thaumatin-like protein [Oryza sativa (japonica cultivar-group)] >gi|20330768|gb|AAM19131.1| Putative thaumatin-like protein [Oryza
  misc_feature: GI Number: 51968828; NR Description: thaumatin-like protein [Arabidopsis thaliana] >gi|12323901|gb|AAG51927.1| thaumatin-like protein; 28949-28112 [Arabidopsis thaliana] >gi|15222088|ref|NP_177640.1| pathogenesis-related thaumatin
  misc_feature: GI Number: 2435406; NR Description: thaumatin-like protein
  misc_feature: GI Number: 6273385; NR Description: SCUTL2 [Vitis vinifera]
AGTCTTACTGCCTGCACATTCCTCTTCCAGCTCCAGCTATTTCCACCGCACATTGTCCACGTCTGCCATTGGCCCATTGCCGGTTCCTCTCGTCAAGCCCTAGCTCCAACCAACCCGTTTCCATGGGAGCCATACGAGTTGCAAGCCTTCTACTCCTCGCTGGGGTAATCTGGCTGTCGCGGGCGATGTTCGGCGCGGAGGCCGCCGGCACGACGGTGTTCACGCTGCACAACAACTGCACCCACACGGTCTGGCCGGCCACACTGTCCGGGAACAGCGCGGCGGCCGTCGGGGGCGGGGGCTTCGAGCTGTCGCCCGGCGCCACCGTCTCGTTCCCGGCGCCGGCGGGCTGGTCGGGCCGCCTGTGGGCGCGCACGGGCTGCGTCGCGTCGTCGTCGTCCCCCGCCGGCCGCCTCTCGTGCGCCACGGGCGACTGCAGCGGCNCCGCGAGCTGCTCCCTGGGCGGGGCGCCGCCCGTCACGCTGGCGGAGTTCACCNTGGGCAGCGCCGACGGCAAGGACTTCTACGACGTGAGCCTGGTGGACGGGTACAACGTCGGCATCGGCGTGGCGGCGGCGGGCGCCAGGGTCAACCGCGCCACGTGCGGGTACGCCGGCTGCGTCGGGGACGTGAACGCGCTGTGCCCGCCCGAGCTGCGGACGGCCGCGGCGGCGGGCGGCGAGGGGGCGCCGGCGGTGGCGTGCCGGAGCGCGTGCGAGGCGTTCGGGTCGCCCGAGTACTGCTGCACGGGGGCGCACGGTGGGCCGAACACCTGCGGGCCCACCAAGTACTCGAGGCTGTTCAAGGCGGCCTGCCCCGCGGCCTACAGCTACGCGTACGACGACCCCACCAGCACCTTCACGTGCGGCACCGGCGCGCAGTACCTCGTCACCTTCTGCCCGGGTCGCCAGTAGTGGGCGGAGTTGTGTCCGTGCCCGTTGATCGTTCTGTTCATCTTATGTCTTAAAAAGATGCTTTCTAATTTGC

SEQ ID NO: 1225 - DNA, 2013 bp, Zea mays
  misc_feature (1)..(2013): Ceres cDNA ID no. 12417337
  misc_feature (1)..(2013): Ceres CLONE  ID no. 364353
  misc_feature (1)..(2013): Also known as  Ceres CDNA ID no. 23851821
gcacgagaccattacctagaacatcctaatcgaaaacttcagtaatcagtgctcgctagcccaccacgccctgaacctagcccggacaccagccagaacaggccatgtccatgggctccccggtgcagctcaggcggctgaagcctctgtaccagttcgtggtgaacaacatcctggccatcgtggccgtgccgctcgccaccgcggtcctgctcaaggcgtcgtcgctcgggcccgaggagatcctggcgctccggccggcgcacctgttcctggccgcgttcctgcctgccgcggccacggtgctgtacctgatgctccggccgcgcacggtgtacctggtggactacgcgtgcttccgcaccagccccaactgccgcgtcccgttcgcgacgttcctggagcactcccgcgtgtggccgggcttcgacgagcgcagcgtccggttcatgacgcgcctgctggagcggtcggggctcggggaggagacgtgcctgccgtacgcgcagcactacatcccgccgtcgcgcgacctggagtcctcccgcgccgaggccgagctcgtcatcttctcggccatcgacgacctgctcgccaagaccggggtctccccgcgggacatcgacatcctggtggtgaactgcagcctgttcgcgccgacgccgtccttcgcggacatggtcacgcaccggtacaggctccgcggggacgtgcgcaacgtgcacctcgccgggatggggtgcagcgcggggctcgtctccgtggagctggcccggaacctgctgcaggtggcgccgcggggcacgcgcgctctggtggtgtccacggagaccatcacccccaattactacatgggcgaggagcgcgcgatgctgctgcccaactgcctgttccgcatgggcggcgcggcggcgctgctgtccaccgacggcgccggcgcgcggttccgcctggcgcgcgtggtgcgcacgctgcgcggcgcgtcggacggcgcgtaccgctgcgtgtaccaggaggaggacgagcgcggcaacgtgggcatcaacctgtccaaggacctgatgagcatccgcgggcgacgcgctgaaggcgaacatcacggcgatggggcccctggtgctgccggcgtcggagcagctgctgttcgcgctgtccttcatcgcgcgcaaggtgctgaacaaccggatcaggccctacatcccggacttccgcacggcgttcgagcacttctgcatccacgcgggcgggcgcgccgtgatcgacgagctccagcgcagcctgacgctgtcggacgagcaggtggaggcgtcgcggatgacgctgcaccggttcggcaacacctccagcagctccctctggtacgagctcgcctacgtcgaggccaagggccgcatgcgcaggggagaccgcgtctggatgatcggcttcggctccggtttcaagtgcaacagcgccgcctgggagtgcatccgccccgccgccaacgccgacgggccgtgggccaactgcatccaccggtaccccgtgcacattcccgacgtgctcaagcactgagcccggcgccagctccagttccgtgccgtgccttgcctttcccttttcctcctcgcccggttgccattgcacctgctgctacatttggtttgtggacatcaaaacgaaccgctggaacagcgattggccgtggtcgtgaactaggttggtggaatatgtgatggagagtgacagagtacttgtcgtgtcgtatcaaggcggcggggtggtcgtcataaaggaggcgaggtcgggccaggctgccgtacatgggcgcccggggaacggacgtgtgttgtgcttgtccggggcgttgtattatctaccattttcctatttcttattacaattcattcctgcagtataccatgaaaagagatatgacatgagctagagctactagtagacgacaagacgagcaaaagctttgatgtatgtgtgcacctactctttatacaatcaagtgttctcatttaagtg

SEQ ID NO: 1226 - protein, 2013 aa, Zea mays
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: PFam Name: Peptidase_S8; PFam Description: Subtilase family
  misc_feature: GI Number: 20334738; NR Description: At1g68530/T26J14_10 [Arabidopsis thaliana] >gi|17979464|gb|AAL50069.1|
  misc_feature: GI Number: 21618184; NR Description: fatty acid condensing
  misc_feature: GI Number: 28393607; NR Description: putative fatty acid
  misc_feature: GI Number: 53792994; NR Description: putative very-long-chain fatty acid condensing enzyme CUT1 [Oryza sativa (japonica
  misc_feature: GI Number: 53793013; NR Description: putative very-long-chain fatty acid condensing enzyme CUT1 [Oryza sativa (japonica
GCACGAGACCATTACCTAGAACATCCTAATCGAAAACTTCAGTAATCAGTGCTCGCTAGCCCACCACGCCCTGAACCTAGCCCGGACACCAGCCAGAACAGGCCATGTCCATGGGCTCCCCGGTGCAGCTCAGGCGGCTGAAGCCTCTGTACCAGTTCGTGGTGAACAACATCCTGGCCATCGTGGCCGTGCCGCTCGCCACCGCGGTCCTGCTCAAGGCGTCGTCGCTCGGGCCCGAGGAGATCCTGGCGCTCCGGCCGGCGCACCTGTTCCTGGCCGCGTTCCTGCCTGCCGCGGCCACGGTGCTGTACCTGATGCTCCGGCCGCGCACGGTGTACCTGGTGGACTACGCGTGCTTCCGCACCAGCCCCAACTGCCGCGTCCCGTTCGCGACGTTCCTGGAGCACTCCCGCGTGTGGCCGGGCTTCGACGAGCGCAGCGTCCGGTTCATGACGCGCCTGCTGGAGCGGTCGGGGCTCGGGGAGGAGACGTGCCTGCCGTACGCGCAGCACTACATCCCGCCGTCGCGCGACCTGGAGTCCTCCCGCGCCGAGGCCGAGCTCGTCATCTTCTCGGCCATCGACGACCTGCTCGCCAAGACCGGGGTCTCCCCGCGGGACATCGACATCCTGGTGGTGAACTGCAGCCTGTTCGCGCCGACGCCGTCCTTCGCGGACATGGTCACGCACCGGTACAGGCTCCGCGGGGACGTGCGCAACGTGCACCTCGCCGGGATGGGGTGCAGCGCGGGGCTCGTCTCCGTGGAGCTGGCCCGGAACCTGCTGCAGGTGGCGCCGCGGGGCACGCGCGCTCTGGTGGTGTCCACGGAGACCATCACCCCCAATTACTACATGGGCGAGGAGCGCGCGATGCTGCTGCCCAACTGCCTGTTCCGCATGGGCGGCGCGGCGGCGCTGCTGTCCACCGACGGCGCCGGCGCGCGGTTCCGCCTGGCGCGCGTGGTGCGCACGCTGCGCGGCGCGTCGGACGGCGCGTACCGCTGCGTGTACCAGGAGGAGGACGAGCGCGGCAACGTGGGCATCAACCTGTCCAAGGACCTGATGAGCATCCGCGGGCGACGCGCTGAAGGCGAACATCACGGCGATGGGGCCCCTGGTGCTGCCGGCGTCGGAGCAGCTGCTGTTCGCGCTGTCCTTCATCGCGCGCAAGGTGCTGAACAACCGGATCAGGCCCTACATCCCGGACTTCCGCACGGCGTTCGAGCACTTCTGCATCCACGCGGGCGGGCGCGCCGTGATCGACGAGCTCCAGCGCAGCCTGACGCTGTCGGACGAGCAGGTGGAGGCGTCGCGGATGACGCTGCACCGGTTCGGCAACACCTCCAGCAGCTCCCTCTGGTACGAGCTCGCCTACGTCGAGGCCAAGGGCCGCATGCGCAGGGGAGACCGCGTCTGGATGATCGGCTTCGGCTCCGGTTTCAAGTGCAACAGCGCCGCCTGGGAGTGCATCCGCCCCGCCGCCAACGCCGACGGGCCGTGGGCCAACTGCATCCACCGGTACCCCGTGCACATTCCCGACGTGCTCAAGCACTGAGCCCGGCGCCAGCTCCAGTTCCGTGCCGTGCCTTGCCTTTCCCTTTTCCTCCTCGCCCGGTTGCCATTGCACCTGCTGCTACATTTGGTTTGTGGACATCAAAACGAACCGCTGGAACAGCGATTGGCCGTGGTCGTGAACTAGGTTGGTGGAATATGTGATGGAGAGTGACAGAGTACTTGTCGTGTCGTATCAAGGCGGCGGGGTGGTCGTCATAAAGGAGGCGAGGTCGGGCCAGGCTGCCGTACATGGGCGCCCGGGGAACGGACGTGTGTTGTGCTTGTCCGGGGCGTTGTATTATCTACCATTTTCCTATTTCTTATTACAATTCATTCCTGCAGTATACCATGAAAAGAGATATGACATGAGCTAGAGCTACTAGTAGACGACAAGACGAGCAAAAGCTTTGATGTATGTGTGCACCTACTCTTTATACAATCAAGTGTTCTCATTTAAGTG

SEQ ID NO: 1227 - DNA, 1069 bp, Zea mays
  misc_feature (1)..(1069): Ceres cDNA ID no. 12417357
  misc_feature (1)..(1069): Ceres CLONE  ID no. 351811
  misc_feature (1)..(1069): Also known as  Ceres CDNA ID no. 23795608
gcacgagaccattacctagaacatcctaatcgaaaaaatcatcactgccatctctctctgactctgtgtccgtctctaaactctagtctgtgcgaatcctgctgccagcagcgaggaacagaacagtagccaatttgccatctcacagttgcgttcctccgattccccgtcccccgatggacctgtctcccagctcgtcggcgccatccgcgccgccggtgccgtgcgagtggtccggcgccgggctcggctccgcggcgtgcggcctcgcctgcagggtgctctgcgccgtcgccacctgcgtcttcgcggccgtggggtcgctggtcggggcggtgacggggtccatggtggggctggcgaccgagagcgggatgctgcgcggcgccggcatcggggccatctccggcgccgtcttctccatcgaggtcgccgagtcgtcccgcgacctctggcactcgggcgactccggcgtctggaccctcctctacatggtggacatcatctccagtctcttgagcggcaggctggtccgggagaaggtggggccggctgttcagagcgccgtgcagagccagatcagcgccatcagctcgccgttcgaggagacgagcgacctgttcgagaccggcagcgtgaggggcctccccgaggccgcggtgcgccggctgccggtgacggtggtcgcggaggacggcgccgtggacgcggcgggccaggcgctgtgctgctcggtgtgcctgcaggacttccgggtgggcgaccgcgcgcggaggctgcccggttgccgccacctgttccacgtgccctgcatcgactgctggctcctcaggcacggctcctgcccgctgtgccggcgagacatctgaaactcggtcgtctgctctgtgaaccgccacccacgtcgccggaaacgtggtgtagtgttgctgctttggacgagatggtcagttagttgagtagggttcctactttttaggacggcaccctgatgcccgtaagggaaatggtgcgctctgacgctctgttaactaaaaaagaagaagagagaaaacagcccctcagcttc

SEQ ID NO: 1228 - protein, 1069 aa, Zea mays
  misc_feature: PFam Name: zf-C3HC4; PFam Description: Zinc finger, C3HC4
  misc_feature: PFam Name: Transferase; PFam Description: Transferase family
  misc_feature: GI Number: 27524904; NR Description: NEP1-interacting protein 2 [Arabidopsis thaliana] >gi|30680091|ref|NP_179364.2| zinc finger
  misc_feature: GI Number: 50937111; NR Description: putative NEP1-interacting protein 2 [Oryza sativa (japonica cultivar-group)] >gi|33146606|dbj|BAC79837.1| putative NEP1-interacting protein 2 [Oryza sativa (japonica cultivar-group)] [Oryza sativa (japonica
  misc_feature: GI Number: 50948297; NR Description: putative NEP1-interacting protein [Oryza sativa (japonica cultivar-group)] >gi|42407817|dbj|BAD08961.1| putative NEP1-interacting protein
  misc_feature: GI Number: 18855037; NR Description: putative zinc finger
  misc_feature: GI Number: 27524902; NR Description: NEP1-interacting protein
GCACGAGACCATTACCTAGAACATCCTAATCGAAAAAATCATCACTGCCATCTCTCTCTGACTCTGTGTCCGTCTCTAAACTCTAGTCTGTGCGAATCCTGCTGCCAGCAGCGAGGAACAGAACAGTAGCCAATTTGCCATCTCACAGTTGCGTTCCTCCGATTCCCCGTCCCCCGATGGACCTGTCTCCCAGCTCGTCGGCGCCATCCGCGCCGCCGGTGCCGTGCGAGTGGTCCGGCGCCGGGCTCGGCTCCGCGGCGTGCGGCCTCGCCTGCAGGGTGCTCTGCGCCGTCGCCACCTGCGTCTTCGCGGCCGTGGGGTCGCTGGTCGGGGCGGTGACGGGGTCCATGGTGGGGCTGGCGACCGAGAGCGGGATGCTGCGCGGCGCCGGCATCGGGGCCATCTCCGGCGCCGTCTTCTCCATCGAGGTCGCCGAGTCGTCCCGCGACCTCTGGCACTCGGGCGACTCCGGCGTCTGGACCCTCCTCTACATGGTGGACATCATCTCCAGTCTCTTGAGCGGCAGGCTGGTCCGGGAGAAGGTGGGGCCGGCTGTTCAGAGCGCCGTGCAGAGCCAGATCAGCGCCATCAGCTCGCCGTTCGAGGAGACGAGCGACCTGTTCGAGACCGGCAGCGTGAGGGGCCTCCCCGAGGCCGCGGTGCGCCGGCTGCCGGTGACGGTGGTCGCGGAGGACGGCGCCGTGGACGCGGCGGGCCAGGCGCTGTGCTGCTCGGTGTGCCTGCAGGACTTCCGGGTGGGCGACCGCGCGCGGAGGCTGCCCGGTTGCCGCCACCTGTTCCACGTGCCCTGCATCGACTGCTGGCTCCTCAGGCACGGCTCCTGCCCGCTGTGCCGGCGAGACATCTGAAACTCGGTCGTCTGCTCTGTGAACCGCCACCCACGTCGCCGGAAACGTGGTGTAGTGTTGCTGCTTTGGACGAGATGGTCAGTTAGTTGAGTAGGGTTCCTACTTTTTAGGACGGCACCCTGATGCCCGTAAGGGAAATGGTGCGCTCTGACGCTCTGTTAACTAAAAAAGAAGAAGAGAGAAAACAGCCCCTCAGCTTC

SEQ ID NO: 1229 - DNA, 1053 bp, Zea mays
  misc_feature (1)..(1053): Ceres cDNA ID no. 12417420
  misc_feature (1)..(1053): Ceres CLONE  ID no. 357451
  misc_feature (1)..(1053): Also known as  Ceres CDNA ID no. 23798260
  misc_feature (605)..(605): n is a, c, t, g, unknown, or other
agcaccagcaggagagtcccggagctggaagaagaagatacagagcgcatgctcctgtgaacatacaccactgaactcatagaaagcagcacacagtctgcataggtgcattgttgttccggcctctcctagaggaaaggaaggtcaggactcaggaggatgcctcgagccccgaccatgaccgctttccttgtcgccgtgcttgccgccctcgttctcacgtccgagggccgcgtttctcggaaggacctgtgcatcgacctcggcggtggcagcggggcaggcatcgggatcggtgctgggattagcattggcataggcggtggtggtggtgccggtggctctggctctggctcggcgtctggctccggctccggctccggctcggcctcaggttccgggtccagtgcgggctctggtgcaggatcgtatgctggatctggcgccggcgccggctctggctctggctctggtgcgggttcaggagctgggtccggagcgggttcgggttcagggtacgggcaagggcaagggtctggatatggcgaagggcatgggtcgggccagggacagggttctgggtctggctcgggatccggtcaggnaagtggatccggtcgaggatctggctacggcgaaggctccggttccggctctggccaaggatcaggatccggctacggcgaaggctccggttccggctctggccaaggatcaggatccggctacggtgaaggttacggctccggtcatggccaaggatctggatacggtgagggttcaggaagaggatacggagaaggttcaggctcaggctacggcgagggacacggctacggctacggctctggttctgggcatgtggcaaataaacatgactgaacaatgttctctgagctctgatgttctcttctctttctgtgtatccatccatatacataaataagtacacgttaccaactgtggacaaagaactgtactctctctctctcctcaaagcatttcctatatagctgttcaagatactgtttttcattatagactacacttttt

SEQ ID NO: 1230 - protein, 1053 aa, Zea mays
  misc_feature: PFam Name: Dehydrin; PFam Description: Dehydrin
  misc_feature: PFam Name: GRP; PFam Description: Glycine rich protein family
  misc_feature: PFam Name: Peptidase_C1; PFam Description: Papain family
  misc_feature: PFam Name: Serglycin; PFam Description: Serglycin
  misc_feature: PFam Name: Secretin_N; PFam Description: Bacterial type
  misc_feature: GI Number: 10954048; NR Description: ovarian fibroin-like
  misc_feature: GI Number: 47007952; NR Description: major ampullate spidroin
  misc_feature: GI Number: 765323; NR Description: silk fibroin heavy chain
  misc_feature: GI Number: 47007963; NR Description: major ampullate spidroin
  misc_feature: GI Number: 10954052; NR Description: ovarian fibroin-like
AGCACCAGCAGGAGAGTCCCGGAGCTGGAAGAAGAAGATACAGAGCGCATGCTCCTGTGAACATACACCACTGAACTCATAGAAAGCAGCACACAGTCTGCATAGGTGCATTGTTGTTCCGGCCTCTCCTAGAGGAAAGGAAGGTCAGGACTCAGGAGGATGCCTCGAGCCCCGACCATGACCGCTTTCCTTGTCGCCGTGCTTGCCGCCCTCGTTCTCACGTCCGAGGGCCGCGTTTCTCGGAAGGACCTGTGCATCGACCTCGGCGGTGGCAGCGGGGCAGGCATCGGGATCGGTGCTGGGATTAGCATTGGCATAGGCGGTGGTGGTGGTGCCGGTGGCTCTGGCTCTGGCTCGGCGTCTGGCTCCGGCTCCGGCTCCGGCTCGGCCTCAGGTTCCGGGTCCAGTGCGGGCTCTGGTGCAGGATCGTATGCTGGATCTGGCGCCGGCGCCGGCTCTGGCTCTGGCTCTGGTGCGGGTTCAGGAGCTGGGTCCGGAGCGGGTTCGGGTTCAGGGTACGGGCAAGGGCAAGGGTCTGGATATGGCGAAGGGCATGGGTCGGGCCAGGGACAGGGTTCTGGGTCTGGCTCGGGATCCGGTCAGGNAAGTGGATCCGGTCGAGGATCTGGCTACGGCGAAGGCTCCGGTTCCGGCTCTGGCCAAGGATCAGGATCCGGCTACGGCGAAGGCTCCGGTTCCGGCTCTGGCCAAGGATCAGGATCCGGCTACGGTGAAGGTTACGGCTCCGGTCATGGCCAAGGATCTGGATACGGTGAGGGTTCAGGAAGAGGATACGGAGAAGGTTCAGGCTCAGGCTACGGCGAGGGACACGGCTACGGCTACGGCTCTGGTTCTGGGCATGTGGCAAATAAACATGACTGAACAATGTTCTCTGAGCTCTGATGTTCTCTTCTCTTTCTGTGTATCCATCCATATACATAAATAAGTACACGTTACCAACTGTGGACAAAGAACTGTACTCTCTCTCTCTCCTCAAAGCATTTCCTATATAGCTGTTCAAGATACTGTTTTTCATTATAGACTACACTTTTT

SEQ ID NO: 1231 - DNA, 845 bp, Zea mays
  misc_feature (1)..(845): Ceres cDNA ID no. 12417607
  misc_feature (1)..(845): Ceres CLONE  ID no. 356677
  misc_feature (1)..(845): Also known as  Ceres CDNA ID no. 23799032
atctcaactactactactcactagcggtagctcacaatggcaggcacaaagctagtatcactggggctcattgttctcatgagcatggggttagcaaatgctgtgagggtggctagattctctactgctgatgggagtggacaaggagggggagggggtggcggttacgtgaatggtgcgggatcaggggtcgggtctggcaccggagtaggtgacagtagtccggagggtgtccatgcaagtgctggagggggtggcgcaggtggtggaactagccagtatggtggatctgcatatggtgtagggttagggtcaggttcggcgagtagcacgtacagtgatagtgatggagggtcttccagtgctggtggtgctggcgggggcggtggtggcggaaaagctggaggttcttgggactccagcgctcaagggtctggtagtggcgtcggttctggctctgcctattctaacaggtatccgtatgggccaagatatgcaggtgcaactgctaatggcaacggtggcggcacggggaacagccagaatggtggtgctggcggcggtaaaggttctggatctgggttcggcgatgccattccctgatttctgtatcgagtgaatctaaagctggagcccatcgccctttcttgttttggagtcacaggattactgtttttgttttgtttttttttctagctgtgttgtgcttttgttagaatttaaattaataaagggcccggctgttcatgtaacagtagcagtctagtgtaagcctgtaaaggtgcagcttatgcgaagatgtaagcctgccagtttatgaaagaaatcatactcgctcctttgtc

SEQ ID NO: 1232 - protein, 845 aa, Zea mays
  misc_feature: PFam Name: GRP; PFam Description: Glycine rich protein family
  misc_feature: PFam Name: Secretin_N; PFam Description: Bacterial type
  misc_feature: PFam Name: Dehydrin; PFam Description: Dehydrin
  misc_feature: PFam Name: Peptidase_C1; PFam Description: Papain family
  misc_feature: PFam Name: GP38; PFam Description: Phage tail fibre adhesin Gp38
  misc_feature: GI Number: 4755087; NR Description: aluminum-induced protein;
  misc_feature: GI Number: 4115615; NR Description: root cap-specific
  misc_feature: GI Number: 15837420; NR Description: endo-1,4-beta-glucanase [Xylella fastidiosa 9a5c] >gi|11360928|pir||E82759 endo-1,4-beta-glucanase XF0818 [imported] - Xylella fastidiosa (strain 9a5c) >gi|9105718|gb|AAF83628.1| endo-1,4-beta-glucanase
  misc_feature: GI Number: 22997061; NR Description: COG2730: Endoglucanase
  misc_feature: GI Number: 53718532; NR Description: putative lipoprotein [Burkholderia pseudomallei K96243] >gi|52208946|emb|CAH34885.1|
ATCTCAACTACTACTACTCACTAGCGGTAGCTCACAATGGCAGGCACAAAGCTAGTATCACTGGGGCTCATTGTTCTCATGAGCATGGGGTTAGCAAATGCTGTGAGGGTGGCTAGATTCTCTACTGCTGATGGGAGTGGACAAGGAGGGGGAGGGGGTGGCGGTTACGTGAATGGTGCGGGATCAGGGGTCGGGTCTGGCACCGGAGTAGGTGACAGTAGTCCGGAGGGTGTCCATGCAAGTGCTGGAGGGGGTGGCGCAGGTGGTGGAACTAGCCAGTATGGTGGATCTGCATATGGTGTAGGGTTAGGGTCAGGTTCGGCGAGTAGCACGTACAGTGATAGTGATGGAGGGTCTTCCAGTGCTGGTGGTGCTGGCGGGGGCGGTGGTGGCGGAAAAGCTGGAGGTTCTTGGGACTCCAGCGCTCAAGGGTCTGGTAGTGGCGTCGGTTCTGGCTCTGCCTATTCTAACAGGTATCCGTATGGGCCAAGATATGCAGGTGCAACTGCTAATGGCAACGGTGGCGGCACGGGGAACAGCCAGAATGGTGGTGCTGGCGGCGGTAAAGGTTCTGGATCTGGGTTCGGCGATGCCATTCCCTGATTTCTGTATCGAGTGAATCTAAAGCTGGAGCCCATCGCCCTTTCTTGTTTTGGAGTCACAGGATTACTGTTTTTGTTTTGTTTTTTTTTCTAGCTGTGTTGTGCTTTTGTTAGAATTTAAATTAATAAAGGGCCCGGCTGTTCATGTAACAGTAGCAGTCTAGTGTAAGCCTGTAAAGGTGCAGCTTATGCGAAGATGTAAGCCTGCCAGTTTATGAAAGAAATCATACTCGCTCCTTTGTC

SEQ ID NO: 1233 - DNA, 2740 bp, Zea mays
  misc_feature (1)..(2740): Ceres cDNA ID no. 12417747
  misc_feature (1)..(2740): Ceres CLONE  ID no. 358735
  misc_feature (1)..(2740): Also known as  Ceres CDNA ID no. 23799841
  misc_feature (352)..(352): n is a, c, t, g, unknown, or other
  misc_feature (551)..(551): n is a, c, t, g, unknown, or other
  misc_feature (593)..(593): n is a, c, t, g, unknown, or other
  misc_feature (1463)..(1463): n is a, c, t, g, unknown, or other
  misc_feature (1891)..(1891): n is a, c, t, g, unknown, or other
  misc_feature (1892)..(1892): n is a, c, t, g, unknown, or other
  misc_feature (1894)..(1894): n is a, c, t, g, unknown, or other
  misc_feature (2140)..(2140): n is a, c, t, g, unknown, or other
  misc_feature (2141)..(2141): n is a, c, t, g, unknown, or other
gcacgagaccattacctagaacatcctaatcgaaaaagccccatcatactcattcatattataaggcgcgaatctatccatctatctaatctacttacgcacgaacatgcgtaacatcggcatgctgcgggcgctggtcctggcgctcgcggtggccgccgccgccgccgccgagaagaggaggacgtacatcgtccacatggccaagtcggcgatgccggccgagtacgcggaccacgccgagtggtacggcgcatcgctgcgctccgtgtccgcctcagcctccgccgccaagatgctctacgcgtacgacaccgtcctgcacggtttctccgcgcgcctcacgccgcangaggccagcgacctggcgtccgccgagggggtgctcgccgtcaacccggaggcgcggtacgagctgcacaccacgcggacgcccgagttcctgggcatcgccggccagggcctgtccccgcagtccggcacggcgggcgacgtcgtcgtcggcgtgctcgacacgggcgtctggcccgagagcaagagctacgacgacnccggcctcgccgaggtgcccgcgtggtggaagggccagtgcnaggcgggacccggcttcgacgcctccaccgcctgcaaccgcaagctcgtcggcgccaggttcttcaacaagggctacgaggccgccatgggccccatggacaccgaccgggagtcccggtccccgctcgacgacgacggccacggcacgcacaccagctccacggccgccggcgccgccgtgccgggtgccagcctcttcggcttcgccgcgggcacggcgcgcggcatggcgccccgggcgcgcgtcgccgcctacaaggtgtgctggctcggcggctgcttcagctccgacatcctcgcgggcatggacgccgccgtcgccgacggctgcggcgtgctctcgctctcgctgggcggcggcgccgccgactactcgcgcgacagcgtcgccatcggcgccttcgccgccacggagcagaacgtcctcgtctcctgctcggccgggaacgccggccccgggagctccacgctgtccaacgtggcgccgtggatcaccaccgtgggcgccggcacgctcgaccgcgacttcccggcctacgtcgtgctcggcgacgggaagaactacacgggcgtctcgctctacgccgggaagccgctgcccagcgccccgatccccatcgtgtacgcggccaacgcctccaactccaccgcggggaacctgtgcatgcccggaaccctcgtgccggagaaggtggccggcaagatcgtcgtgtgcgaccgcggcgtcagcgcgcgcgtccagaagggcctcgtcgtgcgcgacgcgggcggcgccggcatggtgctgtccaacacggccgccaacggccaggagctcgtcgccgacgcgcacctcctgcccgccgccggcgtcggcgagagggaaggcncggcgatcaagtcgtacgtggcctccgccacgaaccccacgacgacggtcgtggtcgccgggacggaggtgggcgtgcgcccctcgccggtggtggcggcgttctcgtcgcgcgggcccaacatggtgacgccggagatcctgaagccggacatgatcgcgccgggggtgaacatcctggcgtcgtggacgggcaaggccgggccgacgggcctcgccgccgacacccgccgcgtgggcttcaacatcatctccggcacgtccatgtcgtgcccgcacgtgagcgggctggcggcgctgctccggagcgcgcacccggagtggagccccgccgccgtgcgctcggcgctcatgaccacagcctacgccagctactccggcgggtcgtcgctgctggacgcggcgacgggcgggatggccacgccgttnnantacggcgcggggcacgtggaccccgcgcgggcgctggacccggggctcgtctacgacctgggcacccgcgactacgtggacttcttgtgcgcgctcaagtacagctccaccatgatcgccgccgtggcgcggagccgggagtacgcgtgcgccgagaacaagacctactccgtgggcgccctcaactacccgtccttctcggtggcctactcgacggccaacggcgacggcggcggggactcggcnnccgtgacacacacgcggacgctgaccaacgtgggcggggcgggcacgtacaaggcgtccacgtcgctcgccgctgccaagggcgtggccgtggacgtggagccggcggagctggagttcacgtcggtgggggagaagaagagctacacggtgaggttcacgtccaagtcgcagccgtcgggcaccgccggtttcgggcggctcgtgtggtcggacgggaagcacagcgtggccagcccgatagcgttcacgtggacctgaacctgatggacggatggattataccatacgacagtggtttttggcgcctcagcctcaaagaaaggcccataatccatcatccatgtgacggcctcgttccctacactacgcagtcaaaagggccgaagtgtagggtgggaaggtttggagggggtacggtgcaaattggaggtttcttctgtgttgctattattactactaataaggtcattaatcctatcagcgtccgtaggttgtgatttttggatggaaatgggatcggggtggacggttggatggagattgatggtgcttggttgattggaatggaattattagagaggagaaggtttttagctt

SEQ ID NO: 1234 - protein, 2740 aa, Zea mays
  misc_feature: PFam Name: Peptidase_S8; PFam Description: Subtilase family
  misc_feature: PFam Name: PA; PFam Description: PA domain
  misc_feature: PFam Name: Subtilisin_N; PFam Description: Subtilisin
  misc_feature: PFam Name: Pyr_redox_2; PFam Description: Pyridine
  misc_feature: PFam Name: FH2; PFam Description: Formin Homology 2 Domain
  misc_feature: GI Number: 45773916; NR Description: At3g14067 [Arabidopsis thaliana] >gi|44917461|gb|AAS49055.1| At3g14067 [Arabidopsis thaliana] >gi|22331076|ref|NP_566473.2| subtilase family protein
  misc_feature: GI Number: 24111425; NR Description: At5g67360/K8K14_8 [Arabidopsis thaliana] >gi|20147211|gb|AAM10321.1|
  misc_feature: GI Number: 50918929; NR Description: putative serine protease [Oryza sativa (japonica cultivar-group)] >gi|14488360|gb|AAK63927.1| putative serine protease [Oryza sativa
  misc_feature: GI Number: 50582703; NR Description: putative serine protease [Oryza sativa (japonica cultivar-group)] >gi|40538972|gb|AAR87229.1| putaive subtilisin-like proteinase
  misc_feature: GI Number: 23296832; NR Description: putative subtilisin serine protease ARA12 [Arabidopsis thaliana] >gi|13430746|gb|AAK25995.1| putative subtilisin serine protease ARA12 [Arabidopsis thaliana] >gi|9758435|dbj|BAB09021.1|
GCACGAGACCATTACCTAGAACATCCTAATCGAAAAAGCCCCATCATACTCATTCATATTATAAGGCGCGAATCTATCCATCTATCTAATCTACTTACGCACGAACATGCGTAACATCGGCATGCTGCGGGCGCTGGTCCTGGCGCTCGCGGTGGCCGCCGCCGCCGCCGCCGAGAAGAGGAGGACGTACATCGTCCACATGGCCAAGTCGGCGATGCCGGCCGAGTACGCGGACCACGCCGAGTGGTACGGCGCATCGCTGCGCTCCGTGTCCGCCTCAGCCTCCGCCGCCAAGATGCTCTACGCGTACGACACCGTCCTGCACGGTTTCTCCGCGCGCCTCACGCCGCANGAGGCCAGCGACCTGGCGTCCGCCGAGGGGGTGCTCGCCGTCAACCCGGAGGCGCGGTACGAGCTGCACACCACGCGGACGCCCGAGTTCCTGGGCATCGCCGGCCAGGGCCTGTCCCCGCAGTCCGGCACGGCGGGCGACGTCGTCGTCGGCGTGCTCGACACGGGCGTCTGGCCCGAGAGCAAGAGCTACGACGACNCCGGCCTCGCCGAGGTGCCCGCGTGGTGGAAGGGCCAGTGCNAGGCGGGACCCGGCTTCGACGCCTCCACCGCCTGCAACCGCAAGCTCGTCGGCGCCAGGTTCTTCAACAAGGGCTACGAGGCCGCCATGGGCCCCATGGACACCGACCGGGAGTCCCGGTCCCCGCTCGACGACGACGGCCACGGCACGCACACCAGCTCCACGGCCGCCGGCGCCGCCGTGCCGGGTGCCAGCCTCTTCGGCTTCGCCGCGGGCACGGCGCGCGGCATGGCGCCCCGGGCGCGCGTCGCCGCCTACAAGGTGTGCTGGCTCGGCGGCTGCTTCAGCTCCGACATCCTCGCGGGCATGGACGCCGCCGTCGCCGACGGCTGCGGCGTGCTCTCGCTCTCGCTGGGCGGCGGCGCCGCCGACTACTCGCGCGACAGCGTCGCCATCGGCGCCTTCGCCGCCACGGAGCAGAACGTCCTCGTCTCCTGCTCGGCCGGGAACGCCGGCCCCGGGAGCTCCACGCTGTCCAACGTGGCGCCGTGGATCACCACCGTGGGCGCCGGCACGCTCGACCGCGACTTCCCGGCCTACGTCGTGCTCGGCGACGGGAAGAACTACACGGGCGTCTCGCTCTACGCCGGGAAGCCGCTGCCCAGCGCCCCGATCCCCATCGTGTACGCGGCCAACGCCTCCAACTCCACCGCGGGGAACCTGTGCATGCCCGGAACCCTCGTGCCGGAGAAGGTGGCCGGCAAGATCGTCGTGTGCGACCGCGGCGTCAGCGCGCGCGTCCAGAAGGGCCTCGTCGTGCGCGACGCGGGCGGCGCCGGCATGGTGCTGTCCAACACGGCCGCCAACGGCCAGGAGCTCGTCGCCGACGCGCACCTCCTGCCCGCCGCCGGCGTCGGCGAGAGGGAAGGCNCGGCGATCAAGTCGTACGTGGCCTCCGCCACGAACCCCACGACGACGGTCGTGGTCGCCGGGACGGAGGTGGGCGTGCGCCCCTCGCCGGTGGTGGCGGCGTTCTCGTCGCGCGGGCCCAACATGGTGACGCCGGAGATCCTGAAGCCGGACATGATCGCGCCGGGGGTGAACATCCTGGCGTCGTGGACGGGCAAGGCCGGGCCGACGGGCCTCGCCGCCGACACCCGCCGCGTGGGCTTCAACATCATCTCCGGCACGTCCATGTCGTGCCCGCACGTGAGCGGGCTGGCGGCGCTGCTCCGGAGCGCGCACCCGGAGTGGAGCCCCGCCGCCGTGCGCTCGGCGCTCATGACCACAGCCTACGCCAGCTACTCCGGCGGGTCGTCGCTGCTGGACGCGGCGACGGGCGGGATGGCCACGCCGTTNNANTACGGCGCGGGGCACGTGGACCCCGCGCGGGCGCTGGACCCGGGGCTCGTCTACGACCTGGGCACCCGCGACTACGTGGACTTCTTGTGCGCGCTCAAGTACAGCTCCACCATGATCGCCGCCGTGGCGCGGAGCCGGGAGTACGCGTGCGCCGAGAACAAGACCTACTCCGTGGGCGCCCTCAACTACCCGTCCTTCTCGGTGGCCTACTCGACGGCCAACGGCGACGGCGGCGGGGACTCGGCNNCCGTGACACACACGCGGACGCTGACCAACGTGGGCGGGGCGGGCACGTACAAGGCGTCCACGTCGCTCGCCGCTGCCAAGGGCGTGGCCGTGGACGTGGAGCCGGCGGAGCTGGAGTTCACGTCGGTGGGGGAGAAGAAGAGCTACACGGTGAGGTTCACGTCCAAGTCGCAGCCGTCGGGCACCGCCGGTTTCGGGCGGCTCGTGTGGTCGGACGGGAAGCACAGCGTGGCCAGCCCGATAGCGTTCACGTGGACCTGAACCTGATGGACGGATGGATTATACCATACGACAGTGGTTTTTGGCGCCTCAGCCTCAAAGAAAGGCCCATAATCCATCATCCATGTGACGGCCTCGTTCCCTACACTACGCAGTCAAAAGGGCCGAAGTGTAGGGTGGGAAGGTTTGGAGGGGGTACGGTGCAAATTGGAGGTTTCTTCTGTGTTGCTATTATTACTACTAATAAGGTCATTAATCCTATCAGCGTCCGTAGGTTGTGATTTTTGGATGGAAATGGGATCGGGGTGGACGGTTGGATGGAGATTGATGGTGCTTGGTTGATTGGAATGGAATTATTAGAGAGGAGAAGGTTTTTAGCTT

SEQ ID NO: 1235 - DNA, 1153 bp, Zea mays
  misc_feature (1)..(1153): Ceres cDNA ID no. 12417770
  misc_feature (1)..(1153): Ceres CLONE  ID no. 381190
  misc_feature (1)..(1153): Also known as  Ceres CDNA ID no. 23800520
attaaaaaaaatcttcagaaaaaaaaagagaaaatcttcaatatctgcctgctcctcgtctccacgactccacctggaccgctggacctcacgccgccggcaaacatgctgatttctccaagacttgcagcaccggccgcctcccggacctccccctccccctctctccccaccaccacgcccacacgtccaggtatccgcggtcggaggcgaagcggtttcgacgcaccggtcgacgcggcatcccttcgccacggcgaccgtacccgcccggcgctccgcttcacataccccgcaccctccgcctctgtcacgactaccagctcaccggagcccatcgattgccgattggacagcgatgagctcgggcggctgtaccgagaacacaaccctgaggccgccgttagcttactcgacgaaatgctccaacgaggcagcgccgaacaactcgagccggaggaacaggccgcactcctccaggtctgcgccgacacgtggtcgctgccctcgctcaggcgcgcccaccgcctgctcacttccacgtcggggtccgcgattcccgcgcccgtcctgcacaggatcgccacgctgtacctcaagctcggcgcccgcggcgacgcgcggcgggtcctcgaggagcgtacaaggcggcgtccggcgagggaggacgacgcggcggtccaggccaagcggcgagaggcgtacactaaggtgcgggagctccacgcgcagatccgtgcggcagggtacgtgccggacacgcgctacgtgctccacgacatcgacgaggacgccaaggcccgcgcgctcatgtaccacagcgagcgcctggccatcgccttcgggctggtgagcacgccgcccgggacgccgctccgcgtcatgaagaacctccgcatctgcggcgactgccacaacgccgtcaagctcattgccaaggtcgccggccgcgagatcgtcgtcagggacaacaagcgcttccaccatttcaaggacggcgcctgctcctgcggagactactggtgaggaagccttcacagctagcacgcacaaaggttacattatccataaaatgtttgtaaattcgtaacacttgttagtggcgagagaaggatcaaagaattggttgagccaacttgtagaagcattggcc

SEQ ID NO: 1236 - protein, 1153 aa, Zea mays
  misc_feature: PFam Name: FBA_1; PFam Description: F-box associated
  misc_feature: PFam Name: Pkinase; PFam Description: Protein kinase domain
  misc_feature: PFam Name: PPR; PFam Description: PPR repeat
  misc_feature: GI Number: 5668803; NR Description: F16N3.14 [Arabidopsis thaliana] >gi|25405224|pir||D96516 F16N3.14 [imported] -
  misc_feature: GI Number: 15220259; NR Description: lipoyltransferase,
  misc_feature: GI Number: 34897884; NR Description: Similar to Arabidopsis thaliana DNA chromosome 4, BAC clone F4I10; vegetative storage protein. (AL035525) [Oryza sativa (japonica cultivar-group)] >gi|7363286|dbj|BAA93030.1| Similar to storage protein.
  misc_feature: GI Number: 20197649; NR Description: putative
  misc_feature: GI Number: 50941233; NR Description: putative pentatricopeptide (PPR) repeat-containing protein [Oryza sativa (japonica cultivar-group)] >gi|27817913|dbj|BAC55678.1| putative pentatricopeptide (PPR) repeat-containing protein [Oryza sativa
ATTAAAAAAAATCTTCAGAAAAAAAAAGAGAAAATCTTCAATATCTGCCTGCTCCTCGTCTCCACGACTCCACCTGGACCGCTGGACCTCACGCCGCCGGCAAACATGCTGATTTCTCCAAGACTTGCAGCACCGGCCGCCTCCCGGACCTCCCCCTCCCCCTCTCTCCCCACCACCACGCCCACACGTCCAGGTATCCGCGGTCGGAGGCGAAGCGGTTTCGACGCACCGGTCGACGCGGCATCCCTTCGCCACGGCGACCGTACCCGCCCGGCGCTCCGCTTCACATACCCCGCACCCTCCGCCTCTGTCACGACTACCAGCTCACCGGAGCCCATCGATTGCCGATTGGACAGCGATGAGCTCGGGCGGCTGTACCGAGAACACAACCCTGAGGCCGCCGTTAGCTTACTCGACGAAATGCTCCAACGAGGCAGCGCCGAACAACTCGAGCCGGAGGAACAGGCCGCACTCCTCCAGGTCTGCGCCGACACGTGGTCGCTGCCCTCGCTCAGGCGCGCCCACCGCCTGCTCACTTCCACGTCGGGGTCCGCGATTCCCGCGCCCGTCCTGCACAGGATCGCCACGCTGTACCTCAAGCTCGGCGCCCGCGGCGACGCGCGGCGGGTCCTCGAGGAGCGTACAAGGCGGCGTCCGGCGAGGGAGGACGACGCGGCGGTCCAGGCCAAGCGGCGAGAGGCGTACACTAAGGTGCGGGAGCTCCACGCGCAGATCCGTGCGGCAGGGTACGTGCCGGACACGCGCTACGTGCTCCACGACATCGACGAGGACGCCAAGGCCCGCGCGCTCATGTACCACAGCGAGCGCCTGGCCATCGCCTTCGGGCTGGTGAGCACGCCGCCCGGGACGCCGCTCCGCGTCATGAAGAACCTCCGCATCTGCGGCGACTGCCACAACGCCGTCAAGCTCATTGCCAAGGTCGCCGGCCGCGAGATCGTCGTCAGGGACAACAAGCGCTTCCACCATTTCAAGGACGGCGCCTGCTCCTGCGGAGACTACTGGTGAGGAAGCCTTCACAGCTAGCACGCACAAAGGTTACATTATCCATAAAATGTTTGTAAATTCGTAACACTTGTTAGTGGCGAGAGAAGGATCAAAGAATTGGTTGAGCCAACTTGTAGAAGCATTGGCC

SEQ ID NO: 1237 - DNA, 1742 bp, Zea mays
  misc_feature (1)..(1742): Ceres cDNA ID no. 12418168
  misc_feature (1)..(1742): Ceres CLONE  ID no. 424081
  misc_feature (1)..(1742): Also known as  Ceres CDNA ID no. 23806041
gcacgagaccattacctagaacatcctaatcgaaaagcgcatcgcatcagcgtcaccaataccacgcgagccgtcccccctccttgtccatccccggccggcacgacgaaccgcctgaggagggagcaatagctcggccgctcggggctctcgctcttggctgcgtgtctgaagctgttgatgcgagtgaaggctcggtttccatggctctcatggcggcggggatggacgaccacgacgagtacgccaagctcgtcaggaggatgaacccgcccagggttgtgatcgacaacgaggcctccgacgacgccaccgtgattaaggtagacagcgtcaacagccacggcacgctgctcgccgtcgtccaggtcatcgccgacctcaacctcgtcatccggaaggcatacttctcctccgatggaaactggttcatggacgcgttcaatgtcaccgaccgtgacggcaacaaggttctggacgcctcaaccatctcctacatccagaagacgctggaggtggacgactggtactacccgggggcgcacaacacggtgggcatcgtgccgtcgggggactacacctccatcgagctcacgggcacggaccgcccgggcctgctctccgaggtgtgcgcggtgctcgcggccatgggctacgcggtccagagcgcggagctgtggacgcacaacacgcgcgtggccgccgttgtgcacgtcacggacgccgagactggcggcgccatcgaggactccgcccgcatcgccgacatcagcgcgcgcttgggcaacctgctgcgcgagcacagcgacgtgcgcgctggcggcggcgcgggaagccctggcactccacaaggagcggcggctgcaccagatgatgttcgacgatcggggagtggaaggccacgccgcgaccgcgccgcccgacggctcgctgcggacggaggtgtccgtgacgcatgccgagcgcgggtacaccgccgttgtggtccggtgccgggaccggcccaagctgctgttcgacaccgtgtgcaccatcacggacatgaagtacgtggtgcaccacggcaccgtgagcgctgagcccggcggcggcgcgtaccaggagtactacatccgccacgtcgacggccacgccatccggtgcgaggacgagcagcagcgcctcgtgcggtgcctggctgccgccatcgagcgacgcaccgccgacggacttgagctggaggtgcggacgggagaccgcgcgggcctgctctcggacatcacccgcatcttccgggagaacgggctcaccattcgccgcgccgagatctcgtcctccgacggcgaggccgtggacacgttctacctatccgacccgcaaggcctccccgtggagaccaagaccatcgaggccatccgtgcacaaatcggcgaggccacgctgagggtgaggaacaactcgttcggtaccggggaccacgccgacgtggccggcgctggcacgacggcgttcatcttcgggaacctgtttaagttctacaggccgttccagagcttcagcctcatcaaactctactcgtgatgcgcacttgggtagcaattttttcacatgttttagatagtttttactgtggttagctgttctgctctggagattttccaatagtgtgtaaatatggctatggatgatgatggcgatatatacggatacagtccagtgtaagtatatagttaggcaaggttatgtagctgcattgcatggtt

SEQ ID NO: 1238 - protein, 1742 aa, Zea mays
  misc_feature: PFam Name: ACT; PFam Description: ACT domain
  misc_feature: PFam Name: Peptidase_S8; PFam Description: Subtilase family
  misc_feature: GI Number: 22138098; NR Description: ACR4 [Arabidopsis thaliana] >gi|15221589|ref|NP_177067.1| ACT domain containing
  misc_feature: GI Number: 42572033; NR Description: ACT domain containing
  misc_feature: GI Number: 25370627; NR Description: protein F4N2.2 [imported] - Arabidopsis thaliana >gi|6730631|gb|AAF27052.1| F4N2.2
  misc_feature: GI Number: 50916533; NR Description: putative ACT domain containing protein, ACR4, with alternative splicing forms [Oryza sativa (japonica cultivar-group)] >gi|41469089|gb|AAS07063.1|
  misc_feature: GI Number: 22138100; NR Description: ACR5 [Arabidopsis thaliana] >gi|25370626|pir||F84451 probable uridylyl transferase
GCACGAGACCATTACCTAGAACATCCTAATCGAAAAGCGCATCGCATCAGCGTCACCAATACCACGCGAGCCGTCCCCCCTCCTTGTCCATCCCCGGCCGGCACGACGAACCGCCTGAGGAGGGAGCAATAGCTCGGCCGCTCGGGGCTCTCGCTCTTGGCTGCGTGTCTGAAGCTGTTGATGCGAGTGAAGGCTCGGTTTCCATGGCTCTCATGGCGGCGGGGATGGACGACCACGACGAGTACGCCAAGCTCGTCAGGAGGATGAACCCGCCCAGGGTTGTGATCGACAACGAGGCCTCCGACGACGCCACCGTGATTAAGGTAGACAGCGTCAACAGCCACGGCACGCTGCTCGCCGTCGTCCAGGTCATCGCCGACCTCAACCTCGTCATCCGGAAGGCATACTTCTCCTCCGATGGAAACTGGTTCATGGACGCGTTCAATGTCACCGACCGTGACGGCAACAAGGTTCTGGACGCCTCAACCATCTCCTACATCCAGAAGACGCTGGAGGTGGACGACTGGTACTACCCGGGGGCGCACAACACGGTGGGCATCGTGCCGTCGGGGGACTACACCTCCATCGAGCTCACGGGCACGGACCGCCCGGGCCTGCTCTCCGAGGTGTGCGCGGTGCTCGCGGCCATGGGCTACGCGGTCCAGAGCGCGGAGCTGTGGACGCACAACACGCGCGTGGCCGCCGTTGTGCACGTCACGGACGCCGAGACTGGCGGCGCCATCGAGGACTCCGCCCGCATCGCCGACATCAGCGCGCGCTTGGGCAACCTGCTGCGCGAGCACAGCGACGTGCGCGCTGGCGGCGGCGCGGGAAGCCCTGGCACTCCACAAGGAGCGGCGGCTGCACCAGATGATGTTCGACGATCGGGGAGTGGAAGGCCACGCCGCGACCGCGCCGCCCGACGGCTCGCTGCGGACGGAGGTGTCCGTGACGCATGCCGAGCGCGGGTACACCGCCGTTGTGGTCCGGTGCCGGGACCGGCCCAAGCTGCTGTTCGACACCGTGTGCACCATCACGGACATGAAGTACGTGGTGCACCACGGCACCGTGAGCGCTGAGCCCGGCGGCGGCGCGTACCAGGAGTACTACATCCGCCACGTCGACGGCCACGCCATCCGGTGCGAGGACGAGCAGCAGCGCCTCGTGCGGTGCCTGGCTGCCGCCATCGAGCGACGCACCGCCGACGGACTTGAGCTGGAGGTGCGGACGGGAGACCGCGCGGGCCTGCTCTCGGACATCACCCGCATCTTCCGGGAGAACGGGCTCACCATTCGCCGCGCCGAGATCTCGTCCTCCGACGGCGAGGCCGTGGACACGTTCTACCTATCCGACCCGCAAGGCCTCCCCGTGGAGACCAAGACCATCGAGGCCATCCGTGCACAAATCGGCGAGGCCACGCTGAGGGTGAGGAACAACTCGTTCGGTACCGGGGACCACGCCGACGTGGCCGGCGCTGGCACGACGGCGTTCATCTTCGGGAACCTGTTTAAGTTCTACAGGCCGTTCCAGAGCTTCAGCCTCATCAAACTCTACTCGTGATGCGCACTTGGGTAGCAATTTTTTCACATGTTTTAGATAGTTTTTACTGTGGTTAGCTGTTCTGCTCTGGAGATTTTCCAATAGTGTGTAAATATGGCTATGGATGATGATGGCGATATATACGGATACAGTCCAGTGTAAGTATATAGTTAGGCAAGGTTATGTAGCTGCATTGCATGGTT

SEQ ID NO: 1239 - DNA, 1404 bp, Zea mays
  misc_feature (1)..(1404): Ceres cDNA ID no. 12418197
  misc_feature (1)..(1404): Ceres CLONE  ID no. 385315
  misc_feature (1)..(1404): Also known as  Ceres CDNA ID no. 23805384
gcacgagaccattacctagaacatcctaatcgaaaaagagcacactagcttagctacacacaggccacaggggcacaagaaacacctgccgatcgacggcgatggacttcgacgaccacgacgacggcgacgaggaggagatggcgccgatgccggtgagctccagctacgacgccccgcctctggcagccggcgggtttggtgcaccggcgccgcccaagccgcccggcgagcgcgccaaggccccgggcgggcggtaccgcgagtgcctcaagaaccacgcggtcggcatcgggggccacgccgtggacgggtgcggcgagttcatgccggccggcgaggagggcacgctcgacgcgctccgctgcgccgcgtgcggctgccaccgcaacttccaccgcaaggagtccccggagggctcccccgccgcgctggtcgcctacggaggcggcgccgccacgccgcaccaccaccacttctccccgtactaccgcaccccgggccgggtcgtacttccaccaccatcaccagcagcagcagccgatccacatggccgccgcgggccaccacacgccgcggccgctggcgctgccgtccacgtcccacagctggcgcgacgacggcgacgactacctctccggggggatggcggccgccgggccggtgtcggcgctgggcccgctgggcctgggcggcggcgccgggccctctggctccggcgggtccggcaagaagcggttccgcaccaagttcacccaggagcagaaggacaggatgctggcgttcgcggagcgcgtggggtggcgcatccagaagcacgacgaggccgccgtgcagcagttctgcgacgaggtctgcgtcaagcgccacgtgctcaaggtgtggatgcacaacaacaagcacaccctcggcaagaagccgtaggcgtagctaagcagcaggcagcgtcacaccatgacacccccaccccaacgcgtgtactgtacacacgcaagagccacgcccacgcgcgcatgcatcacacacacacacacagcggttgatcgcagtcgcagatcgatcgacggtggccgtggccagcctctcctccgggtacgggtaggtacacctgcatcctctttgttagcattcggctccggcgccttcgtgccgtggcggccggagtaggttagttgcagtaagtaactcgtagcgaggtgctcgatcgatctttcttgctcggctttattaggccgttcttttttacttctcatttaaccgtacttgctggtgttgtttattaattaattcctgcggcatgggccatttgccggtttgcttggttgttcttggcgttaataattcttcaatggcaaatgtacttggtgttgcgatgccaacaagtgtatctggggattggggctg

SEQ ID NO: 1240 - protein, 1404 aa, Zea mays
  misc_feature: PFam Name: ZF-HD_dimer; PFam Description: ZF-HD protein
  misc_feature: PFam Name: Homeobox; PFam Description: Homeobox domain
  misc_feature: PFam Name: Mucin; PFam Description: Mucin-like glycoprotein
  misc_feature: PFam Name: Cation_efflux; PFam Description: Cation efflux family
  misc_feature: PFam Name: Cupin_1; PFam Description: Cupin
  misc_feature: GI Number: 50900288; NR Description: putative ZF-HD homeobox protein [Oryza sativa (japonica cultivar-group)] >gi|46806323|dbj|BAD17515.1| putative ZF-HD homeobox protein [Oryza
  misc_feature: GI Number: 50946893; NR Description: putative ZF-HD homeobox protein [Oryza sativa (japonica cultivar-group)] >gi|42408573|dbj|BAD09750.1| putative ZF-HD homeobox protein [Oryza
  misc_feature: GI Number: 62733875; NR Description: ZF-HD protein dimerisation region, putative [Oryza sativa (japonica
  misc_feature: GI Number: 13277220; NR Description: ZF-HD homeobox protein
  misc_feature: GI Number: 13277218; NR Description: ZF-HD homeobox protein
GCACGAGACCATTACCTAGAACATCCTAATCGAAAAAGAGCACACTAGCTTAGCTACACACAGGCCACAGGGGCACAAGAAACACCTGCCGATCGACGGCGATGGACTTCGACGACCACGACGACGGCGACGAGGAGGAGATGGCGCCGATGCCGGTGAGCTCCAGCTACGACGCCCCGCCTCTGGCAGCCGGCGGGTTTGGTGCACCGGCGCCGCCCAAGCCGCCCGGCGAGCGCGCCAAGGCCCCGGGCGGGCGGTACCGCGAGTGCCTCAAGAACCACGCGGTCGGCATCGGGGGCCACGCCGTGGACGGGTGCGGCGAGTTCATGCCGGCCGGCGAGGAGGGCACGCTCGACGCGCTCCGCTGCGCCGCGTGCGGCTGCCACCGCAACTTCCACCGCAAGGAGTCCCCGGAGGGCTCCCCCGCCGCGCTGGTCGCCTACGGAGGCGGCGCCGCCACGCCGCACCACCACCACTTCTCCCCGTACTACCGCACCCCGGGCCGGGTCGTACTTCCACCACCATCACCAGCAGCAGCAGCCGATCCACATGGCCGCCGCGGGCCACCACACGCCGCGGCCGCTGGCGCTGCCGTCCACGTCCCACAGCTGGCGCGACGACGGCGACGACTACCTCTCCGGGGGGATGGCGGCCGCCGGGCCGGTGTCGGCGCTGGGCCCGCTGGGCCTGGGCGGCGGCGCCGGGCCCTCTGGCTCCGGCGGGTCCGGCAAGAAGCGGTTCCGCACCAAGTTCACCCAGGAGCAGAAGGACAGGATGCTGGCGTTCGCGGAGCGCGTGGGGTGGCGCATCCAGAAGCACGACGAGGCCGCCGTGCAGCAGTTCTGCGACGAGGTCTGCGTCAAGCGCCACGTGCTCAAGGTGTGGATGCACAACAACAAGCACACCCTCGGCAAGAAGCCGTAGGCGTAGCTAAGCAGCAGGCAGCGTCACACCATGACACCCCCACCCCAACGCGTGTACTGTACACACGCAAGAGCCACGCCCACGCGCGCATGCATCACACACACACACACAGCGGTTGATCGCAGTCGCAGATCGATCGACGGTGGCCGTGGCCAGCCTCTCCTCCGGGTACGGGTAGGTACACCTGCATCCTCTTTGTTAGCATTCGGCTCCGGCGCCTTCGTGCCGTGGCGGCCGGAGTAGGTTAGTTGCAGTAAGTAACTCGTAGCGAGGTGCTCGATCGATCTTTCTTGCTCGGCTTTATTAGGCCGTTCTTTTTTACTTCTCATTTAACCGTACTTGCTGGTGTTGTTTATTAATTAATTCCTGCGGCATGGGCCATTTGCCGGTTTGCTTGGTTGTTCTTGGCGTTAATAATTCTTCAATGGCAAATGTACTTGGTGTTGCGATGCCAACAAGTGTATCTGGGGATTGGGGCTG

SEQ ID NO: 1241 - DNA, 1847 bp, Zea mays
  misc_feature (1)..(1847): Ceres cDNA ID no. 12418322
  misc_feature (1)..(1847): Ceres CLONE  ID no. 469673
  misc_feature (1)..(1847): Also known as  Ceres CDNA ID no. 23806525
gaacgactcgactgtcgactcctgcacaggcaacacctcacctcgatgatgcatccgctccgccgcatcctcgtgctcttcctcgtcggcctcctccccgcggccgcgtggtccttggcaccaccccgcttcccgaggccccaaccccgctcgcggccgggagctaatggggtgggagactacgagtacgagacgcgatacttccggcagcggctggaccacttcagttttccaggggtcggggacgaggacgaggcggcggcgttcttccagcagcggtacctggtgggccgcggcggtgggtgggctggacccggcggccccatcttcttctactgcggcaacgagggcgacatcgcctggttcgccgccaactccggcctcgtctgggaggccgccccacgcttcgccgccctcgtcgtcttcgccgagcatcgctactacggagagtccatgcctttcggtagcaaagccaaggcgtacagcgactccaagtccctggcgtatctcacggccgagcaggcgcttgctgacttcgctgtgctgctcactgacctcaagaggaacctatcggcagagggcagccccgttgtgctctttgggggctcatacggtggaatgctagctgcttggatgagactcaaatatccccatattgctattggggctctcgcatcatcagctccgatcctgcagtttgaggacattgttccttctactatattctatgatctcgtatctgatgattttaggagggaaagtttaagctgttttcttacaataaaaaaactcctggaaagaattagatgaccaagcaaacgagcaagatggtctactgaaactaagtaaaacgttccacctttgccagaccctgaaaacaagtggagacctttcagattggttgagctcagcgtacagttatctggccatggtggattacccacttccatcagaatttctcatgcctttgccagccaatcctattaaagaagtatgcagaaatatcgacagtcaacctaagggtactggtactttggaacgtatatatgcaggagtaaatgtatactacaattatactggcactgttgactgctttgatctaaatgatgatccccatggaatgggtggatgggactggcaggcttgtaccgagatggtaatgccaatgtcttacagtgagcagaggagcatgtatccaccatataaatttgactacacttcctatgctgaggattgcatcaaaagctatggtgtcaggccaaggcctcagtggattacaacagaatttggtgggcataatatcactaaggtcctggaaaattttggtagtaacatcatattcttcaacggacttcttgacccatggagtggcggaggtgtcctgaagaatatatctgagagtgtcgttgctattgtggctccattaggagcacatcacatcgatctgcgcccggcaactccagatgacccggattggctggtggccctgagagaatcagagctggagatcatatctggctggctatgggattactacggggctggaggagcacccttccagcctgtaggtgtcaagggctcctcttcatactgaggaaccgcaccctggctaataattcaaatgcttggtctcagaaataagagggccctgctgcaagtgccaaccaccgttaatgctgctgcggtgctgcgtcatggagaaggaagatcttcatgttgatgatcgggcaccgaattcgctcctgcatcatgtgccatatcagtagcatttggtctgtgtatcaaatgggacatgtacttggctgatgaggtgaggaaaacactggataacgtaacgactctttcgc

SEQ ID NO: 1242 - protein, 1847 aa, Zea mays
  misc_feature: PFam Name: Peptidase_S28; PFam Description: Serine
  misc_feature: GI Number: 18700101; NR Description: AT5g65760/MPA24_11
  misc_feature: GI Number: 22655366; NR Description: At2g24280/F27D4.19 [Arabidopsis thaliana] >gi|16648801|gb|AAL25591.1| At2g24280/F27D4.19 [Arabidopsis thaliana] >gi|30682358|ref|NP_850050.1| serine carboxypeptidase S28 family
  misc_feature: GI Number: 10177334; NR Description: lysosomal Pro-X
  misc_feature: GI Number: 34909860; NR Description: putative Pro-X
  misc_feature: GI Number: 51535425; NR Description: putative prolylcarboxypeptidase isoform 1 [Oryza sativa (japonica
GAACGACTCGACTGTCGACTCCTGCACAGGCAACACCTCACCTCGATGATGCATCCGCTCCGCCGCATCCTCGTGCTCTTCCTCGTCGGCCTCCTCCCCGCGGCCGCGTGGTCCTTGGCACCACCCCGCTTCCCGAGGCCCCAACCCCGCTCGCGGCCGGGAGCTAATGGGGTGGGAGACTACGAGTACGAGACGCGATACTTCCGGCAGCGGCTGGACCACTTCAGTTTTCCAGGGGTCGGGGACGAGGACGAGGCGGCGGCGTTCTTCCAGCAGCGGTACCTGGTGGGCCGCGGCGGTGGGTGGGCTGGACCCGGCGGCCCCATCTTCTTCTACTGCGGCAACGAGGGCGACATCGCCTGGTTCGCCGCCAACTCCGGCCTCGTCTGGGAGGCCGCCCCACGCTTCGCCGCCCTCGTCGTCTTCGCCGAGCATCGCTACTACGGAGAGTCCATGCCTTTCGGTAGCAAAGCCAAGGCGTACAGCGACTCCAAGTCCCTGGCGTATCTCACGGCCGAGCAGGCGCTTGCTGACTTCGCTGTGCTGCTCACTGACCTCAAGAGGAACCTATCGGCAGAGGGCAGCCCCGTTGTGCTCTTTGGGGGCTCATACGGTGGAATGCTAGCTGCTTGGATGAGACTCAAATATCCCCATATTGCTATTGGGGCTCTCGCATCATCAGCTCCGATCCTGCAGTTTGAGGACATTGTTCCTTCTACTATATTCTATGATCTCGTATCTGATGATTTTAGGAGGGAAAGTTTAAGCTGTTTTCTTACAATAAAAAAACTCCTGGAAAGAATTAGATGACCAAGCAAACGAGCAAGATGGTCTACTGAAACTAAGTAAAACGTTCCACCTTTGCCAGACCCTGAAAACAAGTGGAGACCTTTCAGATTGGTTGAGCTCAGCGTACAGTTATCTGGCCATGGTGGATTACCCACTTCCATCAGAATTTCTCATGCCTTTGCCAGCCAATCCTATTAAAGAAGTATGCAGAAATATCGACAGTCAACCTAAGGGTACTGGTACTTTGGAACGTATATATGCAGGAGTAAATGTATACTACAATTATACTGGCACTGTTGACTGCTTTGATCTAAATGATGATCCCCATGGAATGGGTGGATGGGACTGGCAGGCTTGTACCGAGATGGTAATGCCAATGTCTTACAGTGAGCAGAGGAGCATGTATCCACCATATAAATTTGACTACACTTCCTATGCTGAGGATTGCATCAAAAGCTATGGTGTCAGGCCAAGGCCTCAGTGGATTACAACAGAATTTGGTGGGCATAATATCACTAAGGTCCTGGAAAATTTTGGTAGTAACATCATATTCTTCAACGGACTTCTTGACCCATGGAGTGGCGGAGGTGTCCTGAAGAATATATCTGAGAGTGTCGTTGCTATTGTGGCTCCATTAGGAGCACATCACATCGATCTGCGCCCGGCAACTCCAGATGACCCGGATTGGCTGGTGGCCCTGAGAGAATCAGAGCTGGAGATCATATCTGGCTGGCTATGGGATTACTACGGGGCTGGAGGAGCACCCTTCCAGCCTGTAGGTGTCAAGGGCTCCTCTTCATACTGAGGAACCGCACCCTGGCTAATAATTCAAATGCTTGGTCTCAGAAATAAGAGGGCCCTGCTGCAAGTGCCAACCACCGTTAATGCTGCTGCGGTGCTGCGTCATGGAGAAGGAAGATCTTCATGTTGATGATCGGGCACCGAATTCGCTCCTGCATCATGTGCCATATCAGTAGCATTTGGTCTGTGTATCAAATGGGACATGTACTTGGCTGATGAGGTGAGGAAAACACTGGATAACGTAACGACTCTTTCGC

SEQ ID NO: 1243 - DNA, 1557 bp, Zea mays
  misc_feature (1)..(1557): Ceres cDNA ID no. 12418577
  misc_feature (1)..(1557): Ceres CLONE  ID no. 425297
  misc_feature (1)..(1557): Also known as  Ceres CDNA ID no. 23805799
gcacgagaccattacctagaacatcctaatcgaaaaatgaacaatttggcgctctcgatgctctcgccgtcgacctcaggtttcccgccaagtcccctaccctccaaggccgccacgaacgccacagctacccgatgccgcgccgcgccctcgggagacgcctcgctgtgcgccttccgcgcgcaccacagcgccggccacgccctccacactaacccgtctctgatgcccgcgctcgccgcctgcgcgcggctgccctccgccgtggccgaggccgagcagatccacgcactcctcgtcaagtcaggcggctcgcgggctgtctcccacgtccaagccttcacgtccctgattcgcgcctacgcgaggctcggccgcgtgtgcgacgcgcggaaggtgttcgatggaatggccgaccggacggtggtcacctggaacgtgctgcttgatgcgcttatcagagatggcgacttggacgctgcgtgggaggtgtttgtgaaaatgccgcagcgcaatgcggtttcttggaacaccataatttctggttttgcaaggaacgggtgggcgccggtggcagtggacttgtttatcgagatgactgtggcttatggtttagcgccagatgaggccacgatggttggcttcgtgtcggctgttcgggacattggtctacttgcaattgggaagagcgcacacgggtatgttctccgtcgggagttctcacttgatggtcctctcggggttgcactggtcagtatgtacacgaggtgcgggagcatgggtgctgcacacagttgcttcttaagtgtcaccaccaagaatgtggagcattggacctctttgatcgcaggtttcgcagcacatggtcaaccagagaatgccttgaggttgttcgtcgagatgaggcaggtgggcattgagcctaatggtgtcaccttcgtagccgtcttgagtgcctgcagccatggcgggctcgtcgatgagggcttcaagtacttcgacctaatgaggagcatgggcatcaggccgatgatccagcactatggctgcttggttgatctccttggccgtgctgggttcttgaaggaggctttcaatcttgccagcaatctacctgaagatcctggttttgtaatctggagctcgctactagcagcctgccgtagccatggcaacgtcgagatggcagagctcactgcgtcgaagttggcagaggcaaaaccaagtcatggcagctcgtatgtgctgctatcgaacacatatgcacgagcggaacaatgggaggactcgaagaggacgcggaggaggatggaggaacatagagtagccaagaaacctgggctcagctggatagagatagatggaagcgtacattcctttgccactgcagacaagctgcatatagaaagcgagggtatttatcatatgttggaggatttgaaacataatattacatcagctgcatatgaacctgaaccgttcgctatttctgaacaattgtaataaatttttctttggaggaagattatcacttgttaataaaaaatccatcatatc

SEQ ID NO: 1244 - protein, 1557 aa, Zea mays
  misc_feature: PFam Name: PPR; PFam Description: PPR repeat
  misc_feature: GI Number: 50912423; NR Description: pentatricopeptide (PPR) repeat-containing protein-like [Oryza sativa (japonica cultivar-group)] >gi|46390470|dbj|BAD15931.1| pentatricopeptide (PPR) repeat-containing protein-like [Oryza sativa (japonica
  misc_feature: GI Number: 15228829; NR Description: pentatricopeptide (PPR)
  misc_feature: GI Number: 50913181; NR Description: pentatricopeptide (PPR) repeat-containing protein-like [Oryza sativa (japonica cultivar-group)] >gi|46805412|dbj|BAD16914.1| pentatricopeptide (PPR) repeat-containing protein-like [Oryza sativa (japonica
  misc_feature: GI Number: 10177533; NR Description: selenium-binding protein-like [Arabidopsis thaliana] >gi|15239979|ref|NP_201453.1| pentatricopeptide (PPR) repeat-containing protein [Arabidopsis
  misc_feature: GI Number: 56783979; NR Description: pentatricopeptide (PPR) repeat-containing protein -like [Oryza sativa (japonica
GCACGAGACCATTACCTAGAACATCCTAATCGAAAAATGAACAATTTGGCGCTCTCGATGCTCTCGCCGTCGACCTCAGGTTTCCCGCCAAGTCCCCTACCCTCCAAGGCCGCCACGAACGCCACAGCTACCCGATGCCGCGCCGCGCCCTCGGGAGACGCCTCGCTGTGCGCCTTCCGCGCGCACCACAGCGCCGGCCACGCCCTCCACACTAACCCGTCTCTGATGCCCGCGCTCGCCGCCTGCGCGCGGCTGCCCTCCGCCGTGGCCGAGGCCGAGCAGATCCACGCACTCCTCGTCAAGTCAGGCGGCTCGCGGGCTGTCTCCCACGTCCAAGCCTTCACGTCCCTGATTCGCGCCTACGCGAGGCTCGGCCGCGTGTGCGACGCGCGGAAGGTGTTCGATGGAATGGCCGACCGGACGGTGGTCACCTGGAACGTGCTGCTTGATGCGCTTATCAGAGATGGCGACTTGGACGCTGCGTGGGAGGTGTTTGTGAAAATGCCGCAGCGCAATGCGGTTTCTTGGAACACCATAATTTCTGGTTTTGCAAGGAACGGGTGGGCGCCGGTGGCAGTGGACTTGTTTATCGAGATGACTGTGGCTTATGGTTTAGCGCCAGATGAGGCCACGATGGTTGGCTTCGTGTCGGCTGTTCGGGACATTGGTCTACTTGCAATTGGGAAGAGCGCACACGGGTATGTTCTCCGTCGGGAGTTCTCACTTGATGGTCCTCTCGGGGTTGCACTGGTCAGTATGTACACGAGGTGCGGGAGCATGGGTGCTGCACACAGTTGCTTCTTAAGTGTCACCACCAAGAATGTGGAGCATTGGACCTCTTTGATCGCAGGTTTCGCAGCACATGGTCAACCAGAGAATGCCTTGAGGTTGTTCGTCGAGATGAGGCAGGTGGGCATTGAGCCTAATGGTGTCACCTTCGTAGCCGTCTTGAGTGCCTGCAGCCATGGCGGGCTCGTCGATGAGGGCTTCAAGTACTTCGACCTAATGAGGAGCATGGGCATCAGGCCGATGATCCAGCACTATGGCTGCTTGGTTGATCTCCTTGGCCGTGCTGGGTTCTTGAAGGAGGCTTTCAATCTTGCCAGCAATCTACCTGAAGATCCTGGTTTTGTAATCTGGAGCTCGCTACTAGCAGCCTGCCGTAGCCATGGCAACGTCGAGATGGCAGAGCTCACTGCGTCGAAGTTGGCAGAGGCAAAACCAAGTCATGGCAGCTCGTATGTGCTGCTATCGAACACATATGCACGAGCGGAACAATGGGAGGACTCGAAGAGGACGCGGAGGAGGATGGAGGAACATAGAGTAGCCAAGAAACCTGGGCTCAGCTGGATAGAGATAGATGGAAGCGTACATTCCTTTGCCACTGCAGACAAGCTGCATATAGAAAGCGAGGGTATTTATCATATGTTGGAGGATTTGAAACATAATATTACATCAGCTGCATATGAACCTGAACCGTTCGCTATTTCTGAACAATTGTAATAAATTTTTCTTTGGAGGAAGATTATCACTTGTTAATAAAAAATCCATCATATC

SEQ ID NO: 1245 - DNA, 1637 bp, Zea mays
  misc_feature (1)..(1637): Ceres cDNA ID no. 12418899
  misc_feature (1)..(1637): Ceres CLONE  ID no. 383115
  misc_feature (1)..(1637): Also known as  Ceres CDNA ID no. 23808885
  misc_feature (534)..(534): n is a, c, t, g, unknown, or other
  misc_feature (537)..(537): n is a, c, t, g, unknown, or other
  misc_feature (649)..(649): n is a, c, t, g, unknown, or other
  misc_feature (650)..(650): n is a, c, t, g, unknown, or other
  misc_feature (812)..(812): n is a, c, t, g, unknown, or other
  misc_feature (813)..(813): n is a, c, t, g, unknown, or other
  misc_feature (822)..(822): n is a, c, t, g, unknown, or other
  misc_feature (855)..(855): n is a, c, t, g, unknown, or other
gcacgagaccattacctagaacatcctaatcgaaaaccatttcactcgtattctatcagctagctacccactgtcgccaactcgccgcaacaaagaaccaccatcatgcacctgctgatgctcccttggctcgccttcggccacatcgtgccgttcgtgcagctggcgcggaggctgctgtcctccacctcctcctccgtccgcgtcacgttcctcacggccgctggcaacgtcccgcgcgtcgaggccatgctgtcctctccctcgtccaccggcgaggcggccgtcgtcgtgccgctgcgcctgccccacgtgccggggctgcccgaggacgccgccagcacggcggacctctcgcccgagggcgccgagcttcttaaggccgcgctggacgctgcccggccgcagtggccgcgctgctggccgagctccgcccggacgccgtgctgctcgacttcgccaccccgtgggccgccgaggacgccgcggcgctgggcgccaagtcgctccggttcagcgtcttctccgccgtcncangcgcctacctctccgtccccgcgcgccgccccgacgcggcgggccagctgccgtcggcgcgcgacctcatgtccgcccctgccggcttccccggctcctccccgctcgccgnngccggcgtcccggcgtaccaggcagccgacttcacctacatgttcaccagcttcggcggccagccctgcgtccacgaacgcgtggtggccggcatccgggcctgcgacggcctcgtgctcaagacctgcgccgagatggagggtgcctacatcgactacctnnccgcgcagnttcgcaagcccgtgctcgtggcggggcccctgntgcctggcccgccggcgggagatctcgacgaccactgggccacctggttgtccgcgttcccggacggcgccgtcgtcttcgcctcgttcggcagcgagacgttcctgccgcccgccgcggccacggagctgctcctggggctcgaggccacgggtcgcccgttcctcgccgtgctcaactccccggacggcgccgtcccgccgccggggttcgcggagagggtgtcggggagagggctcgttcatgccgggtgggtgccgcagcagcacatcctgcgccaccggagcgtggggtgctacctcacccacgccggcttcagctccgtcgtggagggcctcgtcgccggctgccgcctcgtactgctgcccatgaagggcgaccagttcctcaacgcggcgctgttcgcgcgcgagctccgcgtgggcgtggaggtggcgcgccgcgacgacgacggctggttcgggcgccaggacgtgtgcgacgcgatcgccgcagcggtggcggacgggggggaaagggacgccaggaagtgggccgactttttgacggacgacggcgtgcaagggaggttcgccgacgagttcgtccggcagctcagggagctcgtcggcgcggcctccagttgatttgagcgctcgacgacgtttctcgtggaacacgcggcaagtgcgattattgaagaaataattccacccacctatttatttgtacattaataacattgcccacccacctgtactgtatcattattgaagaaataattccagccatggatattgcac

SEQ ID NO: 1246 - protein, 1637 aa, Zea mays
  misc_feature: PFam Name: UDPGT; PFam Description: UDP-glucoronosyl and
  misc_feature: PFam Name: Pyr_redox_2; PFam Description: Pyridine
  misc_feature: PFam Name: Glyco_transf_28; PFam Description:
  misc_feature: PFam Name: FH2; PFam Description: Formin Homology 2 Domain
  misc_feature: PFam Name: Pkinase; PFam Description: Protein kinase domain
  misc_feature: GI Number: 397567; NR Description: UDP rhamnose: anthocyanidin-3-glucoside rhamnosyltransferase [Petunia x hybrida] >gi|480314|pir||S36655 UDP rhamnose-anthocyanidin-3-glucoside
  misc_feature: GI Number: 2501497; NR Description: FLAVONOL 3-O-GLUCOSYLTRANSFERASE (UDP-GLUCOSE FLAVONOID
  misc_feature: GI Number: 22759895; NR Description: rhamnosyl transferase
  misc_feature: GI Number: 454253; NR Description: anthocyanin: rhamnosyltransferase [Petunia x hybrida] >gi|454245|emb|CAA50376.1| anthocyanin 3 glucoside: rhamnosyltransferase [Petunia x hybrida] >gi|7433907|pir||S60290
  misc_feature: GI Number: 23955910; NR Description: UDP-glucosyltransferase
GCACGAGACCATTACCTAGAACATCCTAATCGAAAACCATTTCACTCGTATTCTATCAGCTAGCTACCCACTGTCGCCAACTCGCCGCAACAAAGAACCACCATCATGCACCTGCTGATGCTCCCTTGGCTCGCCTTCGGCCACATCGTGCCGTTCGTGCAGCTGGCGCGGAGGCTGCTGTCCTCCACCTCCTCCTCCGTCCGCGTCACGTTCCTCACGGCCGCTGGCAACGTCCCGCGCGTCGAGGCCATGCTGTCCTCTCCCTCGTCCACCGGCGAGGCGGCCGTCGTCGTGCCGCTGCGCCTGCCCCACGTGCCGGGGCTGCCCGAGGACGCCGCCAGCACGGCGGACCTCTCGCCCGAGGGCGCCGAGCTTCTTAAGGCCGCGCTGGACGCTGCCCGGCCGCAGTGGCCGCGCTGCTGGCCGAGCTCCGCCCGGACGCCGTGCTGCTCGACTTCGCCACCCCGTGGGCCGCCGAGGACGCCGCGGCGCTGGGCGCCAAGTCGCTCCGGTTCAGCGTCTTCTCCGCCGTCNCANGCGCCTACCTCTCCGTCCCCGCGCGCCGCCCCGACGCGGCGGGCCAGCTGCCGTCGGCGCGCGACCTCATGTCCGCCCCTGCCGGCTTCCCCGGCTCCTCCCCGCTCGCCGNNGCCGGCGTCCCGGCGTACCAGGCAGCCGACTTCACCTACATGTTCACCAGCTTCGGCGGCCAGCCCTGCGTCCACGAACGCGTGGTGGCCGGCATCCGGGCCTGCGACGGCCTCGTGCTCAAGACCTGCGCCGAGATGGAGGGTGCCTACATCGACTACCTNNCCGCGCAGNTTCGCAAGCCCGTGCTCGTGGCGGGGCCCCTGNTGCCTGGCCCGCCGGCGGGAGATCTCGACGACCACTGGGCCACCTGGTTGTCCGCGTTCCCGGACGGCGCCGTCGTCTTCGCCTCGTTCGGCAGCGAGACGTTCCTGCCGCCCGCCGCGGCCACGGAGCTGCTCCTGGGGCTCGAGGCCACGGGTCGCCCGTTCCTCGCCGTGCTCAACTCCCCGGACGGCGCCGTCCCGCCGCCGGGGTTCGCGGAGAGGGTGTCGGGGAGAGGGCTCGTTCATGCCGGGTGGGTGCCGCAGCAGCACATCCTGCGCCACCGGAGCGTGGGGTGCTACCTCACCCACGCCGGCTTCAGCTCCGTCGTGGAGGGCCTCGTCGCCGGCTGCCGCCTCGTACTGCTGCCCATGAAGGGCGACCAGTTCCTCAACGCGGCGCTGTTCGCGCGCGAGCTCCGCGTGGGCGTGGAGGTGGCGCGCCGCGACGACGACGGCTGGTTCGGGCGCCAGGACGTGTGCGACGCGATCGCCGCAGCGGTGGCGGACGGGGGGGAAAGGGACGCCAGGAAGTGGGCCGACTTTTTGACGGACGACGGCGTGCAAGGGAGGTTCGCCGACGAGTTCGTCCGGCAGCTCAGGGAGCTCGTCGGCGCGGCCTCCAGTTGATTTGAGCGCTCGACGACGTTTCTCGTGGAACACGCGGCAAGTGCGATTATTGAAGAAATAATTCCACCCACCTATTTATTTGTACATTAATAACATTGCCCACCCACCTGTACTGTATCATTATTGAAGAAATAATTCCAGCCATGGATATTGCAC

SEQ ID NO: 1247 - DNA, 1542 bp, Zea mays
  misc_feature (1)..(1542): Ceres cDNA ID no. 12418920
  misc_feature (1)..(1542): Ceres CLONE  ID no. 384382
  misc_feature (1)..(1542): Also known as  Ceres CDNA ID no. 23808936
gcacgagaccattacctagaacatcctaatcgaaaaacctaactagttgctacctagcctcgaccaggtggagcaatgggctccacggcggcggcgccctgccacatcgtggccgtgccgtacccgggccgtggtcacgtcaacgcgatgctgaacctatgccgcctcctggcagctcgagacggcgtcaccatcaccatcatcgtgaccgaggagtggctcagcctcctcggcgccccggcggcgctgccggacctcggcctgcgcgttcgctttgaggccattccaaacgtgatcccctccgagcacggccgcgccaacgacatggtcggcttcatggaggccgtgtacaccaagatggcgtcgccgttcgagcagcttctcgacaggctcgcgccgccggcgcccgcggctattgtggccgacatgttcgtgccgtggaccgtaggcgtcggcgagcggaggggcgtgcctgtgtgcatcatgtgcccgattagcgccaccatgttcgcggtgcagtacaacttccacctgctaccacccgcggcggccggcggcggcgcgtctccggatatcactggttcttgttttgttgaaaactacattcctggcacgaaatcaatcaggttcgccgatcttgcgcctacacacaccgatgcgttacttctagacaaaatccttgaagcccactcctctgtaaagaaagcacaatgtatcgtcttcaccaccttccaagagctcgagagcgacgccatcggcgctatgaggcaaaactgcccagtgtacgcagttgggccctgcgtccccttcatggcactgcaagagcacaaggccagcccagacggtgacgactacatggcgtggctggacgcacagcccgcgggctcggtgatctacgtctcgctcggcagcttcctctcggtgtccgccgcccagttcgacgagatcgccgctggcctggccgagagcaaggccaggtttctgtgggtgctccgcgacgccgacgcatgctcccgcgtgcgaggcctgatccgcgatcccgacgccggcctcatcgtgccatggacgaaccagctgagggtgctgtgccacccttcggtcggggggttcttcacccactgcggcatgaactcgacgctcgaggcggtgtacgccggcgtgcccatgctcaccctgcccatcgcgttcgaccagccgaccaatagccggctcgtcaccgaggtgtggaagaatggcattggcctcagggacatggcccgcgccgacggcgtcatcgggagaggtgagatagcctcggccgtggacaggctgatgctccctgacgcggcggagttccaggacatgaggaagcgagtgacactgtggaaggacgcggctcggactgcgtctgaagagggtggatcctcgtggaaagatgttacgtctttcatcaacttcgtttcacgttgagatctccgaatgtttacggagtcagctgtagtgaattgtgatcgattctcacggagttagtgtgatatctgaatgttagcagaatctttcggc

SEQ ID NO: 1248 - protein, 1542 aa, Zea mays
  misc_feature: PFam Name: UDPGT; PFam Description: UDP-glucoronosyl and
  misc_feature: GI Number: 34909048; NR Description: putative glucosyltransferase [Oryza sativa (japonica cultivar-group)] >gi|20804579|dbj|BAB92271.1| putative glucosyltransferase [Oryza
  misc_feature: GI Number: 55296827; NR Description: putative UDP-glucose:salicylic acid glucosyltransferase [Oryza sativa
  misc_feature: GI Number: 34909046; NR Description: putative glucosyltransferase [Oryza sativa (japonica cultivar-group)] >gi|20804578|dbj|BAB92270.1| putative glucosyltransferase [Oryza
  misc_feature: GI Number: 30387551; NR Description: At2g30140 [Arabidopsis thaliana] >gi|20260554|gb|AAM13175.1| putative glucosyltransferase [Arabidopsis thaliana] >gi|3150406|gb|AAC16958.1| putative glucosyltransferase
  misc_feature: GI Number: 3150405; NR Description: putative glucosyltransferase [Arabidopsis thaliana] >gi|15227717|ref|NP_180576.1| UDP-glucoronosyl/UDP-glucosyl transferase family protein [Arabidopsis thaliana]
GCACGAGACCATTACCTAGAACATCCTAATCGAAAAACCTAACTAGTTGCTACCTAGCCTCGACCAGGTGGAGCAATGGGCTCCACGGCGGCGGCGCCCTGCCACATCGTGGCCGTGCCGTACCCGGGCCGTGGTCACGTCAACGCGATGCTGAACCTATGCCGCCTCCTGGCAGCTCGAGACGGCGTCACCATCACCATCATCGTGACCGAGGAGTGGCTCAGCCTCCTCGGCGCCCCGGCGGCGCTGCCGGACCTCGGCCTGCGCGTTCGCTTTGAGGCCATTCCAAACGTGATCCCCTCCGAGCACGGCCGCGCCAACGACATGGTCGGCTTCATGGAGGCCGTGTACACCAAGATGGCGTCGCCGTTCGAGCAGCTTCTCGACAGGCTCGCGCCGCCGGCGCCCGCGGCTATTGTGGCCGACATGTTCGTGCCGTGGACCGTAGGCGTCGGCGAGCGGAGGGGCGTGCCTGTGTGCATCATGTGCCCGATTAGCGCCACCATGTTCGCGGTGCAGTACAACTTCCACCTGCTACCACCCGCGGCGGCCGGCGGCGGCGCGTCTCCGGATATCACTGGTTCTTGTTTTGTTGAAAACTACATTCCTGGCACGAAATCAATCAGGTTCGCCGATCTTGCGCCTACACACACCGATGCGTTACTTCTAGACAAAATCCTTGAAGCCCACTCCTCTGTAAAGAAAGCACAATGTATCGTCTTCACCACCTTCCAAGAGCTCGAGAGCGACGCCATCGGCGCTATGAGGCAAAACTGCCCAGTGTACGCAGTTGGGCCCTGCGTCCCCTTCATGGCACTGCAAGAGCACAAGGCCAGCCCAGACGGTGACGACTACATGGCGTGGCTGGACGCACAGCCCGCGGGCTCGGTGATCTACGTCTCGCTCGGCAGCTTCCTCTCGGTGTCCGCCGCCCAGTTCGACGAGATCGCCGCTGGCCTGGCCGAGAGCAAGGCCAGGTTTCTGTGGGTGCTCCGCGACGCCGACGCATGCTCCCGCGTGCGAGGCCTGATCCGCGATCCCGACGCCGGCCTCATCGTGCCATGGACGAACCAGCTGAGGGTGCTGTGCCACCCTTCGGTCGGGGGGTTCTTCACCCACTGCGGCATGAACTCGACGCTCGAGGCGGTGTACGCCGGCGTGCCCATGCTCACCCTGCCCATCGCGTTCGACCAGCCGACCAATAGCCGGCTCGTCACCGAGGTGTGGAAGAATGGCATTGGCCTCAGGGACATGGCCCGCGCCGACGGCGTCATCGGGAGAGGTGAGATAGCCTCGGCCGTGGACAGGCTGATGCTCCCTGACGCGGCGGAGTTCCAGGACATGAGGAAGCGAGTGACACTGTGGAAGGACGCGGCTCGGACTGCGTCTGAAGAGGGTGGATCCTCGTGGAAAGATGTTACGTCTTTCATCAACTTCGTTTCACGTTGAGATCTCCGAATGTTTACGGAGTCAGCTGTAGTGAATTGTGATCGATTCTCACGGAGTTAGTGTGATATCTGAATGTTAGCAGAATCTTTCGGC

SEQ ID NO: 1249 - DNA, 1300 bp, Zea mays
  misc_feature (1)..(1300): Ceres cDNA ID no. 12418940
  misc_feature (1)..(1300): Ceres CLONE  ID no. 399052
  misc_feature (1)..(1300): Also known as  Ceres CDNA ID no. 23805613
acggcacggccacagctgactgactcctcctgcgttggctgataatcatggctagagctccgctgctcctcgcgctactgtgcgcgtgcgccgccaatgcggcggggaggaagatggtcggcgtgtacgagctcaaggcgggcgatttctccgtcggcgtcaccaactggggcgccaccatcacctccgttgtgctgccggactccaaaggggatttgtctgacgtcgtgcttggctacgacaccattggaggatacgtgagtggtaaaagctacttcggagcgcttgtcggacgagtggccaacaggatcgccaacgcgcgcttcgtgctcgacggaaaggcttaccatcttttcaagaacgatggcaacaacacgcttcatggtggccatagggggttcagtcaggttgtatggacggttaaagagttcgtcggtggcggtgactcgccctacatcacgttgtactaccacagcttcgatggagaacaaggtttcccaggcgacctggacgtgtacgtgacgtaccagctggcggccccctacgtgctgcgggtgcacatgaacgcgacggccgtgaacaaggcgaccccggtgaacctggcgcagcacacgtactggaacctgggcgggcagggcagcggcgacgtcctccgcaacacggtgcagctgttcgcgtcccggtacacgcccgtgggcggcggcctcatcccgacgggcgcggtggcgcccgtggccggcacgccctacgacttcctcgcgccggccgcggtgggctcgcgcatccgccaggtctccggcggcaaggccggcgtctacggctacgacaccaactacgccgtggacggggagcccggcgcgctgcggaaggtggccgtcgtccgggacggcgcgtccggccgggcgctggagctgtgggccaaccagcctggggtgcagttctacacgggcaacttcctccaggacgtcaaggggaagggcggcaaggtgtaccagcagtacggcgcgctgtgcctcgagacgcaggggttcccggacgccgtcaaccaccctaatttcccctcccagatcgtcaggccggggcaggtgtacaagcacgacatggtgttcaagttctccttctagctgatctgtataggcaacaccctggtccctggctaatcaatctactagtacctgttatgattgccactggcaaagtggcaactgggccttattgggactggagagacacgttacatgattccaagtcaatttgttttgcggaccgtaattaatgtttatcgcaaagattatgtatt

SEQ ID NO: 1250 - protein, 1300 aa, Zea mays
  misc_feature: PFam Name: Aldose_epim; PFam Description: Aldose 1-epimerase
  misc_feature: PFam Name: Peptidase_S8; PFam Description: Subtilase family
  misc_feature: PFam Name: Glutenin_hmw; PFam Description: High molecular
  misc_feature: GI Number: 50909807; NR Description: putative non-cell-autonomous protein pathway2; plasmodesmal receptor [Oryza sativa (japonica cultivar-group)] >gi|50725243|dbj|BAD34245.1| putative non-cell-autonomous protein pathway2; plasmodesmal
  misc_feature: GI Number: 50920801; NR Description: putative aldose 1-epimerase [Oryza sativa (japonica cultivar-group)] >gi|40882679|gb|AAR96220.1| putative aldose 1-epimerase [Oryza
  misc_feature: GI Number: 15824567; NR Description: non-cell-autonomous
  misc_feature: GI Number: 15824565; NR Description: non-cell-autonomous
  misc_feature: GI Number: 21537069; NR Description: aldose 1-epimerase-like
ACGGCACGGCCACAGCTGACTGACTCCTCCTGCGTTGGCTGATAATCATGGCTAGAGCTCCGCTGCTCCTCGCGCTACTGTGCGCGTGCGCCGCCAATGCGGCGGGGAGGAAGATGGTCGGCGTGTACGAGCTCAAGGCGGGCGATTTCTCCGTCGGCGTCACCAACTGGGGCGCCACCATCACCTCCGTTGTGCTGCCGGACTCCAAAGGGGATTTGTCTGACGTCGTGCTTGGCTACGACACCATTGGAGGATACGTGAGTGGTAAAAGCTACTTCGGAGCGCTTGTCGGACGAGTGGCCAACAGGATCGCCAACGCGCGCTTCGTGCTCGACGGAAAGGCTTACCATCTTTTCAAGAACGATGGCAACAACACGCTTCATGGTGGCCATAGGGGGTTCAGTCAGGTTGTATGGACGGTTAAAGAGTTCGTCGGTGGCGGTGACTCGCCCTACATCACGTTGTACTACCACAGCTTCGATGGAGAACAAGGTTTCCCAGGCGACCTGGACGTGTACGTGACGTACCAGCTGGCGGCCCCCTACGTGCTGCGGGTGCACATGAACGCGACGGCCGTGAACAAGGCGACCCCGGTGAACCTGGCGCAGCACACGTACTGGAACCTGGGCGGGCAGGGCAGCGGCGACGTCCTCCGCAACACGGTGCAGCTGTTCGCGTCCCGGTACACGCCCGTGGGCGGCGGCCTCATCCCGACGGGCGCGGTGGCGCCCGTGGCCGGCACGCCCTACGACTTCCTCGCGCCGGCCGCGGTGGGCTCGCGCATCCGCCAGGTCTCCGGCGGCAAGGCCGGCGTCTACGGCTACGACACCAACTACGCCGTGGACGGGGAGCCCGGCGCGCTGCGGAAGGTGGCCGTCGTCCGGGACGGCGCGTCCGGCCGGGCGCTGGAGCTGTGGGCCAACCAGCCTGGGGTGCAGTTCTACACGGGCAACTTCCTCCAGGACGTCAAGGGGAAGGGCGGCAAGGTGTACCAGCAGTACGGCGCGCTGTGCCTCGAGACGCAGGGGTTCCCGGACGCCGTCAACCACCCTAATTTCCCCTCCCAGATCGTCAGGCCGGGGCAGGTGTACAAGCACGACATGGTGTTCAAGTTCTCCTTCTAGCTGATCTGTATAGGCAACACCCTGGTCCCTGGCTAATCAATCTACTAGTACCTGTTATGATTGCCACTGGCAAAGTGGCAACTGGGCCTTATTGGGACTGGAGAGACACGTTACATGATTCCAAGTCAATTTGTTTTGCGGACCGTAATTAATGTTTATCGCAAAGATTATGTATT

SEQ ID NO: 1251 - DNA, 1270 bp, Zea mays
  misc_feature (1)..(1270): Ceres cDNA ID no. 12418955
  misc_feature (1)..(1270): Ceres CLONE  ID no. 380068
  misc_feature (1)..(1270): Also known as  Ceres CDNA ID no. 23802268
cttcaaggggatgccgctttccattgctgggtggaaggaggccttcttcttcctcaagtcgccgactccgtggccgtgccccgtgaagtggggcgggctgtccacgggctccactgttgagccggcgctcaccagagaggagcagagcgtggccaagaagctgctccgtgttcacggcgcggcagtcgatatcatgacgtatctttccgagagcaatcttgctgctgcaacgattgctggttcatcagcgaagccgccgccgccgccgccgattggtactacaagcagtgctagtgccaaaggaatggacccttgcgtctacgacatgatgaagaatctgcgggcggcaaaggccgcgcaggcgtcgggagtgacggtgaagactgagcccagcagcgatacgccgtcgtcctgtaaaaagaggaaggtggtggaggatgccacgaaacaggatccgccgcgccccgagccaccgcattattcccctcctggcttcttctccgcgcacaagtcaccgaaggttacccgtgagcctgacggcggcgccacctccgactgggagcgggcgcggcggatgctacagagcatcgtcacgccggcgctggagcagacgttctcggtggcgaagccctccgacgtcatcgcctcgagctacacgacagcgctacaggccgcgaactacgcgtcgttctcgctgggctacgcgctggagctcgaggagaagctcgcggcaagggagcgcgaggcggacgcgctgcggcgggagctgtcgcaggccaaggtcgagctcgccggcgcgaagaaggcggctgcggaggaggtgaggggcgccagggaggctgccgtgcgcgacttccggggctccacggagcaggtggtccggttcgcggagcacgcgttggccgggtacgagaagggaatggatgatatgaagcgagccgtgctgcgcaggtacccgcacctcgacccggagcagctcgtcgtgccggcggacggcggcggagctcagtaattagctcgtggcgtcgaatcgacgcgataagattttttggcgtgccggtcccctaactaacctcaggatcaggcagcgtatcagacgttaaacttgcatatatatatatatatatttctgtacgtgcatgatcttgtggttttcagtggtctacttggctggatgcaaaatatgaccaacagacattatcagtggtctacttattggactatggaaaacagacattgccctattgttttactttgaactcctttcttt

SEQ ID NO: 1252 - protein, 1270 aa, Zea mays
  misc_feature: GI Number: 34898444; NR Description: Similar to Arabidopsis thaliana chromosome II BAC F13B15 genomic sequence, putative non-LTR retroelement reverse transcriptase. (AC006300) [Oryza
  misc_feature: GI Number: 34898446; NR Description: Similar to Zea mays putative AC9 transposase. (P03010) [Oryza sativa (japonica
CTTCAAGGGGATGCCGCTTTCCATTGCTGGGTGGAAGGAGGCCTTCTTCTTCCTCAAGTCGCCGACTCCGTGGCCGTGCCCCGTGAAGTGGGGCGGGCTGTCCACGGGCTCCACTGTTGAGCCGGCGCTCACCAGAGAGGAGCAGAGCGTGGCCAAGAAGCTGCTCCGTGTTCACGGCGCGGCAGTCGATATCATGACGTATCTTTCCGAGAGCAATCTTGCTGCTGCAACGATTGCTGGTTCATCAGCGAAGCCGCCGCCGCCGCCGCCGATTGGTACTACAAGCAGTGCTAGTGCCAAAGGAATGGACCCTTGCGTCTACGACATGATGAAGAATCTGCGGGCGGCAAAGGCCGCGCAGGCGTCGGGAGTGACGGTGAAGACTGAGCCCAGCAGCGATACGCCGTCGTCCTGTAAAAAGAGGAAGGTGGTGGAGGATGCCACGAAACAGGATCCGCCGCGCCCCGAGCCACCGCATTATTCCCCTCCTGGCTTCTTCTCCGCGCACAAGTCACCGAAGGTTACCCGTGAGCCTGACGGCGGCGCCACCTCCGACTGGGAGCGGGCGCGGCGGATGCTACAGAGCATCGTCACGCCGGCGCTGGAGCAGACGTTCTCGGTGGCGAAGCCCTCCGACGTCATCGCCTCGAGCTACACGACAGCGCTACAGGCCGCGAACTACGCGTCGTTCTCGCTGGGCTACGCGCTGGAGCTCGAGGAGAAGCTCGCGGCAAGGGAGCGCGAGGCGGACGCGCTGCGGCGGGAGCTGTCGCAGGCCAAGGTCGAGCTCGCCGGCGCGAAGAAGGCGGCTGCGGAGGAGGTGAGGGGCGCCAGGGAGGCTGCCGTGCGCGACTTCCGGGGCTCCACGGAGCAGGTGGTCCGGTTCGCGGAGCACGCGTTGGCCGGGTACGAGAAGGGAATGGATGATATGAAGCGAGCCGTGCTGCGCAGGTACCCGCACCTCGACCCGGAGCAGCTCGTCGTGCCGGCGGACGGCGGCGGAGCTCAGTAATTAGCTCGTGGCGTCGAATCGACGCGATAAGATTTTTTGGCGTGCCGGTCCCCTAACTAACCTCAGGATCAGGCAGCGTATCAGACGTTAAACTTGCATATATATATATATATATTTCTGTACGTGCATGATCTTGTGGTTTTCAGTGGTCTACTTGGCTGGATGCAAAATATGACCAACAGACATTATCAGTGGTCTACTTATTGGACTATGGAAAACAGACATTGCCCTATTGTTTTACTTTGAACTCCTTTCTTT

SEQ ID NO: 1253 - DNA, 1306 bp, Zea mays
  misc_feature (1)..(1306): Ceres cDNA ID no. 12419040
  misc_feature (1)..(1306): Ceres CLONE  ID no. 390216
  misc_feature (1)..(1306): Also known as  Ceres CDNA ID no. 23802999
  misc_feature (837)..(837): n is a, c, t, g, unknown, or other
  misc_feature (839)..(839): n is a, c, t, g, unknown, or other
  misc_feature (1076)..(1076): n is a, c, t, g, unknown, or other
  misc_feature (1149)..(1149): n is a, c, t, g, unknown, or other
  misc_feature (1175)..(1175): n is a, c, t, g, unknown, or other
  misc_feature (1192)..(1192): n is a, c, t, g, unknown, or other
  misc_feature (1250)..(1250): n is a, c, t, g, unknown, or other
caaaaaatttttgctcagcccgctctcggacgaacccattcacccgtccggccgtccgtgcgcggcgcacccacccggcaccggcaccagcaccaccgcccgcccggcgcccgtcacgctcgagaggaggaggaagaagaagggactggtgcgacagcgcgcgatggccgccgtcgtgtgcgtcaccggcgccggcggcttcatcggctcgtggatcgtcaagatcctcctcgcccgcgggtacgccgtccggggcacctcccgccgcgaagctgctgaccccaagaacgcgcacctgtgggcgctcgacggcgcggcggagcgcctcaccatgctgcaggtggacctgctcgaccgcgccagcctccgcgccgccttccgcggctgcgacggcgtcatccacaccgcctcgccgatgcacgacaaccccgaggagatcatcgagccgattatcgccgggacgcggaacgtcgtggaggcggcggcggacgccggcgtgcggcgcctggtgctgtcctccaccatcggcaccatgtacatggacccgcgccgcgaccccgacgccccgctcggcgactccagctggagcgacctcgagtactgcaagagcaccgagaactggtactgctacgcaaagacggtggcggagcagggcgcgtgggaggcggcgcgggcgcgggggctggacctggcggtggtcatcccggtggtggtgctcggcgagctgctgcagcccagcatgaacaccagcaccctgcacatcctcaagtacctcacgggacagacaaaggagtacgtcaacgagtcgcacgcctacgtgcacgtcatggacgccgncnaggcgcacgtaagggtgctggaggcgcccggcgccggcggccggcggtacgtctgcgccgagcgcaccctgcaccgcggcgagctctgccgcatcctcgccggactcttcccggagtaccctattccgacaaggtgcaaggatcaggtgaacccaccgaagaagggctacaagtttacgaaccaacctctgaaggaccttggcgtcaagttcactccagtgcatgggtacctgtacnaagcagtgaagtccctgcaagacaagggcttcctcccgaagacctctggcgccaaggtgcctgaacgacgcanctacctgcctcaaacgacatcacagncaccacccgaaatcgtntcgaaactttgaggtggatctgcacacgtgctcaaactggccatgttttttttttgtnagaacaagccgttcatttgattggttattaaaagattttgggcagtctgttcttac

SEQ ID NO: 1254 - protein, 1306 aa, Zea mays
  misc_feature: PFam Name: Epimerase; PFam Description: NAD dependent
  misc_feature: PFam Name: 3Beta_HSD; PFam Description: 3-beta
  misc_feature: PFam Name: Polysacc_synt_2; PFam Description: Polysaccharide
  misc_feature: PFam Name: Peptidase_S8; PFam Description: Subtilase family
  misc_feature: GI Number: 50905679; NR Description: putative cinnamoyl-CoA reductase [Oryza sativa (japonica cultivar-group)] >gi|49388016|dbj|BAD25132.1| putative cinnamoyl-CoA reductase
  misc_feature: GI Number: 28544967; NR Description: cinnamoyl-CoA reductase [Zea mays] >gi|28544965|gb|AAO42622.1| cinnamoyl-CoA reductase [Zea
  misc_feature: GI Number: 28544969; NR Description: cinnamoyl-CoA reductase [Zea mays] >gi|28544963|gb|AAO42621.1| cinnamoyl-CoA reductase [Zea mays] >gi|3668115|emb|CAA75352.1| cinnamoyl-CoA reductase [Zea
  misc_feature: GI Number: 28544961; NR Description: cinnamoyl-CoA reductase [Zea mays] >gi|28544959|gb|AAO42619.1| cinnamoyl-CoA reductase [Zea
  misc_feature: GI Number: 50898722; NR Description: putative cinnamoyl-CoA reductase [Oryza sativa (japonica cultivar-group)] >gi|47848519|dbj|BAD22372.1| putative cinnamoyl-CoA reductase
CAAAAAATTTTTGCTCAGCCCGCTCTCGGACGAACCCATTCACCCGTCCGGCCGTCCGTGCGCGGCGCACCCACCCGGCACCGGCACCAGCACCACCGCCCGCCCGGCGCCCGTCACGCTCGAGAGGAGGAGGAAGAAGAAGGGACTGGTGCGACAGCGCGCGATGGCCGCCGTCGTGTGCGTCACCGGCGCCGGCGGCTTCATCGGCTCGTGGATCGTCAAGATCCTCCTCGCCCGCGGGTACGCCGTCCGGGGCACCTCCCGCCGCGAAGCTGCTGACCCCAAGAACGCGCACCTGTGGGCGCTCGACGGCGCGGCGGAGCGCCTCACCATGCTGCAGGTGGACCTGCTCGACCGCGCCAGCCTCCGCGCCGCCTTCCGCGGCTGCGACGGCGTCATCCACACCGCCTCGCCGATGCACGACAACCCCGAGGAGATCATCGAGCCGATTATCGCCGGGACGCGGAACGTCGTGGAGGCGGCGGCGGACGCCGGCGTGCGGCGCCTGGTGCTGTCCTCCACCATCGGCACCATGTACATGGACCCGCGCCGCGACCCCGACGCCCCGCTCGGCGACTCCAGCTGGAGCGACCTCGAGTACTGCAAGAGCACCGAGAACTGGTACTGCTACGCAAAGACGGTGGCGGAGCAGGGCGCGTGGGAGGCGGCGCGGGCGCGGGGGCTGGACCTGGCGGTGGTCATCCCGGTGGTGGTGCTCGGCGAGCTGCTGCAGCCCAGCATGAACACCAGCACCCTGCACATCCTCAAGTACCTCACGGGACAGACAAAGGAGTACGTCAACGAGTCGCACGCCTACGTGCACGTCATGGACGCCGNCNAGGCGCACGTAAGGGTGCTGGAGGCGCCCGGCGCCGGCGGCCGGCGGTACGTCTGCGCCGAGCGCACCCTGCACCGCGGCGAGCTCTGCCGCATCCTCGCCGGACTCTTCCCGGAGTACCCTATTCCGACAAGGTGCAAGGATCAGGTGAACCCACCGAAGAAGGGCTACAAGTTTACGAACCAACCTCTGAAGGACCTTGGCGTCAAGTTCACTCCAGTGCATGGGTACCTGTACNAAGCAGTGAAGTCCCTGCAAGACAAGGGCTTCCTCCCGAAGACCTCTGGCGCCAAGGTGCCTGAACGACGCANCTACCTGCCTCAAACGACATCACAGNCACCACCCGAAATCGTNTCGAAACTTTGAGGTGGATCTGCACACGTGCTCAAACTGGCCATGTTTTTTTTTTGTNAGAACAAGCCGTTCATTTGATTGGTTATTAAAAGATTTTGGGCAGTCTGTTCTTAC

SEQ ID NO: 1255 - DNA, 1914 bp, Zea mays
  misc_feature (1)..(1914): Ceres cDNA ID no. 12419897
  misc_feature (1)..(1914): Ceres CLONE  ID no. 394135
  misc_feature (1)..(1914): Also known as  Ceres CDNA ID no. 23814121
gcacgagaccattacctagaacatcctaatcaaaaaagttcttctgatctctgacttctgagcgaggagtggacgagtggtgtgccgtcgtccggttcccgttggtttggcgatgaggcgcgctcgcggtcgccgcgggctgctgcttctcctcggcgtggcgctctcggcggctgcgctgctccgtggctgcgcggggcagcaaggggaggacggctcggacgcccctgcggcggcggcggcggagacggcccccatggaggagaaggagcgcagggcgctgtacgccgccatcgagagcttcgtcggcaaggggtggaacggctccggggctctaccccagacccctgcggctggtctccccatccagggggtgtcatgtgatctcttcaatggcctgtggtacccaacagtgatgagcattggcccagtccttgacaactcgctgcagtgcggccccgacgccaagttcagcgcccagctgttcgacctgaggcgcctccggacgctgtctttctacagctgcttcccggcgagcaaccccacggccatcccgaccggcagctgggagaagctggcggggacgctggagacgctggagttccgcaccaacccgggcctgaacggcgccatcccggcgtccctcggccgcctggccagcctgcagtcgctggtgctcgtggagaacaacctgacggggcccgtgcccgcggagctgggcgcgctgtcgaggctgagacggctggtgctgtccgggaacgggctgtcggggccgatcccggtgacactcggtggcctcacggggctcctgaagatggacctgagcagcaacctgctgcagggcagcatcccgccggagctcgcggggctcaggagcctcacgctgctggacctcaggaacaacagcctcaccggcgggctgcccccagttcgtgcagggcatggcgtcgctgcaggacctgctgctctcgaacaacccgctgggcggcggcctgccgcagtccggctggggggcgctggcgggcctggccacgctggacctgtccaacgtcggcctcgtgggcgccataccggggtccatggcggccctgacggggctccggttcctggcgctggaccacaaccgcctgacgggggccgtgccgcccgagctcgcccggctgcccagcatcggcgcgctgtacctgaacggcaacaacctgacggggacgctggagttctcggccgggttctaccagcgcatggggcggcggttcgcgtcgtgggacaaccccgggctgtgctacaacgtcgcggccgtggacgcggcccacgcgccgtcgggcgtggtggtgtgcaaggacctgcaggagcccagcgtgggcggcggcgcgcgggacggggacggggacggggacgcggaggaggacgggacgaagcccgaggcgggctccatcctcgtggcctcctcgtcgtccggcatgccggttggcagtgtcggtgggctcgggtacctggtggtggttcggggaatggcggctgcggttcttgggttggtgtccctcctacaatagcaagcaagcaggttcagaagaagaacacggagaaacttgaagtaatgctaggtaggttagcacgaagtagtttctgcgcgttctctgtgatcttttggcatttgtttttggctgctggtggcttaccatcgtcagatggtgacggaggaaggagggaacatggatctggatggtgtgagccacagattacattacagtagtagagtaaactatgagagttcttgtggactgaaggtgtgtagtggtggatagggtagcttctccggggttcttttgtgtgtaattagcctgtgtcgccctgtggtgtcatgttacaacagcaagtggaaatctaagctggttcgtccgttgttggagaatc

SEQ ID NO: 1256 - protein, 1914 aa, Zea mays
  misc_feature: PFam Name: Glutenin_hmw; PFam Description: High molecular
  misc_feature: PFam Name: Collagen; PFam Description: Collagen triple helix
  misc_feature: PFam Name: Pkinase; PFam Description: Protein kinase domain
  misc_feature: PFam Name: S-antigen; PFam Description: S-antigen protein
  misc_feature: PFam Name: LRR_1; PFam Description: Leucine Rich Repeat
  misc_feature: GI Number: 34894182; NR Description: P0439B06.12 [Oryza
  misc_feature: GI Number: 15230865; NR Description: leucine rich repeat
  misc_feature: GI Number: 48843812; NR Description: putative leucine-rich
  misc_feature: GI Number: 34910824; NR Description: putative Hcr2-0B [Oryza sativa (japonica cultivar-group)] >gi|12328502|dbj|BAB21161.1| putative Hcr2-0B [Oryza sativa (japonica cultivar-group)] >gi|15289814|dbj|BAB63512.1| putative Hcr2-0B [Oryza sativa
  misc_feature: GI Number: 15236148; NR Description: leucine rich repeat
GCACGAGACCATTACCTAGAACATCCTAATCAAAAAAGTTCTTCTGATCTCTGACTTCTGAGCGAGGAGTGGACGAGTGGTGTGCCGTCGTCCGGTTCCCGTTGGTTTGGCGATGAGGCGCGCTCGCGGTCGCCGCGGGCTGCTGCTTCTCCTCGGCGTGGCGCTCTCGGCGGCTGCGCTGCTCCGTGGCTGCGCGGGGCAGCAAGGGGAGGACGGCTCGGACGCCCCTGCGGCGGCGGCGGCGGAGACGGCCCCCATGGAGGAGAAGGAGCGCAGGGCGCTGTACGCCGCCATCGAGAGCTTCGTCGGCAAGGGGTGGAACGGCTCCGGGGCTCTACCCCAGACCCCTGCGGCTGGTCTCCCCATCCAGGGGGTGTCATGTGATCTCTTCAATGGCCTGTGGTACCCAACAGTGATGAGCATTGGCCCAGTCCTTGACAACTCGCTGCAGTGCGGCCCCGACGCCAAGTTCAGCGCCCAGCTGTTCGACCTGAGGCGCCTCCGGACGCTGTCTTTCTACAGCTGCTTCCCGGCGAGCAACCCCACGGCCATCCCGACCGGCAGCTGGGAGAAGCTGGCGGGGACGCTGGAGACGCTGGAGTTCCGCACCAACCCGGGCCTGAACGGCGCCATCCCGGCGTCCCTCGGCCGCCTGGCCAGCCTGCAGTCGCTGGTGCTCGTGGAGAACAACCTGACGGGGCCCGTGCCCGCGGAGCTGGGCGCGCTGTCGAGGCTGAGACGGCTGGTGCTGTCCGGGAACGGGCTGTCGGGGCCGATCCCGGTGACACTCGGTGGCCTCACGGGGCTCCTGAAGATGGACCTGAGCAGCAACCTGCTGCAGGGCAGCATCCCGCCGGAGCTCGCGGGGCTCAGGAGCCTCACGCTGCTGGACCTCAGGAACAACAGCCTCACCGGCGGGCTGCCCCCAGTTCGTGCAGGGCATGGCGTCGCTGCAGGACCTGCTGCTCTCGAACAACCCGCTGGGCGGCGGCCTGCCGCAGTCCGGCTGGGGGGCGCTGGCGGGCCTGGCCACGCTGGACCTGTCCAACGTCGGCCTCGTGGGCGCCATACCGGGGTCCATGGCGGCCCTGACGGGGCTCCGGTTCCTGGCGCTGGACCACAACCGCCTGACGGGGGCCGTGCCGCCCGAGCTCGCCCGGCTGCCCAGCATCGGCGCGCTGTACCTGAACGGCAACAACCTGACGGGGACGCTGGAGTTCTCGGCCGGGTTCTACCAGCGCATGGGGCGGCGGTTCGCGTCGTGGGACAACCCCGGGCTGTGCTACAACGTCGCGGCCGTGGACGCGGCCCACGCGCCGTCGGGCGTGGTGGTGTGCAAGGACCTGCAGGAGCCCAGCGTGGGCGGCGGCGCGCGGGACGGGGACGGGGACGGGGACGCGGAGGAGGACGGGACGAAGCCCGAGGCGGGCTCCATCCTCGTGGCCTCCTCGTCGTCCGGCATGCCGGTTGGCAGTGTCGGTGGGCTCGGGTACCTGGTGGTGGTTCGGGGAATGGCGGCTGCGGTTCTTGGGTTGGTGTCCCTCCTACAATAGCAAGCAAGCAGGTTCAGAAGAAGAACACGGAGAAACTTGAAGTAATGCTAGGTAGGTTAGCACGAAGTAGTTTCTGCGCGTTCTCTGTGATCTTTTGGCATTTGTTTTTGGCTGCTGGTGGCTTACCATCGTCAGATGGTGACGGAGGAAGGAGGGAACATGGATCTGGATGGTGTGAGCCACAGATTACATTACAGTAGTAGAGTAAACTATGAGAGTTCTTGTGGACTGAAGGTGTGTAGTGGTGGATAGGGTAGCTTCTCCGGGGTTCTTTTGTGTGTAATTAGCCTGTGTCGCCCTGTGGTGTCATGTTACAACAGCAAGTGGAAATCTAAGCTGGTTCGTCCGTTGTTGGAGAATC

SEQ ID NO: 1257 - DNA, 1333 bp, Zea mays
  misc_feature (1)..(1333): Ceres cDNA ID no. 12420004
  misc_feature (1)..(1333): Ceres CLONE  ID no. 397706
  misc_feature (1)..(1333): Also known as  Ceres CDNA ID no. 23832672
  misc_feature (430)..(430): n is a, c, t, g, unknown, or other
  misc_feature (436)..(436): n is a, c, t, g, unknown, or other
  misc_feature (442)..(442): n is a, c, t, g, unknown, or other
gcacgagaccattacctagaacatcctaatcgaaaaagaagccaatcctccatcaccgccaccgcccgagccccgaggcctaggccctgatctctgcctaccaaacaatggaagccacagcagccaccttgtcccgctccgcctccctctccgccggccgcccccaccgctcccgcaccgccaggttcccgccaccacccccacacctcaccccgctctcggctgccgcgtccccgcgcggcctcccgctccgccgagccaggtccgacgccgaggtcgcctacttcgcgagatccgccgtcctcgtccgccacgctccgatccccgccattatcgtggccgacgaggaagagcgccaggatgacaacagcaaggcgccagcaggcctcgacggcgccggcgccggcaggaacggcagcagccaccgcgncggcancggagnccgtggcggcggcggcggcggcggcggctgtgacatgggcgagtactaccgccgcgtgctgcgggtggatcccgggaacccgctgctgctgcgcaactacggcaagtacctgcacgaggtggagcgcgacctggcgggcgccgagggctgctacgcgcgcgcgctgctggcgtgccccggggacgccgacctgctcagcctctacggccgcgtcatctgggaggcgcgccaggagaaggaccgcgccgcggcctacttcgagcgcgccgtgcaggccgccccggatgactgctacgtgctcgggtcctatgcgagcttcctgtgggacgccgaagacgacgacgaggaaacaggcaccccagcggtcgatgtggtcgcgtcgtgcgactcgccggcgttggtgcccgcgtgctgatcgttgtccgcgtggggtgtggacggtgtccggtggtcacctgcttcatctgctgtgttttgttaggactggtgtacatatgaggacggatgagggcggcggagggagcaccagggtaaatcaactgtcaccgccgtctacggaaccggcgaaaaataattaacaaggaacctcgccgacgggacgaacgcgcggcgaaaaataacgatggccgcagcaaaacggctgggccatcgacggtcacctcgtttgcctctactctaatcattactgtttgtgtttgatagatgtgttagtgcgaccttgtagctggatgaatagctgaatttactgagcagttgatgtacttaggctcctggtgacctaaaatgggtgtgcaaatgtgcaatcctagtgatctaaaatcagtagtgtgtaatcctgtttttctacattgatagtcgatagaggactgcctcgctatatagcttgagctc

SEQ ID NO: 1258 - protein, 1333 aa, Zea mays
  misc_feature: PFam Name: Pkinase; PFam Description: Protein kinase domain
  misc_feature: PFam Name: FH2; PFam Description: Formin Homology 2 Domain
  misc_feature: PFam Name: Pyr_redox_2; PFam Description: Pyridine
  misc_feature: PFam Name: Drf_FH1; PFam Description: Formin Homology Region 1
  misc_feature: PFam Name: Atrophin-1; PFam Description: Atrophin-1 family
  misc_feature: GI Number: 21592868; NR Description: unknown [Arabidopsis thaliana]
  misc_feature: GI Number: 21555875; NR Description: unknown [Arabidopsis thaliana]
  misc_feature: GI Number: 29247944; NR Description: GLP_26_54603_52153
  misc_feature: GI Number: 31204361; NR Description: ENSANGP00000004749 [Anopheles gambiae] >gi|30178092|gb|EAA06612.2| ENSANGP00000004749
  misc_feature: GI Number: 7488999; NR Description: extensin class I (clone
GCACGAGACCATTACCTAGAACATCCTAATCGAAAAAGAAGCCAATCCTCCATCACCGCCACCGCCCGAGCCCCGAGGCCTAGGCCCTGATCTCTGCCTACCAAACAATGGAAGCCACAGCAGCCACCTTGTCCCGCTCCGCCTCCCTCTCCGCCGGCCGCCCCCACCGCTCCCGCACCGCCAGGTTCCCGCCACCACCCCCACACCTCACCCCGCTCTCGGCTGCCGCGTCCCCGCGCGGCCTCCCGCTCCGCCGAGCCAGGTCCGACGCCGAGGTCGCCTACTTCGCGAGATCCGCCGTCCTCGTCCGCCACGCTCCGATCCCCGCCATTATCGTGGCCGACGAGGAAGAGCGCCAGGATGACAACAGCAAGGCGCCAGCAGGCCTCGACGGCGCCGGCGCCGGCAGGAACGGCAGCAGCCACCGCGNCGGCANCGGAGNCCGTGGCGGCGGCGGCGGCGGCGGCGGCTGTGACATGGGCGAGTACTACCGCCGCGTGCTGCGGGTGGATCCCGGGAACCCGCTGCTGCTGCGCAACTACGGCAAGTACCTGCACGAGGTGGAGCGCGACCTGGCGGGCGCCGAGGGCTGCTACGCGCGCGCGCTGCTGGCGTGCCCCGGGGACGCCGACCTGCTCAGCCTCTACGGCCGCGTCATCTGGGAGGCGCGCCAGGAGAAGGACCGCGCCGCGGCCTACTTCGAGCGCGCCGTGCAGGCCGCCCCGGATGACTGCTACGTGCTCGGGTCCTATGCGAGCTTCCTGTGGGACGCCGAAGACGACGACGAGGAAACAGGCACCCCAGCGGTCGATGTGGTCGCGTCGTGCGACTCGCCGGCGTTGGTGCCCGCGTGCTGATCGTTGTCCGCGTGGGGTGTGGACGGTGTCCGGTGGTCACCTGCTTCATCTGCTGTGTTTTGTTAGGACTGGTGTACATATGAGGACGGATGAGGGCGGCGGAGGGAGCACCAGGGTAAATCAACTGTCACCGCCGTCTACGGAACCGGCGAAAAATAATTAACAAGGAACCTCGCCGACGGGACGAACGCGCGGCGAAAAATAACGATGGCCGCAGCAAAACGGCTGGGCCATCGACGGTCACCTCGTTTGCCTCTACTCTAATCATTACTGTTTGTGTTTGATAGATGTGTTAGTGCGACCTTGTAGCTGGATGAATAGCTGAATTTACTGAGCAGTTGATGTACTTAGGCTCCTGGTGACCTAAAATGGGTGTGCAAATGTGCAATCCTAGTGATCTAAAATCAGTAGTGTGTAATCCTGTTTTTCTACATTGATAGTCGATAGAGGACTGCCTCGCTATATAGCTTGAGCTC

SEQ ID NO: 1259 - DNA, 1221 bp, Zea mays
  misc_feature (1)..(1221): Ceres cDNA ID no. 12420021
  misc_feature (1)..(1221): Ceres CLONE  ID no. 392509
  misc_feature (1)..(1221): Also known as  Ceres CDNA ID no. 23815425
  misc_feature (194)..(194): n is a, c, t, g, unknown, or other
  misc_feature (197)..(197): n is a, c, t, g, unknown, or other
  misc_feature (235)..(235): n is a, c, t, g, unknown, or other
  misc_feature (263)..(263): n is a, c, t, g, unknown, or other
  misc_feature (271)..(271): n is a, c, t, g, unknown, or other
  misc_feature (325)..(325): n is a, c, t, g, unknown, or other
  misc_feature (326)..(326): n is a, c, t, g, unknown, or other
  misc_feature (344)..(344): n is a, c, t, g, unknown, or other
  misc_feature (345)..(345): n is a, c, t, g, unknown, or other
  misc_feature (411)..(411): n is a, c, t, g, unknown, or other
  misc_feature (553)..(553): n is a, c, t, g, unknown, or other
  misc_feature (912)..(912): n is a, c, t, g, unknown, or other
  misc_feature (933)..(933): n is a, c, t, g, unknown, or other
  misc_feature (937)..(937): n is a, c, t, g, unknown, or other
  misc_feature (938)..(938): n is a, c, t, g, unknown, or other
  misc_feature (951)..(951): n is a, c, t, g, unknown, or other
  misc_feature (955)..(955): n is a, c, t, g, unknown, or other
  misc_feature (1001)..(1001): n is a, c, t, g, unknown, or other
  misc_feature (1045)..(1045): n is a, c, t, g, unknown, or other
ccaagcagaagagaagagaggcagacaggctcactagtgggagatggtgactactacgatcgaggacctccacggcgacgtgctgggctgcgcgctgcggcggctggacgggcggtcgcttgcggcggccagctgcgccacggtcgcgctccgggcgctggccacggacccggagacgtggcgcgcgctctgcntcnccgagtggccgtcgctggcgctggcgctggcggcgcancgccggctgctcgcggcggtcccgccgnagcggctnttcgccgacgcgcacccgttcccgtccgcggacaccgggggagccggaggtccnnaccccgaccccgtccccnncggggagctggtctccgcggtggacgtcctactacaggggcgcgcccctgctgtcccgcgtggtgnagacgcccgcgtcctcgccgtggttcctcggctcgccgttccgcgtggaggccgtggagcggaagaggccggcctccgccgccgcggtgccctcgccggcggagctcgagctgagctgggtggtcgtggacccggcccgcgnccgcgcggtcaacgtctccagccggcgccccgtggcggtggcccggcactggtacacgggcgagacgctggcgcggttcgccgtggtgctgggagggtgcaagttcgaggccaccgtcgcctgctccgaaggggcggatgggcacgtcagcgaggtcagcctggccgtggaggacgccgacggcgccgccgtcagcggcgagggcacgctgcggctcctcgccgcggcgatggaggccccccggaagggaggggcgcgggagccggaggaggcccggaggcggtacctcgacttcgtgaagcgcaagaaggggaggaaggagagcaaggcgcgccgcgaggcgctcgtggacctgtgcntgctccgctgccagcgccgtngtcnngctcacctgcctngccnctgtcgcgctccggtgaccggcgcctgctgcctgctgcccggacgnacgagcgcgtgtagtgggcactaggcaaggcagctgcacacagnacgtgtcgtaacatctcgggtagcacttgagtattagcgtacaacgtcgggtggcgatcttttctccaacgctctttttctctctctcttcttcttcccggtaacagttaggaacagcacatcatcatgtcctgcactggtgtgcatcgttttcctatcctataacaaacgacgtg

SEQ ID NO: 1260 - protein, 1221 aa, Zea mays
  misc_feature: PFam Name: F-box; PFam Description: F-box domain
  misc_feature: GI Number: 50253058; NR Description: F-box protein-like [Oryza sativa (japonica cultivar-group)] >gi|50251878|dbj|BAD27806.1| F-box protein-like [Oryza sativa
  misc_feature: GI Number: 62701652; NR Description: F-box domain, putative
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
  misc_feature: GI Number: 66778264; NR Description: LigA [Anaeromyxobacter dehalogenans 2CP-C] >gi|66856061|ref|ZP_00400131.1| LigA
CCAAGCAGAAGAGAAGAGAGGCAGACAGGCTCACTAGTGGGAGATGGTGACTACTACGATCGAGGACCTCCACGGCGACGTGCTGGGCTGCGCGCTGCGGCGGCTGGACGGGCGGTCGCTTGCGGCGGCCAGCTGCGCCACGGTCGCGCTCCGGGCGCTGGCCACGGACCCGGAGACGTGGCGCGCGCTCTGCNTCNCCGAGTGGCCGTCGCTGGCGCTGGCGCTGGCGGCGCANCGCCGGCTGCTCGCGGCGGTCCCGCCGNAGCGGCTNTTCGCCGACGCGCACCCGTTCCCGTCCGCGGACACCGGGGGAGCCGGAGGTCCNNACCCCGACCCCGTCCCCNNCGGGGAGCTGGTCTCCGCGGTGGACGTCCTACTACAGGGGCGCGCCCCTGCTGTCCCGCGTGGTGNAGACGCCCGCGTCCTCGCCGTGGTTCCTCGGCTCGCCGTTCCGCGTGGAGGCCGTGGAGCGGAAGAGGCCGGCCTCCGCCGCCGCGGTGCCCTCGCCGGCGGAGCTCGAGCTGAGCTGGGTGGTCGTGGACCCGGCCCGCGNCCGCGCGGTCAACGTCTCCAGCCGGCGCCCCGTGGCGGTGGCCCGGCACTGGTACACGGGCGAGACGCTGGCGCGGTTCGCCGTGGTGCTGGGAGGGTGCAAGTTCGAGGCCACCGTCGCCTGCTCCGAAGGGGCGGATGGGCACGTCAGCGAGGTCAGCCTGGCCGTGGAGGACGCCGACGGCGCCGCCGTCAGCGGCGAGGGCACGCTGCGGCTCCTCGCCGCGGCGATGGAGGCCCCCCGGAAGGGAGGGGCGCGGGAGCCGGAGGAGGCCCGGAGGCGGTACCTCGACTTCGTGAAGCGCAAGAAGGGGAGGAAGGAGAGCAAGGCGCGCCGCGAGGCGCTCGTGGACCTGTGCNTGCTCCGCTGCCAGCGCCGTNGTCNNGCTCACCTGCCTNGCCNCTGTCGCGCTCCGGTGACCGGCGCCTGCTGCCTGCTGCCCGGACGNACGAGCGCGTGTAGTGGGCACTAGGCAAGGCAGCTGCACACAGNACGTGTCGTAACATCTCGGGTAGCACTTGAGTATTAGCGTACAACGTCGGGTGGCGATCTTTTCTCCAACGCTCTTTTTCTCTCTCTCTTCTTCTTCCCGGTAACAGTTAGGAACAGCACATCATCATGTCCTGCACTGGTGTGCATCGTTTTCCTATCCTATAACAAACGACGTG

SEQ ID NO: 1261 - DNA, 1248 bp, Arabidopsis thaliana
  misc_feature (1)..(1248): Ceres cDNA ID no. 12421238
  misc_feature (1)..(1248): Ceres CLONE  ID no. 9001
  misc_feature (1)..(1248): Also known as  Ceres CDNA ID no. 23388506
gtagggtttttaggggttttctctctctttgcaatcatggagtctctagggaagctacagcttcatcagcaaccaaatcacctctctttcactcatttctcttcatctttccccaaaaagccttcgtctttctctctcagatccttacccagatcaacatcatccttcaaatgcatttcaatcaaagcttcctcatccaagtctcaagactcgaagctctcaatcctcaaatccacatgcgtcagcttcactgcggcagcagcactgttccttgtgaatctccagctcaaaccttcaccggcgattgcggctcctgtggcggcgacgccgttaatggaatctctcaaacaaagtaacggaaacgtttcatttgaagaagaagagagatcactcgaagagtatcttgcttctcaccctgatgatgttgaagctctacgatctttaatggaggtaaggatcaaatctcgaaagcttctagaagctatagaattgattgataggttgattgaattggaaccagaggagaaggaatggccaatgttgaaagctaatatctttagttacagtggagatttagagtctgctaaaactggttttgaagagattctagtcaaagatccgcttcgtgtcgaggcttatcacggtttagttatggcttattctgattctggtgatgatttgaatgctgtggagcagagaattgaggaggcaatggttaggtgcaagaaggagaagaatcgtaaggacttgagagattttaagctactagtggcgcaaattcgggttattgaagggaagcataatgaagcattgaagttgtatgaggagcttgtgaaggaagagccgagagatttcaggccgtatctatgtcaagggattatatacacagtgttgaagaaggagaatgaggcggagaaacagtttgagaagtttaggagacttgtcccgaagaatcatccttatagagagtattttatggataatatggttgcttcgaagctctttgccgagaaggtacagcgagagatggctgaatgattgtcttacgaaatgctagtcgtgcttgaatgtggttttttttgtctcttttctgttgctaatggttttagatggttgtagtatgtaggttgagcttgaatttatgtcgtgatcgtgtgttgtagtacggatcgaatactcaatatgggaatcttgaattgcttgcactgttttttgagatgtgtatgtatacatcacgactcacgagtc

SEQ ID NO: 1262 - protein, 1248 aa, Arabidopsis thaliana
  misc_feature: PFam Name: TPR_1; PFam Description: Tetratricopeptide repeat
  misc_feature: GI Number: 21617936; NR Description: unknown [Arabidopsis thaliana]
  misc_feature: GI Number: 21553360; NR Description: unknown [Arabidopsis thaliana] >gi|18413971|ref|NP_568104.1| chloroplast lumen common
  misc_feature: GI Number: 28416459; NR Description: At4g39470/F23K16_100 [Arabidopsis thaliana] >gi|15215656|gb|AAK91373.1| AT4g39470/F23K16_100 [Arabidopsis thaliana] >gi|18420460|ref|NP_568061.1| chloroplast lumen common family
  misc_feature: GI Number: 57900694; NR Description: unknow protein [Oryza
  misc_feature: GI Number: 48854192; NR Description: COG0457: FOG: TPR repeat
GTAGGGTTTTTAGGGGTTTTCTCTCTCTTTGCAATCATGGAGTCTCTAGGGAAGCTACAGCTTCATCAGCAACCAAATCACCTCTCTTTCACTCATTTCTCTTCATCTTTCCCCAAAAAGCCTTCGTCTTTCTCTCTCAGATCCTTACCCAGATCAACATCATCCTTCAAATGCATTTCAATCAAAGCTTCCTCATCCAAGTCTCAAGACTCGAAGCTCTCAATCCTCAAATCCACATGCGTCAGCTTCACTGCGGCAGCAGCACTGTTCCTTGTGAATCTCCAGCTCAAACCTTCACCGGCGATTGCGGCTCCTGTGGCGGCGACGCCGTTAATGGAATCTCTCAAACAAAGTAACGGAAACGTTTCATTTGAAGAAGAAGAGAGATCACTCGAAGAGTATCTTGCTTCTCACCCTGATGATGTTGAAGCTCTACGATCTTTAATGGAGGTAAGGATCAAATCTCGAAAGCTTCTAGAAGCTATAGAATTGATTGATAGGTTGATTGAATTGGAACCAGAGGAGAAGGAATGGCCAATGTTGAAAGCTAATATCTTTAGTTACAGTGGAGATTTAGAGTCTGCTAAAACTGGTTTTGAAGAGATTCTAGTCAAAGATCCGCTTCGTGTCGAGGCTTATCACGGTTTAGTTATGGCTTATTCTGATTCTGGTGATGATTTGAATGCTGTGGAGCAGAGAATTGAGGAGGCAATGGTTAGGTGCAAGAAGGAGAAGAATCGTAAGGACTTGAGAGATTTTAAGCTACTAGTGGCGCAAATTCGGGTTATTGAAGGGAAGCATAATGAAGCATTGAAGTTGTATGAGGAGCTTGTGAAGGAAGAGCCGAGAGATTTCAGGCCGTATCTATGTCAAGGGATTATATACACAGTGTTGAAGAAGGAGAATGAGGCGGAGAAACAGTTTGAGAAGTTTAGGAGACTTGTCCCGAAGAATCATCCTTATAGAGAGTATTTTATGGATAATATGGTTGCTTCGAAGCTCTTTGCCGAGAAGGTACAGCGAGAGATGGCTGAATGATTGTCTTACGAAATGCTAGTCGTGCTTGAATGTGGTTTTTTTTGTCTCTTTTCTGTTGCTAATGGTTTTAGATGGTTGTAGTATGTAGGTTGAGCTTGAATTTATGTCGTGATCGTGTGTTGTAGTACGGATCGAATACTCAATATGGGAATCTTGAATTGCTTGCACTGTTTTTTGAGATGTGTATGTATACATCACGACTCACGAGTC

SEQ ID NO: 1263 - DNA, 899 bp, Arabidopsis thaliana
  misc_feature (1)..(899): Ceres cDNA ID no. 12421506
  misc_feature (1)..(899): Ceres CLONE  ID no. 34819
  misc_feature (1)..(899): Also known as  Ceres CDNA ID no. 23388736
ctccactgaaatattccccacaagaactaacaatgataatgagaagcgcgtcttcactggaccttaacctacgcgccgcccagaaaccgtctgttccaagggtggtaaccacggctcgaaccgtctctgctgctactcctcgtgttgctaaaccgattacaagagcttcttcagatggaaacctctacaagattcagtcgccggagagcataacgaaaaccatcagcgtatatcacgaagaaacggcgtctttgagggttttggaaggatctcgactcccccaaggaggttccaacggtggatttggtggtagaggcggagatggtgccggaggtggcggtggaggtggaggtgggagcgtagatggttattacgaagagatgatccaacgttatcccggagacactctccttctctctaactacgctcgtttcctcaaagaggtgaaaggagatgggagaaaagcggaggagtactgtgagagagcgatgttgtctgagagtggaagagatggagagttactgtctatgtatggagatttgatatggaaaaatcatggagacggtgttcgtgctcagtcttactatgatcaagctgttcaatcttctcctgatgactgtaatgttcttgcgtcgtatgctcggtttctatgggatgctgaagaagaagtggaagaggaagagagtaaacatcatgaggatggtttctctgactctacctataacccatctgtatcagttgtgtcttgactctttgtgctgatgttaaaccggtgtaatacaatgaaaactcaaaggtccggtttaatcaggaaaatatcttctgcacacattgaagtagattgatgctaatgtgtatcaaaaggtccaaagccgcattattgttgcaaaatgcggatt

SEQ ID NO: 1264 - protein, 899 aa, Arabidopsis thaliana
  misc_feature: PFam Name: MelC1; PFam Description: Tyrosinase co-factor MelC1
  misc_feature: PFam Name: Ank; PFam Description: Ankyrin repeat
  misc_feature: PFam Name: GRP; PFam Description: Glycine rich protein family
  misc_feature: PFam Name: K_tetra; PFam Description: K+ channel
  misc_feature: GI Number: 21592868; NR Description: unknown [Arabidopsis thaliana]
  misc_feature: GI Number: 21555875; NR Description: unknown [Arabidopsis thaliana]
CTCCACTGAAATATTCCCCACAAGAACTAACAATGATAATGAGAAGCGCGTCTTCACTGGACCTTAACCTACGCGCCGCCCAGAAACCGTCTGTTCCAAGGGTGGTAACCACGGCTCGAACCGTCTCTGCTGCTACTCCTCGTGTTGCTAAACCGATTACAAGAGCTTCTTCAGATGGAAACCTCTACAAGATTCAGTCGCCGGAGAGCATAACGAAAACCATCAGCGTATATCACGAAGAAACGGCGTCTTTGAGGGTTTTGGAAGGATCTCGACTCCCCCAAGGAGGTTCCAACGGTGGATTTGGTGGTAGAGGCGGAGATGGTGCCGGAGGTGGCGGTGGAGGTGGAGGTGGGAGCGTAGATGGTTATTACGAAGAGATGATCCAACGTTATCCCGGAGACACTCTCCTTCTCTCTAACTACGCTCGTTTCCTCAAAGAGGTGAAAGGAGATGGGAGAAAAGCGGAGGAGTACTGTGAGAGAGCGATGTTGTCTGAGAGTGGAAGAGATGGAGAGTTACTGTCTATGTATGGAGATTTGATATGGAAAAATCATGGAGACGGTGTTCGTGCTCAGTCTTACTATGATCAAGCTGTTCAATCTTCTCCTGATGACTGTAATGTTCTTGCGTCGTATGCTCGGTTTCTATGGGATGCTGAAGAAGAAGTGGAAGAGGAAGAGAGTAAACATCATGAGGATGGTTTCTCTGACTCTACCTATAACCCATCTGTATCAGTTGTGTCTTGACTCTTTGTGCTGATGTTAAACCGGTGTAATACAATGAAAACTCAAAGGTCCGGTTTAATCAGGAAAATATCTTCTGCACACATTGAAGTAGATTGATGCTAATGTGTATCAAAAGGTCCAAAGCCGCATTATTGTTGCAAAATGCGGATT

SEQ ID NO: 1265 - DNA, 1388 bp, Arabidopsis thaliana
  misc_feature (1)..(1388): Ceres cDNA ID no. 12421518
  misc_feature (1)..(1388): Ceres CLONE  ID no. 33726
  misc_feature (1)..(1388): Also known as  Ceres CDNA ID no. 23388744
tcgttagctctctcaatgaggagcccgatttagggtttcctccattggttatatcaattcgatcatctccacaaagctctctaagactctttcggtgatctcatcttcttcttcttgtttagcctccttgaggttactttgtttgttactagttccaaaacatgccgaaagagaggaaagaacggtccgtatctcttgataagtataaacgatcgccactgtgttgtgaggcaagccttgctttgaagccgagtgagaaacaagttaaagaatgggaagaggctcgttgtcctgtttgtatggaacatcctcacaatgggattcttctcatttgttcttcttatgaaaatggttgtcgaccttacatgtgcgacactagccatcggcattctaactgtttcgatcagttccgcaaagcttctaaagagaaaccttctttgtctttacttcgtgaggaagaggaaagtaatgaaccaactgagatggaagatgtggattcagactcaactgctgtaaatctattaggagaagctgcatctgagataacagttgtggatttaagtgatggtgagagaggagaagaagaagtagaagaagatcaaaaaaaaaacaaaccaccaaagcttacttgtccgttatgtcgtggacatataaaagaatgggtagttgttaaagcagctcgatgtttcatgaactcaaaacatagaagctgttcttgtgagacttgtgatttcagtggaagctattccgatctgagaaagcacgcaaggcttctacatccaggagttaggccatcagaagcagatccagagagacagagaagctggaggaggctagaaaggcagagcgatttaggggatttacttagcacactccaatcttcttttggaggagatgaaataagtaacgatgatgggtttctatttgctgatactcgcttgcttacagtgtactttctcatccgcgtgtttagaccagaatcgagtggctcaaggagtagtagctggtctggtacatctagagctaggacacatacaagtgggagaagaagatcttcaagacctgcaagtctttggggagagagctatgaaggtaatacaggaacatcacctagagatgaggagaataatcaatcttctgatgtacaagtgtctggaactcggagacgtcgttctagaagaagaactgtcattgatgatgatgatgaagaagaagaaccgtgatgctctgcagtttggaaatttggtctttggagtttatgataaaatgggggaaaccttgtagtaataaccccacttatgaaaccctattatgtaaaatttctttggagattgaaaaaagtttctactattgggaaacaaaatgttcaatatttcattaccgtttac

SEQ ID NO: 1266 - protein, 1388 aa, Arabidopsis thaliana
  misc_feature: GI Number: 34912600; NR Description: P0046B10.17 [Oryza sativa (japonica cultivar-group)] >gi|11034559|dbj|BAB17083.1| P0410E01.4 [Oryza sativa (japonica cultivar-group)] >gi|21104687|dbj|BAB93277.1| P0046B10.17 [Oryza sativa (japonica
  misc_feature: GI Number: 5103842; NR Description: F9L1.39 [Arabidopsis thaliana]
TCGTTAGCTCTCTCAATGAGGAGCCCGATTTAGGGTTTCCTCCATTGGTTATATCAATTCGATCATCTCCACAAAGCTCTCTAAGACTCTTTCGGTGATCTCATCTTCTTCTTCTTGTTTAGCCTCCTTGAGGTTACTTTGTTTGTTACTAGTTCCAAAACATGCCGAAAGAGAGGAAAGAACGGTCCGTATCTCTTGATAAGTATAAACGATCGCCACTGTGTTGTGAGGCAAGCCTTGCTTTGAAGCCGAGTGAGAAACAAGTTAAAGAATGGGAAGAGGCTCGTTGTCCTGTTTGTATGGAACATCCTCACAATGGGATTCTTCTCATTTGTTCTTCTTATGAAAATGGTTGTCGACCTTACATGTGCGACACTAGCCATCGGCATTCTAACTGTTTCGATCAGTTCCGCAAAGCTTCTAAAGAGAAACCTTCTTTGTCTTTACTTCGTGAGGAAGAGGAAAGTAATGAACCAACTGAGATGGAAGATGTGGATTCAGACTCAACTGCTGTAAATCTATTAGGAGAAGCTGCATCTGAGATAACAGTTGTGGATTTAAGTGATGGTGAGAGAGGAGAAGAAGAAGTAGAAGAAGATCAAAAAAAAAACAAACCACCAAAGCTTACTTGTCCGTTATGTCGTGGACATATAAAAGAATGGGTAGTTGTTAAAGCAGCTCGATGTTTCATGAACTCAAAACATAGAAGCTGTTCTTGTGAGACTTGTGATTTCAGTGGAAGCTATTCCGATCTGAGAAAGCACGCAAGGCTTCTACATCCAGGAGTTAGGCCATCAGAAGCAGATCCAGAGAGACAGAGAAGCTGGAGGAGGCTAGAAAGGCAGAGCGATTTAGGGGATTTACTTAGCACACTCCAATCTTCTTTTGGAGGAGATGAAATAAGTAACGATGATGGGTTTCTATTTGCTGATACTCGCTTGCTTACAGTGTACTTTCTCATCCGCGTGTTTAGACCAGAATCGAGTGGCTCAAGGAGTAGTAGCTGGTCTGGTACATCTAGAGCTAGGACACATACAAGTGGGAGAAGAAGATCTTCAAGACCTGCAAGTCTTTGGGGAGAGAGCTATGAAGGTAATACAGGAACATCACCTAGAGATGAGGAGAATAATCAATCTTCTGATGTACAAGTGTCTGGAACTCGGAGACGTCGTTCTAGAAGAAGAACTGTCATTGATGATGATGATGAAGAAGAAGAACCGTGATGCTCTGCAGTTTGGAAATTTGGTCTTTGGAGTTTATGATAAAATGGGGGAAACCTTGTAGTAATAACCCCACTTATGAAACCCTATTATGTAAAATTTCTTTGGAGATTGAAAAAAGTTTCTACTATTGGGAAACAAAATGTTCAATATTTCATTACCGTTTAC

SEQ ID NO: 1267 - DNA, 1037 bp, Arabidopsis thaliana
  misc_feature (1)..(1037): Ceres cDNA ID no. 12421608
  misc_feature (1)..(1037): Ceres CLONE  ID no. 30000
  misc_feature (1)..(1037): Also known as  Ceres CDNA ID no. 23388827
aatcgaaccatccaagacccgaattggatggattgggatcgggataatgggatcagcgatggtttctcatatcctcgccgcaggctattcagtcaccgtttatgctcgcgatcttcgtaaaacaaaggatctgcaaaccaaaggaggtcgtaccgccaatagccccaaagagttagcggagatgagcgacgttgtgtacgatcgttggaaactctaacgatgttagattgttgcttcttggggatgatggtgtactctctggtcttaaacccggtggagtaacagtggacatgactagtagcaagccaggattggcgcgtgagatatacgcggaggcgaggcggagggattgctgggcggtggatgcgcctgtatcgggtggagacgctggagcacgtgaggggaagctaacgatattcgccggcggagattccgagattgtggagtggttggctccggtgatgaaaacgatgggaattgtgaggtttatgggaggagctgggagtggacagagctgtaaaattgggaatcagatttgtgttggaagcaacatgattggattagctgaagggattgtgtttgctgagaaggcgggtttagatccggtgaaatggcttgaggcggttaaggatggtgcagctggatcggcggttatgcggcttttcggggagatgatggcgaagagggactataaggcgacggggtttgcggagtatatggtgaaagatttgggaatggcagcggaagcggcaacggcgatgcctggaactgctttgaacaagcagttgttcactggaatggtggcaaatggagatgggaagttaggatttcaaggcgtcgtcgatgttattaggagacttaacggcttatcctgataaaactagtgttaactaggcaagcttgttttccatttggttagaagttgctaataagaacatggagtctcaccaatctcgagaactatagttacaagagtgtgtaacattagtttccaattggattatcaacttctacctcctataactatttctctgttg

SEQ ID NO: 1268 - protein, 1037 aa, Arabidopsis thaliana
  misc_feature: PFam Name: NAD_binding_2; PFam Description: NAD binding
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
AATCGAACCATCCAAGACCCGAATTGGATGGATTGGGATCGGGATAATGGGATCAGCGATGGTTTCTCATATCCTCGCCGCAGGCTATTCAGTCACCGTTTATGCTCGCGATCTTCGTAAAACAAAGGATCTGCAAACCAAAGGAGGTCGTACCGCCAATAGCCCCAAAGAGTTAGCGGAGATGAGCGACGTTGTGTACGATCGTTGGAAACTCTAACGATGTTAGATTGTTGCTTCTTGGGGATGATGGTGTACTCTCTGGTCTTAAACCCGGTGGAGTAACAGTGGACATGACTAGTAGCAAGCCAGGATTGGCGCGTGAGATATACGCGGAGGCGAGGCGGAGGGATTGCTGGGCGGTGGATGCGCCTGTATCGGGTGGAGACGCTGGAGCACGTGAGGGGAAGCTAACGATATTCGCCGGCGGAGATTCCGAGATTGTGGAGTGGTTGGCTCCGGTGATGAAAACGATGGGAATTGTGAGGTTTATGGGAGGAGCTGGGAGTGGACAGAGCTGTAAAATTGGGAATCAGATTTGTGTTGGAAGCAACATGATTGGATTAGCTGAAGGGATTGTGTTTGCTGAGAAGGCGGGTTTAGATCCGGTGAAATGGCTTGAGGCGGTTAAGGATGGTGCAGCTGGATCGGCGGTTATGCGGCTTTTCGGGGAGATGATGGCGAAGAGGGACTATAAGGCGACGGGGTTTGCGGAGTATATGGTGAAAGATTTGGGAATGGCAGCGGAAGCGGCAACGGCGATGCCTGGAACTGCTTTGAACAAGCAGTTGTTCACTGGAATGGTGGCAAATGGAGATGGGAAGTTAGGATTTCAAGGCGTCGTCGATGTTATTAGGAGACTTAACGGCTTATCCTGATAAAACTAGTGTTAACTAGGCAAGCTTGTTTTCCATTTGGTTAGAAGTTGCTAATAAGAACATGGAGTCTCACCAATCTCGAGAACTATAGTTACAAGAGTGTGTAACATTAGTTTCCAATTGGATTATCAACTTCTACCTCCTATAACTATTTCTCTGTTG

SEQ ID NO: 1269 - DNA, 1373 bp, Arabidopsis thaliana
  misc_feature (1)..(1373): Ceres cDNA ID no. 12421682
  misc_feature (1)..(1373): Ceres CLONE  ID no. 2686
  misc_feature (1)..(1373): Also known as  Ceres CDNA ID no. 23388896
gtttcttcttcacactctgattctcttactattttactctgttgttgttgttgtgatatcaagagagtgggtttgagatcatgccaaattctggaaaaagtttgagtttttaattccaatcgagaaaaaataaaaatgggttctttaggtgatgagcttagtttgggatcgatctttgggagaggagtttcgatgaatgttgtggcggtggagaaagttgatgaacatgttaagaagcttgaagaagagaagagaaagctcgaaagttgtcaacttgagcttcctctgtctttgcagattttaaacgatgcgattttgtatctgaaggataagagatgttcagagatggagactcaaccattgttgaaagatttcatttctgttaataaacctattcaaggagaaagaggaatagaattgctgaaaagagaggagctaatgagggagaagaagtttcagcaatggaaagctaatgatgatcacactagtaagatcaagagcaagcttgagattaagagaaatgaggagaaatctcctatgttgttgattccaaaggtggaaactggtttaggcctcggtttaagttcgagttcgataagaagaaaagggattgttgcctcatgtggctttacttctaactctatgccacaaccaccaacaccagcagtaccacaacaaccagcatttcttaagcagcaagctttacggaagcaaagaaggtgttggaatccagagttgcatcgccgatttgtcgatgcattgcaacagctaggtggaccgggagtggcaactcctaaacaaattagagaacatatgcaagaagaaggcttaaccaatgatgaagtcaagagtcatttacagaaatacaggttacacatcaggaagccaaattcgaatgcggagaaacaatcagcagttgttttagggtttaacttgtggaattcttcagcacaagatgaagaagagacatgtgaaggaggagaatcattgaagagacgcaatgcgcaatcagattctcctcaaggtcctttgcagttaccgtctacaacaacaacaactggtggagatagtagcatggaagatgttgaagatgctaagtctgagagctttcaactggagagattgagatcaccataaatctcaagaaaccaaactcttgatcacggttttgttattttggattcattactatatctattagtagtgaatgagaacaataattatagaaaggtttatagatatatatatagagaaaaagagagagtgaggatggttcaaattatttgcagagattatacttagccttgtttttgtaaacggctttttttggttgggtttttatttttcttgaggcattatccaatattcaagtg

SEQ ID NO: 1270 - protein, 1373 aa, Arabidopsis thaliana
  misc_feature: PFam Name: Myb_DNA-binding; PFam Description: Myb-like
  misc_feature: GI Number: 21554992; NR Description: unknown [Arabidopsis thaliana]
  misc_feature: GI Number: 5734711; NR Description: F24J5.9 [Arabidopsis thaliana] >gi|25404762|pir||C96711 F24J5.9 [imported] - Arabidopsis
  misc_feature: GI Number: 21593572; NR Description: unknown [Arabidopsis thaliana]
  misc_feature: GI Number: 18419989; NR Description: myb family transcription
  misc_feature: GI Number: 21553699; NR Description: unknown [Arabidopsis thaliana]
GTTTCTTCTTCACACTCTGATTCTCTTACTATTTTACTCTGTTGTTGTTGTTGTGATATCAAGAGAGTGGGTTTGAGATCATGCCAAATTCTGGAAAAAGTTTGAGTTTTTAATTCCAATCGAGAAAAAATAAAAATGGGTTCTTTAGGTGATGAGCTTAGTTTGGGATCGATCTTTGGGAGAGGAGTTTCGATGAATGTTGTGGCGGTGGAGAAAGTTGATGAACATGTTAAGAAGCTTGAAGAAGAGAAGAGAAAGCTCGAAAGTTGTCAACTTGAGCTTCCTCTGTCTTTGCAGATTTTAAACGATGCGATTTTGTATCTGAAGGATAAGAGATGTTCAGAGATGGAGACTCAACCATTGTTGAAAGATTTCATTTCTGTTAATAAACCTATTCAAGGAGAAAGAGGAATAGAATTGCTGAAAAGAGAGGAGCTAATGAGGGAGAAGAAGTTTCAGCAATGGAAAGCTAATGATGATCACACTAGTAAGATCAAGAGCAAGCTTGAGATTAAGAGAAATGAGGAGAAATCTCCTATGTTGTTGATTCCAAAGGTGGAAACTGGTTTAGGCCTCGGTTTAAGTTCGAGTTCGATAAGAAGAAAAGGGATTGTTGCCTCATGTGGCTTTACTTCTAACTCTATGCCACAACCACCAACACCAGCAGTACCACAACAACCAGCATTTCTTAAGCAGCAAGCTTTACGGAAGCAAAGAAGGTGTTGGAATCCAGAGTTGCATCGCCGATTTGTCGATGCATTGCAACAGCTAGGTGGACCGGGAGTGGCAACTCCTAAACAAATTAGAGAACATATGCAAGAAGAAGGCTTAACCAATGATGAAGTCAAGAGTCATTTACAGAAATACAGGTTACACATCAGGAAGCCAAATTCGAATGCGGAGAAACAATCAGCAGTTGTTTTAGGGTTTAACTTGTGGAATTCTTCAGCACAAGATGAAGAAGAGACATGTGAAGGAGGAGAATCATTGAAGAGACGCAATGCGCAATCAGATTCTCCTCAAGGTCCTTTGCAGTTACCGTCTACAACAACAACAACTGGTGGAGATAGTAGCATGGAAGATGTTGAAGATGCTAAGTCTGAGAGCTTTCAACTGGAGAGATTGAGATCACCATAAATCTCAAGAAACCAAACTCTTGATCACGGTTTTGTTATTTTGGATTCATTACTATATCTATTAGTAGTGAATGAGAACAATAATTATAGAAAGGTTTATAGATATATATATAGAGAAAAAGAGAGAGTGAGGATGGTTCAAATTATTTGCAGAGATTATACTTAGCCTTGTTTTTGTAAACGGCTTTTTTTGGTTGGGTTTTTATTTTTCTTGAGGCATTATCCAATATTCAAGTG

SEQ ID NO: 1271 - DNA, 1014 bp, Arabidopsis thaliana
  misc_feature (1)..(1014): Ceres cDNA ID no. 12421710
  misc_feature (1)..(1014): Ceres CLONE  ID no. 4524
  misc_feature (1)..(1014): Also known as  Ceres CDNA ID no. 23388920
gtaacaaacaaacaaaaaagttggtgaactactaaacaacactcacaccaaaaagacgacgatggtttcgtttcgcttccctttctcgttttctcagcccccgcgtgccaccacgtcattctccggattctccatttccgctgtcgctgtctccgtcaccgttggcgccgcagccgccggagctgcgatcgcggcgtcccggaatcccagccatccgattctagagtgggccttctcctctcaccgttcgtctctttcaccatggggatctataactctagcagacgaatccgttgtcgaacctaagaccggtttctcgtttcccgcttcaatcggagattcccggcgattactcggcgtcggcctgaggaagaagagcttactgggattgaagaacatcgatgtctacgccttcggcgtgtatgctgattgtgatgatgtgaagaaacttgtgggagacaagtacgcaaatcttccagcttcagagatcaggggaaacaagtcattcatggatgatctcatggaagccgatattaagatgacgataagactacagattgtctacggcaaactcaacatccgatccgtgcgtaatgctttccaagagtctgttggaaacagactcaagaagttcggtggctcagacaatgacgagttgcttcaaagcttcactagcctcttcaaagatgagtataagattccaagaaactccaccattgatttgacaaaagatccgggccatgtactcagcgttgcaattgaggggaaccatgtcgggagtgtgaagagccatctcttgtgtagatcaatcttagacttgtacattggtgaagaaccgtttgataagaatgcaagagaagattttctagacaatgcagcttctctagccttcgacaactagttcacaacaaaatgttgctttctttctttcttaacggattctctatatatacggcataatgttgaggaatgtatttgaaataaattgcttggggaattgggttttgttagtct

SEQ ID NO: 1272 - protein, 1014 aa, Arabidopsis thaliana
  misc_feature: GI Number: 33867695; NR Description: putative chalcone
GTAACAAACAAACAAAAAAGTTGGTGAACTACTAAACAACACTCACACCAAAAAGACGACGATGGTTTCGTTTCGCTTCCCTTTCTCGTTTTCTCAGCCCCCGCGTGCCACCACGTCATTCTCCGGATTCTCCATTTCCGCTGTCGCTGTCTCCGTCACCGTTGGCGCCGCAGCCGCCGGAGCTGCGATCGCGGCGTCCCGGAATCCCAGCCATCCGATTCTAGAGTGGGCCTTCTCCTCTCACCGTTCGTCTCTTTCACCATGGGGATCTATAACTCTAGCAGACGAATCCGTTGTCGAACCTAAGACCGGTTTCTCGTTTCCCGCTTCAATCGGAGATTCCCGGCGATTACTCGGCGTCGGCCTGAGGAAGAAGAGCTTACTGGGATTGAAGAACATCGATGTCTACGCCTTCGGCGTGTATGCTGATTGTGATGATGTGAAGAAACTTGTGGGAGACAAGTACGCAAATCTTCCAGCTTCAGAGATCAGGGGAAACAAGTCATTCATGGATGATCTCATGGAAGCCGATATTAAGATGACGATAAGACTACAGATTGTCTACGGCAAACTCAACATCCGATCCGTGCGTAATGCTTTCCAAGAGTCTGTTGGAAACAGACTCAAGAAGTTCGGTGGCTCAGACAATGACGAGTTGCTTCAAAGCTTCACTAGCCTCTTCAAAGATGAGTATAAGATTCCAAGAAACTCCACCATTGATTTGACAAAAGATCCGGGCCATGTACTCAGCGTTGCAATTGAGGGGAACCATGTCGGGAGTGTGAAGAGCCATCTCTTGTGTAGATCAATCTTAGACTTGTACATTGGTGAAGAACCGTTTGATAAGAATGCAAGAGAAGATTTTCTAGACAATGCAGCTTCTCTAGCCTTCGACAACTAGTTCACAACAAAATGTTGCTTTCTTTCTTTCTTAACGGATTCTCTATATATACGGCATAATGTTGAGGAATGTATTTGAAATAAATTGCTTGGGGAATTGGGTTTTGTTAGTCT

SEQ ID NO: 1273 - DNA, 1578 bp, Arabidopsis thaliana
  misc_feature (1)..(1578): Ceres cDNA ID no. 12421854
  misc_feature (1)..(1578): Ceres CLONE  ID no. 232220
  misc_feature (1)..(1578): Also known as  Ceres CDNA ID no. 23389053
gacctttggtttctgtgttgtgtgatatttactacgaaaccacttgtcaccaaaggttcttctttcttttagcgttgggttcgtgattccaagatcaatggttgtgaacttcactagttagagatactgaatcaaagagatgattcttccgagaattgggtaaatctatcgattctgattttctggattaaagaactagtaacctattttcattccatagcttcttcagatcatacattctcgcaagtgttcgatacgggtgtagaagaagaagagtctttctatgctcctgatcatgatgtcttgactctgcttcaacctaacttcaccaccaacgatgtctagtagtaccaagaacattccaaaacctcctcctcttccttgtattacctaccagcgttttcaatctagtacaaggaaaccttcgagcttaatgcgccttgtgcctaaagaagcacttgaaacttgggataagcttttcaaggaaggatctggagcagatacatatgttgaaaccgataacaagtctcactttcctgcccattcaagtgtcctggctgcagcctcaccagttatagcgacacttctgaatcaatcgagggataagaatgggaatacatacctcaaaatccatggagttccttgtgaagcagtctacatgttcattaggtttctatactcttcctgctacgaggaggaagaaatgaagaagtttgtgctccatttattggttctgtcacattgctactcggtcccatctcttaaaagactttgtgtagagattctcgatcaaggatggattaacaaggagaatgtgatcgatgtgcttcaactagcgagaaactgtgacgtgacaaggatttgctttgtatgtctttccatggtcatcaaagacttcaaatctgtatcttcaacagagggatggaaagtgatgaaacgctctaatcctttgctcgaacaagagctcattgaggcagtcatcgaatccgacagtaggaaacaagaaagaagaagaaaactggaggagagagaagtgtatttgcagctctatgaagccatggaagctcttgtccacatatgtcgtgaaggttgtgggacaattggacctcgcgataaggcccttaaaggaagccataccgtgtgtaaattcccggcgtgtaaagggcttgaaggtgcgctcagacatttcttgggatgcaagtctagggcttcatgttctcattgcaaaaggatgtggcagcttcttcagcttcactcttgtatctgtgatgattctaattcttgcaaagtttctctctgctggaatttcaaggagaaaatgaagaagcttagcaagaaagaacaatctaaatggcgattgcttgtagaaaacattattagggcgaggaacagtctcgggcccttctcgtcacgtccttctggtttgatatagaaacaggttttagattttagtgtatagccagttagacacaaaaagaaaacgtacataggcgcagggtatagtgtatattgcgcaccaatacggcgcacaatagtggttttgaacaaacattgtctatatcaagttggttgttatat

SEQ ID NO: 1274 - protein, 1578 aa, Arabidopsis thaliana
  misc_feature: PFam Name: BTB; PFam Description: BTB/POZ domain
  misc_feature: PFam Name: zf-TAZ; PFam Description: TAZ zinc finger
  misc_feature: GI Number: 42561724; NR Description: TAZ zinc finger family
  misc_feature: GI Number: 57899800; NR Description: putative BTB and TAZ
  misc_feature: GI Number: 42573822; NR Description: TAZ zinc finger family
  misc_feature: GI Number: 34907566; NR Description: B1078G07.24 [Oryza sativa (japonica cultivar-group)] >gi|20161276|dbj|BAB90202.1| B1078G07.24 [Oryza sativa (japonica cultivar-group)] >gi|21952829|dbj|BAC06244.1| P0696G06.1 [Oryza sativa (japonica
  misc_feature: GI Number: 21537174; NR Description: unknown [Arabidopsis thaliana]
GACCTTTGGTTTCTGTGTTGTGTGATATTTACTACGAAACCACTTGTCACCAAAGGTTCTTCTTTCTTTTAGCGTTGGGTTCGTGATTCCAAGATCAATGGTTGTGAACTTCACTAGTTAGAGATACTGAATCAAAGAGATGATTCTTCCGAGAATTGGGTAAATCTATCGATTCTGATTTTCTGGATTAAAGAACTAGTAACCTATTTTCATTCCATAGCTTCTTCAGATCATACATTCTCGCAAGTGTTCGATACGGGTGTAGAAGAAGAAGAGTCTTTCTATGCTCCTGATCATGATGTCTTGACTCTGCTTCAACCTAACTTCACCACCAACGATGTCTAGTAGTACCAAGAACATTCCAAAACCTCCTCCTCTTCCTTGTATTACCTACCAGCGTTTTCAATCTAGTACAAGGAAACCTTCGAGCTTAATGCGCCTTGTGCCTAAAGAAGCACTTGAAACTTGGGATAAGCTTTTCAAGGAAGGATCTGGAGCAGATACATATGTTGAAACCGATAACAAGTCTCACTTTCCTGCCCATTCAAGTGTCCTGGCTGCAGCCTCACCAGTTATAGCGACACTTCTGAATCAATCGAGGGATAAGAATGGGAATACATACCTCAAAATCCATGGAGTTCCTTGTGAAGCAGTCTACATGTTCATTAGGTTTCTATACTCTTCCTGCTACGAGGAGGAAGAAATGAAGAAGTTTGTGCTCCATTTATTGGTTCTGTCACATTGCTACTCGGTCCCATCTCTTAAAAGACTTTGTGTAGAGATTCTCGATCAAGGATGGATTAACAAGGAGAATGTGATCGATGTGCTTCAACTAGCGAGAAACTGTGACGTGACAAGGATTTGCTTTGTATGTCTTTCCATGGTCATCAAAGACTTCAAATCTGTATCTTCAACAGAGGGATGGAAAGTGATGAAACGCTCTAATCCTTTGCTCGAACAAGAGCTCATTGAGGCAGTCATCGAATCCGACAGTAGGAAACAAGAAAGAAGAAGAAAACTGGAGGAGAGAGAAGTGTATTTGCAGCTCTATGAAGCCATGGAAGCTCTTGTCCACATATGTCGTGAAGGTTGTGGGACAATTGGACCTCGCGATAAGGCCCTTAAAGGAAGCCATACCGTGTGTAAATTCCCGGCGTGTAAAGGGCTTGAAGGTGCGCTCAGACATTTCTTGGGATGCAAGTCTAGGGCTTCATGTTCTCATTGCAAAAGGATGTGGCAGCTTCTTCAGCTTCACTCTTGTATCTGTGATGATTCTAATTCTTGCAAAGTTTCTCTCTGCTGGAATTTCAAGGAGAAAATGAAGAAGCTTAGCAAGAAAGAACAATCTAAATGGCGATTGCTTGTAGAAAACATTATTAGGGCGAGGAACAGTCTCGGGCCCTTCTCGTCACGTCCTTCTGGTTTGATATAGAAACAGGTTTTAGATTTTAGTGTATAGCCAGTTAGACACAAAAAGAAAACGTACATAGGCGCAGGGTATAGTGTATATTGCGCACCAATACGGCGCACAATAGTGGTTTTGAACAAACATTGTCTATATCAAGTTGGTTGTTATAT

SEQ ID NO: 1275 - DNA, 1253 bp, Arabidopsis thaliana
  misc_feature (1)..(1253): Ceres cDNA ID no. 12422100
  misc_feature (1)..(1253): Ceres CLONE  ID no. 118190
  misc_feature (1)..(1253): Also known as  Ceres CDNA ID no. 23389275
caaagagcaaagagctaaagtccaaaaccaaacacaaaaacaaaaatctaaatttctttcttggtctgctttcaatatggctcctctacctatttcttcgattagagttgggaaaatagatgatgttcaagaactcataaaatccaaaccaaacaaagttccagagagattcattagagaagagtatgagagaggagtcgttgtgtcgtctcttaagactcatcatcttcatcatcagattcctgttattgatctctctaagctctctaaacccgacaatgatgattttttctttgagattcttaagctctcacaagcttgtgaagactggggatttttccaggttataaatcatgggatagaagtggaggttgtggaagatatagaggaagtggcttcagagttctttgatatgccattggaggagaagaagaagtatccaatggagccaggtaccgtacaaggttatggtcaagctttcatattctccgaagatcagaaacttgattggtgcaacatgtttgcccttggtgttcatcctccacaaattcgcaaccccaaactatggccctctaaaccggcccggttcagtgaaagtcttgaaggttactcaaaagagataagggaactatgcaaaaggttgttgaagtatatagcaataagcttgggtctaaaagaagagagatttgaggaaatgtttggggaggcagtgcaagcagtgaggatgaattattaccctccatgttcaagtcctgatcttgtcttaggacttagtccacattctgatggaagtgctctcactgttcttcaacagagcaagaacagttgtgttggccttcagatcctcaaagacaacacttgggtccctgttaaacctcttcccaatgcccttgtcatcaacattggtgataccattgaggtgctaagtaatgggaaatacaagagtgtagagcatagggcagtaacaaacagggaaaaggagaggcttacaatagtgacattctatgcaccaaactatgaggttgaaatagaaccaatgagtgagttggttgatgatgagaccaacccatgcaagtatagaagctacaatcatggtgactatagttatcactatgtctccaacaagctccaaggcaagaagtcccttgattttgccaagattctcaattaaactattattaatttcaccccatcaaatctccattaactagttaccacttaatttgctttctttaataagaaaaattatttgt

SEQ ID NO: 1276 - protein, 1253 aa, Arabidopsis thaliana
  misc_feature: PFam Name: 2OG-FeII_Oxy; PFam Description: 2OG-Fe(II)
  misc_feature: GI Number: 34907194; NR Description: putative ethylene-forming enzyme [Oryza sativa (japonica cultivar-group)] >gi|15408799|dbj|BAB64195.1| putative ethylene-forming enzyme
  misc_feature: GI Number: 1161167; NR Description: ethylene-forming enzyme
  misc_feature: GI Number: 5734767; NR Description: SRG1 Protein [Arabidopsis thaliana] >gi|22655018|gb|AAM98100.1| At1g17020/F6I1.30 [Arabidopsis thaliana] >gi|479047|emb|CAA55654.1| SRG1 [Arabidopsis thaliana] >gi|15081819|gb|AAK82564.1|
  misc_feature: GI Number: 7269382; NR Description: SRG1-like protein [Arabidopsis thaliana] >gi|4454019|emb|CAA23072.1| SRG1-like protein [Arabidopsis thaliana] >gi|45752708|gb|AAS76252.1| At4g25310 [Arabidopsis thaliana] >gi|15235017|ref|NP_194261.1|
  misc_feature: GI Number: 7269381; NR Description: SRG1-like protein [Arabidopsis thaliana] >gi|4454018|emb|CAA23071.1| SRG1-like protein [Arabidopsis thaliana] >gi|15235014|ref|NP_194260.1| oxidoreductase, 2OG-Fe(II) oxygenase family protein [Arabidopsis
CAAAGAGCAAAGAGCTAAAGTCCAAAACCAAACACAAAAACAAAAATCTAAATTTCTTTCTTGGTCTGCTTTCAATATGGCTCCTCTACCTATTTCTTCGATTAGAGTTGGGAAAATAGATGATGTTCAAGAACTCATAAAATCCAAACCAAACAAAGTTCCAGAGAGATTCATTAGAGAAGAGTATGAGAGAGGAGTCGTTGTGTCGTCTCTTAAGACTCATCATCTTCATCATCAGATTCCTGTTATTGATCTCTCTAAGCTCTCTAAACCCGACAATGATGATTTTTTCTTTGAGATTCTTAAGCTCTCACAAGCTTGTGAAGACTGGGGATTTTTCCAGGTTATAAATCATGGGATAGAAGTGGAGGTTGTGGAAGATATAGAGGAAGTGGCTTCAGAGTTCTTTGATATGCCATTGGAGGAGAAGAAGAAGTATCCAATGGAGCCAGGTACCGTACAAGGTTATGGTCAAGCTTTCATATTCTCCGAAGATCAGAAACTTGATTGGTGCAACATGTTTGCCCTTGGTGTTCATCCTCCACAAATTCGCAACCCCAAACTATGGCCCTCTAAACCGGCCCGGTTCAGTGAAAGTCTTGAAGGTTACTCAAAAGAGATAAGGGAACTATGCAAAAGGTTGTTGAAGTATATAGCAATAAGCTTGGGTCTAAAAGAAGAGAGATTTGAGGAAATGTTTGGGGAGGCAGTGCAAGCAGTGAGGATGAATTATTACCCTCCATGTTCAAGTCCTGATCTTGTCTTAGGACTTAGTCCACATTCTGATGGAAGTGCTCTCACTGTTCTTCAACAGAGCAAGAACAGTTGTGTTGGCCTTCAGATCCTCAAAGACAACACTTGGGTCCCTGTTAAACCTCTTCCCAATGCCCTTGTCATCAACATTGGTGATACCATTGAGGTGCTAAGTAATGGGAAATACAAGAGTGTAGAGCATAGGGCAGTAACAAACAGGGAAAAGGAGAGGCTTACAATAGTGACATTCTATGCACCAAACTATGAGGTTGAAATAGAACCAATGAGTGAGTTGGTTGATGATGAGACCAACCCATGCAAGTATAGAAGCTACAATCATGGTGACTATAGTTATCACTATGTCTCCAACAAGCTCCAAGGCAAGAAGTCCCTTGATTTTGCCAAGATTCTCAATTAAACTATTATTAATTTCACCCCATCAAATCTCCATTAACTAGTTACCACTTAATTTGCTTTCTTTAATAAGAAAAATTATTTGT

SEQ ID NO: 1277 - DNA, 1527 bp, Arabidopsis thaliana
  misc_feature (1)..(1527): Ceres cDNA ID no. 12422176
  misc_feature (1)..(1527): Ceres CLONE  ID no. 108820
  misc_feature (1)..(1527): Also known as  Ceres CDNA ID no. 23389344
acactttccccaactcatcatcactctaaaatatctcccaccacataccacttaacccgacccgacccgaccggaaaacccgacccgatccatcccaatgtcaggagctaccaccgcttcctccggagaccacaacaacctccgtctcccaactccgacgcttgacgccgaatcgcaaactctgctgcaatcgatttctgctgaagggggttacgcttatgctcgcatggcggtgttagcggtggccggtgaccaaagcgcggcggaggcggcgcgtgatatggcttgggagcaacttcactctggtccgtggcactcggttctccccgtttggcgcgacgcttactcaatggcttgtctccacgtagctaaaatccatttcgccgccggcgagtttggtgaggcgcttggtgcgcttgatatgggtcttatcatgggaggtatgcttctccgcaaggatcttcatgattctgttttgttggtctcctctgaagctcgtaagatgacgaagagtcttgaagaagcttctggagatttcaaaggtgagagattggtcccggaagttcccgtcgacgtcaatgaggtccttaagattctaccttgcaggtctttaacttgtaaaagagtagagaagaggtctggtttatctttggaggggtttctgcgtgattattatctgccaggtacaccagttgttataaccaattctatggctcattggccagccaggaccaagtggaatcacttggactacctcaatgctgttgctggtaaccgcaccgttcccgtggaggtggggaaaaactatttgtgttctgattggaagcaagagcttgtgacattttctaagttccttgaacggatgcggaccaataaatcgtctccaatggagcctacttatcttgcccagcatcctttgtttgatcagataaatgaactgagagatgatatatgtattcctgattactgttttgtcggtggtggggaactccaatcacttaatgcatggtttggcccggctgggacagttactccgttacaccatgatccacatcataatatacttgctcaggttgttggcaagaagtatataaggctttacccatccttcctgcaagacgaactttacccttactctgagacaatgctctgcaactctagtcaggttgatctagacaatatcgacgaaaccgagttcccaaaggccatggagttggagtttatggattgtattctagaagaaggtgaaatgttgtacatccctcccaaatggtggcactatgtcaggtccttaacaatgagtctctcggttagcttctggtggagcaatgaagcagaatcttctagctcgtagcgaatggatttatttttaatctctgtttcaggttctaagttcacgttgtgtctttatgtaagaagaaactatgtagagaagaaaacaactgctccgagcatgaagatgtttgtttggtttacgtctatgttgtaaaagacaattgagagctcttggtacagacattttttagg

SEQ ID NO: 1278 - protein, 1527 aa, Arabidopsis thaliana
  misc_feature: PFam Name: JmjC; PFam Description: JmjC domain
  misc_feature: PFam Name: Cupin_4; PFam Description: Cupin superfamily protein
  misc_feature: GI Number: 21928039; NR Description: AT3g20810/MOE17_10 [Arabidopsis thaliana] >gi|20147203|gb|AAM10317.1| AT3g20810/MOE17_10 [Arabidopsis thaliana] >gi|30685945|ref|NP_850617.1| transcription factor jumonji (jmjC)
  misc_feature: GI Number: 50947487; NR Description: N-acetyltransferase and Transcription factor-like protein [Oryza sativa (japonica cultivar-group)] >gi|42408989|dbj|BAD10244.1| N-acetyltransferase and Transcription factor-like protein [Oryza sativa (japonica
  misc_feature: GI Number: 62641259; NR Description: PREDICTED: similar to
  misc_feature: GI Number: 28317179; NR Description: GM21055p [Drosophila
  misc_feature: GI Number: 47575576; NR Description: COG2850: Uncharacterized
ACACTTTCCCCAACTCATCATCACTCTAAAATATCTCCCACCACATACCACTTAACCCGACCCGACCCGACCGGAAAACCCGACCCGATCCATCCCAATGTCAGGAGCTACCACCGCTTCCTCCGGAGACCACAACAACCTCCGTCTCCCAACTCCGACGCTTGACGCCGAATCGCAAACTCTGCTGCAATCGATTTCTGCTGAAGGGGGTTACGCTTATGCTCGCATGGCGGTGTTAGCGGTGGCCGGTGACCAAAGCGCGGCGGAGGCGGCGCGTGATATGGCTTGGGAGCAACTTCACTCTGGTCCGTGGCACTCGGTTCTCCCCGTTTGGCGCGACGCTTACTCAATGGCTTGTCTCCACGTAGCTAAAATCCATTTCGCCGCCGGCGAGTTTGGTGAGGCGCTTGGTGCGCTTGATATGGGTCTTATCATGGGAGGTATGCTTCTCCGCAAGGATCTTCATGATTCTGTTTTGTTGGTCTCCTCTGAAGCTCGTAAGATGACGAAGAGTCTTGAAGAAGCTTCTGGAGATTTCAAAGGTGAGAGATTGGTCCCGGAAGTTCCCGTCGACGTCAATGAGGTCCTTAAGATTCTACCTTGCAGGTCTTTAACTTGTAAAAGAGTAGAGAAGAGGTCTGGTTTATCTTTGGAGGGGTTTCTGCGTGATTATTATCTGCCAGGTACACCAGTTGTTATAACCAATTCTATGGCTCATTGGCCAGCCAGGACCAAGTGGAATCACTTGGACTACCTCAATGCTGTTGCTGGTAACCGCACCGTTCCCGTGGAGGTGGGGAAAAACTATTTGTGTTCTGATTGGAAGCAAGAGCTTGTGACATTTTCTAAGTTCCTTGAACGGATGCGGACCAATAAATCGTCTCCAATGGAGCCTACTTATCTTGCCCAGCATCCTTTGTTTGATCAGATAAATGAACTGAGAGATGATATATGTATTCCTGATTACTGTTTTGTCGGTGGTGGGGAACTCCAATCACTTAATGCATGGTTTGGCCCGGCTGGGACAGTTACTCCGTTACACCATGATCCACATCATAATATACTTGCTCAGGTTGTTGGCAAGAAGTATATAAGGCTTTACCCATCCTTCCTGCAAGACGAACTTTACCCTTACTCTGAGACAATGCTCTGCAACTCTAGTCAGGTTGATCTAGACAATATCGACGAAACCGAGTTCCCAAAGGCCATGGAGTTGGAGTTTATGGATTGTATTCTAGAAGAAGGTGAAATGTTGTACATCCCTCCCAAATGGTGGCACTATGTCAGGTCCTTAACAATGAGTCTCTCGGTTAGCTTCTGGTGGAGCAATGAAGCAGAATCTTCTAGCTCGTAGCGAATGGATTTATTTTTAATCTCTGTTTCAGGTTCTAAGTTCACGTTGTGTCTTTATGTAAGAAGAAACTATGTAGAGAAGAAAACAACTGCTCCGAGCATGAAGATGTTTGTTTGGTTTACGTCTATGTTGTAAAAGACAATTGAGAGCTCTTGGTACAGACATTTTTTAGG

SEQ ID NO: 1279 - DNA, 1470 bp, Arabidopsis thaliana
  misc_feature (1)..(1470): Ceres cDNA ID no. 12422493
  misc_feature (1)..(1470): Ceres CLONE  ID no. 22418
  misc_feature (1)..(1470): Also known as  Ceres CDNA ID no. 23389639
aacactctcctccaaatcccagatctctctctgtctctgtcccgcggagtccccgagagattgatcaccatcacttttgtaccttccttgtactacctatggcgtctgctagcttcgttaagcctaacaccctctcttctccatggatcggccaacgctcctttgctcacacctctgcttcttcttctcctcctcctcgagtctccttcgcgatccgcgccggtgcttactccgacgagcttgttaaaaccgccaaaagcattgcatcccctgggagaggtatcttggcgatcgatgagtccaatgcaacctgtgggaagaggcttgcttctatcggcttggataacaccgaggacaaccgtcaggcctacaggcaacttctgcttaccactcctggcctcggcgattacatctctggttccattctcttcgaggagactctttaccagtccaccaaggacggtaagacctttgtcgattgcttgcgcgatgccaacatcgtccctggcatcaaagttgacaagggcttgtctcccctagccggttccaacgaagagtcttggtgccaaggcttggatggattggcctcacgctctgctgagtactacaagcaaggcgctcgttttgccaagtggaggacagtggtgagtgttccctgcggtccttcagcactggctgtgaaggaagctgcgtgggggctggctcgctatgcagccatctctcaggataatggtcttgtccccattgtggagccagagatccttctggacggggaccacccaatagagaggactctggaggtggcagagaaagtgtggtcagaggtgttcttctacttggcacagaacaacgtcatgtttgagggcattctgttgaagccgagcatggtcaccccaggcgctgagcacaagaacaaggcctctcccgagaccgttgcagatttcacgctcaccatgctgaaaaggagggttcctccggctgtcccagggatcatgtttctgtcaggaggacaatcagaggcagaggccacactgaacctgaacgccatgaaccagagcccaaacccatggcatgtgtccttctcatacgcacgtgccctgcagaactccgtgctcagaacatggcaaggcaagccggagaagattgaggcctcgcagaaggcactgttggtgagggcaaaggccaactcactggcccagctcggcaaatactcagccgagggagagaacgaggatgccaagaaaggaatgtttgtcaagggttacacctactgatttgttaatttcagagatcgtaataaggattaaggaccattgttgtcttttgtttttttttcccttttttgttttgtctctgagaaagaaagacagtcacgagtcacgatcatatcatatatgtatgtgagcaacgtgaaaacatcctcttaaatctatatttcctctcagaaagactgattactgtttgactgcc

SEQ ID NO: 1280 - protein, 1470 aa, Arabidopsis thaliana
  misc_feature: PFam Name: Glycolytic; PFam Description:
  misc_feature: GI Number: 53828647; NR Description: At4g38970 [Arabidopsis thaliana] >gi|18420348|ref|NP_568049.1| fructose-bisphosphate
  misc_feature: GI Number: 399024; NR Description: FRUCTOSE-BISPHOSPHATE ALDOLASE 1, CHLOROPLAST PRECURSOR >gi|322710|pir||S29047 fructose-bisphosphate aldolase (EC 4.1.2.13) precursor, chloroplast
  misc_feature: GI Number: 1781348; NR Description: homologous to plastidic aldolases [Solanum tuberosum] >gi|7436610|pir||T07418 probable fructose-bisphosphate aldolase (EC 4.1.2.13) precursor, chloroplast
  misc_feature: GI Number: 21311559; NR Description: latex plastidic
  misc_feature: GI Number: 4827251; NR Description: plastidic aldolase
AACACTCTCCTCCAAATCCCAGATCTCTCTCTGTCTCTGTCCCGCGGAGTCCCCGAGAGATTGATCACCATCACTTTTGTACCTTCCTTGTACTACCTATGGCGTCTGCTAGCTTCGTTAAGCCTAACACCCTCTCTTCTCCATGGATCGGCCAACGCTCCTTTGCTCACACCTCTGCTTCTTCTTCTCCTCCTCCTCGAGTCTCCTTCGCGATCCGCGCCGGTGCTTACTCCGACGAGCTTGTTAAAACCGCCAAAAGCATTGCATCCCCTGGGAGAGGTATCTTGGCGATCGATGAGTCCAATGCAACCTGTGGGAAGAGGCTTGCTTCTATCGGCTTGGATAACACCGAGGACAACCGTCAGGCCTACAGGCAACTTCTGCTTACCACTCCTGGCCTCGGCGATTACATCTCTGGTTCCATTCTCTTCGAGGAGACTCTTTACCAGTCCACCAAGGACGGTAAGACCTTTGTCGATTGCTTGCGCGATGCCAACATCGTCCCTGGCATCAAAGTTGACAAGGGCTTGTCTCCCCTAGCCGGTTCCAACGAAGAGTCTTGGTGCCAAGGCTTGGATGGATTGGCCTCACGCTCTGCTGAGTACTACAAGCAAGGCGCTCGTTTTGCCAAGTGGAGGACAGTGGTGAGTGTTCCCTGCGGTCCTTCAGCACTGGCTGTGAAGGAAGCTGCGTGGGGGCTGGCTCGCTATGCAGCCATCTCTCAGGATAATGGTCTTGTCCCCATTGTGGAGCCAGAGATCCTTCTGGACGGGGACCACCCAATAGAGAGGACTCTGGAGGTGGCAGAGAAAGTGTGGTCAGAGGTGTTCTTCTACTTGGCACAGAACAACGTCATGTTTGAGGGCATTCTGTTGAAGCCGAGCATGGTCACCCCAGGCGCTGAGCACAAGAACAAGGCCTCTCCCGAGACCGTTGCAGATTTCACGCTCACCATGCTGAAAAGGAGGGTTCCTCCGGCTGTCCCAGGGATCATGTTTCTGTCAGGAGGACAATCAGAGGCAGAGGCCACACTGAACCTGAACGCCATGAACCAGAGCCCAAACCCATGGCATGTGTCCTTCTCATACGCACGTGCCCTGCAGAACTCCGTGCTCAGAACATGGCAAGGCAAGCCGGAGAAGATTGAGGCCTCGCAGAAGGCACTGTTGGTGAGGGCAAAGGCCAACTCACTGGCCCAGCTCGGCAAATACTCAGCCGAGGGAGAGAACGAGGATGCCAAGAAAGGAATGTTTGTCAAGGGTTACACCTACTGATTTGTTAATTTCAGAGATCGTAATAAGGATTAAGGACCATTGTTGTCTTTTGTTTTTTTTTCCCTTTTTTGTTTTGTCTCTGAGAAAGAAAGACAGTCACGAGTCACGATCATATCATATATGTATGTGAGCAACGTGAAAACATCCTCTTAAATCTATATTTCCTCTCAGAAAGACTGATTACTGTTTGACTGCC

SEQ ID NO: 1281 - DNA, 1460 bp, Arabidopsis thaliana
  misc_feature (1)..(1460): Ceres cDNA ID no. 12422685
  misc_feature (1)..(1460): Ceres CLONE  ID no. 114093
  misc_feature (1)..(1460): Also known as  Ceres CDNA ID no. 23389808
aaggaaaaggcaatgcaagaagaagcttaaatctctcttctctgctcctgaagtctgttcatggcgatgtcgggaactttccatttgacttctgactatgtccctggttacacactttcagacagccgttgcttctttaactctgctgtttcaagaagaacacttgccatattaccttgctcttcctgtctcgatcacaagaatgggcgtctgaaatctgtccccaatagaagttcttttgtgtgccgagcaagttctggcggctataggagaaatcctgatttctcaagacttaataagcatggttaccggggaaacaacaggcaaagcggagggagagaagattttgatatcgaaaactctgatatgttgtcttcaagaaatgggcctttattcaacctgtctagttcccccaaattccaagctacctcatcccctggacctagagagaaagagatcgtggagcttttcagaaaggttcaagctcagctccgagctcgtgctgcagcaaagaaagaagaaaaaaagattgaagaagcttctaaagggcagggaaaagaaagtgaaactgttgactctcttcttaagttactaaggaagcactcgggagagcaaagcaagaggcaagttagcaaatttagcagccagggagaagtacaaggagatactgttgacaaacaagatcgcaccggaaatcttgtcacttcagggaacaaagataataatgcatcatcctttaccagaccaacatcaagcttcagaagaaagtcgccagtaccaagatctcaatcaccgccagcttattctagcgaggcaacttttgatcaatcatcaagttacagtgtaacctggacccagaagaaggatacagtagagttgcatgatgagcctgaacatgagcctgcgtatgagcatgagcatgagcctgaaaatgagtcagaacctgggcctgtgacaactatgcttgaaccagattcagagctgaaaccagagtcatcatcattttatcaagaggaggaggatgatgatgttacttttgatgtgttatcacaggatgatggtattttagatgtgttatcagatgatgatgagtctctcgatgatgctgatgaagatagtgatgaagctgaggaagaagccgtgaaagacttgagtgaattgaagctggtcgaacttagaggcatagcaaagtcacggggactaaaagggttgtcaaagatgaagaaagccgaattagtggagttgcttggtagtgattccagctgaaccttgctctagtatgcaccagttaaaatgagttactttctctgtattttgtttgtttggaaaatgctggctttgatgttcttgatttactaggattaccttcttctcttttaagttattattattacactgatgtaccttgtcaactacagttttcaggacgcattatttactgttcaatcatatggattttc

SEQ ID NO: 1282 - protein, 1460 aa, Arabidopsis thaliana
  misc_feature: PFam Name: Rho_N; PFam Description: Rho termination factor,
  misc_feature: GI Number: 21536878; NR Description: unknown [Arabidopsis thaliana]
  misc_feature: GI Number: 21727822; NR Description: SAP-like protein [Oryza sativa] >gi|21727820|emb|CAC86222.1| SAP-like protein [Oryza
  misc_feature: GI Number: 50920397; NR Description: Putative plasma membrane proton ATPase [Oryza sativa] >gi|15217290|gb|AAK92634.1| Putative
  misc_feature: GI Number: 9837385; NR Description: retinitis pigmentosa
AAGGAAAAGGCAATGCAAGAAGAAGCTTAAATCTCTCTTCTCTGCTCCTGAAGTCTGTTCATGGCGATGTCGGGAACTTTCCATTTGACTTCTGACTATGTCCCTGGTTACACACTTTCAGACAGCCGTTGCTTCTTTAACTCTGCTGTTTCAAGAAGAACACTTGCCATATTACCTTGCTCTTCCTGTCTCGATCACAAGAATGGGCGTCTGAAATCTGTCCCCAATAGAAGTTCTTTTGTGTGCCGAGCAAGTTCTGGCGGCTATAGGAGAAATCCTGATTTCTCAAGACTTAATAAGCATGGTTACCGGGGAAACAACAGGCAAAGCGGAGGGAGAGAAGATTTTGATATCGAAAACTCTGATATGTTGTCTTCAAGAAATGGGCCTTTATTCAACCTGTCTAGTTCCCCCAAATTCCAAGCTACCTCATCCCCTGGACCTAGAGAGAAAGAGATCGTGGAGCTTTTCAGAAAGGTTCAAGCTCAGCTCCGAGCTCGTGCTGCAGCAAAGAAAGAAGAAAAAAAGATTGAAGAAGCTTCTAAAGGGCAGGGAAAAGAAAGTGAAACTGTTGACTCTCTTCTTAAGTTACTAAGGAAGCACTCGGGAGAGCAAAGCAAGAGGCAAGTTAGCAAATTTAGCAGCCAGGGAGAAGTACAAGGAGATACTGTTGACAAACAAGATCGCACCGGAAATCTTGTCACTTCAGGGAACAAAGATAATAATGCATCATCCTTTACCAGACCAACATCAAGCTTCAGAAGAAAGTCGCCAGTACCAAGATCTCAATCACCGCCAGCTTATTCTAGCGAGGCAACTTTTGATCAATCATCAAGTTACAGTGTAACCTGGACCCAGAAGAAGGATACAGTAGAGTTGCATGATGAGCCTGAACATGAGCCTGCGTATGAGCATGAGCATGAGCCTGAAAATGAGTCAGAACCTGGGCCTGTGACAACTATGCTTGAACCAGATTCAGAGCTGAAACCAGAGTCATCATCATTTTATCAAGAGGAGGAGGATGATGATGTTACTTTTGATGTGTTATCACAGGATGATGGTATTTTAGATGTGTTATCAGATGATGATGAGTCTCTCGATGATGCTGATGAAGATAGTGATGAAGCTGAGGAAGAAGCCGTGAAAGACTTGAGTGAATTGAAGCTGGTCGAACTTAGAGGCATAGCAAAGTCACGGGGACTAAAAGGGTTGTCAAAGATGAAGAAAGCCGAATTAGTGGAGTTGCTTGGTAGTGATTCCAGCTGAACCTTGCTCTAGTATGCACCAGTTAAAATGAGTTACTTTCTCTGTATTTTGTTTGTTTGGAAAATGCTGGCTTTGATGTTCTTGATTTACTAGGATTACCTTCTTCTCTTTTAAGTTATTATTATTACACTGATGTACCTTGTCAACTACAGTTTTCAGGACGCATTATTTACTGTTCAATCATATGGATTTTC

SEQ ID NO: 1283 - DNA, 2143 bp, Zea mays
  misc_feature (1)..(2143): Ceres cDNA ID no. 12424075
  misc_feature (1)..(2143): Ceres CLONE  ID no. 377651
  misc_feature (1)..(2143): Also known as  Ceres CDNA ID no. 23796680
acaaattaagacgggcgtcgttggcttcaaatactggtctctcccctgtccaaaagtctctcgaatctccaccctggttccgcaccggttccagaattttctcccatttccagggtctccccgtttctgtccggcggttctgccgttccactgcttttgatttcggagtgtgagcttacatcttgctggacaataaagattggattttaagcgatttggggggtgcttgcctgatctccccctgcgaggtactgccgggggattggatttcggggaagttttggtggtttgatattcggcttggccggagcaggaatgacgatcgacatgtccattcccaggagctccgggctgctgaacgctgcggggaagagggacatgaagttcttcagcaacccctacgtgcttgcgctcacgggcgctgcaggaatcggtggattcctctttggctacgatacaggtgtcatatctggagcccttctgtatatccgcgatgattttccagcggtcaaggacaattacttcttacaggaaacgattgttagcatggccttagtcggagctatgattggagctgctgggggtggttggatcaatgatgcatacggtcgcaagaagtctactcttcttgctgatttgatgtttgctcttggctcacttgtcatgtgtgctgctgctggtccttacattctaattatcggaaggctcctcgttggtttgggtgtgggtgttgcatcagtcacagcaccggtatacattgctgaagctgctccttcagaaatcaggggaggtttggtgtcaactaatgtactcatgattaccggtggccaattcttctcctatcttatcaatcttggctttactgaggtgcctggaacatggcgctggatgcttggtgttgctgctgttcctgccattatacagtttgtgctgatgctattcctgccagaatctccgcgttggctttactggaaggatgagaaggcaaaagctattgccgtccttgagaggatctatgaatcggaccgcttggaggaagaggtagagctgcttgctacatcctccatgcatgaattccagtccaacaataccggaagctatctggatgtcttcaagtcgaaagaattgaggctagctttctttgctggggctggccttcaggccttccagcaatttactgggatcaacaccgtgatgtattacagccccacgatagtccagatggctggtttctcctccaacaggctggccttgctcctctccctgatcgtggcggccatgaacgccgccggaaccatcgtcgggatctacctaatcgaccgttgcggccgccgccgcctggccctcacaagcttggccggggtcgtggtctccctggccatcctcgccacggccttcatactgcagtcatcatccggcctctgcgcgagcgccgccagcggcacgtgccagggcgcgctaggctggttcgcggtggccggcctcgctctgtacatcgccttcttctccccgggcatggggcccgtgccgtgggccgtgaactcggagatctaccccgaggcgtaccgtgggatgtgcggcggcatgtcggccaccgtgaactgggtctctaacctcgtcgtggcacagacgttcctgtcgatcgtggggctggtcgggaccggcccgacgttcctgatcgtcgccgggatcgcggtgctggccttcgtcttcgtggccacgtacgtgccggagacgaagggcctgacttttgagcaggtggagcagatgtggagggagagagcgtgggggaacagcggcggcaactgcgagagccttttggcgggtactgcttctgcgccgtaggctacccgttgtcagcactggtcaagcgcgtcagttttagtatggccgcgctgggcttgatcggctccgtcctggcattagttggaagaaagtaaaaaacaaattggagatgcagatgcaaactgttgtatgtggtggtgctttatattgctatcctgttgcctgattgtacgtgttgtcatcgtggcaaatgtgcagtgggtgtaaaatatgaggtcataccgtaacgtcaaactaaggcaaaagggcagttgtatgacccagatgggtgattataattatttgtacagtttccggc

SEQ ID NO: 1284 - protein, 2143 aa, Zea mays
  misc_feature: PFam Name: Sugar_tr; PFam Description: Sugar (and other)
  misc_feature: PFam Name: MFS_1; PFam Description: Major Facilitator Superfamily
  misc_feature: GI Number: 29501739; NR Description: putative
  misc_feature: GI Number: 2289003; NR Description: putative membrane transporter [Arabidopsis thaliana] >gi|25308955|pir||G84864
  misc_feature: GI Number: 20465939; NR Description: putative membrane transporter protein [Arabidopsis thaliana] >gi|17380890|gb|AAL36257.1| putative membrane transporter protein [Arabidopsis thaliana] >gi|30689342|ref|NP_850393.1| sugar
  misc_feature: GI Number: 50934251; NR Description: putative proton myo-inositol transporter [Oryza sativa (japonica cultivar-group)] >gi|33146705|dbj|BAC79509.1| putative proton myo-inositol transporter [Oryza sativa (japonica cultivar-group)]
  misc_feature: GI Number: 28973605; NR Description: putative membrane transporter [Arabidopsis thaliana] >gi|7268398|emb|CAB78690.1| membrane transporter like protein [Arabidopsis thaliana] >gi|2245004|emb|CAB10424.1| membrane transporter like protein
ACAAATTAAGACGGGCGTCGTTGGCTTCAAATACTGGTCTCTCCCCTGTCCAAAAGTCTCTCGAATCTCCACCCTGGTTCCGCACCGGTTCCAGAATTTTCTCCCATTTCCAGGGTCTCCCCGTTTCTGTCCGGCGGTTCTGCCGTTCCACTGCTTTTGATTTCGGAGTGTGAGCTTACATCTTGCTGGACAATAAAGATTGGATTTTAAGCGATTTGGGGGGTGCTTGCCTGATCTCCCCCTGCGAGGTACTGCCGGGGGATTGGATTTCGGGGAAGTTTTGGTGGTTTGATATTCGGCTTGGCCGGAGCAGGAATGACGATCGACATGTCCATTCCCAGGAGCTCCGGGCTGCTGAACGCTGCGGGGAAGAGGGACATGAAGTTCTTCAGCAACCCCTACGTGCTTGCGCTCACGGGCGCTGCAGGAATCGGTGGATTCCTCTTTGGCTACGATACAGGTGTCATATCTGGAGCCCTTCTGTATATCCGCGATGATTTTCCAGCGGTCAAGGACAATTACTTCTTACAGGAAACGATTGTTAGCATGGCCTTAGTCGGAGCTATGATTGGAGCTGCTGGGGGTGGTTGGATCAATGATGCATACGGTCGCAAGAAGTCTACTCTTCTTGCTGATTTGATGTTTGCTCTTGGCTCACTTGTCATGTGTGCTGCTGCTGGTCCTTACATTCTAATTATCGGAAGGCTCCTCGTTGGTTTGGGTGTGGGTGTTGCATCAGTCACAGCACCGGTATACATTGCTGAAGCTGCTCCTTCAGAAATCAGGGGAGGTTTGGTGTCAACTAATGTACTCATGATTACCGGTGGCCAATTCTTCTCCTATCTTATCAATCTTGGCTTTACTGAGGTGCCTGGAACATGGCGCTGGATGCTTGGTGTTGCTGCTGTTCCTGCCATTATACAGTTTGTGCTGATGCTATTCCTGCCAGAATCTCCGCGTTGGCTTTACTGGAAGGATGAGAAGGCAAAAGCTATTGCCGTCCTTGAGAGGATCTATGAATCGGACCGCTTGGAGGAAGAGGTAGAGCTGCTTGCTACATCCTCCATGCATGAATTCCAGTCCAACAATACCGGAAGCTATCTGGATGTCTTCAAGTCGAAAGAATTGAGGCTAGCTTTCTTTGCTGGGGCTGGCCTTCAGGCCTTCCAGCAATTTACTGGGATCAACACCGTGATGTATTACAGCCCCACGATAGTCCAGATGGCTGGTTTCTCCTCCAACAGGCTGGCCTTGCTCCTCTCCCTGATCGTGGCGGCCATGAACGCCGCCGGAACCATCGTCGGGATCTACCTAATCGACCGTTGCGGCCGCCGCCGCCTGGCCCTCACAAGCTTGGCCGGGGTCGTGGTCTCCCTGGCCATCCTCGCCACGGCCTTCATACTGCAGTCATCATCCGGCCTCTGCGCGAGCGCCGCCAGCGGCACGTGCCAGGGCGCGCTAGGCTGGTTCGCGGTGGCCGGCCTCGCTCTGTACATCGCCTTCTTCTCCCCGGGCATGGGGCCCGTGCCGTGGGCCGTGAACTCGGAGATCTACCCCGAGGCGTACCGTGGGATGTGCGGCGGCATGTCGGCCACCGTGAACTGGGTCTCTAACCTCGTCGTGGCACAGACGTTCCTGTCGATCGTGGGGCTGGTCGGGACCGGCCCGACGTTCCTGATCGTCGCCGGGATCGCGGTGCTGGCCTTCGTCTTCGTGGCCACGTACGTGCCGGAGACGAAGGGCCTGACTTTTGAGCAGGTGGAGCAGATGTGGAGGGAGAGAGCGTGGGGGAACAGCGGCGGCAACTGCGAGAGCCTTTTGGCGGGTACTGCTTCTGCGCCGTAGGCTACCCGTTGTCAGCACTGGTCAAGCGCGTCAGTTTTAGTATGGCCGCGCTGGGCTTGATCGGCTCCGTCCTGGCATTAGTTGGAAGAAAGTAAAAAACAAATTGGAGATGCAGATGCAAACTGTTGTATGTGGTGGTGCTTTATATTGCTATCCTGTTGCCTGATTGTACGTGTTGTCATCGTGGCAAATGTGCAGTGGGTGTAAAATATGAGGTCATACCGTAACGTCAAACTAAGGCAAAAGGGCAGTTGTATGACCCAGATGGGTGATTATAATTATTTGTACAGTTTCCGGC

SEQ ID NO: 1285 - DNA, 1413 bp, Zea mays
  misc_feature (1)..(1413): Ceres cDNA ID no. 12434813
  misc_feature (1)..(1413): Ceres CLONE  ID no. 289333
  misc_feature (1)..(1413): Also known as  Ceres CDNA ID no. 23776253
acgaattcaattaccgcgatgatggtgctaagtttctgaagcccaccttagatggtgccatatttgcaaaattctcccccgcaggtatataaatacgtgtgttcatcgtattcaataacatgatcgatcgatcgatcccgcgcgtcaaccatgcaggccctcgccctgcccacgatggagtcggagctgagggctctcgcgtgggcgacgttgctcaccccagcgtgcgcggtgtacgcgcggttcgccgctcgccgccttcgccccggcgtcccgcgcctggccgcgctcttcccgacattcccggtgttcgtgtacatgccctgcatgttcagctccctccacctgcgcctcttctccaccttcttccacacctggctggccatcaacaggctcgtcctcctcgcgctcgacctcggcccgctccacccgcgcctcccgctcctgccgttcgtcctctgcgccggcctccccatcaaggtccgtctccagcagccgacgaagaaccaagcgtcgtcgtcgtcgtcatcaccaccacccagcgccgagttcctgaggccatgcgtccgcagcgtcctgctcctcagctgtctcgccatggcgtacccctacacgaggtggctcccgctctacgcgctccactacctctactgcgtccagatcttcctcacgctcgacctcgtgttctcctctatcgcgctcgtctccgcggcactcatggacgcgagcctggagaggcagttcagcacgccgctcgccgtcacctcgctgaacagcttctggggccaacagtggaacctaatggccgtggacctcctccgcgagtcggtgtatgcgcccgtgcgcgccaggtggggacgggacgtcggcgtgctggccgcgttcctaatgtcgggcctgctccacgagttcctgtactggtacctgacgctacagcagcccaggggtgagatgttgctcttcttcgtgttccatgccgcgttccagatcgctgagcgacgggccagggcggccgggctgtggcggccgcccagagcagcggcgtacctcctcgtcacagccttcatggtggtcaccatatcggagatgttcttcgcgccgttcgtgagagccggcacagacgtgcgcctcacggaggaaaccacggcgatggtggaactcatttggggtactaggaaatatctgctccatccgtttagggtggcctcaagctagaggcgtaaggtcgatttatggttgctacattgtagagaatccactcgcagatgagcacttgtatatctctaatactccctccgtttctttttatttgtcgctgaatagtgtaattttacactatccagcgacaaataaaaagaaacggagggagtactatattactacatgagtctgaagcataaaaccattgagtcg

SEQ ID NO: 1286 - protein, 1413 aa, Zea mays
  misc_feature: PFam Name: MBOAT; PFam Description: MBOAT family
  misc_feature: PFam Name: Pyr_redox_2; PFam Description: Pyridine
  misc_feature: GI Number: 34911838; NR Description: wax synthase-like protein [Oryza sativa (japonica cultivar-group)] >gi|20146429|dbj|BAB89209.1| wax synthase-like protein [Oryza
  misc_feature: GI Number: 50938097; NR Description: putative wax synthase isoform protein [Oryza sativa (japonica cultivar-group)] >gi|28812087|dbj|BAC65039.1| putative wax synthase isoform protein [Oryza sativa (japonica cultivar-group)] [Oryza sativa
  misc_feature: GI Number: 50907895; NR Description: putative wax synthase [Oryza sativa (japonica cultivar-group)] >gi|47497822|dbj|BAD19919.1| putative wax synthase [Oryza sativa
  misc_feature: GI Number: 38347115; NR Description: OSJNBa0009K15.12 [Oryza
  misc_feature: GI Number: 58532043; NR Description: OSJNBa0009K15.16 [Oryza
ACGAATTCAATTACCGCGATGATGGTGCTAAGTTTCTGAAGCCCACCTTAGATGGTGCCATATTTGCAAAATTCTCCCCCGCAGGTATATAAATACGTGTGTTCATCGTATTCAATAACATGATCGATCGATCGATCCCGCGCGTCAACCATGCAGGCCCTCGCCCTGCCCACGATGGAGTCGGAGCTGAGGGCTCTCGCGTGGGCGACGTTGCTCACCCCAGCGTGCGCGGTGTACGCGCGGTTCGCCGCTCGCCGCCTTCGCCCCGGCGTCCCGCGCCTGGCCGCGCTCTTCCCGACATTCCCGGTGTTCGTGTACATGCCCTGCATGTTCAGCTCCCTCCACCTGCGCCTCTTCTCCACCTTCTTCCACACCTGGCTGGCCATCAACAGGCTCGTCCTCCTCGCGCTCGACCTCGGCCCGCTCCACCCGCGCCTCCCGCTCCTGCCGTTCGTCCTCTGCGCCGGCCTCCCCATCAAGGTCCGTCTCCAGCAGCCGACGAAGAACCAAGCGTCGTCGTCGTCGTCATCACCACCACCCAGCGCCGAGTTCCTGAGGCCATGCGTCCGCAGCGTCCTGCTCCTCAGCTGTCTCGCCATGGCGTACCCCTACACGAGGTGGCTCCCGCTCTACGCGCTCCACTACCTCTACTGCGTCCAGATCTTCCTCACGCTCGACCTCGTGTTCTCCTCTATCGCGCTCGTCTCCGCGGCACTCATGGACGCGAGCCTGGAGAGGCAGTTCAGCACGCCGCTCGCCGTCACCTCGCTGAACAGCTTCTGGGGCCAACAGTGGAACCTAATGGCCGTGGACCTCCTCCGCGAGTCGGTGTATGCGCCCGTGCGCGCCAGGTGGGGACGGGACGTCGGCGTGCTGGCCGCGTTCCTAATGTCGGGCCTGCTCCACGAGTTCCTGTACTGGTACCTGACGCTACAGCAGCCCAGGGGTGAGATGTTGCTCTTCTTCGTGTTCCATGCCGCGTTCCAGATCGCTGAGCGACGGGCCAGGGCGGCCGGGCTGTGGCGGCCGCCCAGAGCAGCGGCGTACCTCCTCGTCACAGCCTTCATGGTGGTCACCATATCGGAGATGTTCTTCGCGCCGTTCGTGAGAGCCGGCACAGACGTGCGCCTCACGGAGGAAACCACGGCGATGGTGGAACTCATTTGGGGTACTAGGAAATATCTGCTCCATCCGTTTAGGGTGGCCTCAAGCTAGAGGCGTAAGGTCGATTTATGGTTGCTACATTGTAGAGAATCCACTCGCAGATGAGCACTTGTATATCTCTAATACTCCCTCCGTTTCTTTTTATTTGTCGCTGAATAGTGTAATTTTACACTATCCAGCGACAAATAAAAAGAAACGGAGGGAGTACTATATTACTACATGAGTCTGAAGCATAAAACCATTGAGTCG

SEQ ID NO: 1287 - DNA, 1181 bp, Zea mays
  misc_feature (1)..(1181): Ceres cDNA ID no. 12434843
  misc_feature (1)..(1181): Ceres CLONE  ID no. 263803
  misc_feature (1)..(1181): Also known as  Ceres CDNA ID no. 23756608
  misc_feature (500)..(500): n is a, c, t, g, unknown, or other
atcccaacccactcacagtctcacgctactatcgctatctagagctccggccgtcacagacacgagctagagctagagctgcagggaagaagaagaaggaggaggaggagaagatgagggcgtccgcgctggtctgcttcgtggcggtgtcggcgtgcatagcgtgcatcgcgcatggcggcaacttctaccaggacacggagatgacctgggggcaggggcgcggcaaggtggtggacggcgggcgcgggctggacctgagcctggacagggcctccgggtccgggttccagtccaaggacgagtacctgttcggcaagatcgagatgcagatgaagctggtgcctggcaactcggcgggcaccgtgacgaccttgtacctgtcgtcgcagggcgacgcgcacgacgagatcgacctggagttcctgggcaacgtgtcgggcgagccctacacgctgcacacgaacgtgttcacgcgcgggcgggggcagcgggagcancagttccgcctctggttcgaccccaccgccgacttccacacctactccgtggtgtggaacccgcggcacgtcatcttcgcggtggacggcacgccggtgagggacttcgccaaccgcgaggcccgcggggtggcgttcccgcggacgcagcccatgcgggtgtacgccagcctctggaacgccgacgactgggccacgcagggcggccgcgtcaaggcggactgggcgcgggcgccgttcgtcgcctcgttccgcgggttcagcgccgacgcctgcgtctggtccggcggcaggtcgcagtgccccgtcggcaccatggaggaggcgggaggaggcggcggctggtggaaccagcagctcaccgacgccagctaccgccgcatgcgctgggtgcagaggaagttcatgatctacaactactgcaccgacgccaagcggttcccgcagggccggggcgtgcccgctgaatgcaggctccggcgataaaggtggctggatgagcgaacgcgaagccacctgcgtgcgtgcacgacgatcgatcccctcgtcgtcgttcacttcagaccagagatcggtggtctggcgaataatgtttgggtttttttttttgccatgggcgatggcaatgtaaatgtagcacgtgacgcacgtcgcagtgatattctttcatctgttttctgc

SEQ ID NO: 1288 - protein, 1181 aa, Zea mays
  misc_feature: PFam Name: Glyco_hydro_16; PFam Description: Glycosyl
  misc_feature: PFam Name: XET_C; PFam Description: Xyloglucan
  misc_feature: GI Number: 53793221; NR Description: putative xyloglucan endotransglycosylase [Oryza sativa (japonica cultivar-group)] >gi|53791844|dbj|BAD53910.1| putative xyloglucan
  misc_feature: GI Number: 51039064; NR Description:
  misc_feature: GI Number: 1890577; NR Description: xyloglucan endotransglycosylase (XET) [Hordeum vulgare subsp. vulgare] >gi|7447413|pir||T06202 xyloglucan endo-1,4-beta-D-glucanase (EC
  misc_feature: GI Number: 14330332; NR Description: Xet1 protein
  misc_feature: GI Number: 53793227; NR Description: putative xyloglucan
ATCCCAACCCACTCACAGTCTCACGCTACTATCGCTATCTAGAGCTCCGGCCGTCACAGACACGAGCTAGAGCTAGAGCTGCAGGGAAGAAGAAGAAGGAGGAGGAGGAGAAGATGAGGGCGTCCGCGCTGGTCTGCTTCGTGGCGGTGTCGGCGTGCATAGCGTGCATCGCGCATGGCGGCAACTTCTACCAGGACACGGAGATGACCTGGGGGCAGGGGCGCGGCAAGGTGGTGGACGGCGGGCGCGGGCTGGACCTGAGCCTGGACAGGGCCTCCGGGTCCGGGTTCCAGTCCAAGGACGAGTACCTGTTCGGCAAGATCGAGATGCAGATGAAGCTGGTGCCTGGCAACTCGGCGGGCACCGTGACGACCTTGTACCTGTCGTCGCAGGGCGACGCGCACGACGAGATCGACCTGGAGTTCCTGGGCAACGTGTCGGGCGAGCCCTACACGCTGCACACGAACGTGTTCACGCGCGGGCGGGGGCAGCGGGAGCANCAGTTCCGCCTCTGGTTCGACCCCACCGCCGACTTCCACACCTACTCCGTGGTGTGGAACCCGCGGCACGTCATCTTCGCGGTGGACGGCACGCCGGTGAGGGACTTCGCCAACCGCGAGGCCCGCGGGGTGGCGTTCCCGCGGACGCAGCCCATGCGGGTGTACGCCAGCCTCTGGAACGCCGACGACTGGGCCACGCAGGGCGGCCGCGTCAAGGCGGACTGGGCGCGGGCGCCGTTCGTCGCCTCGTTCCGCGGGTTCAGCGCCGACGCCTGCGTCTGGTCCGGCGGCAGGTCGCAGTGCCCCGTCGGCACCATGGAGGAGGCGGGAGGAGGCGGCGGCTGGTGGAACCAGCAGCTCACCGACGCCAGCTACCGCCGCATGCGCTGGGTGCAGAGGAAGTTCATGATCTACAACTACTGCACCGACGCCAAGCGGTTCCCGCAGGGCCGGGGCGTGCCCGCTGAATGCAGGCTCCGGCGATAAAGGTGGCTGGATGAGCGAACGCGAAGCCACCTGCGTGCGTGCACGACGATCGATCCCCTCGTCGTCGTTCACTTCAGACCAGAGATCGGTGGTCTGGCGAATAATGTTTGGGTTTTTTTTTTTGCCATGGGCGATGGCAATGTAAATGTAGCACGTGACGCACGTCGCAGTGATATTCTTTCATCTGTTTTCTGC

SEQ ID NO: 1289 - DNA, 1263 bp, Zea mays
  misc_feature (1)..(1263): Ceres cDNA ID no. 12435111
  misc_feature (1)..(1263): Ceres CLONE  ID no. 275649
  misc_feature (1)..(1263): Also known as  Ceres CDNA ID no. 12435111
atgttttaaactgctacgcctacaacacgcctccccagtcaacacagctcagctcagctcggctagcgagctcctcgctcggctctactagctagtgtgttgggacttgggagctaggcggggttgattgcgattgggggaggcgggagtaggtgatgtacggcgcgccgttgcccaaggacctgaacctgccagcagccctgccgcagccgaccaggacgccaccgcagcagcagatgggctccccgggactgctgcggtacaggtcagcgccgagcacgctgctcggcgaggtgatgtgtggtggtgatcaggacttccccgcggctggcggcgcagggcacggaccaccggaccacgccgccgcggacaacgtcctcgcgcgctttctcgccgggcaccactccgagacccgcgactgcaagcctccccgccccgccgccgccgctcacttcatggacgaagctgccgtcgcgtccatggccgcctcacagcagcagcagctcatgtaccagtcgcagcaggagcagcagatggccgccatggaggggctgtaccgcaacgtcagctccggcggcacggagcacggtgcagccgttggcgctggtaacaacagcctgatccgccagagcagctcccccgccggcttcctcaaccacttgaacatggacaacgggtacgggagcatgctccgggtgggcatgggcggcggcgggttcaggaacggcgtcagcgacgcgcggctcaaggggcagctgagcttctcgtcccggcaggggtcggtgatgtcgcagatctcggaggtgggcagcgaggagctcgacggaggcggcggcagcggcagccccgaggcggccggcagcaacgccagcggcgcggcgcgtgggtacagcggcatcccggggtacccgatgggcggcctcgcgtccggcgcctgtccggacgaggcgtcgccgtcgccgacgtccggcgcgaagcgcccccgcgactccggccccgcgctgcagcagccgctggcgccgcagctcagcctgcccagcggaaagaacaagggcggcagggcggcctcggcggagatggcggcgatcgagaagttcctccagttccaggacgccgtcccctgcaagatccgcgccaagcgcgggtgcgccacccacccgcgcagcatcgccgagcgggttcgctgcattcctgctcgctgctactctcgaattcctcgcttggttttaattcccagcccaatccaaaaagagaacgaaagcg

SEQ ID NO: 1290 - protein, 1263 aa, Zea mays
ATGTTTTAAACTGCTACGCCTACAACACGCCTCCCCAGTCAACACAGCTCAGCTCAGCTCGGCTAGCGAGCTCCTCGCTCGGCTCTACTAGCTAGTGTGTTGGGACTTGGGAGCTAGGCGGGGTTGATTGCGATTGGGGGAGGCGGGAGTAGGTGATGTACGGCGCGCCGTTGCCCAAGGACCTGAACCTGCCAGCAGCCCTGCCGCAGCCGACCAGGACGCCACCGCAGCAGCAGATGGGCTCCCCGGGACTGCTGCGGTACAGGTCAGCGCCGAGCACGCTGCTCGGCGAGGTGATGTGTGGTGGTGATCAGGACTTCCCCGCGGCTGGCGGCGCAGGGCACGGACCACCGGACCACGCCGCCGCGGACAACGTCCTCGCGCGCTTTCTCGCCGGGCACCACTCCGAGACCCGCGACTGCAAGCCTCCCCGCCCCGCCGCCGCCGCTCACTTCATGGACGAAGCTGCCGTCGCGTCCATGGCCGCCTCACAGCAGCAGCAGCTCATGTACCAGTCGCAGCAGGAGCAGCAGATGGCCGCCATGGAGGGGCTGTACCGCAACGTCAGCTCCGGCGGCACGGAGCACGGTGCAGCCGTTGGCGCTGGTAACAACAGCCTGATCCGCCAGAGCAGCTCCCCCGCCGGCTTCCTCAACCACTTGAACATGGACAACGGGTACGGGAGCATGCTCCGGGTGGGCATGGGCGGCGGCGGGTTCAGGAACGGCGTCAGCGACGCGCGGCTCAAGGGGCAGCTGAGCTTCTCGTCCCGGCAGGGGTCGGTGATGTCGCAGATCTCGGAGGTGGGCAGCGAGGAGCTCGACGGAGGCGGCGGCAGCGGCAGCCCCGAGGCGGCCGGCAGCAACGCCAGCGGCGCGGCGCGTGGGTACAGCGGCATCCCGGGGTACCCGATGGGCGGCCTCGCGTCCGGCGCCTGTCCGGACGAGGCGTCGCCGTCGCCGACGTCCGGCGCGAAGCGCCCCCGCGACTCCGGCCCCGCGCTGCAGCAGCCGCTGGCGCCGCAGCTCAGCCTGCCCAGCGGAAAGAACAAGGGCGGCAGGGCGGCCTCGGCGGAGATGGCGGCGATCGAGAAGTTCCTCCAGTTCCAGGACGCCGTCCCCTGCAAGATCCGCGCCAAGCGCGGGTGCGCCACCCACCCGCGCAGCATCGCCGAGCGGGTTCGCTGCATTCCTGCTCGCTGCTACTCTCGAATTCCTCGCTTGGTTTTAATTCCCAGCCCAATCCAAAAAGAGAACGAAAGCG

SEQ ID NO: 1291 - DNA, 2327 bp, Zea mays
  misc_feature (1)..(2327): Ceres cDNA ID no. 12435879
  misc_feature (1)..(2327): Ceres CLONE  ID no. 490849
  misc_feature (1)..(2327): Also known as  Ceres CDNA ID no. 23817387
gcatagagagcagttggattggatcaaagagaggagggctttgctttccgttttccttctccaaatggctcattagctcgtgcttcttccttccttgctaccgagttcggggcgctaaccaatgcgcagcgacaagctgatctctctctgccacgggatggaggtggaggctctagagaaggggtacacagcttttgccaaggcggtgaagtcttttacttcttcagaacggtacaagcgatcagagagtcgcagctattttgaggacatgtatggtacagatgctttgcgttcttcagacaagacaattgttctacctatgccagaagctgtaaaagctaaggtgaaaggtgatatcagcaaggaagctcaacctggaaggggagcacaaagcaccttgagaaaggagatccttgagcttgagaagcacttcagggaacaacaggttgtgagtggtgcactggaaaacgctttaggacctaacgccggttcagtcaacttttcaccagagaatccaatgccaaaggcagctaatgaactgatacgggagattgccacattggagctcgaggtgaagaacatggagcagtatctcctgacactctaccgcaaagcattcgagcagcaagcgccggcactctctccccctgattgccgggaagcttcgaagccgtcagtgagctcacgctttgggcagctccgagaaacacccgtggcggcgaagtcttgcaagagtggaggaggggatgcggcactccggaccagttacccgccgccggcgcataagaaactgaacgatccgttggcagactgctgcacatctgctcgctcccatagagcggttgattcagatgtcctccgctgccagtcagccctgtcgtaccgcggagtttgctcgtccagggtactgccttcagaagaggatgatgatagcctcgcgagggctcttcgctcgtgccactcacagccattctcattcgcagaggaaggagagggggccggtgcatctggaggagcgataagcttagcagagtatctaggaaccaacgtagccgaccacatcccggaaacccccaacaacctgtcggaggagatggtgagatgcatggcggggatatactgcaggcttgcagaccctcccttggtccaccacggctcgtcgtcctcgccgacattgtccttctcctcgaccaccagcgcagtctctccacagtacgtcggagacgacatgtggagtcccagctaccgcaggagagaagcgatgaccctggactcccgcctgatcaacccgttccacgtcgagggtctgaaggagttcagtgggccttacaacacgatggtcgaggttcctacgatcagccgtgacggtcggaggatgaaagaagccgaggacctgctccagacttacaggctggttttgtaccggctggaagccgttgatctgaggacgatgacgaacgaagaaaagatagcgttctgggtgaacgtacacaatgccttgctgatgcatgcttatctggagaacggcgtcccacagaacaaaacatccctgcttgctaaggccgcctgcaaaatagctggacgcagcatcaacgcggccgttatccagagcgttgttcttggatgtaccacgcactgccccggacagtggctacgacggacgctgctctaccccaggaccaaaagcaaagtgagcaaagcggggcatgagtggcgagcctttgccgtcgcacaaccggagcctcttttgcgctttgcgctttgctccggcagccattctgatcccgcggtgagggtgtacactccgaagcggctgttccaccagctggaggcggccaaggaggagttcatccgggcgacggccggcgtgtggaaggagcagaagctgcttctccccaagctggtggaggcgtacgccaaggacgtgaggctgtcgccgcagggcctcgtggacatggtccagcgccacctcccggagaccatgagggtggccgtgcagcggtgccagcagggcggcagggcgtcgtcgggcaaggtcgtcgtcgactgggtgccccacaacccggccttccggtacctgctcgcaagggacctcgcgttccctcacctcagctgacgctgacactgagcatatatcgatgggcatgggctcaagtagtatatgcatgtgtcaaagggttaggacttaggagtaaagaagggatcgtgtgcagtttttgtgtgggtggttatcaatggcgtggcgtgtaaagatgcttctgtagtctgtagatgatgaacaggaaaggaaacagttgacgaaatgatagaaagcacgtttgacggtc

SEQ ID NO: 1292 - protein, 2327 aa, Zea mays
  misc_feature: GI Number: 28916180; NR Description: putative ternary complex
  misc_feature: GI Number: 50947619; NR Description: ternary complex factor-like [Oryza sativa (japonica cultivar-group)] >gi|42408754|dbj|BAD09990.1| ternary complex factor-like [Oryza
  misc_feature: GI Number: 53791925; NR Description: ternary complex factor
  misc_feature: GI Number: 53793306; NR Description: ternary complex factor MIP1-like [Oryza sativa (japonica cultivar-group)] >gi|53792826|dbj|BAD53859.1| ternary complex factor MIP1-like
  misc_feature: GI Number: 27363288; NR Description: At5g60720/mup24_130 [Arabidopsis thaliana] >gi|15983811|gb|AAL10502.1|
GCATAGAGAGCAGTTGGATTGGATCAAAGAGAGGAGGGCTTTGCTTTCCGTTTTCCTTCTCCAAATGGCTCATTAGCTCGTGCTTCTTCCTTCCTTGCTACCGAGTTCGGGGCGCTAACCAATGCGCAGCGACAAGCTGATCTCTCTCTGCCACGGGATGGAGGTGGAGGCTCTAGAGAAGGGGTACACAGCTTTTGCCAAGGCGGTGAAGTCTTTTACTTCTTCAGAACGGTACAAGCGATCAGAGAGTCGCAGCTATTTTGAGGACATGTATGGTACAGATGCTTTGCGTTCTTCAGACAAGACAATTGTTCTACCTATGCCAGAAGCTGTAAAAGCTAAGGTGAAAGGTGATATCAGCAAGGAAGCTCAACCTGGAAGGGGAGCACAAAGCACCTTGAGAAAGGAGATCCTTGAGCTTGAGAAGCACTTCAGGGAACAACAGGTTGTGAGTGGTGCACTGGAAAACGCTTTAGGACCTAACGCCGGTTCAGTCAACTTTTCACCAGAGAATCCAATGCCAAAGGCAGCTAATGAACTGATACGGGAGATTGCCACATTGGAGCTCGAGGTGAAGAACATGGAGCAGTATCTCCTGACACTCTACCGCAAAGCATTCGAGCAGCAAGCGCCGGCACTCTCTCCCCCTGATTGCCGGGAAGCTTCGAAGCCGTCAGTGAGCTCACGCTTTGGGCAGCTCCGAGAAACACCCGTGGCGGCGAAGTCTTGCAAGAGTGGAGGAGGGGATGCGGCACTCCGGACCAGTTACCCGCCGCCGGCGCATAAGAAACTGAACGATCCGTTGGCAGACTGCTGCACATCTGCTCGCTCCCATAGAGCGGTTGATTCAGATGTCCTCCGCTGCCAGTCAGCCCTGTCGTACCGCGGAGTTTGCTCGTCCAGGGTACTGCCTTCAGAAGAGGATGATGATAGCCTCGCGAGGGCTCTTCGCTCGTGCCACTCACAGCCATTCTCATTCGCAGAGGAAGGAGAGGGGGCCGGTGCATCTGGAGGAGCGATAAGCTTAGCAGAGTATCTAGGAACCAACGTAGCCGACCACATCCCGGAAACCCCCAACAACCTGTCGGAGGAGATGGTGAGATGCATGGCGGGGATATACTGCAGGCTTGCAGACCCTCCCTTGGTCCACCACGGCTCGTCGTCCTCGCCGACATTGTCCTTCTCCTCGACCACCAGCGCAGTCTCTCCACAGTACGTCGGAGACGACATGTGGAGTCCCAGCTACCGCAGGAGAGAAGCGATGACCCTGGACTCCCGCCTGATCAACCCGTTCCACGTCGAGGGTCTGAAGGAGTTCAGTGGGCCTTACAACACGATGGTCGAGGTTCCTACGATCAGCCGTGACGGTCGGAGGATGAAAGAAGCCGAGGACCTGCTCCAGACTTACAGGCTGGTTTTGTACCGGCTGGAAGCCGTTGATCTGAGGACGATGACGAACGAAGAAAAGATAGCGTTCTGGGTGAACGTACACAATGCCTTGCTGATGCATGCTTATCTGGAGAACGGCGTCCCACAGAACAAAACATCCCTGCTTGCTAAGGCCGCCTGCAAAATAGCTGGACGCAGCATCAACGCGGCCGTTATCCAGAGCGTTGTTCTTGGATGTACCACGCACTGCCCCGGACAGTGGCTACGACGGACGCTGCTCTACCCCAGGACCAAAAGCAAAGTGAGCAAAGCGGGGCATGAGTGGCGAGCCTTTGCCGTCGCACAACCGGAGCCTCTTTTGCGCTTTGCGCTTTGCTCCGGCAGCCATTCTGATCCCGCGGTGAGGGTGTACACTCCGAAGCGGCTGTTCCACCAGCTGGAGGCGGCCAAGGAGGAGTTCATCCGGGCGACGGCCGGCGTGTGGAAGGAGCAGAAGCTGCTTCTCCCCAAGCTGGTGGAGGCGTACGCCAAGGACGTGAGGCTGTCGCCGCAGGGCCTCGTGGACATGGTCCAGCGCCACCTCCCGGAGACCATGAGGGTGGCCGTGCAGCGGTGCCAGCAGGGCGGCAGGGCGTCGTCGGGCAAGGTCGTCGTCGACTGGGTGCCCCACAACCCGGCCTTCCGGTACCTGCTCGCAAGGGACCTCGCGTTCCCTCACCTCAGCTGACGCTGACACTGAGCATATATCGATGGGCATGGGCTCAAGTAGTATATGCATGTGTCAAAGGGTTAGGACTTAGGAGTAAAGAAGGGATCGTGTGCAGTTTTTGTGTGGGTGGTTATCAATGGCGTGGCGTGTAAAGATGCTTCTGTAGTCTGTAGATGATGAACAGGAAAGGAAACAGTTGACGAAATGATAGAAAGCACGTTTGACGGTC

SEQ ID NO: 1293 - DNA, 2440 bp, Zea mays
  misc_feature (1)..(2440): Ceres cDNA ID no. 12436117
  misc_feature (1)..(2440): Ceres CLONE  ID no. 391061
  misc_feature (1)..(2440): Also known as  Ceres CDNA ID no. 23809867
gcacgagaccattacctagaacatcctaatcgaaaaagctactctgtagattgacagagagacaagagcgctcttgctaccaatctcctcctcgtcgccgccgcggccgctctcgctcccacgatccggcgctgccacgagcttccagatccgccgcccgggcaatgctgtagctgcccgcgccgagatgggcggcgtcggcgccggctctctcgccctgctgcggctgctcctcctcctgctcctccgctccgaggcctccgctctccacggttgttctagttatatctgcaccgagccactgactgcaacaccaattggttccccttgtggctgtgtcgagcctattagtgttatcgttgatctggacttagctccttatctactgttcatgagcatagctgagttagaagttgaggttgcagctgggacatttcttaaacaaagccaggtgaagatcatggctgcagttgcaagtatccaggatgaccagaagacacgggtgaccatttatttggtgccgctaagagaacagttcgatacttatacggcatccctaatatctgataggttcatggagaaaaaggttcagataaattcatctatatttggagattataaagttatcaatatcagctatcatggattgcaatccccgccatcatctctgcctggaggatcggatccttcaggaactgaagaatatcctataactgcagaggtgcctgatcagaagaaaaagcacaataaatcagatattttggtcatcgtggtagtgttagggtcttctcttggacttctgatgacatgtgctgttgtgctgatcttactagtaagatggaagaaacttggacggcttcatgaggctatgacccctgcaactatcccagcagttaatagaagatatggcaccaggccaactttgtcaaccagcatggtgagctctgcgtcagcatcagtgttttcaacagtggctacttgcacaacatctgtaaagacattttcactagcccaacttcagaaggccacagatggttttgattcaagaagagttttgggtcaagggggctttgggcgtgtctaccatgggacgatagaggatggaaacgaaattgctgttaaattgcttacaagggaggacaggagtggtgaccgtgagtttattgcagaagtggaaatgctcagtcgattgcaccaccggaatcttgtcaaattgattggtatttgcattgagcggagtaaaaggtgtcttgtgtatgagctcatacgaaacggaagtgtggaatcccatcttcatggcgctgacaaggctaagggtaagctgaactgggatgttaggatgaaaattgctcttggcgctgctcgaggcttagcatatctgcatgaagattcaaaccctcatgtcatacaccgtgacttcaaggccagtaatatattattagaggaagatttcactcctaaagtgaccgattttggtttagcaagggaagcatccaatgcgactcaacctatatctaccagggtaatgggtactttcggttatgttgctccagaatatgcaatgacgggccatcttcttgttaaaagcgatgtttacagttatggggttgtcttgctggaacttatatcaggaaggaagcctgtaaacatctctgagtccaaggatcctgagaaccttgtaacttgggcccgtcctctgctaagccataaggagggcctggagaagttaattgatccgtctctggatggaaattttaacttcgacaatgtagcgaaggtggcatccatcgcttccatgtgtgtgcacacagatccatcgcagaggccgtttatgggtgaagttgtccaggcactgaagctgatctacaatgatccagatgaggcttgcgacgattcctacagtccaaggaattcatctgatcaagacggtgactacgaaggagacctggtctttgagagtggaagctggggctttggggcctctgggtgtctagactaccggaattccttaccgtttgtcactatggactacagttctggccgaatagaagggccgcacgaccctcgcgcggcattgtcagcgggatcccatgcccagtcaccagtgctgctgaatagatcaggccccttgcggatgaagaagaagctggcctccttctaccgctctagaggcagcattagtgagcatgggcacctgccgcgccattgatcagtcagtgaactagtgttaggctgttagcttcggttgactctgggattgaggctggcgggggttgtcactacctgattcgtgcctcatgttagtgtacagttcgtggtgacccttcacccttgggtatgggtgttttttttctctctttgccttctgcttcttccccggaagcaatgaggatggggttggcaggtgctctctaattttcgcaaattgcggttcatttct

SEQ ID NO: 1294 - protein, 2440 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 20453162; NR Description: At5g56885 [Arabidopsis thaliana] >gi|25090425|gb|AAN72298.1| At5g56885/At5g56885
  misc_feature: GI Number: 56784133; NR Description: protein kinase CDG1-like
  misc_feature: GI Number: 22327898; NR Description: protein kinase family
  misc_feature: GI Number: 50915848; NR Description: putative receptor protein kinase PERK1 [Oryza sativa (japonica cultivar-group)] >gi|47848175|dbj|BAD22002.1| putative receptor protein kinase PERK1
  misc_feature: GI Number: 50915850; NR Description: putative receptor protein kinase PERK1 [Oryza sativa (japonica cultivar-group)] >gi|47848176|dbj|BAD22003.1| putative receptor protein kinase PERK1
GCACGAGACCATTACCTAGAACATCCTAATCGAAAAAGCTACTCTGTAGATTGACAGAGAGACAAGAGCGCTCTTGCTACCAATCTCCTCCTCGTCGCCGCCGCGGCCGCTCTCGCTCCCACGATCCGGCGCTGCCACGAGCTTCCAGATCCGCCGCCCGGGCAATGCTGTAGCTGCCCGCGCCGAGATGGGCGGCGTCGGCGCCGGCTCTCTCGCCCTGCTGCGGCTGCTCCTCCTCCTGCTCCTCCGCTCCGAGGCCTCCGCTCTCCACGGTTGTTCTAGTTATATCTGCACCGAGCCACTGACTGCAACACCAATTGGTTCCCCTTGTGGCTGTGTCGAGCCTATTAGTGTTATCGTTGATCTGGACTTAGCTCCTTATCTACTGTTCATGAGCATAGCTGAGTTAGAAGTTGAGGTTGCAGCTGGGACATTTCTTAAACAAAGCCAGGTGAAGATCATGGCTGCAGTTGCAAGTATCCAGGATGACCAGAAGACACGGGTGACCATTTATTTGGTGCCGCTAAGAGAACAGTTCGATACTTATACGGCATCCCTAATATCTGATAGGTTCATGGAGAAAAAGGTTCAGATAAATTCATCTATATTTGGAGATTATAAAGTTATCAATATCAGCTATCATGGATTGCAATCCCCGCCATCATCTCTGCCTGGAGGATCGGATCCTTCAGGAACTGAAGAATATCCTATAACTGCAGAGGTGCCTGATCAGAAGAAAAAGCACAATAAATCAGATATTTTGGTCATCGTGGTAGTGTTAGGGTCTTCTCTTGGACTTCTGATGACATGTGCTGTTGTGCTGATCTTACTAGTAAGATGGAAGAAACTTGGACGGCTTCATGAGGCTATGACCCCTGCAACTATCCCAGCAGTTAATAGAAGATATGGCACCAGGCCAACTTTGTCAACCAGCATGGTGAGCTCTGCGTCAGCATCAGTGTTTTCAACAGTGGCTACTTGCACAACATCTGTAAAGACATTTTCACTAGCCCAACTTCAGAAGGCCACAGATGGTTTTGATTCAAGAAGAGTTTTGGGTCAAGGGGGCTTTGGGCGTGTCTACCATGGGACGATAGAGGATGGAAACGAAATTGCTGTTAAATTGCTTACAAGGGAGGACAGGAGTGGTGACCGTGAGTTTATTGCAGAAGTGGAAATGCTCAGTCGATTGCACCACCGGAATCTTGTCAAATTGATTGGTATTTGCATTGAGCGGAGTAAAAGGTGTCTTGTGTATGAGCTCATACGAAACGGAAGTGTGGAATCCCATCTTCATGGCGCTGACAAGGCTAAGGGTAAGCTGAACTGGGATGTTAGGATGAAAATTGCTCTTGGCGCTGCTCGAGGCTTAGCATATCTGCATGAAGATTCAAACCCTCATGTCATACACCGTGACTTCAAGGCCAGTAATATATTATTAGAGGAAGATTTCACTCCTAAAGTGACCGATTTTGGTTTAGCAAGGGAAGCATCCAATGCGACTCAACCTATATCTACCAGGGTAATGGGTACTTTCGGTTATGTTGCTCCAGAATATGCAATGACGGGCCATCTTCTTGTTAAAAGCGATGTTTACAGTTATGGGGTTGTCTTGCTGGAACTTATATCAGGAAGGAAGCCTGTAAACATCTCTGAGTCCAAGGATCCTGAGAACCTTGTAACTTGGGCCCGTCCTCTGCTAAGCCATAAGGAGGGCCTGGAGAAGTTAATTGATCCGTCTCTGGATGGAAATTTTAACTTCGACAATGTAGCGAAGGTGGCATCCATCGCTTCCATGTGTGTGCACACAGATCCATCGCAGAGGCCGTTTATGGGTGAAGTTGTCCAGGCACTGAAGCTGATCTACAATGATCCAGATGAGGCTTGCGACGATTCCTACAGTCCAAGGAATTCATCTGATCAAGACGGTGACTACGAAGGAGACCTGGTCTTTGAGAGTGGAAGCTGGGGCTTTGGGGCCTCTGGGTGTCTAGACTACCGGAATTCCTTACCGTTTGTCACTATGGACTACAGTTCTGGCCGAATAGAAGGGCCGCACGACCCTCGCGCGGCATTGTCAGCGGGATCCCATGCCCAGTCACCAGTGCTGCTGAATAGATCAGGCCCCTTGCGGATGAAGAAGAAGCTGGCCTCCTTCTACCGCTCTAGAGGCAGCATTAGTGAGCATGGGCACCTGCCGCGCCATTGATCAGTCAGTGAACTAGTGTTAGGCTGTTAGCTTCGGTTGACTCTGGGATTGAGGCTGGCGGGGGTTGTCACTACCTGATTCGTGCCTCATGTTAGTGTACAGTTCGTGGTGACCCTTCACCCTTGGGTATGGGTGTTTTTTTTCTCTCTTTGCCTTCTGCTTCTTCCCCGGAAGCAATGAGGATGGGGTTGGCAGGTGCTCTCTAATTTTCGCAAATTGCGGTTCATTTCT

SEQ ID NO: 1295 - DNA, 1942 bp, Zea mays
  misc_feature (1)..(1942): Ceres cDNA ID no. 12436371
  misc_feature (1)..(1942): Ceres CLONE  ID no. 394840
  misc_feature (1)..(1942): Also known as  Ceres CDNA ID no. 23810802
  misc_feature (1012)..(1012): n is a, c, t, g, unknown, or other
gcacgagaccattacctagaacatcctaatcgaaaaagggcgctaatttcagccgtgttctcttctctctcgttcgagagatttatactacgtgtataaaaagcatcgtccaacagaggtacctttgctgcgcctctcgatctctagctatagcccgtagctagctagccctcccggcgaatcggccgatcagccggtcgggaacgatgaagaaagatgatgacctcgagtcggcgctgctggccgccaaagagccggcgccggcgcccgccaagggctacgcgtacgcgctcacctgcgcgctcctggcttccctcacctccatcatctacggctacaaccgcggggtgatgagcggggcgcagaagttcgtgcaggccgacctcggcgtcacggacgcgcagctggaggtgctcatcggcgccaccagcgtctactccctcgtcggctcgctggcggcgggctgggcgtgcgaccgcgcgggccggcgccgcaccatcgcgctgtcggcggccttgttcctcgccggctcagccgtcaccgccgccgccgacggctacgccgcgctcatggcgggccagttcgtcgccggcgtggcctgcggattcggcctcgtcgtcgctcccgtctacatcgcggagatctcgccggccaacgctcggggcttcctctcctccatccccgagatcgccggcaactcgggcatcctgctgagctacatcgccgacttcgcgctcgccggcctcccgacgccactcaactggcgcctgatgatcggcatcggcgccgtccctcctctattcctagcggccgcggccgcgcttgccatgccggagaccccgcgctggctcgtcctccacggccaccgcgacgaggcgcgccgcgtgctggcgcgcacggtgggggacgcggaccgccggctccaggagatcgtgacgtccgtgcaggaggccacgaagcaggcgggctccggcggcggcgacgcgccgtcgtcggcgagcgtgcggcgcgngatcctgctccggccgacgcccgccgtccgccgcgtgatgctggccatcctggggctgcaggtgttccagcaggcgtgcggcgtggcggccatggtgctgtacgccccgcgcgtgttcagccacgtcgggatcacctccgagcgcgacgtgctcggcgccaccgtcctcctcggcgccgccaagacggtggcgatcgtcgtccctctgttcctcgccgacagcctcggccgccggcccatgctgctcaccagcgcgggtggcatggccgcgtcgcttctggtcctcggcctgtccatacgcgcgacgtcggccgcgacgtgcgtcgccgccgccgtggcgttcatggcgaccttctcgctggggttcggacccgtgatctggatgtacgggtcggagatcctgccgctgcggctgcgcgcgcaggggactggcgtcgggacggcggtcaaccgggtgatgagcgccatcgtggggatgaccttcatcccgatgtacgaggcggtgggcatggccgggaccttctacatcttcgcggcgatgtccgcggcagcgtgggtgttcgtctacgcgtgcctgcctgagaccaaggggaggagcctcgaggagatggaggcactcttcgacgccggtgccggtgccgatgctgcaccgtcgccacgggcggcgttgtcgtgacgttccagacactgagtacacatgcatcatgtccacgcaaggaacaaacacgtgatgacatgaagttgtcaggtgtgcagtgtagcaaggttagacaggtgctagtgtatttgtaagcagccaagatgccgtcgacgaatagttttgtactcttgtcattttgaatgggttgattatatggtagctgtttctagcaacgcgtctcttaaatttcattctctaaagcaatatgtaccgttctttacatttacaat

SEQ ID NO: 1296 - protein, 1942 aa, Zea mays
  misc_feature: PFam Name: Sugar_tr; PFam Description: Sugar (and other)
  misc_feature: PFam Name: MFS_1; PFam Description: Major Facilitator Superfamily
  misc_feature: GI Number: 30025133; NR Description: putative sorbitol
  misc_feature: GI Number: 51849627; NR Description: sorbitol transporter
  misc_feature: GI Number: 9293909; NR Description: sugar transporter protein [Arabidopsis thaliana] >gi|15230212|ref|NP_188513.1| mannitol
  misc_feature: GI Number: 28316433; NR Description: sorbitol transporter
  misc_feature: GI Number: 51849623; NR Description: sorbitol transporter
GCACGAGACCATTACCTAGAACATCCTAATCGAAAAAGGGCGCTAATTTCAGCCGTGTTCTCTTCTCTCTCGTTCGAGAGATTTATACTACGTGTATAAAAAGCATCGTCCAACAGAGGTACCTTTGCTGCGCCTCTCGATCTCTAGCTATAGCCCGTAGCTAGCTAGCCCTCCCGGCGAATCGGCCGATCAGCCGGTCGGGAACGATGAAGAAAGATGATGACCTCGAGTCGGCGCTGCTGGCCGCCAAAGAGCCGGCGCCGGCGCCCGCCAAGGGCTACGCGTACGCGCTCACCTGCGCGCTCCTGGCTTCCCTCACCTCCATCATCTACGGCTACAACCGCGGGGTGATGAGCGGGGCGCAGAAGTTCGTGCAGGCCGACCTCGGCGTCACGGACGCGCAGCTGGAGGTGCTCATCGGCGCCACCAGCGTCTACTCCCTCGTCGGCTCGCTGGCGGCGGGCTGGGCGTGCGACCGCGCGGGCCGGCGCCGCACCATCGCGCTGTCGGCGGCCTTGTTCCTCGCCGGCTCAGCCGTCACCGCCGCCGCCGACGGCTACGCCGCGCTCATGGCGGGCCAGTTCGTCGCCGGCGTGGCCTGCGGATTCGGCCTCGTCGTCGCTCCCGTCTACATCGCGGAGATCTCGCCGGCCAACGCTCGGGGCTTCCTCTCCTCCATCCCCGAGATCGCCGGCAACTCGGGCATCCTGCTGAGCTACATCGCCGACTTCGCGCTCGCCGGCCTCCCGACGCCACTCAACTGGCGCCTGATGATCGGCATCGGCGCCGTCCCTCCTCTATTCCTAGCGGCCGCGGCCGCGCTTGCCATGCCGGAGACCCCGCGCTGGCTCGTCCTCCACGGCCACCGCGACGAGGCGCGCCGCGTGCTGGCGCGCACGGTGGGGGACGCGGACCGCCGGCTCCAGGAGATCGTGACGTCCGTGCAGGAGGCCACGAAGCAGGCGGGCTCCGGCGGCGGCGACGCGCCGTCGTCGGCGAGCGTGCGGCGCGNGATCCTGCTCCGGCCGACGCCCGCCGTCCGCCGCGTGATGCTGGCCATCCTGGGGCTGCAGGTGTTCCAGCAGGCGTGCGGCGTGGCGGCCATGGTGCTGTACGCCCCGCGCGTGTTCAGCCACGTCGGGATCACCTCCGAGCGCGACGTGCTCGGCGCCACCGTCCTCCTCGGCGCCGCCAAGACGGTGGCGATCGTCGTCCCTCTGTTCCTCGCCGACAGCCTCGGCCGCCGGCCCATGCTGCTCACCAGCGCGGGTGGCATGGCCGCGTCGCTTCTGGTCCTCGGCCTGTCCATACGCGCGACGTCGGCCGCGACGTGCGTCGCCGCCGCCGTGGCGTTCATGGCGACCTTCTCGCTGGGGTTCGGACCCGTGATCTGGATGTACGGGTCGGAGATCCTGCCGCTGCGGCTGCGCGCGCAGGGGACTGGCGTCGGGACGGCGGTCAACCGGGTGATGAGCGCCATCGTGGGGATGACCTTCATCCCGATGTACGAGGCGGTGGGCATGGCCGGGACCTTCTACATCTTCGCGGCGATGTCCGCGGCAGCGTGGGTGTTCGTCTACGCGTGCCTGCCTGAGACCAAGGGGAGGAGCCTCGAGGAGATGGAGGCACTCTTCGACGCCGGTGCCGGTGCCGATGCTGCACCGTCGCCACGGGCGGCGTTGTCGTGACGTTCCAGACACTGAGTACACATGCATCATGTCCACGCAAGGAACAAACACGTGATGACATGAAGTTGTCAGGTGTGCAGTGTAGCAAGGTTAGACAGGTGCTAGTGTATTTGTAAGCAGCCAAGATGCCGTCGACGAATAGTTTTGTACTCTTGTCATTTTGAATGGGTTGATTATATGGTAGCTGTTTCTAGCAACGCGTCTCTTAAATTTCATTCTCTAAAGCAATATGTACCGTTCTTTACATTTACAAT

SEQ ID NO: 1297 - DNA, 1980 bp, Zea mays
  misc_feature (1)..(1980): Ceres cDNA ID no. 12436401
  misc_feature (1)..(1980): Ceres CLONE  ID no. 456911
  misc_feature (1)..(1980): Also known as  Ceres CDNA ID no. 23811261
atcgattcctcccgcttggctttcccacccctcgaagccgaatccgatggttccacccgttgaccgcctccgccatcggaggccgcgccgcctcctccccgccttcttcctcggtccccgcgcccgcctcctcctatagatataccgcccgcgcatcgctccatggcggtcggcggcgacgacgacagcatggagcgggacttcgccgccaggctgcgcctcgcgcattcgccctccccggccacgcctgccgccgccgcctcatcctcccccaccgccgctggggggatcgccttccgcgcgccgcaggagcagttcaccgccgacgacttcgtactcggcaagatctacggcgtcggctcgtactccaaggtggtgcgggccaagaagaaggacactggtcgcgtctacgcgcttaagatcatggacaagaagttcatcaccaaggagaacaagatctcctacgtcaagatggagcgtattgtactcgaccagctcgaccaccctggcgtcatcaggctcttcttcactttccaggacacatactccctctacatggcgctcgagtcgtgcgaaggcggggagttattcgaccaaattgttcggaaaggtcggctctctgaggactatgcacggttctatgctgctgaaattgttgatatattggagtacttgcatggccttggcctaattcatcgggatgtcaagccagaaaatctactgcttacttctgatgggcacatcaagattgctgactttggtagtgtgaagcctacaagggatactcctatcaaagttctcccaaattcaactactgaaagggcctgtacatttgttggaaccgctgcatatgtaccacctgaggtcctgaactctgccccagcaacctttggaaatgatttatgggcattgggatgcacactgtaccaaatgctttctggctcttcgccatttaaagatgctagtgagtggttaattttccagagaatcattgcaagggacctcaaatttccagagtatttttcagctgaagctagagatcttgttgacaaattgctggatgttgatccaggcaaaaggccaggtgcaggacctgatggttattcttccttgaaggagcatcctttcttcagaggcatagactggaagaacctgaggaagacacggccacctaagctcgcaatcgatgcaaatgtaaatgaagatgaggatagccaagattcaaattggttggcacacatgggaagtgtggcagtcaaccaacagtcaaatactgttggtaataatggtgccccgtcatcatctgaagtgcgctcccatatatctaaattagcttccatcgactcctttgactcaaaatggcaagaattcctggaccccggcgagtctgtagtcttaatatcaaagctgaagaagattaataagctagcaaacaagaagatccagttgatcctcactgacaaacctcaattgatctgtgttgacccttcaaaaatggtggccaagggaaacattatttggtctgatgacccaagtgaactcagtgtgcaagtatcagattcttcacattttagaatatgcacgccaaagaaggtgtcaacatttgaggatgcgaaacagcgtgcttggcaatggaagaaggcaattgaagacctccaacgctgccaaaggaattaattttcaattcaaatcaaaactctaaaatgtcgaattatgcactgttaatacatcatatccttttcacttgggaggaacatgagggggtttatttctcctgcatcctgctccaatgcctggttgcaaggaacttgctactcgctaattcacacactgaatgatggcccccaattttttcccttcccatccatgttttcaaatagtacacaattttgtttgtcacttttgtgaaccgttggagcagatatcttcaaaacaggctgcagtctggaaatattgacacaggaaactattttaacagtc

SEQ ID NO: 1298 - protein, 1980 aa, Zea mays
  misc_feature: PFam Name: Pkinase; PFam Description: Protein kinase domain
  misc_feature: GI Number: 30681369; NR Description: 3-phosphoinositide-dependent protein kinase, putative [Arabidopsis
  misc_feature: GI Number: 42573267; NR Description: 3-phosphoinositide-dependent protein kinase, putative [Arabidopsis
  misc_feature: GI Number: 7406455; NR Description: 3-phosphoinositide-dependent protein kinase-1 PDK1 [Arabidopsis thaliana] >gi|11357147|pir||T48447 3-phosphoinositide-dependent
  misc_feature: GI Number: 57168305; NR Description: 3-phosphoinositide-dependent protein kinase-1 [Lycopersicon
  misc_feature: GI Number: 5001830; NR Description:
ATCGATTCCTCCCGCTTGGCTTTCCCACCCCTCGAAGCCGAATCCGATGGTTCCACCCGTTGACCGCCTCCGCCATCGGAGGCCGCGCCGCCTCCTCCCCGCCTTCTTCCTCGGTCCCCGCGCCCGCCTCCTCCTATAGATATACCGCCCGCGCATCGCTCCATGGCGGTCGGCGGCGACGACGACAGCATGGAGCGGGACTTCGCCGCCAGGCTGCGCCTCGCGCATTCGCCCTCCCCGGCCACGCCTGCCGCCGCCGCCTCATCCTCCCCCACCGCCGCTGGGGGGATCGCCTTCCGCGCGCCGCAGGAGCAGTTCACCGCCGACGACTTCGTACTCGGCAAGATCTACGGCGTCGGCTCGTACTCCAAGGTGGTGCGGGCCAAGAAGAAGGACACTGGTCGCGTCTACGCGCTTAAGATCATGGACAAGAAGTTCATCACCAAGGAGAACAAGATCTCCTACGTCAAGATGGAGCGTATTGTACTCGACCAGCTCGACCACCCTGGCGTCATCAGGCTCTTCTTCACTTTCCAGGACACATACTCCCTCTACATGGCGCTCGAGTCGTGCGAAGGCGGGGAGTTATTCGACCAAATTGTTCGGAAAGGTCGGCTCTCTGAGGACTATGCACGGTTCTATGCTGCTGAAATTGTTGATATATTGGAGTACTTGCATGGCCTTGGCCTAATTCATCGGGATGTCAAGCCAGAAAATCTACTGCTTACTTCTGATGGGCACATCAAGATTGCTGACTTTGGTAGTGTGAAGCCTACAAGGGATACTCCTATCAAAGTTCTCCCAAATTCAACTACTGAAAGGGCCTGTACATTTGTTGGAACCGCTGCATATGTACCACCTGAGGTCCTGAACTCTGCCCCAGCAACCTTTGGAAATGATTTATGGGCATTGGGATGCACACTGTACCAAATGCTTTCTGGCTCTTCGCCATTTAAAGATGCTAGTGAGTGGTTAATTTTCCAGAGAATCATTGCAAGGGACCTCAAATTTCCAGAGTATTTTTCAGCTGAAGCTAGAGATCTTGTTGACAAATTGCTGGATGTTGATCCAGGCAAAAGGCCAGGTGCAGGACCTGATGGTTATTCTTCCTTGAAGGAGCATCCTTTCTTCAGAGGCATAGACTGGAAGAACCTGAGGAAGACACGGCCACCTAAGCTCGCAATCGATGCAAATGTAAATGAAGATGAGGATAGCCAAGATTCAAATTGGTTGGCACACATGGGAAGTGTGGCAGTCAACCAACAGTCAAATACTGTTGGTAATAATGGTGCCCCGTCATCATCTGAAGTGCGCTCCCATATATCTAAATTAGCTTCCATCGACTCCTTTGACTCAAAATGGCAAGAATTCCTGGACCCCGGCGAGTCTGTAGTCTTAATATCAAAGCTGAAGAAGATTAATAAGCTAGCAAACAAGAAGATCCAGTTGATCCTCACTGACAAACCTCAATTGATCTGTGTTGACCCTTCAAAAATGGTGGCCAAGGGAAACATTATTTGGTCTGATGACCCAAGTGAACTCAGTGTGCAAGTATCAGATTCTTCACATTTTAGAATATGCACGCCAAAGAAGGTGTCAACATTTGAGGATGCGAAACAGCGTGCTTGGCAATGGAAGAAGGCAATTGAAGACCTCCAACGCTGCCAAAGGAATTAATTTTCAATTCAAATCAAAACTCTAAAATGTCGAATTATGCACTGTTAATACATCATATCCTTTTCACTTGGGAGGAACATGAGGGGGTTTATTTCTCCTGCATCCTGCTCCAATGCCTGGTTGCAAGGAACTTGCTACTCGCTAATTCACACACTGAATGATGGCCCCCAATTTTTTCCCTTCCCATCCATGTTTTCAAATAGTACACAATTTTGTTTGTCACTTTTGTGAACCGTTGGAGCAGATATCTTCAAAACAGGCTGCAGTCTGGAAATATTGACACAGGAAACTATTTTAACAGTC

SEQ ID NO: 1299 - DNA, 1170 bp, Arabidopsis thaliana
  misc_feature (1)..(1170): Ceres cDNA ID no. 12439856
  misc_feature (1)..(1170): Ceres CLONE  ID no. 43069
  misc_feature (1)..(1170): Also known as  Ceres CDNA ID no. 23396236
aacaaaacaagaatctttatggaagaagacgggtctgattggggcggattggctccagagatactcatcaacatcatttcaaggcttacgattcaggagctatggaccggtccgatgttcgtccaaaaatcgtggctaactgtttgcagagatccgtatctctggtctatcttcgatctggagccatggttcgattcctatcccgagtcgactcacttgtggtcccctgagttcgagcagaaggtagacttaatgctacgatcagtcgttgattggagcgaaggtggtctcactaagatccgcgtccgccattgcagcgaccacgctctctcttacgcagccgatagatgcccgaatctacaggttcttgccattagaagcagtcctaacgtgacagacgcatcgatgacgaagatagcgtttcggtgcaggagtttaaaggaacttgatatcagttactgtcacgagatatctcacgacactcttgtgatgattggtagaaactgtcctaatctgaggatcttgaaacgtaatcttatggattggtcttctcggcacattggctctgttcctacagaatacttagacgcttgtcctcaagacggagacacagaagctgacgcgattgggaaacatatgatcaatctagagcatttggagattcagttctctagattatctgtcaagggtcttgcttcgatatgtgagggttgtcccaagctagagtacttggacttgtttgggtgtgtgcatttgtcaagccgtgacattacaagcaacgtgtcaaggcttaaatggcttaaggaggtaaagaagccagatgtgtatgtgccaaggtcaggggatgtggcgcagacggagaggtatggacattggagactctatgacgagagatttgacatacaagccatgagaatctgatttctacacacacactgccatgttttataataaagctgcccatagttctgacttgggtcggttgtttgttatatgtcgtgttgttaaaatggaccttaggcccacgggtctaaacgggctatttgtaatgtttgaacgggtacccatttaaacccgattactaacgggtctaaacaaatattaaccgagtggcccatttatttttaagtttttggaattttctatgctaaaacgacaacgttacgagtt

SEQ ID NO: 1300 - protein, 1170 aa, Arabidopsis thaliana
  misc_feature: PFam Name: LRR_1; PFam Description: Leucine Rich Repeat
  misc_feature: PFam Name: F-box; PFam Description: F-box domain
  misc_feature: GI Number: 50943267; NR Description: putative SKP1 interacting partner 1 [Oryza sativa (japonica cultivar-group)] >gi|37805883|dbj|BAC99611.1| putative SKP1 interacting partner 1
  misc_feature: GI Number: 7267307; NR Description: N7-like protein [Arabidopsis thaliana] >gi|25376523|pir||G85068 N7-like protein
  misc_feature: GI Number: 5732065; NR Description: contains similarity to Medicago truncatula N7 protein (GB:Y17613) [Arabidopsis thaliana] >gi|30692594|ref|NP_849530.1| F-box family protein [Arabidopsis
  misc_feature: GI Number: 18412949; NR Description: F-box family protein
  misc_feature: GI Number: 7267308; NR Description: N7-like protein [Arabidopsis thaliana] >gi|25376524|pir||H85068 N7-like protein
AACAAAACAAGAATCTTTATGGAAGAAGACGGGTCTGATTGGGGCGGATTGGCTCCAGAGATACTCATCAACATCATTTCAAGGCTTACGATTCAGGAGCTATGGACCGGTCCGATGTTCGTCCAAAAATCGTGGCTAACTGTTTGCAGAGATCCGTATCTCTGGTCTATCTTCGATCTGGAGCCATGGTTCGATTCCTATCCCGAGTCGACTCACTTGTGGTCCCCTGAGTTCGAGCAGAAGGTAGACTTAATGCTACGATCAGTCGTTGATTGGAGCGAAGGTGGTCTCACTAAGATCCGCGTCCGCCATTGCAGCGACCACGCTCTCTCTTACGCAGCCGATAGATGCCCGAATCTACAGGTTCTTGCCATTAGAAGCAGTCCTAACGTGACAGACGCATCGATGACGAAGATAGCGTTTCGGTGCAGGAGTTTAAAGGAACTTGATATCAGTTACTGTCACGAGATATCTCACGACACTCTTGTGATGATTGGTAGAAACTGTCCTAATCTGAGGATCTTGAAACGTAATCTTATGGATTGGTCTTCTCGGCACATTGGCTCTGTTCCTACAGAATACTTAGACGCTTGTCCTCAAGACGGAGACACAGAAGCTGACGCGATTGGGAAACATATGATCAATCTAGAGCATTTGGAGATTCAGTTCTCTAGATTATCTGTCAAGGGTCTTGCTTCGATATGTGAGGGTTGTCCCAAGCTAGAGTACTTGGACTTGTTTGGGTGTGTGCATTTGTCAAGCCGTGACATTACAAGCAACGTGTCAAGGCTTAAATGGCTTAAGGAGGTAAAGAAGCCAGATGTGTATGTGCCAAGGTCAGGGGATGTGGCGCAGACGGAGAGGTATGGACATTGGAGACTCTATGACGAGAGATTTGACATACAAGCCATGAGAATCTGATTTCTACACACACACTGCCATGTTTTATAATAAAGCTGCCCATAGTTCTGACTTGGGTCGGTTGTTTGTTATATGTCGTGTTGTTAAAATGGACCTTAGGCCCACGGGTCTAAACGGGCTATTTGTAATGTTTGAACGGGTACCCATTTAAACCCGATTACTAACGGGTCTAAACAAATATTAACCGAGTGGCCCATTTATTTTTAAGTTTTTGGAATTTTCTATGCTAAAACGACAACGTTACGAGTT

SEQ ID NO: 1301 - DNA, 1814 bp, Zea mays
  misc_feature (1)..(1814): Ceres cDNA ID no. 12443273
  misc_feature (1)..(1814): Ceres CLONE  ID no. 450694
  misc_feature (1)..(1814): Also known as  Ceres CDNA ID no. 23805935
aggacccctattcttggctcagcaaatcctctcctcggcgcaaaggcatggagcgaatgctcatcccacctgaccacattttcccccacagagatcacatttaccgcgcacaaagcaccaacaacgatccacagcctgtttgcgagatctttagcacaaggagggaggcaggcatatagactcccacccgtgctctcattgtcagcacaacgaggcctgcggatcggtctgtgcgttctagagagaggggacgaggtttacccactgcgagagcggagaggggcagagaagagatccaaggttctggtacgtacagctgggagaagatgagctgcttcggatgcttcaagcccgacaagaaggtgccacccaggaggacggaatccagggaggtcacggtcgtcaacaaggcccccagccagaacgaagcgcctcccagggaatctgggtccatcaggccaccaccagttgcttcgaagcacaagcacagggccatcatctgaaacagcagcaagcatcgaacctcctaaaggaagttgttctgttgccaaaaccgcaaaagcattcacgttccgtgagctagccacggccacgaaaaacttccgctctgactgccttctcggagaagggggattcggcagggtatacaagggcaggcttgaaaacggacagcttgttgctgtcaagcaactagacctgaatgggtatcaaggcaacagagagttcctagttgaggtcctgatgctcagcctattgcaccatccaaacctagtcaatttggtgggctattgtgcagatggagatcaaaggcttctggtttatgagtacatggcacttggctcacttgcagatcacctgcttgatagcactcctgatcaagtgccactgagttggtatctcaggatgaagatagcttatggaactgcaaaagggcttgaatacctccatgagaaggcgaacccacctgtcatttaccgggatctcaagtcccccaacatccttctcgatgagaagtacaaccctaagctctcagattttgggctcgcaaagcttggcccagttgagggaaagacacacatctccactcgggtgatgggaacgtatgggtactgcgctccggaatacataagaacaggccagctaactgttaagaccgacgtgtacagttttggggttttcctactggagttgatcacaggaagaagagcagtggatacctccaggccagcaagtgaacagatcctggttaactgggtcaagcccatgctgagagacaggaagcgatacaatgagctagtagaccctcatcttagaggtgagtacccagaaaaagacttgagccaggctgtgggtgtggcagcaatgtgcctacaagaggaagcctcagtccggccttacatgagtgatgctgttgtggcactgggattccttgcagaaatgcctgctggctataaacacaaatctggacccatactccaaatgaaacaagttggagatccctcacgaactggtagcactaagcaagataaggatgcgtacaatcgtcaaaaagctgtagctgaggccattgagtggggctcactgaggcagaaacagaaggctcaaaatccagaaaagaaagctctaagtcaaggtatatcccctccagaagccagcagactgtgaaacacctctgctgtgcactaggttaccttctgacttgtaaccctccaattttgtgtaagacttagggccaaattgtcccacatagctgagagtttgtaaatgaaattcgtctctcataaagatgtaaggggtatatagtatttgctgtt

SEQ ID NO: 1302 - protein, 1814 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 28416685; NR Description: At3g07070 [Arabidopsis
  misc_feature: GI Number: 34907210; NR Description: putative serine/threonine kinase PBS1 protein [Oryza sativa (japonica cultivar-group)] >gi|15408807|dbj|BAB64203.1| putative serine/threonine kinase PBS1 protein [Oryza sativa (japonica
  misc_feature: GI Number: 50931229; NR Description: putative serine/threonine protein kinase [Oryza sativa (japonica cultivar-group)] >gi|49328131|gb|AAT58829.1| putative serine/threonine protein kinase [Oryza sativa (japonica
  misc_feature: GI Number: 15238886; NR Description: protein kinase family
  misc_feature: GI Number: 11994661; NR Description: receptor protein
AGGACCCCTATTCTTGGCTCAGCAAATCCTCTCCTCGGCGCAAAGGCATGGAGCGAATGCTCATCCCACCTGACCACATTTTCCCCCACAGAGATCACATTTACCGCGCACAAAGCACCAACAACGATCCACAGCCTGTTTGCGAGATCTTTAGCACAAGGAGGGAGGCAGGCATATAGACTCCCACCCGTGCTCTCATTGTCAGCACAACGAGGCCTGCGGATCGGTCTGTGCGTTCTAGAGAGAGGGGACGAGGTTTACCCACTGCGAGAGCGGAGAGGGGCAGAGAAGAGATCCAAGGTTCTGGTACGTACAGCTGGGAGAAGATGAGCTGCTTCGGATGCTTCAAGCCCGACAAGAAGGTGCCACCCAGGAGGACGGAATCCAGGGAGGTCACGGTCGTCAACAAGGCCCCCAGCCAGAACGAAGCGCCTCCCAGGGAATCTGGGTCCATCAGGCCACCACCAGTTGCTTCGAAGCACAAGCACAGGGCCATCATCTGAAACAGCAGCAAGCATCGAACCTCCTAAAGGAAGTTGTTCTGTTGCCAAAACCGCAAAAGCATTCACGTTCCGTGAGCTAGCCACGGCCACGAAAAACTTCCGCTCTGACTGCCTTCTCGGAGAAGGGGGATTCGGCAGGGTATACAAGGGCAGGCTTGAAAACGGACAGCTTGTTGCTGTCAAGCAACTAGACCTGAATGGGTATCAAGGCAACAGAGAGTTCCTAGTTGAGGTCCTGATGCTCAGCCTATTGCACCATCCAAACCTAGTCAATTTGGTGGGCTATTGTGCAGATGGAGATCAAAGGCTTCTGGTTTATGAGTACATGGCACTTGGCTCACTTGCAGATCACCTGCTTGATAGCACTCCTGATCAAGTGCCACTGAGTTGGTATCTCAGGATGAAGATAGCTTATGGAACTGCAAAAGGGCTTGAATACCTCCATGAGAAGGCGAACCCACCTGTCATTTACCGGGATCTCAAGTCCCCCAACATCCTTCTCGATGAGAAGTACAACCCTAAGCTCTCAGATTTTGGGCTCGCAAAGCTTGGCCCAGTTGAGGGAAAGACACACATCTCCACTCGGGTGATGGGAACGTATGGGTACTGCGCTCCGGAATACATAAGAACAGGCCAGCTAACTGTTAAGACCGACGTGTACAGTTTTGGGGTTTTCCTACTGGAGTTGATCACAGGAAGAAGAGCAGTGGATACCTCCAGGCCAGCAAGTGAACAGATCCTGGTTAACTGGGTCAAGCCCATGCTGAGAGACAGGAAGCGATACAATGAGCTAGTAGACCCTCATCTTAGAGGTGAGTACCCAGAAAAAGACTTGAGCCAGGCTGTGGGTGTGGCAGCAATGTGCCTACAAGAGGAAGCCTCAGTCCGGCCTTACATGAGTGATGCTGTTGTGGCACTGGGATTCCTTGCAGAAATGCCTGCTGGCTATAAACACAAATCTGGACCCATACTCCAAATGAAACAAGTTGGAGATCCCTCACGAACTGGTAGCACTAAGCAAGATAAGGATGCGTACAATCGTCAAAAAGCTGTAGCTGAGGCCATTGAGTGGGGCTCACTGAGGCAGAAACAGAAGGCTCAAAATCCAGAAAAGAAAGCTCTAAGTCAAGGTATATCCCCTCCAGAAGCCAGCAGACTGTGAAACACCTCTGCTGTGCACTAGGTTACCTTCTGACTTGTAACCCTCCAATTTTGTGTAAGACTTAGGGCCAAATTGTCCCACATAGCTGAGAGTTTGTAAATGAAATTCGTCTCTCATAAAGATGTAAGGGGTATATAGTATTTGCTGTT

SEQ ID NO: 1303 - DNA, 1389 bp, Zea mays
  misc_feature (1)..(1389): Ceres cDNA ID no. 12450437
  misc_feature (1)..(1389): Ceres CLONE  ID no. 330351
  misc_feature (1)..(1389): Also known as  Ceres CDNA ID no. 23762938
  misc_feature (466)..(466): n is a, c, t, g, unknown, or other
  misc_feature (474)..(474): n is a, c, t, g, unknown, or other
  misc_feature (498)..(498): n is a, c, t, g, unknown, or other
  misc_feature (504)..(504): n is a, c, t, g, unknown, or other
  misc_feature (529)..(529): n is a, c, t, g, unknown, or other
  misc_feature (531)..(531): n is a, c, t, g, unknown, or other
  misc_feature (532)..(532): n is a, c, t, g, unknown, or other
  misc_feature (547)..(547): n is a, c, t, g, unknown, or other
  misc_feature (550)..(550): n is a, c, t, g, unknown, or other
  misc_feature (635)..(635): n is a, c, t, g, unknown, or other
  misc_feature (650)..(650): n is a, c, t, g, unknown, or other
  misc_feature (728)..(728): n is a, c, t, g, unknown, or other
  misc_feature (985)..(985): n is a, c, t, g, unknown, or other
  misc_feature (1017)..(1017): n is a, c, t, g, unknown, or other
  misc_feature (1072)..(1072): n is a, c, t, g, unknown, or other
ttaaccctcactaaagggaacaaaagctggagctccaccgcggtggcggccgctctagaactagtggatcccccgggctgcaggaattcgcacgagaccattacctagaacatcctaatcgaaaagaggtaacccaaagaacagagagaaattactgaagcatgagcgcggagctgaagagggactacgagatcggcgaggagatcgggcgcggccgcttcggggtggtccaccgctgcacgtcccgcgccaccggggaggccttcgccgtgaagtccgtggaccggtcgcggctgggcgacgacctggaccgcgagctcgcgcagctggagccgaagctggcgcagctcgccggcgcgggcaacccgggcgtggtgcaggtgcacgcggcgtacgaggacgaggcgtggacgcacgtggtcatggacctgtgcccgggcccggacctgctggagtgggtgggccnccgccgcngcgcgcccgtgccggagcccgtgncggccnccatcgtcgcgcaggtcgcgcaggngnncgcgctctgccaccnccncggcgtcgcccaccgcgacgtgaagcccaagaacatcctcatcgacgccgacgacgacgccgggagcgacgaggaggaccaggcngaggcggcgccgcgngcgcgcctggcggacttcgggtcggcggcgtgggtgggcgccggtgggctcgggcgcgccgagggccttgtggggacngccccactacgtggcgcccgaggtggtggccggcggcgagtacggcgccaaggcggacgtgtggagcgccggcgtggtgatgtacgcgctgctctccggcggcgcgctccccttcggcggcgacagcgccgcggaggtgctggcggccgtgctgcgcggcagcgcgcgcttcccgcccaggctcttcggcggggtgtcgcccgccgccaaggacctgatgcggcgcatgatctgccgcgacgagtggaggaggttcnccgccgagcaagtcctcgctcacccgtggatngtgagtggcggaggagcccgggcaatggagcggccaacctgaggaggaatccagncggacgtgtattgccgtagagcactcaggcacggcaagcaatcccggacgttatgtatgaggtttttgtacgtacgtacgtagtagtgtacggtagctgctgccagctgcagagcagatcgatcggcaaaagaagctttgtaggcttgtggttttcctttgccccccgggtttttggggacgctctttacctagcggagcagagagcacccgttttccgatgtgctggttttcctagctggatgtacatacactgaccgtcttttgtacagatggagtgtgctgttggatacataaataaaaaaaaaccaagccttt

SEQ ID NO: 1304 - protein, 1389 aa, Zea mays
  misc_feature: PFam Name: Pkinase; PFam Description: Protein kinase domain
  misc_feature: GI Number: 59803710; NR Description: phosphoenolpyruvate
  misc_feature: GI Number: 15029405; NR Description: phosphoenolpyruvate
  misc_feature: GI Number: 50910689; NR Description: putative phosphoenolpyruvate carboxylase kinase [Oryza sativa (japonica cultivar-group)] >gi|48716248|dbj|BAD23784.1| putative phosphoenolpyruvate carboxylase kinase [Oryza sativa (japonica
  misc_feature: GI Number: 59803714; NR Description: phosphoenolpyruvate
  misc_feature: GI Number: 59803712; NR Description: phosphoenolpyruvate
TTAACCCTCACTAAAGGGAACAAAAGCTGGAGCTCCACCGCGGTGGCGGCCGCTCTAGAACTAGTGGATCCCCCGGGCTGCAGGAATTCGCACGAGACCATTACCTAGAACATCCTAATCGAAAAGAGGTAACCCAAAGAACAGAGAGAAATTACTGAAGCATGAGCGCGGAGCTGAAGAGGGACTACGAGATCGGCGAGGAGATCGGGCGCGGCCGCTTCGGGGTGGTCCACCGCTGCACGTCCCGCGCCACCGGGGAGGCCTTCGCCGTGAAGTCCGTGGACCGGTCGCGGCTGGGCGACGACCTGGACCGCGAGCTCGCGCAGCTGGAGCCGAAGCTGGCGCAGCTCGCCGGCGCGGGCAACCCGGGCGTGGTGCAGGTGCACGCGGCGTACGAGGACGAGGCGTGGACGCACGTGGTCATGGACCTGTGCCCGGGCCCGGACCTGCTGGAGTGGGTGGGCCNCCGCCGCNGCGCGCCCGTGCCGGAGCCCGTGNCGGCCNCCATCGTCGCGCAGGTCGCGCAGGNGNNCGCGCTCTGCCACCNCCNCGGCGTCGCCCACCGCGACGTGAAGCCCAAGAACATCCTCATCGACGCCGACGACGACGCCGGGAGCGACGAGGAGGACCAGGCNGAGGCGGCGCCGCGNGCGCGCCTGGCGGACTTCGGGTCGGCGGCGTGGGTGGGCGCCGGTGGGCTCGGGCGCGCCGAGGGCCTTGTGGGGACNGCCCCACTACGTGGCGCCCGAGGTGGTGGCCGGCGGCGAGTACGGCGCCAAGGCGGACGTGTGGAGCGCCGGCGTGGTGATGTACGCGCTGCTCTCCGGCGGCGCGCTCCCCTTCGGCGGCGACAGCGCCGCGGAGGTGCTGGCGGCCGTGCTGCGCGGCAGCGCGCGCTTCCCGCCCAGGCTCTTCGGCGGGGTGTCGCCCGCCGCCAAGGACCTGATGCGGCGCATGATCTGCCGCGACGAGTGGAGGAGGTTCNCCGCCGAGCAAGTCCTCGCTCACCCGTGGATNGTGAGTGGCGGAGGAGCCCGGGCAATGGAGCGGCCAACCTGAGGAGGAATCCAGNCGGACGTGTATTGCCGTAGAGCACTCAGGCACGGCAAGCAATCCCGGACGTTATGTATGAGGTTTTTGTACGTACGTACGTAGTAGTGTACGGTAGCTGCTGCCAGCTGCAGAGCAGATCGATCGGCAAAAGAAGCTTTGTAGGCTTGTGGTTTTCCTTTGCCCCCCGGGTTTTTGGGGACGCTCTTTACCTAGCGGAGCAGAGAGCACCCGTTTTCCGATGTGCTGGTTTTCCTAGCTGGATGTACATACACTGACCGTCTTTTGTACAGATGGAGTGTGCTGTTGGATACATAAATAAAAAAAAACCAAGCCTTT

SEQ ID NO: 1305 - DNA, 1761 bp, Zea mays
  misc_feature (1)..(1761): Ceres cDNA ID no. 12450583
  misc_feature (1)..(1761): Ceres CLONE  ID no. 504434
  misc_feature (1)..(1761): Also known as  Ceres CDNA ID no. 23818938
  misc_feature (476)..(476): n is a, c, t, g, unknown, or other
  misc_feature (498)..(498): n is a, c, t, g, unknown, or other
  misc_feature (902)..(902): n is a, c, t, g, unknown, or other
  misc_feature (1429)..(1429): n is a, c, t, g, unknown, or other
  misc_feature (1483)..(1483): n is a, c, t, g, unknown, or other
  misc_feature (1503)..(1503): n is a, c, t, g, unknown, or other
  misc_feature (1714)..(1714): n is a, c, t, g, unknown, or other
  misc_feature (1723)..(1723): n is a, c, t, g, unknown, or other
  misc_feature (1745)..(1745): n is a, c, t, g, unknown, or other
aaccagcacaacgaagtcccgcgcacgcaaagaagtcacgtccaaactgaaggtgacaacatggagtccgcgccgtcaacggcggcggtcatggagcgcgagcgcctcacggccgagctggccttcgcggaggccgacgcagagcctagcagcttcgtcgtcaagatccggtgtcggctgccggacttcgcgcgcagcgtcaacctcaagtacgtccgcctcggcctgcgctctggcgccatccctgcgccctcctcatgggtcccgctcgcgctcgcgccgtcgctcctcgtcgcggcggcatactcgctcgttggcgcggacaagttctactcactcgacctgctcacctgcatcgcgtggctcgccgcggcggtgctgctgctcaccgtgtatttcctcatgcgcccaaggccggtgtacctcgtggacttcgcgtgctacaggccgggcaacgagcacgccatctccaaggngggcttcctggacatgacagancagcacgggctgcttcaacgcggaggcactcgagttccagaccaagatcaccaagcgctccggactcggcgatcggacgtacctcccgccgggcatccaggcacggccgccgcggctgtctatggaggaggcgcgcgcggaggccgaggccgtcatgttcggctgcctcgactcgctattctcggccacgggcatcgacccacgccgcgatgtgcgcgtgctcatcgtcaactgcagcctcttcaacccgacgccgtcgctggcgtccatggtagtgcaccgctacaagatgcgggaggacgtcaagtcgttcaaccttggaggcatggggtgcagcgcagggctcatcgccgtggacctcgccagggacatgctgcaggcgaaccccgggtgctacgccgtcntggtgagcaccgagaacatcacgctgaactggtacttcggcaacgaccgctccatgctgctgtccaactgcatcttccgcatgggcggcgctgccgcgctgctgtccaaccgccgcgccgacgccgggcgcgccaagtacaggctgctacacacggtacgcacccacaagggcgccgcggacgagtgctacggctgcgtgtaccagcgcgaggacggcaccggccgcgtcggcgtgtcgctggcgcgcgagctcatggccgtcgccggggacgcgctcaagacgaacatcaccaccctgggcccgctggtgctcccgatatcggagcagctcaagttcctcaagtccctcgtgctccgccgcgccctccgctcccgcggtgtccgtccgtacatcccggacttccggcgcgcgtttgaacacttctgcgtgcacgccggcgggcgcgccgtgctggaggaggtgcagcgcagcctggggctcagggacgcggacatggagcccagcaggtgcaccctgcaccgcttnggcaacaccagcagcagctcgctctggtacgagctcgcctacgccgaggccaanggccgcgtccgccgcggccnccgcgtgtggcagatcggattcggatccggattcaagtgcaacagtgctgtctggcgcgcgctccgcgacgtgccgcccgtgcacgccgacggcgccggcggtggcagcaactgcaacccgtgggtggacagcattcagagctacccgccaaaagagtacatctgatcgccatcttctttgtggtgaattaatcacgtcctgttggatcanttgtactanccgcgacgcagtagtgcacganaactgtatgtatggtg

SEQ ID NO: 1306 - protein, 1761 aa, Zea mays
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: SerH; PFam Description: Cell surface
  misc_feature: PFam Name: MMTV_SAg; PFam Description: Mouse mammary tumour
  misc_feature: GI Number: 32172500; NR Description: FAE3 [Marchantia polymorpha]
  misc_feature: GI Number: 29417540; NR Description:
  misc_feature: GI Number: 4091810; NR Description: fatty acid elongase
  misc_feature: GI Number: 49355348; NR Description: fatty acid elongase
  misc_feature: GI Number: 49355351; NR Description: fatty acid elongase
AACCAGCACAACGAAGTCCCGCGCACGCAAAGAAGTCACGTCCAAACTGAAGGTGACAACATGGAGTCCGCGCCGTCAACGGCGGCGGTCATGGAGCGCGAGCGCCTCACGGCCGAGCTGGCCTTCGCGGAGGCCGACGCAGAGCCTAGCAGCTTCGTCGTCAAGATCCGGTGTCGGCTGCCGGACTTCGCGCGCAGCGTCAACCTCAAGTACGTCCGCCTCGGCCTGCGCTCTGGCGCCATCCCTGCGCCCTCCTCATGGGTCCCGCTCGCGCTCGCGCCGTCGCTCCTCGTCGCGGCGGCATACTCGCTCGTTGGCGCGGACAAGTTCTACTCACTCGACCTGCTCACCTGCATCGCGTGGCTCGCCGCGGCGGTGCTGCTGCTCACCGTGTATTTCCTCATGCGCCCAAGGCCGGTGTACCTCGTGGACTTCGCGTGCTACAGGCCGGGCAACGAGCACGCCATCTCCAAGGNGGGCTTCCTGGACATGACAGANCAGCACGGGCTGCTTCAACGCGGAGGCACTCGAGTTCCAGACCAAGATCACCAAGCGCTCCGGACTCGGCGATCGGACGTACCTCCCGCCGGGCATCCAGGCACGGCCGCCGCGGCTGTCTATGGAGGAGGCGCGCGCGGAGGCCGAGGCCGTCATGTTCGGCTGCCTCGACTCGCTATTCTCGGCCACGGGCATCGACCCACGCCGCGATGTGCGCGTGCTCATCGTCAACTGCAGCCTCTTCAACCCGACGCCGTCGCTGGCGTCCATGGTAGTGCACCGCTACAAGATGCGGGAGGACGTCAAGTCGTTCAACCTTGGAGGCATGGGGTGCAGCGCAGGGCTCATCGCCGTGGACCTCGCCAGGGACATGCTGCAGGCGAACCCCGGGTGCTACGCCGTCNTGGTGAGCACCGAGAACATCACGCTGAACTGGTACTTCGGCAACGACCGCTCCATGCTGCTGTCCAACTGCATCTTCCGCATGGGCGGCGCTGCCGCGCTGCTGTCCAACCGCCGCGCCGACGCCGGGCGCGCCAAGTACAGGCTGCTACACACGGTACGCACCCACAAGGGCGCCGCGGACGAGTGCTACGGCTGCGTGTACCAGCGCGAGGACGGCACCGGCCGCGTCGGCGTGTCGCTGGCGCGCGAGCTCATGGCCGTCGCCGGGGACGCGCTCAAGACGAACATCACCACCCTGGGCCCGCTGGTGCTCCCGATATCGGAGCAGCTCAAGTTCCTCAAGTCCCTCGTGCTCCGCCGCGCCCTCCGCTCCCGCGGTGTCCGTCCGTACATCCCGGACTTCCGGCGCGCGTTTGAACACTTCTGCGTGCACGCCGGCGGGCGCGCCGTGCTGGAGGAGGTGCAGCGCAGCCTGGGGCTCAGGGACGCGGACATGGAGCCCAGCAGGTGCACCCTGCACCGCTTNGGCAACACCAGCAGCAGCTCGCTCTGGTACGAGCTCGCCTACGCCGAGGCCAANGGCCGCGTCCGCCGCGGCCNCCGCGTGTGGCAGATCGGATTCGGATCCGGATTCAAGTGCAACAGTGCTGTCTGGCGCGCGCTCCGCGACGTGCCGCCCGTGCACGCCGACGGCGCCGGCGGTGGCAGCAACTGCAACCCGTGGGTGGACAGCATTCAGAGCTACCCGCCAAAAGAGTACATCTGATCGCCATCTTCTTTGTGGTGAATTAATCACGTCCTGTTGGATCANTTGTACTANCCGCGACGCAGTAGTGCACGANAACTGTATGTATGGTG

SEQ ID NO: 1307 - DNA, 1463 bp, Zea mays
  misc_feature (1)..(1463): Ceres cDNA ID no. 12454872
  misc_feature (1)..(1463): Ceres CLONE  ID no. 448266
  misc_feature (1)..(1463): Also known as  Ceres CDNA ID no. 23807790
aggtgcagtcagtcagtcaggcagagaaacgtgcggaggtggaagccacaacgggagcgcctaccctcgcagtccgcccctcgacctcggagccgcagcccgcgaggagcgttcacaatcacaccggccaccgcggaccctagcgctttagccttatccgtccgagcgcgcgcccgatgcagacggaggcgcgcgtgggcgtcgtcgtcgacggcggcgccgccgtgggccggtgccaggagcagcgccacatcggcacggcggcgcacctcgccgccggaggcttcgcgggcgccgtcagcaagacgtgcaccgcccccctcgcgcggctcaccatcctcttccaggtagctggtatgcattcagatgttgcgactctaaggaagtgtagcatatggcatgaggcttcacgaatttttcgagaagaagggattgaagccttttggaaaggaaatctagtgacaattgtacatcgcttgccttattctgccatcagcttctattcgtatgagcgctacaaaaatcttctccaaacggttcctggcctggatagagactcaaataatgttggtgttgtacgtttgcttggtggtggtttggcgggaataactgctgcatctttaacttacccgttggatgttgttcgtactcgcttggcgacgcagaaaaccactaggtattacaagggcatcttccatgcggtgtccacaatttgtagagacgagggtgtcaaaggattgtataaaggccttggggccacgttattgggagttggacctagtatagcaatcagcttttctgtctatgaatcactaaggtcttattggcaaatggaaaggccccatgattcaactgcagttgttagcttgttttctgggagtctatctggtattgcatcatctacagccacatttccccttgatcttgtaaagcgacggatgcaacttcaaggagcagctgggacagcgtccgtccagaaatcaaccatatctggaactgtccgtgatatcttgcagagagaaggtctccgtggcttctacagaggtatcgcccctgagtacctcaaggtcgttcctagtgttggaatcgccttcatgacatacgagacactgaagggcttgctctccagcattgacatagacgatgagagctgaggtttcccattatacgaagaggttaaacttcaccggattttttggccataggttaccatcagaatgtatgtaagtgcatcagagtggttacacgaacggcattgtggcagttttgtagttgacggtaggtcaaagcttacctgaggtgtacaactagtcttgtgttgtaccataggctaaacagagcaaataagcgcttcatgatggagtcttcatcttgtgttcctttgtacattatgctccatcaaggaagagcaaaaaaaaaaaaaaaagaagaagaagaaggtgaaagtcaatgattttataggt

SEQ ID NO: 1308 - protein, 1463 aa, Zea mays
  misc_feature: PFam Name: Mito_carr; PFam Description: Mitochondrial
  misc_feature: GI Number: 34895726; NR Description: putative peroxisomal Ca-dependent solute carrier protein [Oryza sativa (japonica cultivar-group)] >gi|10798831|dbj|BAB16462.1| putative peroxisomal Ca-dependent solute carrier protein [Oryza sativa
  misc_feature: GI Number: 34902034; NR Description: putative peroxisomal Ca-dependent solute carrier protein [Oryza sativa (japonica cultivar-group)] >gi|29893633|gb|AAP06887.1| putative peroxisomal
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
AGGTGCAGTCAGTCAGTCAGGCAGAGAAACGTGCGGAGGTGGAAGCCACAACGGGAGCGCCTACCCTCGCAGTCCGCCCCTCGACCTCGGAGCCGCAGCCCGCGAGGAGCGTTCACAATCACACCGGCCACCGCGGACCCTAGCGCTTTAGCCTTATCCGTCCGAGCGCGCGCCCGATGCAGACGGAGGCGCGCGTGGGCGTCGTCGTCGACGGCGGCGCCGCCGTGGGCCGGTGCCAGGAGCAGCGCCACATCGGCACGGCGGCGCACCTCGCCGCCGGAGGCTTCGCGGGCGCCGTCAGCAAGACGTGCACCGCCCCCCTCGCGCGGCTCACCATCCTCTTCCAGGTAGCTGGTATGCATTCAGATGTTGCGACTCTAAGGAAGTGTAGCATATGGCATGAGGCTTCACGAATTTTTCGAGAAGAAGGGATTGAAGCCTTTTGGAAAGGAAATCTAGTGACAATTGTACATCGCTTGCCTTATTCTGCCATCAGCTTCTATTCGTATGAGCGCTACAAAAATCTTCTCCAAACGGTTCCTGGCCTGGATAGAGACTCAAATAATGTTGGTGTTGTACGTTTGCTTGGTGGTGGTTTGGCGGGAATAACTGCTGCATCTTTAACTTACCCGTTGGATGTTGTTCGTACTCGCTTGGCGACGCAGAAAACCACTAGGTATTACAAGGGCATCTTCCATGCGGTGTCCACAATTTGTAGAGACGAGGGTGTCAAAGGATTGTATAAAGGCCTTGGGGCCACGTTATTGGGAGTTGGACCTAGTATAGCAATCAGCTTTTCTGTCTATGAATCACTAAGGTCTTATTGGCAAATGGAAAGGCCCCATGATTCAACTGCAGTTGTTAGCTTGTTTTCTGGGAGTCTATCTGGTATTGCATCATCTACAGCCACATTTCCCCTTGATCTTGTAAAGCGACGGATGCAACTTCAAGGAGCAGCTGGGACAGCGTCCGTCCAGAAATCAACCATATCTGGAACTGTCCGTGATATCTTGCAGAGAGAAGGTCTCCGTGGCTTCTACAGAGGTATCGCCCCTGAGTACCTCAAGGTCGTTCCTAGTGTTGGAATCGCCTTCATGACATACGAGACACTGAAGGGCTTGCTCTCCAGCATTGACATAGACGATGAGAGCTGAGGTTTCCCATTATACGAAGAGGTTAAACTTCACCGGATTTTTTGGCCATAGGTTACCATCAGAATGTATGTAAGTGCATCAGAGTGGTTACACGAACGGCATTGTGGCAGTTTTGTAGTTGACGGTAGGTCAAAGCTTACCTGAGGTGTACAACTAGTCTTGTGTTGTACCATAGGCTAAACAGAGCAAATAAGCGCTTCATGATGGAGTCTTCATCTTGTGTTCCTTTGTACATTATGCTCCATCAAGGAAGAGCAAAAAAAAAAAAAAAAGAAGAAGAAGAAGGTGAAAGTCAATGATTTTATAGGT

SEQ ID NO: 1309 - DNA, 1845 bp, Zea mays
  misc_feature (1)..(1845): Ceres cDNA ID no. 12454887
  misc_feature (1)..(1845): Ceres CLONE  ID no. 506910
  misc_feature (1)..(1845): Also known as  Ceres CDNA ID no. 24305164
  misc_feature (700)..(700): n is a, c, t, g, unknown, or other
  misc_feature (1418)..(1418): n is a, c, t, g, unknown, or other
agtcctgggccgctgctgccgcgcactgcctgcttcggccgagacgagccccccggcccccgtttcgctcccatctcgcgacactctgcccacagctcactcgcctccgtctctccccgtcaaaaaagccacccccgtcccccgcgccgcgccacccgcctttggcctctggctggcaccctttcccccgcctagaaacccgagctctccctctagccttctgccgcacacttccgagttccttccgccacaacatccacacgcaaacctcgcgatggccgcgtcggaatccgtgccgttctgcgtcaaagggggcggcggcggcgcgcccaggccgcacggccacctggtgctcccggcggggcgggtccgcgaggggcttgcgttcgcggcgggcgccgtggtggccgctctcgtgctcctctcctcggcctccgtcctcacgccgccgcccgtgcccaacatcgtctccctccccctgtcgtcgtcgcccgccaacgccaacgccgccatctcttcctcccctgccgtggccgtcggcgagggcccgcgcacgttctacgacgaccgggagctgtcgtacgccgtcggggggcagcgcgtcacgggctgggacgcgaagcgcgcggcgtggctgcggacccggggcctggacggcgcggcggtcgcggggcgggtggtgatggtgaccgggtcgcanccggagccatgcaaggggccggggggcgaccacgcgctgctgcggttcctcaagaataagctggactactgccgcctccacgggatcgagctcctgtacaacaccgcgctgctggagccgtccatggtggcgtactgggccaagatccccagcgtgcgcgccgcgatgctggcgcacccggacgccgagtgggtgtggtgggtggacgccgacgccgtgttcacggacatggacttctccctcccgctggagcggtaccgcgagagcagcctggtggtgtacgggtgggagcgggaggtgtacgaggagcggtcgtgggtggggctcaacgccggcgtcttcctcatccgtaactgccagtggtcgctggacctcatggacgcgtgggcgcgcatgggcccggcctcgccggagtacgcgcggtgggggaagacgctgcgcgaggagctggaggggaaacccaacgacgagtcggacgaccagtcggcgctcgtgtacctcctgtccaggcacctggagcgggagcggtgggcgaacgccacgttcctcgagtccgggtactacttccaggggtactgggcggagatcgtggacaggctcgacggcgtggccacgcgctacgaggccgtggagcgcggccgcgcagggggccgggccgggctccgccgccgccacgcggagcgggagcacctcctgtacgcggcggcgcgacgtgagncggtgcggcagcagcgagggaccggcggaggcgtgcccgggccggacggcggcggccagaaggggtggcgccgccccttcgtcacgcacttcacggggtgccagccctgcggcggcgcgcccaaccggatgtacacgcggaggcggtgcgccgaggggatccgccgcgccctggcgttcgcggacgaccaggtgctccgctcctacggcttccgacacgccgcgccgctcagcgacagcgtcacgccgctgccgttcgactaccccgccgcacactgatgggcggtcgcgttggtgggcggtgggttcggcaactggctatggctattggctaggttaattaaatgagacaaaaccatgaatgcgatgcaatgtgtcaagtcacagtgtgtgtactatacatttttgatttgggtgtcatccatatt

SEQ ID NO: 1310 - protein, 1845 aa, Zea mays
  misc_feature: PFam Name: Glyco_transf_34; PFam Description: galactosyl
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: PFam Name: Amelogenin; PFam Description: Amelogenin
  misc_feature: GI Number: 55956982; NR Description:
  misc_feature: GI Number: 50912265; NR Description: putative alpha galactosyltransferase [Oryza sativa (japonica cultivar-group)] >gi|45735998|dbj|BAD13026.1| putative alpha galactosyltransferase
  misc_feature: GI Number: 32127690; NR Description: galactomannan
  misc_feature: GI Number: 62700755; NR Description: galactomannan
  misc_feature: GI Number: 5702018; NR Description: alpha galactosyltransferase [Trigonella foenum-graecum] >gi|25486551|pir||T52082 alpha galactosyltransferase (EC 2.4.1.-)
AGTCCTGGGCCGCTGCTGCCGCGCACTGCCTGCTTCGGCCGAGACGAGCCCCCCGGCCCCCGTTTCGCTCCCATCTCGCGACACTCTGCCCACAGCTCACTCGCCTCCGTCTCTCCCCGTCAAAAAAGCCACCCCCGTCCCCCGCGCCGCGCCACCCGCCTTTGGCCTCTGGCTGGCACCCTTTCCCCCGCCTAGAAACCCGAGCTCTCCCTCTAGCCTTCTGCCGCACACTTCCGAGTTCCTTCCGCCACAACATCCACACGCAAACCTCGCGATGGCCGCGTCGGAATCCGTGCCGTTCTGCGTCAAAGGGGGCGGCGGCGGCGCGCCCAGGCCGCACGGCCACCTGGTGCTCCCGGCGGGGCGGGTCCGCGAGGGGCTTGCGTTCGCGGCGGGCGCCGTGGTGGCCGCTCTCGTGCTCCTCTCCTCGGCCTCCGTCCTCACGCCGCCGCCCGTGCCCAACATCGTCTCCCTCCCCCTGTCGTCGTCGCCCGCCAACGCCAACGCCGCCATCTCTTCCTCCCCTGCCGTGGCCGTCGGCGAGGGCCCGCGCACGTTCTACGACGACCGGGAGCTGTCGTACGCCGTCGGGGGGCAGCGCGTCACGGGCTGGGACGCGAAGCGCGCGGCGTGGCTGCGGACCCGGGGCCTGGACGGCGCGGCGGTCGCGGGGCGGGTGGTGATGGTGACCGGGTCGCANCCGGAGCCATGCAAGGGGCCGGGGGGCGACCACGCGCTGCTGCGGTTCCTCAAGAATAAGCTGGACTACTGCCGCCTCCACGGGATCGAGCTCCTGTACAACACCGCGCTGCTGGAGCCGTCCATGGTGGCGTACTGGGCCAAGATCCCCAGCGTGCGCGCCGCGATGCTGGCGCACCCGGACGCCGAGTGGGTGTGGTGGGTGGACGCCGACGCCGTGTTCACGGACATGGACTTCTCCCTCCCGCTGGAGCGGTACCGCGAGAGCAGCCTGGTGGTGTACGGGTGGGAGCGGGAGGTGTACGAGGAGCGGTCGTGGGTGGGGCTCAACGCCGGCGTCTTCCTCATCCGTAACTGCCAGTGGTCGCTGGACCTCATGGACGCGTGGGCGCGCATGGGCCCGGCCTCGCCGGAGTACGCGCGGTGGGGGAAGACGCTGCGCGAGGAGCTGGAGGGGAAACCCAACGACGAGTCGGACGACCAGTCGGCGCTCGTGTACCTCCTGTCCAGGCACCTGGAGCGGGAGCGGTGGGCGAACGCCACGTTCCTCGAGTCCGGGTACTACTTCCAGGGGTACTGGGCGGAGATCGTGGACAGGCTCGACGGCGTGGCCACGCGCTACGAGGCCGTGGAGCGCGGCCGCGCAGGGGGCCGGGCCGGGCTCCGCCGCCGCCACGCGGAGCGGGAGCACCTCCTGTACGCGGCGGCGCGACGTGAGNCGGTGCGGCAGCAGCGAGGGACCGGCGGAGGCGTGCCCGGGCCGGACGGCGGCGGCCAGAAGGGGTGGCGCCGCCCCTTCGTCACGCACTTCACGGGGTGCCAGCCCTGCGGCGGCGCGCCCAACCGGATGTACACGCGGAGGCGGTGCGCCGAGGGGATCCGCCGCGCCCTGGCGTTCGCGGACGACCAGGTGCTCCGCTCCTACGGCTTCCGACACGCCGCGCCGCTCAGCGACAGCGTCACGCCGCTGCCGTTCGACTACCCCGCCGCACACTGATGGGCGGTCGCGTTGGTGGGCGGTGGGTTCGGCAACTGGCTATGGCTATTGGCTAGGTTAATTAAATGAGACAAAACCATGAATGCGATGCAATGTGTCAAGTCACAGTGTGTGTACTATACATTTTTGATTTGGGTGTCATCCATATT

SEQ ID NO: 1311 - DNA, 1073 bp, Arabidopsis thaliana
  misc_feature (1)..(1073): Ceres cDNA ID no. 12455314
  misc_feature (1)..(1073): Ceres CLONE  ID no. 1012659
  misc_feature (1)..(1073): Also known as  Ceres CDNA ID no. 23405891
gctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctgaaagaagagcaaatgagtggtgggatatcaggaatgatggatatgaacatggacaagatttttgaggattcagttccttgtagggttcgtgctaaacgtggttgtgctactcatcctcgtagcattgctgaacgggtgagaagaacgcgaataagtgatcggattaggaggctgcaagagcttgttcctaacatggataagcaaaccaacactgcagacatgttggaagaagctgtggagtatgtgaaggctcttcaaagccagatccaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgttt

SEQ ID NO: 1312 - protein, 1073 aa, Arabidopsis thaliana
  misc_feature: PFam Name: HLH; PFam Description: Helix-loop-helix
  misc_feature: GI Number: 20127088; NR Description: putative bHLH transcription factor [Arabidopsis thaliana] >gi|20147401|gb|AAM10410.1| At1g35460/F12A4_2 [Arabidopsis thaliana] >gi|15724178|gb|AAL06481.1| At1g35460/F12A4_2
  misc_feature: GI Number: 50947455; NR Description: putative transcription factor RAU1 [Oryza sativa (japonica cultivar-group)] >gi|42408931|dbj|BAD10188.1| putative transcription factor RAU1
  misc_feature: GI Number: 21554238; NR Description: Contains similarity to bHLH transcription factor GBOF-1 from Tulipa gesneriana gb|AF185269
  misc_feature: GI Number: 19401700; NR Description: transcription factor
  misc_feature: GI Number: 6166283; NR Description: helix-loop-helix protein
GCTGCTAAAATTTAATAAATTGTTTTGTCTAATTGTCTCCACCCATAAAAAAGCGCGAATTCAATTCACCGACTAAAGACATTCTCCGGTGGAGACCCCGATGCAATCCACTCATATAAGCGGCGGAAGTAGCGGTGGTGGTGGTGGAGGAGGAGGAGAGGTGAGTCGAAGTGGATTATCTCGGATCCGTTCAGCTCCAGCTACTTGGATTGAAACCCTACTCGAAGAAGATGAAGAAGAAGGTTTAAAACCTAACCTTTGTTTAACAGAGCTGCTTACTGGTAATAATAACTCTGGAGGAGTGATAACGAGTCGTGACGACTCGTTCGAGTTCCTGAGTTCTGTTGAGCAAGGATTGTATAATCATCATCAAGGTGGTGGCTTTCACCGTCAGAATAGTTCTCCGGCTGATTTTCTTAGTGGGTCTGGTTCTGGGACTGATGGGTATTTCTCTAATTTTGGTATTCCGGCGAATTATGACTATTTGTCGACCAACGTTGATATTTCTCCGACTAAACGGTCTAGAGATATGGAAACACAGTTTTCTTCTCAGCTGAAAGAAGAGCAAATGAGTGGTGGGATATCAGGAATGATGGATATGAACATGGACAAGATTTTTGAGGATTCAGTTCCTTGTAGGGTTCGTGCTAAACGTGGTTGTGCTACTCATCCTCGTAGCATTGCTGAACGGGTGAGAAGAACGCGAATAAGTGATCGGATTAGGAGGCTGCAAGAGCTTGTTCCTAACATGGATAAGCAAACCAACACTGCAGACATGTTGGAAGAAGCTGTGGAGTATGTGAAGGCTCTTCAAAGCCAGATCCAGGAATTGACAGAGCAGCAGAAGAGATGCAAATGCAAACCTAAAGAAGAACAATAATGTATCCTTTAGGATTTGATATATCTGTATTTTATTTTTGTACTATCTAAAAATGGTGATGATCTGTTCGAAAATTCGAAACATGATCTTATATATTGAACTAGAAAAAATAGATATATATGAATTTTAGCTGTAAAATTTTTGTACAATAAGGAGAAAAAGATTTAGAAGAGTCAATAAAAAGATGATGTTT

SEQ ID NO: 1313 - DNA, 1581 bp, Arabidopsis thaliana
  misc_feature (1)..(1581): Ceres cDNA ID no. 12455365
  misc_feature (1)..(1581): Ceres CLONE  ID no. 1026568
  misc_feature (1)..(1581): Also known as  Ceres CDNA ID no. 23405951
  misc_feature (144)..(144): n is a, c, t, g, unknown, or other
aattgaaccaatcgtgattcaactacaaaattcctctttgaaccaaaaagacaaatccgaaacatgcgtgtggatacgaaagatctctagattcctccactcctcaatttctcatcttttgcttcgtcgtgactcttcttgatntcatcaataatgggttctgttatgagtttgagctgttccaagaggaaagcaacgagtcaggacgttgagtgttcaagcgaatctcgtaaaagacgaaagatatcttcagagaacgatgaagaagagtgttgtagattgattccaagtcttcctgatgagttatctatacagattcttgctaggcttcctagaatttgttactcgagtgttcggttggtttctcggaggtggagatcggctgtttcgacttctgaggtgtatagtttgaggaaagaacttgggaggactgaggagtggctctatgtgttgactaaaggtcatgaggataagcttttgtggtatgctttagatcctgtgtctactaaatggcagagattgcctccaatgccggttgttgtttatgaagaagagtctagaaagagtttatctggtttgtggaatatgattacaccgagctttaatgttggtgcgattgtgaggagctttctaggtaggagggactcctctgagcaaatgccgttttgtgggtgcgctattggtgctgttgatgggggtctttatgttattggtggactttctaggtctaaaacagtgagctgtgtttggcggtttgatccgattttgaactcttggagtgaagttagttctatgttggcgagtcgggcttattccaaaacaggtgtattgaataagaaactatatgttgttggaggggttgatcggggacggggaggtttatctcctcttcagtcagctgaggtttatgatccaagcacggatgcttggtcagaggttccgagcatgcctttctcaaaggcgcaagtgttgccaaatgcgtttttggctgacttactaaagcctattgccacaggaatgacttgctacaacggtaggttatgtgttcctcagagtttatactcttggcctttctttgttgatgttggaggagaggtttatgatcccgagacaaatctctgggttgaaatgccgtctggtatgggtgaaggttggcctgcgaggcaagcaggtacaaaactgagtgttgtggtggatggtgagttatacgcttttgatccttcttcttcgatggagaacggaaagattaaagtgtatgatcaaaaggaagatacttggaaggttgttattggggaagtccctgtgtatgacttaacagattcagaatctccttatttgcttgctgggtttcatggcaagcttcatttcattactagagaccctaatcataacgttacagtcttacgagctgatgtccccaacatcccagtctcctcatcatcatctagctccagttctgtttcaatcccacacttaaagaccaatgcacctaacaagtcagacactgttacatggaaactcattgcaaccaaggactttggtgctgctgaacttgttagctgccaagttatagatatataa

SEQ ID NO: 1314 - protein, 1581 aa, Arabidopsis thaliana
  misc_feature: PFam Name: Kelch_1; PFam Description: Kelch motif
  misc_feature: PFam Name: F-box; PFam Description: F-box domain
  misc_feature: GI Number: 15219186; NR Description: Kelch repeat containing F-box protein family [Arabidopsis thaliana]
  misc_feature: GI Number: 50909791; NR Description: kelch repeat-containing F-box-like protein [Oryza sativa (japonica cultivar-group)] >gi|50725819|dbj|BAD33349.1| kelch repeat-containing F-box-like
  misc_feature: GI Number: 50919839; NR Description: putative Kelch motif containing protein [Oryza sativa (japonica cultivar-group)] >gi|19071626|gb|AAL84293.1| putative Kelch motif containing protein
  misc_feature: GI Number: 50508810; NR Description: kelch repeat containing
  misc_feature: GI Number: 50908777; NR Description: kelch repeat-containing F-box protein-like [Oryza sativa (japonica cultivar-group)] >gi|48716191|dbj|BAD23231.1| kelch repeat-containing F-box
AATTGAACCAATCGTGATTCAACTACAAAATTCCTCTTTGAACCAAAAAGACAAATCCGAAACATGCGTGTGGATACGAAAGATCTCTAGATTCCTCCACTCCTCAATTTCTCATCTTTTGCTTCGTCGTGACTCTTCTTGATNTCATCAATAATGGGTTCTGTTATGAGTTTGAGCTGTTCCAAGAGGAAAGCAACGAGTCAGGACGTTGAGTGTTCAAGCGAATCTCGTAAAAGACGAAAGATATCTTCAGAGAACGATGAAGAAGAGTGTTGTAGATTGATTCCAAGTCTTCCTGATGAGTTATCTATACAGATTCTTGCTAGGCTTCCTAGAATTTGTTACTCGAGTGTTCGGTTGGTTTCTCGGAGGTGGAGATCGGCTGTTTCGACTTCTGAGGTGTATAGTTTGAGGAAAGAACTTGGGAGGACTGAGGAGTGGCTCTATGTGTTGACTAAAGGTCATGAGGATAAGCTTTTGTGGTATGCTTTAGATCCTGTGTCTACTAAATGGCAGAGATTGCCTCCAATGCCGGTTGTTGTTTATGAAGAAGAGTCTAGAAAGAGTTTATCTGGTTTGTGGAATATGATTACACCGAGCTTTAATGTTGGTGCGATTGTGAGGAGCTTTCTAGGTAGGAGGGACTCCTCTGAGCAAATGCCGTTTTGTGGGTGCGCTATTGGTGCTGTTGATGGGGGTCTTTATGTTATTGGTGGACTTTCTAGGTCTAAAACAGTGAGCTGTGTTTGGCGGTTTGATCCGATTTTGAACTCTTGGAGTGAAGTTAGTTCTATGTTGGCGAGTCGGGCTTATTCCAAAACAGGTGTATTGAATAAGAAACTATATGTTGTTGGAGGGGTTGATCGGGGACGGGGAGGTTTATCTCCTCTTCAGTCAGCTGAGGTTTATGATCCAAGCACGGATGCTTGGTCAGAGGTTCCGAGCATGCCTTTCTCAAAGGCGCAAGTGTTGCCAAATGCGTTTTTGGCTGACTTACTAAAGCCTATTGCCACAGGAATGACTTGCTACAACGGTAGGTTATGTGTTCCTCAGAGTTTATACTCTTGGCCTTTCTTTGTTGATGTTGGAGGAGAGGTTTATGATCCCGAGACAAATCTCTGGGTTGAAATGCCGTCTGGTATGGGTGAAGGTTGGCCTGCGAGGCAAGCAGGTACAAAACTGAGTGTTGTGGTGGATGGTGAGTTATACGCTTTTGATCCTTCTTCTTCGATGGAGAACGGAAAGATTAAAGTGTATGATCAAAAGGAAGATACTTGGAAGGTTGTTATTGGGGAAGTCCCTGTGTATGACTTAACAGATTCAGAATCTCCTTATTTGCTTGCTGGGTTTCATGGCAAGCTTCATTTCATTACTAGAGACCCTAATCATAACGTTACAGTCTTACGAGCTGATGTCCCCAACATCCCAGTCTCCTCATCATCATCTAGCTCCAGTTCTGTTTCAATCCCACACTTAAAGACCAATGCACCTAACAAGTCAGACACTGTTACATGGAAACTCATTGCAACCAAGGACTTTGGTGCTGCTGAACTTGTTAGCTGCCAAGTTATAGATATATAA

SEQ ID NO: 1315 - DNA, 1350 bp, Zea mays
  misc_feature (1)..(1350): Ceres cDNA ID no. 12462509
  misc_feature (1)..(1350): Ceres CLONE  ID no. 294723
  misc_feature (1)..(1350): Also known as  Ceres CDNA ID no. 23760549
ctgattcctgaacacaccctcgtctccgcacggaggccgtcctctcctctcctctcctctgcgtccgccactgccgcccaccgctcgcccacgcgcgctccattacctcggcgggcgatggccgacctatccaacaccggctccacctaacacgagcagcgcccccgcctaggcggctggctggtcggtcgtcgagcagctagcggcggcagcgccccggaggccgtctcactctcctcgtcggggcggcaggagatggaggcccatcgtgggcgtcccgcgcgccgccgcgtggccgtgcctgggccggcctcgagaagccgccgcgcgccgcttgctgcgccagagtcccgacggcgaggctcgcggtcgcggcggacaggccgcggaggctggtgctgctgggcgccgatacgcggagggccgcggattatcctgccctccgttgcgccgcgcaatctgcaggaacaggaaaggtccactactctgctgatgacgctctcatactacagcaaaaagcccaggatgttctgccttacttggatggccgttgcgtttatcttgttggaatgatgggttcaggcaaaactacagttgggaagatactatccgaagtgttaggttattcgttcttcgacagtgataagttggtagagaaggctgttggtatttcatctgttgctgagatctttcagctccatagcgaaacattcttcagagataatgagagtgaggtcctgacggatctgtcatcaatgcatcggttggttgttgcaaccggaggtggtgcagtgatccgaccaatcaattggagttacatgaagaaagggctgaccgtatggttagatgtcccactggatgcacttgcaagaagaatcgctgctgtaggaaccgcgtctcgaccactcttgcatcaggaatccggtgatccttatgcaaaggcttatgcaaaacttacgtcactttttgagcaaagaatggactcgtatgctaatgctgatgccagagtttcacttgaacatattgcattaaaacaaggccataatgatgtcactatacttacacctagtaccatcgccattgaggcattgctaaagatggaaagttttcttaccgagaagaccatggtcagaaactgacctcttgaatgagagggaaaggatgctgacaacatgtggcccttgtttgtttaattgtacatatacctttgcattattgcctaaactctttctacagtgttgttggattattgtttgtgcagcatgaaagaggaccgtttgagtttgtatttatgcaaatgaataagtaaataactttcagttaaaacaatgacaattcgttatttatcgc

SEQ ID NO: 1316 - protein, 1350 aa, Zea mays
  misc_feature: PFam Name: SKI; PFam Description: Shikimate kinase
  misc_feature: GI Number: 56805577; NR Description: shikimate kinase 1
  misc_feature: GI Number: 56805579; NR Description: shikimate kinase 2
  misc_feature: GI Number: 32488697; NR Description: OSJNBb0003B01.26 [Oryza
  misc_feature: GI Number: 19349; NR Description: shikimate kinase precursor [Lycopersicon esculentum] >gi|114200|sp|Q00497|AROK_LYCES Shikimate kinase, chloroplast precursor >gi|100253|pir||S21584 shikimate
  misc_feature: GI Number: 30681570; NR Description: shikimate kinase,
CTGATTCCTGAACACACCCTCGTCTCCGCACGGAGGCCGTCCTCTCCTCTCCTCTCCTCTGCGTCCGCCACTGCCGCCCACCGCTCGCCCACGCGCGCTCCATTACCTCGGCGGGCGATGGCCGACCTATCCAACACCGGCTCCACCTAACACGAGCAGCGCCCCCGCCTAGGCGGCTGGCTGGTCGGTCGTCGAGCAGCTAGCGGCGGCAGCGCCCCGGAGGCCGTCTCACTCTCCTCGTCGGGGCGGCAGGAGATGGAGGCCCATCGTGGGCGTCCCGCGCGCCGCCGCGTGGCCGTGCCTGGGCCGGCCTCGAGAAGCCGCCGCGCGCCGCTTGCTGCGCCAGAGTCCCGACGGCGAGGCTCGCGGTCGCGGCGGACAGGCCGCGGAGGCTGGTGCTGCTGGGCGCCGATACGCGGAGGGCCGCGGATTATCCTGCCCTCCGTTGCGCCGCGCAATCTGCAGGAACAGGAAAGGTCCACTACTCTGCTGATGACGCTCTCATACTACAGCAAAAAGCCCAGGATGTTCTGCCTTACTTGGATGGCCGTTGCGTTTATCTTGTTGGAATGATGGGTTCAGGCAAAACTACAGTTGGGAAGATACTATCCGAAGTGTTAGGTTATTCGTTCTTCGACAGTGATAAGTTGGTAGAGAAGGCTGTTGGTATTTCATCTGTTGCTGAGATCTTTCAGCTCCATAGCGAAACATTCTTCAGAGATAATGAGAGTGAGGTCCTGACGGATCTGTCATCAATGCATCGGTTGGTTGTTGCAACCGGAGGTGGTGCAGTGATCCGACCAATCAATTGGAGTTACATGAAGAAAGGGCTGACCGTATGGTTAGATGTCCCACTGGATGCACTTGCAAGAAGAATCGCTGCTGTAGGAACCGCGTCTCGACCACTCTTGCATCAGGAATCCGGTGATCCTTATGCAAAGGCTTATGCAAAACTTACGTCACTTTTTGAGCAAAGAATGGACTCGTATGCTAATGCTGATGCCAGAGTTTCACTTGAACATATTGCATTAAAACAAGGCCATAATGATGTCACTATACTTACACCTAGTACCATCGCCATTGAGGCATTGCTAAAGATGGAAAGTTTTCTTACCGAGAAGACCATGGTCAGAAACTGACCTCTTGAATGAGAGGGAAAGGATGCTGACAACATGTGGCCCTTGTTTGTTTAATTGTACATATACCTTTGCATTATTGCCTAAACTCTTTCTACAGTGTTGTTGGATTATTGTTTGTGCAGCATGAAAGAGGACCGTTTGAGTTTGTATTTATGCAAATGAATAAGTAAATAACTTTCAGTTAAAACAATGACAATTCGTTATTTATCGC

SEQ ID NO: 1317 - DNA, 972 bp, Arabidopsis thaliana
  misc_feature (1)..(972): Ceres cDNA ID no. 12481764
  misc_feature (1)..(972): Ceres CLONE  ID no. 1027854
  misc_feature (1)..(972): Also known as  Ceres CDNA ID no. 0
atggcggaagagaggagcttgaacggcgaagcgactggtcaggatgatgagagtttcttcgattctgatcagcaaggcgacgacggcaagtccacggaactcaatcagaagatcggagacctcgagtctcagaatcaggaactggccagagataacgatgctatcaatcgtaaaattgagagcttgacggcggagattgaggagttgagaggagccgaatccaaggccaagcgtaagatgggtgagatggagcgagagattgacaagtccgatgaggagaggaaggttcttgaagccatagcttctagagcttcggagttagagaccgaagttgcacggctgcagcatgaactgatcacggccaggacggaaggggaagaggctacggcggaggcggagaagctgaggtctgagatttcacagaaaggtggtggaattgaggaattggagaaagaggtcgctggtttaaggactgtcaaggaggagaatgagaagagaatgaaggaattggagtcaaagcttggtgctttggaggtgaaggagttagatgagaagaacaaaaagttccgtgcagaggaagagatgagggagaagattgacaataaggagaaggaggttcatgatttgaaggagaagattaagagtttggaatcagatgtagcaaaagggaaaacagagttgcagaagtggataacagagaagatggttgtggaagattcgttgaaagattcagagaagaaagtggtggctttggaatcagagattgtggagttacagaaacagttggatgatgctgagaagatgatcaatggattgaagaatgtggttgaggagccactgaatggcattgagttcaagtcatggtcgccgaatgtgactgctgttggttccggtggagctgtggcagcggttgcagttgcagtggcaggagcagctgttgtctgctacatttaccactcgaggagggtttga

SEQ ID NO: 1318 - protein, 972 aa, Arabidopsis thaliana
ATGGCGGAAGAGAGGAGCTTGAACGGCGAAGCGACTGGTCAGGATGATGAGAGTTTCTTCGATTCTGATCAGCAAGGCGACGACGGCAAGTCCACGGAACTCAATCAGAAGATCGGAGACCTCGAGTCTCAGAATCAGGAACTGGCCAGAGATAACGATGCTATCAATCGTAAAATTGAGAGCTTGACGGCGGAGATTGAGGAGTTGAGAGGAGCCGAATCCAAGGCCAAGCGTAAGATGGGTGAGATGGAGCGAGAGATTGACAAGTCCGATGAGGAGAGGAAGGTTCTTGAAGCCATAGCTTCTAGAGCTTCGGAGTTAGAGACCGAAGTTGCACGGCTGCAGCATGAACTGATCACGGCCAGGACGGAAGGGGAAGAGGCTACGGCGGAGGCGGAGAAGCTGAGGTCTGAGATTTCACAGAAAGGTGGTGGAATTGAGGAATTGGAGAAAGAGGTCGCTGGTTTAAGGACTGTCAAGGAGGAGAATGAGAAGAGAATGAAGGAATTGGAGTCAAAGCTTGGTGCTTTGGAGGTGAAGGAGTTAGATGAGAAGAACAAAAAGTTCCGTGCAGAGGAAGAGATGAGGGAGAAGATTGACAATAAGGAGAAGGAGGTTCATGATTTGAAGGAGAAGATTAAGAGTTTGGAATCAGATGTAGCAAAAGGGAAAACAGAGTTGCAGAAGTGGATAACAGAGAAGATGGTTGTGGAAGATTCGTTGAAAGATTCAGAGAAGAAAGTGGTGGCTTTGGAATCAGAGATTGTGGAGTTACAGAAACAGTTGGATGATGCTGAGAAGATGATCAATGGATTGAAGAATGTGGTTGAGGAGCCACTGAATGGCATTGAGTTCAAGTCATGGTCGCCGAATGTGACTGCTGTTGGTTCCGGTGGAGCTGTGGCAGCGGTTGCAGTTGCAGTGGCAGGAGCAGCTGTTGTCTGCTACATTTACCACTCGAGGAGGGTTTGA

SEQ ID NO: 1319 - DNA, 937 bp, Arabidopsis thaliana
  misc_feature (1)..(937): Ceres cDNA ID no. 12481904
atgaccagagaattcgaactggaaaataactaccagctttgcgacgagatcggcagaggtagattcggaacaatcactcgctgtttctcaccggcgactaaagaattctacgcctgcaaaaccatcgacaagcgcgtgctcaccgacgcgttagatcgcgagtgtatagagacggagccgaggatcatggcgatgttaccgccgcatccgaatatcatcaggatcttcgatctctacgaaacagaggattctcttgcgatcgtcatggaattagtcgatccgccgatgacgatttacgatcggttaatctccgccggggggaggttatcagaatcagaatccgcctcatacgcgaaacagatcctccgtgcgcttgctcattgtcatcggtgcgacgtcgttcatcgggatgtgaaacctgacaacgtcttagtcgatctcgtaagcggcggtgttaagctctgtgatttcggatcagcggtgtggttaggcggagaaacggcggagggagttgtgggaacaccgtattacgtggcgccggaggtagtgatggggaggaagtacgacgagaaggttgatatatggagcgctggtgtagtgatatacacgatgctagctggagaaccgccgtttaacggtgagacggcggaagatatatttgaatcgatattgagagggaatttgaggtttccgccgaagaagtttgggtctgtatcatcggaagcgaaggatttgttgaggaaaatgatatgtcgcgatgtttctcgacgattttctgcagaggatgctcttcgacattcatggatgatgaacgttggaaacctccaaagcaattagtcgaagcttttcagatatgtgattagagaagtcgtaatatagatgtgagtgtgtaattgcttgattcgaatagtcaaacgtagttgtgtgtttcagcaat

SEQ ID NO: 1320 - protein, 278 aa, Arabidopsis thaliana
  misc_feature: PFam Name: Pkinase; PFam Description: Protein kinase domain
  misc_feature: GI Number: 7547112; NR Description: phosphoenolpyruvate
  misc_feature: GI Number: 18396914; NR Description: phosphoenolpyruvate carboxylase kinase, putative; protein id: At3g04530.1, supported by
  misc_feature: GI Number: 6175181; NR Description: putative
  misc_feature: GI Number: 15451567; NR Description: Putative
  misc_feature: GI Number: 2665890; NR Description: calcium-dependent protein
MTREFELENNYQLCDEIGRGRFGTITRCFSPATKEFYACKTIDKRVLTDALDRECIETEPRIMAMLPPHPNIIRIFDLYETEDSLAIVMELVDPPMTIYDRLISAGGRLSESESASYAKQILRALAHCHRCDVVHRDVKPDNVLVDLVSGGVKLCDFGSAVWLGGETAEGVVGTPYYVAPEVVMGRKYDEKVDIWSAGVVIYTMLAGEPPFNGETAEDIFESILRGNLRFPPKKFGSVSSEAKDLLRKMICRDVSRRFSAEDALRHSWMMNVGNLQSN

SEQ ID NO: 1321 - DNA, 1826 bp, Arabidopsis thaliana
  misc_feature (1)..(1826): Ceres cDNA ID no. 12482214
  misc_feature (1)..(1826): Ceres CLONE  ID no. 30044
  misc_feature (1)..(1826): Also known as  Ceres CDNA ID no. 24419422
aaagttgtcctaaaaaaaaccacccctctaaatagggagtgagtgagagagagagtgatagtgagaacaaaaaaaaaacatcatttcttctcgcactcttcacctgctccaatggacgaaagacccgagacagagctaatatcaataccagccacaccacgagtttcaacaccggagattctaactccctccggtcaaagatcacctcgtccggccaccaaaccatcgtcggcgacatggactccgacttcgttcatatcaccgaggttcttgagtccgattggtacaccaatgaaacgagttcttgtgaacatgaaagggtatcttgaagaagttggtcatctcactaagctaaacccacaagatgcttggcttccaatcactgaatctcgtaatggaaacgctcattacgctgcttttcacaatctcaacgctggtgttggttttcaagcccttgttcttcccgtcgcgtttgcgtttcttggctggagttggggaatactgtctttaacaatagcatattgctggcaactctacacactgtggattctggttcagttgcacgaagctgtccccgggaaacgctacaatcgatatgtcgagcttgcacaagctgcttttggagaaaggttaggagtatggcttgcattgtttcctacggtttacttatcagcaggaaccgcgacagcgctgattctgatcggtggagagacaatgaaactcttcttccagatagtttgcggtccattatgcacctcgaatccgttaacaacagttgaatggtatttggtgtttacatctctctgcatcgttctgtctcagctaccaaacctcaattctattgcgggactctccttaataggagcagtgactgcaataacttactccacaatggtttgggttctctctgtgagccaaccaagaccagccactatctcatacgagcctctttctatgccttcgacttctggttcactcttcgctgttttgaatgctcttggcattatagcttttgccttcagaggtcacaacttggttttggaaattcagtcgacgatgccatcaacgtttaagcatcctgctcacgtaccaatgtggagaggagccaaaatctcttacttcctcattgctctgtgtatctttccaatctccatcggaggcttttgggcttatgggaaccttatgccttcaggaggtatgcttgctgctttgtatgcattccacattcacgatatcccgagaggcttattagcgacggcatttctcctagtagtcttcagctgcttgagcagttttcagatatactccatgcctgcctttgacagctttgaagctggctacacaagcagaaccaacaagccgtgttcgatttgggtcagatcaggtttccgagtcttttttggttttgtctcgtttttcatcggtgttgctctcccttttctgtctagtcttgcggggttgctcggtggactcactctcccggtcacatttgcttatccttgcttcatgtgggtcttgattaagaaaccggcgaaatacagtttcaattggtatttccattggggattaggttggttgggagttgcattcagcttggcattctccataggtgggatctggagtatggttaccaatggacttaagctcaagttcttcaagccgcctaactaagtagtaatagcctatgtggttttgtttggttgggaagtttgaagttttaagagattttgtatttctgtgttttgtttaagagtgcctatgttttgaagttggaacaatgtaatgtgtattataattcagtaagcttttcaatataaagaatttgg

SEQ ID NO: 1322 - protein, 1826 aa, Arabidopsis thaliana
  misc_feature: PFam Name: Aa_trans; PFam Description: Transmembrane amino
  misc_feature: GI Number: 452593; NR Description: ORF [Lilium longiflorum]
  misc_feature: GI Number: 5688864; NR Description: amino acid
  misc_feature: GI Number: 21436363; NR Description: putative lysine and histidine specific transporter protein [Arabidopsis thaliana] >gi|17529318|gb|AAL38886.1| putative lysine and histidine specific
  misc_feature: GI Number: 28393033; NR Description: putative amino acid permease [Arabidopsis thaliana] >gi|18418590|ref|NP_567977.1| amino
  misc_feature: GI Number: 21593132; NR Description: amino acid permease-like
AAAGTTGTCCTAAAAAAAACCACCCCTCTAAATAGGGAGTGAGTGAGAGAGAGAGTGATAGTGAGAACAAAAAAAAAACATCATTTCTTCTCGCACTCTTCACCTGCTCCAATGGACGAAAGACCCGAGACAGAGCTAATATCAATACCAGCCACACCACGAGTTTCAACACCGGAGATTCTAACTCCCTCCGGTCAAAGATCACCTCGTCCGGCCACCAAACCATCGTCGGCGACATGGACTCCGACTTCGTTCATATCACCGAGGTTCTTGAGTCCGATTGGTACACCAATGAAACGAGTTCTTGTGAACATGAAAGGGTATCTTGAAGAAGTTGGTCATCTCACTAAGCTAAACCCACAAGATGCTTGGCTTCCAATCACTGAATCTCGTAATGGAAACGCTCATTACGCTGCTTTTCACAATCTCAACGCTGGTGTTGGTTTTCAAGCCCTTGTTCTTCCCGTCGCGTTTGCGTTTCTTGGCTGGAGTTGGGGAATACTGTCTTTAACAATAGCATATTGCTGGCAACTCTACACACTGTGGATTCTGGTTCAGTTGCACGAAGCTGTCCCCGGGAAACGCTACAATCGATATGTCGAGCTTGCACAAGCTGCTTTTGGAGAAAGGTTAGGAGTATGGCTTGCATTGTTTCCTACGGTTTACTTATCAGCAGGAACCGCGACAGCGCTGATTCTGATCGGTGGAGAGACAATGAAACTCTTCTTCCAGATAGTTTGCGGTCCATTATGCACCTCGAATCCGTTAACAACAGTTGAATGGTATTTGGTGTTTACATCTCTCTGCATCGTTCTGTCTCAGCTACCAAACCTCAATTCTATTGCGGGACTCTCCTTAATAGGAGCAGTGACTGCAATAACTTACTCCACAATGGTTTGGGTTCTCTCTGTGAGCCAACCAAGACCAGCCACTATCTCATACGAGCCTCTTTCTATGCCTTCGACTTCTGGTTCACTCTTCGCTGTTTTGAATGCTCTTGGCATTATAGCTTTTGCCTTCAGAGGTCACAACTTGGTTTTGGAAATTCAGTCGACGATGCCATCAACGTTTAAGCATCCTGCTCACGTACCAATGTGGAGAGGAGCCAAAATCTCTTACTTCCTCATTGCTCTGTGTATCTTTCCAATCTCCATCGGAGGCTTTTGGGCTTATGGGAACCTTATGCCTTCAGGAGGTATGCTTGCTGCTTTGTATGCATTCCACATTCACGATATCCCGAGAGGCTTATTAGCGACGGCATTTCTCCTAGTAGTCTTCAGCTGCTTGAGCAGTTTTCAGATATACTCCATGCCTGCCTTTGACAGCTTTGAAGCTGGCTACACAAGCAGAACCAACAAGCCGTGTTCGATTTGGGTCAGATCAGGTTTCCGAGTCTTTTTTGGTTTTGTCTCGTTTTTCATCGGTGTTGCTCTCCCTTTTCTGTCTAGTCTTGCGGGGTTGCTCGGTGGACTCACTCTCCCGGTCACATTTGCTTATCCTTGCTTCATGTGGGTCTTGATTAAGAAACCGGCGAAATACAGTTTCAATTGGTATTTCCATTGGGGATTAGGTTGGTTGGGAGTTGCATTCAGCTTGGCATTCTCCATAGGTGGGATCTGGAGTATGGTTACCAATGGACTTAAGCTCAAGTTCTTCAAGCCGCCTAACTAAGTAGTAATAGCCTATGTGGTTTTGTTTGGTTGGGAAGTTTGAAGTTTTAAGAGATTTTGTATTTCTGTGTTTTGTTTAAGAGTGCCTATGTTTTGAAGTTGGAACAATGTAATGTGTATTATAATTCAGTAAGCTTTTCAATATAAAGAATTTGG

SEQ ID NO: 1323 - DNA, 832 bp, Arabidopsis thaliana
  misc_feature (1)..(832): Ceres cDNA ID no. 12482239
  misc_feature (1)..(832): Ceres CLONE  ID no. 16261
  misc_feature (1)..(832): Also known as  Ceres CDNA ID no. 23654133
attggataagacaactatcaagaagccttcaatttccattggtcctcctctctccttctataatcccaaaaaccatctcacaaactcatcaaacctctttctcatctcatcttcaagccatctccgatcatcatcagacaatggcagcagctatggcaacagcaaccaagtgcatgtctctaaacccatctcctcctaaactccaaaaccaaaccaaatccaaaccattcatctccctaccaaccccaccaaaaccaaacgtctctctcgccgtcacaagcaccgccctagccggagccgtcttctcttccctcagctactctgagccagctttagccatccaacagatcgctcagctcgctgcagcaaacgccagtagcgacaaccgtggcttagctcttctccttcccatcgtcccagccattgcatgggtcctttacaacatcctccagccagctattaaccaggtcaacaagatgcgtgagagtaaaggtatcgttgttggtctaggtattggtggtggtcttgcagcgtcagggcttttgactccacctccggaggcttatgctgcggcagaagcggcggctgctagttcagacagcagaggacagttgttgttgattgttgtgacaccggcactactttgggttctgtacaatatcttgcagccagctttgaaccaaatcaacaagatgaggtctggggattaaaatcttatatatatataatattattataaatcatctttgggattcaaatgtaaaattaatcctttgttttatggacagttttatgtttacatttttggactaatatcgtttctcttatcggc

SEQ ID NO: 1324 - protein, 832 aa, Arabidopsis thaliana
  misc_feature: PFam Name: PsbY; PFam Description: Photosystem II protein Y (PsbY)
  misc_feature: GI Number: 24417352; NR Description: unknown [Arabidopsis thaliana] >gi|2956690|emb|CAA11248.1| PSBY [Arabidopsis thaliana] >gi|20453251|gb|AAM19864.1| At1g67740/F12A21_13 [Arabidopsis thaliana] >gi|15529290|gb|AAK97739.1| At1g67740/F12A21_13
  misc_feature: GI Number: 21593330; NR Description: unknown [Arabidopsis thaliana]
  misc_feature: GI Number: 6093830; NR Description: Photosystem II core complex proteins psbY, chloroplast precursor (L-arginine metabolising enzyme) (L-AME) [Contains: Photosystem II protein
  misc_feature: GI Number: 51979541; NR Description: PREDICTED OJ1005_B05.27 gene product [Oryza sativa (japonica cultivar-group)] >gi|51964634|ref|XP_507101.1| PREDICTED OJ1005_B05.27 gene product [Oryza sativa (japonica cultivar-group)] enzyme) (L-AME)
ATTGGATAAGACAACTATCAAGAAGCCTTCAATTTCCATTGGTCCTCCTCTCTCCTTCTATAATCCCAAAAACCATCTCACAAACTCATCAAACCTCTTTCTCATCTCATCTTCAAGCCATCTCCGATCATCATCAGACAATGGCAGCAGCTATGGCAACAGCAACCAAGTGCATGTCTCTAAACCCATCTCCTCCTAAACTCCAAAACCAAACCAAATCCAAACCATTCATCTCCCTACCAACCCCACCAAAACCAAACGTCTCTCTCGCCGTCACAAGCACCGCCCTAGCCGGAGCCGTCTTCTCTTCCCTCAGCTACTCTGAGCCAGCTTTAGCCATCCAACAGATCGCTCAGCTCGCTGCAGCAAACGCCAGTAGCGACAACCGTGGCTTAGCTCTTCTCCTTCCCATCGTCCCAGCCATTGCATGGGTCCTTTACAACATCCTCCAGCCAGCTATTAACCAGGTCAACAAGATGCGTGAGAGTAAAGGTATCGTTGTTGGTCTAGGTATTGGTGGTGGTCTTGCAGCGTCAGGGCTTTTGACTCCACCTCCGGAGGCTTATGCTGCGGCAGAAGCGGCGGCTGCTAGTTCAGACAGCAGAGGACAGTTGTTGTTGATTGTTGTGACACCGGCACTACTTTGGGTTCTGTACAATATCTTGCAGCCAGCTTTGAACCAAATCAACAAGATGAGGTCTGGGGATTAAAATCTTATATATATATAATATTATTATAAATCATCTTTGGGATTCAAATGTAAAATTAATCCTTTGTTTTATGGACAGTTTTATGTTTACATTTTTGGACTAATATCGTTTCTCTTATCGGC

SEQ ID NO: 1325 - DNA, 1527 bp, Arabidopsis thaliana
  misc_feature (1)..(1527): Ceres cDNA ID no. 12482552
  misc_feature (1)..(1527): Ceres CLONE  ID no. 101816
  misc_feature (1)..(1527): Also known as  Ceres CDNA ID no. 23427869
atggttcatgctgatggtcataattttcccggttcggatccaaaccctcatatgaacaagttcgctttcgggtgtgccattgttgcttccatcatttctatcatctttggatatgatacgggagttatgagcggagctcagatatttataagagatgatctaaaaataaacgacactcagattgaagttttggccggaatcttgaatctttgtgcactcgtcggatcactaacggcggggaaaacgtctgacgtcatcggccgacgttacaccatagctctctccgccgtgatattcttagtgggctcagttcttatgggttacggcccaaactatcctgttttgatggtcggacgatgtattgccggagttggtgtagggtttgctctcatgatagctccggtttactctgccgagatatcctctgcgtcacatagaggctttctcacttctctacctgagctttgtattagtcttgggattttactaggctatgtctcgaattactgttttgggaaactgacgttgaaacttggatggagattgatgcttggaatcgcagcgttcccgtctttgatattggcttttgggattacaagaatgcccgagtcgccgaggtggcttgtgatgcaaggtaggttagaagaagccaagaaaataatggttttggtatccaatacggaagaagaagctgaagaacggttcagagacatcttaaccgctgcggaagtagatgtgacagagataaaagaagttggtggcggcgttaagaagaagaatcacggtaaaagtgtttggagggagttggtgataaaaccgcgacctgcggtgcgtttgatcttgatagcggccgttgggatacactttttcgagcatgcgacggggattgaggccgtcgtgttgtacagcccgagaattttcaagaaagccggagttgtttcgaaagacaagctcttactagccacggtcggtgtaggtttaactaaggcctttttcataataatagccactttcttgctcgacaaggtaggtcgtagaaagctcctgttgaccagtacgggtgggatggtcttcgcattgaccagtttagcggttagtctcacgatggttcagcgatttgggcggttagcgtgggcattgagtttaagcatcgtctctacgtatgcatttgtagcttttttctccatagggcttggacctatcacatgggtgtacagctccgagatattcccgttgagacttagggctcagggagcgagtataggtgttgcggttaataggatcatgaacgcgacggtctcaatgagttttctgtcgatgacgaaggcgatcacgacagggggcgtgttcttcgtattcgccggaatagcggtggcggcatggtggttcttcttctttatgttgccggagacgaaaggattgccattggaggagatggagaagctttttggtggtgggggtcctcgtggtgatcgtgacggacttgagattcaaactaaaaccatctctattgggggtttctcataa

SEQ ID NO: 1326 - protein, 1527 aa, Arabidopsis thaliana
  misc_feature: PFam Name: Sugar_tr; PFam Description: Sugar (and other)
  misc_feature: PFam Name: MFS_1; PFam Description: Major Facilitator Superfamily
  misc_feature: GI Number: 13129489; NR Description: Putative sugar
  misc_feature: GI Number: 30025133; NR Description: putative sorbitol
  misc_feature: GI Number: 4678209; NR Description: putative sugar transporter [Arabidopsis thaliana] >gi|15226696|ref|NP_179210.1| mannitol transporter, putative [Arabidopsis thaliana] >gi|25308959|pir||A84537 probable sugar transporter [imported] -
  misc_feature: GI Number: 20197812; NR Description: putative sugar transporter [Arabidopsis thaliana] >gi|4218010|gb|AAD12218.1| putative sugar transporter [Arabidopsis thaliana] >gi|15224183|ref|NP_179438.1| mannitol transporter, sugar
  misc_feature: GI Number: 16118827; NR Description: putative sugar
ATGGTTCATGCTGATGGTCATAATTTTCCCGGTTCGGATCCAAACCCTCATATGAACAAGTTCGCTTTCGGGTGTGCCATTGTTGCTTCCATCATTTCTATCATCTTTGGATATGATACGGGAGTTATGAGCGGAGCTCAGATATTTATAAGAGATGATCTAAAAATAAACGACACTCAGATTGAAGTTTTGGCCGGAATCTTGAATCTTTGTGCACTCGTCGGATCACTAACGGCGGGGAAAACGTCTGACGTCATCGGCCGACGTTACACCATAGCTCTCTCCGCCGTGATATTCTTAGTGGGCTCAGTTCTTATGGGTTACGGCCCAAACTATCCTGTTTTGATGGTCGGACGATGTATTGCCGGAGTTGGTGTAGGGTTTGCTCTCATGATAGCTCCGGTTTACTCTGCCGAGATATCCTCTGCGTCACATAGAGGCTTTCTCACTTCTCTACCTGAGCTTTGTATTAGTCTTGGGATTTTACTAGGCTATGTCTCGAATTACTGTTTTGGGAAACTGACGTTGAAACTTGGATGGAGATTGATGCTTGGAATCGCAGCGTTCCCGTCTTTGATATTGGCTTTTGGGATTACAAGAATGCCCGAGTCGCCGAGGTGGCTTGTGATGCAAGGTAGGTTAGAAGAAGCCAAGAAAATAATGGTTTTGGTATCCAATACGGAAGAAGAAGCTGAAGAACGGTTCAGAGACATCTTAACCGCTGCGGAAGTAGATGTGACAGAGATAAAAGAAGTTGGTGGCGGCGTTAAGAAGAAGAATCACGGTAAAAGTGTTTGGAGGGAGTTGGTGATAAAACCGCGACCTGCGGTGCGTTTGATCTTGATAGCGGCCGTTGGGATACACTTTTTCGAGCATGCGACGGGGATTGAGGCCGTCGTGTTGTACAGCCCGAGAATTTTCAAGAAAGCCGGAGTTGTTTCGAAAGACAAGCTCTTACTAGCCACGGTCGGTGTAGGTTTAACTAAGGCCTTTTTCATAATAATAGCCACTTTCTTGCTCGACAAGGTAGGTCGTAGAAAGCTCCTGTTGACCAGTACGGGTGGGATGGTCTTCGCATTGACCAGTTTAGCGGTTAGTCTCACGATGGTTCAGCGATTTGGGCGGTTAGCGTGGGCATTGAGTTTAAGCATCGTCTCTACGTATGCATTTGTAGCTTTTTTCTCCATAGGGCTTGGACCTATCACATGGGTGTACAGCTCCGAGATATTCCCGTTGAGACTTAGGGCTCAGGGAGCGAGTATAGGTGTTGCGGTTAATAGGATCATGAACGCGACGGTCTCAATGAGTTTTCTGTCGATGACGAAGGCGATCACGACAGGGGGCGTGTTCTTCGTATTCGCCGGAATAGCGGTGGCGGCATGGTGGTTCTTCTTCTTTATGTTGCCGGAGACGAAAGGATTGCCATTGGAGGAGATGGAGAAGCTTTTTGGTGGTGGGGGTCCTCGTGGTGATCGTGACGGACTTGAGATTCAAACTAAAACCATCTCTATTGGGGGTTTCTCATAA

SEQ ID NO: 1327 - DNA, 1674 bp, Arabidopsis thaliana
  misc_feature (1)..(1674): Ceres cDNA ID no. 12482626
  misc_feature (1)..(1674): Ceres CLONE  ID no. 255298
  misc_feature (1)..(1674): Also known as  Ceres CDNA ID no. 23427925
agatgtaatttgtataattttagtaactcttcagtttttttttgttttaaaaatatattttctctctctctgtcttcctgcaatctatcgccggccgattcaataatttcgctttactctgccaaaaaagtttgttcttttgttttctgggattatccaaagagaagaaacagaggaaatcagtctcttttttagtttcagaccctaaatcctaggttttgaagttttgtttctttagtaattttgtcaggttttgtgtctggtgttgggatttttcggagcttggtttcttgaaccagctccattttctaaaaattccttctttaaatccccattgttgtaagtcttaaagaaaaaagaagatgacttgttgtttctcttgtttgaatcctcgaaccaaggacataagagtcgacattgataacgctcgatgcaactctcgttaccaaaccgattcatcagttcatggaagtgatacaacaggaacagagtcgatttcgggtatcttagtaaatggtaaagtgaatagtccgatacctggtggtggagctcggagcttcacgttcaaggagttagctgcagctacaagaaacttccgggaagttaatttgctcggagaaggaggttttggcagagtttataagggacgtttagattcaggacaagtagtggctattaagcaattgaatccagatgggcttcaagggaaccgagagtttatagtagaagttcttatgcttagcttattgcatcatcccaatctcgttacattgatcggttactgtacttctggtgatcaaagacttcttgtctatgaatacatgccaatgggaagcttagaagatcacctttttgatcttgagtctaatcaagaaccattaagctggaatactcgaatgaaaatcgcggttggtgcagctcgaggaatagagtatcttcactgcacagctaacccgccagtgatttaccgtgatttgaaatccgcaaacatattgttagataaagagttcagtccaaaactctcggatttcggattggcgaaactcggtccagttggtgatcgaactcatgtatcgactcgtgtcatgggaacttacggttactgtgctcctgaatacgcaatgagcgggaaattaactgttaaatcggatatctactgcttcggtgtagtgttgcttgagctgattactgggagaaaagctattgatttaggtcaaaagcaaggcgagcagaatcttgttacttggtcacgtccatacctcaaggatcagaagaagtttggacatttagtggatccgtctctacgaggaaaatacccaagacggtgtttaaactatgcgattgcgattattgcaatgtgtcttaatgaagaagctcattatcgaccgttcataggtgacatagttgtggcactagagtacttagccgcacagagcagatctcatgaagctcgaaacgtctcatcaccgtcaccagagatttcaagaacgccgcgacgagacttgtaaaaactcaaaaacagcttttaagaatttcagtttggtgttgtgtaaaaatggtttttttgtttctttctcagaaaacaatatatgtttggtaaatgtttcgttattagtctcttttacttgatgtatatggcaattatggaaacaattaaagttcttttatatgtgt

SEQ ID NO: 1328 - protein, 1674 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15217992; NR Description: protein kinase family
  misc_feature: GI Number: 34907210; NR Description: putative serine/threonine kinase PBS1 protein [Oryza sativa (japonica cultivar-group)] >gi|15408807|dbj|BAB64203.1| putative serine/threonine kinase PBS1 protein [Oryza sativa (japonica
  misc_feature: GI Number: 15238886; NR Description: protein kinase family
  misc_feature: GI Number: 50931229; NR Description: putative serine/threonine protein kinase [Oryza sativa (japonica cultivar-group)] >gi|49328131|gb|AAT58829.1| putative serine/threonine protein kinase [Oryza sativa (japonica
  misc_feature: GI Number: 37625033; NR Description: protein kinase-like
AGATGTAATTTGTATAATTTTAGTAACTCTTCAGTTTTTTTTTGTTTTAAAAATATATTTTCTCTCTCTCTGTCTTCCTGCAATCTATCGCCGGCCGATTCAATAATTTCGCTTTACTCTGCCAAAAAAGTTTGTTCTTTTGTTTTCTGGGATTATCCAAAGAGAAGAAACAGAGGAAATCAGTCTCTTTTTTAGTTTCAGACCCTAAATCCTAGGTTTTGAAGTTTTGTTTCTTTAGTAATTTTGTCAGGTTTTGTGTCTGGTGTTGGGATTTTTCGGAGCTTGGTTTCTTGAACCAGCTCCATTTTCTAAAAATTCCTTCTTTAAATCCCCATTGTTGTAAGTCTTAAAGAAAAAAGAAGATGACTTGTTGTTTCTCTTGTTTGAATCCTCGAACCAAGGACATAAGAGTCGACATTGATAACGCTCGATGCAACTCTCGTTACCAAACCGATTCATCAGTTCATGGAAGTGATACAACAGGAACAGAGTCGATTTCGGGTATCTTAGTAAATGGTAAAGTGAATAGTCCGATACCTGGTGGTGGAGCTCGGAGCTTCACGTTCAAGGAGTTAGCTGCAGCTACAAGAAACTTCCGGGAAGTTAATTTGCTCGGAGAAGGAGGTTTTGGCAGAGTTTATAAGGGACGTTTAGATTCAGGACAAGTAGTGGCTATTAAGCAATTGAATCCAGATGGGCTTCAAGGGAACCGAGAGTTTATAGTAGAAGTTCTTATGCTTAGCTTATTGCATCATCCCAATCTCGTTACATTGATCGGTTACTGTACTTCTGGTGATCAAAGACTTCTTGTCTATGAATACATGCCAATGGGAAGCTTAGAAGATCACCTTTTTGATCTTGAGTCTAATCAAGAACCATTAAGCTGGAATACTCGAATGAAAATCGCGGTTGGTGCAGCTCGAGGAATAGAGTATCTTCACTGCACAGCTAACCCGCCAGTGATTTACCGTGATTTGAAATCCGCAAACATATTGTTAGATAAAGAGTTCAGTCCAAAACTCTCGGATTTCGGATTGGCGAAACTCGGTCCAGTTGGTGATCGAACTCATGTATCGACTCGTGTCATGGGAACTTACGGTTACTGTGCTCCTGAATACGCAATGAGCGGGAAATTAACTGTTAAATCGGATATCTACTGCTTCGGTGTAGTGTTGCTTGAGCTGATTACTGGGAGAAAAGCTATTGATTTAGGTCAAAAGCAAGGCGAGCAGAATCTTGTTACTTGGTCACGTCCATACCTCAAGGATCAGAAGAAGTTTGGACATTTAGTGGATCCGTCTCTACGAGGAAAATACCCAAGACGGTGTTTAAACTATGCGATTGCGATTATTGCAATGTGTCTTAATGAAGAAGCTCATTATCGACCGTTCATAGGTGACATAGTTGTGGCACTAGAGTACTTAGCCGCACAGAGCAGATCTCATGAAGCTCGAAACGTCTCATCACCGTCACCAGAGATTTCAAGAACGCCGCGACGAGACTTGTAAAAACTCAAAAACAGCTTTTAAGAATTTCAGTTTGGTGTTGTGTAAAAATGGTTTTTTTGTTTCTTTCTCAGAAAACAATATATGTTTGGTAAATGTTTCGTTATTAGTCTCTTTTACTTGATGTATATGGCAATTATGGAAACAATTAAAGTTCTTTTATATGTGT

SEQ ID NO: 1329 - DNA, 1104 bp, Arabidopsis thaliana
  misc_feature (1)..(1104): Ceres cDNA ID no. 12483988
  misc_feature (1)..(1104): Ceres CLONE  ID no. 28208
  misc_feature (1)..(1104): Also known as  Ceres CDNA ID no. 23428758
caaaaaacattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttctagcttgtctattatgtccgagaatttctttttctgtttttgattcttttcgttgtatatctttgtccaataaaggaaatgatgtgtctttactcttatagatatgtataaaaagatgtccctgttttatttgttaaaaaaaattgtttatg

SEQ ID NO: 1330 - protein, 1104 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 17104625; NR Description: putative xyloglucan endo-1,4-beta-D-glucanase precursor [Arabidopsis thaliana] >gi|14334966|gb|AAK59660.1| putative xyloglucan endo-1,4-beta-D-glucanase precursor [Arabidopsis thaliana]
  misc_feature: GI Number: 21553999; NR Description: xyloglucan
  misc_feature: GI Number: 9758317; NR Description: TCH4 protein [Arabidopsis thaliana] >gi|17386136|gb|AAL38614.1| AT5g57560/MUA2_13 [Arabidopsis thaliana] >gi|15777883|gb|AAL05902.1| AT5g57560/MUA2_13 [Arabidopsis thaliana]
  misc_feature: GI Number: 29500899; NR Description: putative xyloglucan endotransglycosylase [Cucumis sativus] >gi|29500891|emb|CAD87535.1|
  misc_feature: GI Number: 29500901; NR Description: putative xyloglucan endotransglycosylase [Cucumis sativus] >gi|29500893|emb|CAD87536.1|
CAAAAAACATTCCTCACCAAACCCTCTCCAAAACACACCCACACGTACGCACACACACAAAGACAATGTCTCCTTTCAAAATATTCTTCTTCACGACTCTTCTCGTGGCGGCGTTTTCAGTGTCGGCTGCTGATTTCAACACTGACGTCAACGTAGCTTGGGGAAATGGCCGTGGGAAGATACTCAACAACGGCCAGCTTCTTACTCTCTCCTTAGACAAATCCTCTGGTTCCGGTTTTCAATCCAAAACAGAGTATTTGTTTGGAAAGATTGATATGCAGATTAAGCTTGTTCCTGGTAACTCTGCAGGAACAGTCACAACTTTTTACCTAAAATCCGAAGGATCCACTTGGGATGAGATTGATTTTGAGTTCTTGGGTAATATGAGTGGAGATCCTTATACTTTACACACTAATGTTTACACTCAAGGTAAAGGTGACAAAGAGCAACAATTCCATCTCTGGTTCGACCCAACCGCCAATTTCCACACTTACTCAATCCTCTGGAACCCTCAAAGAATCATATTGACCGTCGATGACACACCCATTAGAGAGTTTAAAAACTATGAGTCTCTCGGTGTCTTGTTTCCAAAGAACAAGCCGATGAGGATGTACGCGAGTTTATGGAACGCAGACGATTGGGCAACAAGAGGCGGTCTTGTTAAAACTGATTGGTCTAAAGCTCCATTCATGGCTTCTTACAGAAACATTAAGATTGACTCGAAACCAAACTCCAATTGGTACACTCAAGAAATGGATTCAACAAGCCAAGCTAGACTCAAATGGGTTCAGAAGAATTACATGATCTACAATTATTGTACTGACCATAGGAGGTTTCCACAGGGAGCTCCTAAGGAATGCACAACAAGCTCATAGAATCTCAAATTATATTCTATTTATTTATCTACACTTCCTCTCTTTCTTTTATGTGAAAATTGTGAATGCTCTGTTTCTAGCTTGTCTATTATGTCCGAGAATTTCTTTTTCTGTTTTTGATTCTTTTCGTTGTATATCTTTGTCCAATAAAGGAAATGATGTGTCTTTACTCTTATAGATATGTATAAAAAGATGTCCCTGTTTTATTTGTTAAAAAAAATTGTTTATG

SEQ ID NO: 1331 - DNA, 1459 bp, Arabidopsis thaliana
  misc_feature (1)..(1459): Ceres cDNA ID no. 12488248
  misc_feature (1)..(1459): Ceres CLONE  ID no. 158343
  misc_feature (1)..(1459): Also known as  Ceres CDNA ID no. 23431220
atgagagaaggatctcatcttatcgtcttgcctttcccaggacaaggccacataactccaatgtcccagttctgcaaacgcttagcctcaaaaggtcttaagctcactctggtcctcgtctccgacaaaccctctcctccatacaaaacagagcacgactcaatcactgtcttccccatctccaacggcttccaagaaggcgaggaaccattacaagacctcgatgattacatggaaagagtagaaaccagcatcaaaaacaccttaccgaagttggttgaagacatgaaactgtcgggaaatccacctagggctatcgtgtacgactccaccatgccatggcttcttgatgtagctcatagttatggattgagcggtgccgtgtttttcacgcaaccttggcttgtcacagctatttactaccatgttttcaagggttcgttctctgtaccgtctacaaagtacggtcactcgacattagcatctttcccttcgttcccgatgctgactgcaaatgatttgccgtctttcctctgcgaatcgtcctcatacccgaatatactgaggattgtggtggatcagctctcaaacattgatcgagtcgacatagtgttgtgcaacactttcgataaattggaggaaaagttgttgaaatgggtccaaagcttgtggccagtcttgaatattggaccaacggttccatcgatgtatttagacaaacgactgtctgaagacaagaactacggttttagcctcttcaatgcgaaagtcgctgaatgcatggagtggctaaactcaaaggagcctaattctgttgtctatttatcattcggaagtttggtgattctaaaagaagatcaaatgttggaactcgctgcgggtctgaaacagagcggacgtttctttctgtgggttgtgagagagacagagacacacaaacttccaagaaactatgtcgaggaaatcggtgaaaaaggacttattgtaagctggagtcctcagcttgacgtacttgcacataaatcaatcggttgtttcttgacacactgtggatggaactcgacgttagagggattgagtttgggagttccaatgattggtatgccacactggactgatcagcccacgaatgctaagttcatgcaggatgtgtggaaggttggggtaagggttaaggcagaaggtgatgggtttgtgagaagagaagagattatgagaagtgtggaagaagttatggagggagagaaagggaaagagattagaaagaatgctgagaaatggaaagtgttggctcaagaggcagtttctgaaggaggtagctctgataagagcatcaatgagtttgtttctatgttttgttgaatgatttaaattgatatgttcaaaagtacatcgtcttttgcaagtccaattgtaattcttgttgttgttgtagtaataactaataatatagtttctc

SEQ ID NO: 1332 - protein, 1459 aa, Arabidopsis thaliana
  misc_feature: PFam Name: UDPGT; PFam Description: UDP-glucoronosyl and
  misc_feature: GI Number: 21436309; NR Description: putative glucosyltransferase [Arabidopsis thaliana] >gi|15810477|gb|AAL07126.1| putative glucosyltransferase [Arabidopsis thaliana] >gi|4887757|gb|AAD32293.1| putative
  misc_feature: GI Number: 21536917; NR Description: putative
  misc_feature: GI Number: 23507803; NR Description: At2g31750/F20M17.21 [Arabidopsis thaliana] >gi|21928141|gb|AAM78098.1| At2g31750/F20M17.21 [Arabidopsis thaliana] >gi|4887761|gb|AAD32297.1| putative glucosyltransferase
  misc_feature: GI Number: 60649935; NR Description: UDP-xylose phenolic
  misc_feature: GI Number: 7385017; NR Description: UDP-glucose:salicylic
ATGAGAGAAGGATCTCATCTTATCGTCTTGCCTTTCCCAGGACAAGGCCACATAACTCCAATGTCCCAGTTCTGCAAACGCTTAGCCTCAAAAGGTCTTAAGCTCACTCTGGTCCTCGTCTCCGACAAACCCTCTCCTCCATACAAAACAGAGCACGACTCAATCACTGTCTTCCCCATCTCCAACGGCTTCCAAGAAGGCGAGGAACCATTACAAGACCTCGATGATTACATGGAAAGAGTAGAAACCAGCATCAAAAACACCTTACCGAAGTTGGTTGAAGACATGAAACTGTCGGGAAATCCACCTAGGGCTATCGTGTACGACTCCACCATGCCATGGCTTCTTGATGTAGCTCATAGTTATGGATTGAGCGGTGCCGTGTTTTTCACGCAACCTTGGCTTGTCACAGCTATTTACTACCATGTTTTCAAGGGTTCGTTCTCTGTACCGTCTACAAAGTACGGTCACTCGACATTAGCATCTTTCCCTTCGTTCCCGATGCTGACTGCAAATGATTTGCCGTCTTTCCTCTGCGAATCGTCCTCATACCCGAATATACTGAGGATTGTGGTGGATCAGCTCTCAAACATTGATCGAGTCGACATAGTGTTGTGCAACACTTTCGATAAATTGGAGGAAAAGTTGTTGAAATGGGTCCAAAGCTTGTGGCCAGTCTTGAATATTGGACCAACGGTTCCATCGATGTATTTAGACAAACGACTGTCTGAAGACAAGAACTACGGTTTTAGCCTCTTCAATGCGAAAGTCGCTGAATGCATGGAGTGGCTAAACTCAAAGGAGCCTAATTCTGTTGTCTATTTATCATTCGGAAGTTTGGTGATTCTAAAAGAAGATCAAATGTTGGAACTCGCTGCGGGTCTGAAACAGAGCGGACGTTTCTTTCTGTGGGTTGTGAGAGAGACAGAGACACACAAACTTCCAAGAAACTATGTCGAGGAAATCGGTGAAAAAGGACTTATTGTAAGCTGGAGTCCTCAGCTTGACGTACTTGCACATAAATCAATCGGTTGTTTCTTGACACACTGTGGATGGAACTCGACGTTAGAGGGATTGAGTTTGGGAGTTCCAATGATTGGTATGCCACACTGGACTGATCAGCCCACGAATGCTAAGTTCATGCAGGATGTGTGGAAGGTTGGGGTAAGGGTTAAGGCAGAAGGTGATGGGTTTGTGAGAAGAGAAGAGATTATGAGAAGTGTGGAAGAAGTTATGGAGGGAGAGAAAGGGAAAGAGATTAGAAAGAATGCTGAGAAATGGAAAGTGTTGGCTCAAGAGGCAGTTTCTGAAGGAGGTAGCTCTGATAAGAGCATCAATGAGTTTGTTTCTATGTTTTGTTGAATGATTTAAATTGATATGTTCAAAAGTACATCGTCTTTTGCAAGTCCAATTGTAATTCTTGTTGTTGTTGTAGTAATAACTAATAATATAGTTTCTC

SEQ ID NO: 1333 - DNA, 1282 bp, Arabidopsis thaliana
  misc_feature (1)..(1282): Ceres cDNA ID no. 12488272
  misc_feature (1)..(1282): Ceres CLONE  ID no. 107277
  misc_feature (1)..(1282): Also known as  Ceres CDNA ID no. 23431234
atcaccattgctttgttttgttcgtcaaatataatcaattttaaatttcttctcttctcttcaaacgaatcgcctttttcgataatctctttgcatcgatttcatcatggctactcaaacggatctcgctcagcccaagcttgatatgaccaaggaggagaaagagaggttgaagtatttgcaattcgtgcaagctgctgctgtggaagctctgcttcgctttgctcttatttacgctaaggcaaaggacaagtctggtcctttgaaacctggtgttgaatctgttgaaggagctgtcaagactgtcgttggtcctgtctacgagaaataccacgacgtccctgttgaggtccttaaatacatggaccagaaggtacaattttgactctttccctatctttggatcttgctgaaagtgcctttgttgatgaacaatgaatgaatctgtgttgttgattgtatatccacttcatcgaacatatgtgattaaaaaagtacagttaaagttgtgatgatttcatatcatctctttggtagaaggttcaggttaacgggtcaatgtcattatgttctgtagagtccctctttttgaagctgacaagtttgttttgcgttgttgcaggttgatatgtctgtgactgagcttgaccgtcgtgtcccaccagtcgtcaagcaagtgtctgcccaagccatctccgctgctcagatagcacccattgtggcacgtgcgttggcctctgaggttcgacgtgctggtgttgttgaaaccgcttctggaatggctaaatccgtctactccaagtacgagcctgctgctaaggagttgtatgcaaactatgagccaaaagcaaagcagtgtgccgtttcagcttggaagaagcttaaccagcttcctctattcccaaggctgggctcaagttgctgtaccaacagctgctttctgctctgagaagtacaatgatactgtggttaaggctgcagagaaagggtacagagtcacatcgtacatgccattggttccaacagagaggatctcaaaaatcttcgctgaggagaaagctgagaccgagcctttggagttccatccacttgattgatatgggtgttttgttagtgtgattttttgttttgttgggattaaggtgaaccggatcttggttagcgattgatctctggttctcgttcttttttttctttgtcatgaacttttgttgtttcgtttaataatcaaaagttgtataatctaagtttgggattaccaccctattgagtattgagtgat

SEQ ID NO: 1334 - protein, 1282 aa, Arabidopsis thaliana
  misc_feature: PFam Name: REF; PFam Description: Rubber elongation factor
  misc_feature: GI Number: 7596762; NR Description: stress related protein, putative [Arabidopsis thaliana] >gi|21537353|gb|AAM61694.1| stress related protein, putative [Arabidopsis thaliana] >gi|17380640|gb|AAL36083.1| AT3g05500/F22F7_5 [Arabidopsis
  misc_feature: GI Number: 5802955; NR Description: stress related protein [Vitis riparia] >gi|15214303|sp|Q9SW70|SRP_VITRI Stress-related
  misc_feature: GI Number: 29367349; NR Description: stress-related
  misc_feature: GI Number: 37622210; NR Description: small rubber particle
  misc_feature: GI Number: 33332330; NR Description: rubber synthesis protein
ATCACCATTGCTTTGTTTTGTTCGTCAAATATAATCAATTTTAAATTTCTTCTCTTCTCTTCAAACGAATCGCCTTTTTCGATAATCTCTTTGCATCGATTTCATCATGGCTACTCAAACGGATCTCGCTCAGCCCAAGCTTGATATGACCAAGGAGGAGAAAGAGAGGTTGAAGTATTTGCAATTCGTGCAAGCTGCTGCTGTGGAAGCTCTGCTTCGCTTTGCTCTTATTTACGCTAAGGCAAAGGACAAGTCTGGTCCTTTGAAACCTGGTGTTGAATCTGTTGAAGGAGCTGTCAAGACTGTCGTTGGTCCTGTCTACGAGAAATACCACGACGTCCCTGTTGAGGTCCTTAAATACATGGACCAGAAGGTACAATTTTGACTCTTTCCCTATCTTTGGATCTTGCTGAAAGTGCCTTTGTTGATGAACAATGAATGAATCTGTGTTGTTGATTGTATATCCACTTCATCGAACATATGTGATTAAAAAAGTACAGTTAAAGTTGTGATGATTTCATATCATCTCTTTGGTAGAAGGTTCAGGTTAACGGGTCAATGTCATTATGTTCTGTAGAGTCCCTCTTTTTGAAGCTGACAAGTTTGTTTTGCGTTGTTGCAGGTTGATATGTCTGTGACTGAGCTTGACCGTCGTGTCCCACCAGTCGTCAAGCAAGTGTCTGCCCAAGCCATCTCCGCTGCTCAGATAGCACCCATTGTGGCACGTGCGTTGGCCTCTGAGGTTCGACGTGCTGGTGTTGTTGAAACCGCTTCTGGAATGGCTAAATCCGTCTACTCCAAGTACGAGCCTGCTGCTAAGGAGTTGTATGCAAACTATGAGCCAAAAGCAAAGCAGTGTGCCGTTTCAGCTTGGAAGAAGCTTAACCAGCTTCCTCTATTCCCAAGGCTGGGCTCAAGTTGCTGTACCAACAGCTGCTTTCTGCTCTGAGAAGTACAATGATACTGTGGTTAAGGCTGCAGAGAAAGGGTACAGAGTCACATCGTACATGCCATTGGTTCCAACAGAGAGGATCTCAAAAATCTTCGCTGAGGAGAAAGCTGAGACCGAGCCTTTGGAGTTCCATCCACTTGATTGATATGGGTGTTTTGTTAGTGTGATTTTTTGTTTTGTTGGGATTAAGGTGAACCGGATCTTGGTTAGCGATTGATCTCTGGTTCTCGTTCTTTTTTTTCTTTGTCATGAACTTTTGTTGTTTCGTTTAATAATCAAAAGTTGTATAATCTAAGTTTGGGATTACCACCCTATTGAGTATTGAGTGAT

SEQ ID NO: 1335 - DNA, 1332 bp, Arabidopsis thaliana
  misc_feature (1)..(1332): Ceres cDNA ID no. 12488506
  misc_feature (1)..(1332): Ceres CLONE  ID no. 39854
  misc_feature (1)..(1332): Also known as  Ceres CDNA ID no. 23431468
attcacaataaaccagcgtcggcccaccgcatcccaaaccataacgcttaatccttaaaaaccgtccagatccatttccttcctctacaactcatcacacacacttctaatggcttcttcttcttgtttgaatctcttcttcttctcttttctctccgctctaatcatttctaaatctcagatctctgattccgttaacggggtcgttttccctgttgttaaagaccttccaaccggtcaatacctcgcacagattcgactcggtgactcaccggatccagtcaagctcgtagtcgatctggccggctcaattctctggtttgattgttcctcaagacatgtttcctcgtcaaggaacctaatatccggtagctctagcggctgcttaaaggcaaaagttggaaatgaacgagtatcatcatcatcatcatcgcgtaaagaccaaaacgccgattgcgaattacttgttaaaaacgacgcctttgggattacggcgagaggagagcttttcagtgacgtcatgtcggttggctctgttacttctccgggaaccgttgatctacttttcgcttgtactccaccgtggctgttacgtgggctcgctagtggagcccaaggagtaatgggcttaggaagggcccaaatctcactcccttcacaactcgccgcggaaactaacgaacgtcgtcggttaactgtttacctgtcgccgttgaacggtgtcgtatcaacgagttcggtggaggaggtttttggagtggctgcgtctagatcgctggtttacacgcctttgttaaccggttcgagtggcaactacgtaattaacgtgaaatcgattagagtcaacggggaaaagctctccgtggaaggtccgttggcggtggagctgagcacggtggttccttacacgattttagagagctcgatctacaaggtgttcgcggaagcttacgccaaagctgcgggtgaagctacatcggtgcctcctgtcgcaccgtttgggctctgcttcactagtgacgtagattttccggcggtagatctagcgttgcagagtgagatggtgcggtggaggattcatgggaagaatctgatggtggatgttggtggtggagtccgatgctcggggattgttgacggcgggtcaagtcgagtcaacccgattgtaatgggtgggctacaattagaaggctttatattggactttgatttgggtaactcaatgatgggctttggacaaagaacacgctctgattcaacttcgttgtaatacagaaacctttgtaattgtaaccttctaattatctggtagatatcctcaattttgatccc

SEQ ID NO: 1336 - protein, 1332 aa, Arabidopsis thaliana
  misc_feature: PFam Name: Asp; PFam Description: Eukaryotic aspartyl protease
  misc_feature: GI Number: 27372527; NR Description: xyloglucan-specific fungal endoglucanase inhibitor protein precursor [Lycopersicon
  misc_feature: GI Number: 32482806; NR Description: putative xyloglucanase
  misc_feature: GI Number: 21537233; NR Description: EDGP precursor
  misc_feature: GI Number: 11191819; NR Description: conglutin gamma [Lupinus
  misc_feature: GI Number: 11558383; NR Description: conglutin gamma [Lupinus
ATTCACAATAAACCAGCGTCGGCCCACCGCATCCCAAACCATAACGCTTAATCCTTAAAAACCGTCCAGATCCATTTCCTTCCTCTACAACTCATCACACACACTTCTAATGGCTTCTTCTTCTTGTTTGAATCTCTTCTTCTTCTCTTTTCTCTCCGCTCTAATCATTTCTAAATCTCAGATCTCTGATTCCGTTAACGGGGTCGTTTTCCCTGTTGTTAAAGACCTTCCAACCGGTCAATACCTCGCACAGATTCGACTCGGTGACTCACCGGATCCAGTCAAGCTCGTAGTCGATCTGGCCGGCTCAATTCTCTGGTTTGATTGTTCCTCAAGACATGTTTCCTCGTCAAGGAACCTAATATCCGGTAGCTCTAGCGGCTGCTTAAAGGCAAAAGTTGGAAATGAACGAGTATCATCATCATCATCATCGCGTAAAGACCAAAACGCCGATTGCGAATTACTTGTTAAAAACGACGCCTTTGGGATTACGGCGAGAGGAGAGCTTTTCAGTGACGTCATGTCGGTTGGCTCTGTTACTTCTCCGGGAACCGTTGATCTACTTTTCGCTTGTACTCCACCGTGGCTGTTACGTGGGCTCGCTAGTGGAGCCCAAGGAGTAATGGGCTTAGGAAGGGCCCAAATCTCACTCCCTTCACAACTCGCCGCGGAAACTAACGAACGTCGTCGGTTAACTGTTTACCTGTCGCCGTTGAACGGTGTCGTATCAACGAGTTCGGTGGAGGAGGTTTTTGGAGTGGCTGCGTCTAGATCGCTGGTTTACACGCCTTTGTTAACCGGTTCGAGTGGCAACTACGTAATTAACGTGAAATCGATTAGAGTCAACGGGGAAAAGCTCTCCGTGGAAGGTCCGTTGGCGGTGGAGCTGAGCACGGTGGTTCCTTACACGATTTTAGAGAGCTCGATCTACAAGGTGTTCGCGGAAGCTTACGCCAAAGCTGCGGGTGAAGCTACATCGGTGCCTCCTGTCGCACCGTTTGGGCTCTGCTTCACTAGTGACGTAGATTTTCCGGCGGTAGATCTAGCGTTGCAGAGTGAGATGGTGCGGTGGAGGATTCATGGGAAGAATCTGATGGTGGATGTTGGTGGTGGAGTCCGATGCTCGGGGATTGTTGACGGCGGGTCAAGTCGAGTCAACCCGATTGTAATGGGTGGGCTACAATTAGAAGGCTTTATATTGGACTTTGATTTGGGTAACTCAATGATGGGCTTTGGACAAAGAACACGCTCTGATTCAACTTCGTTGTAATACAGAAACCTTTGTAATTGTAACCTTCTAATTATCTGGTAGATATCCTCAATTTTGATCCC

SEQ ID NO: 1337 - DNA, 1401 bp, Arabidopsis thaliana
  misc_feature (1)..(1401): Ceres cDNA ID no. 12488861
  misc_feature (1)..(1401): Ceres CLONE  ID no. 1011070
  misc_feature (1)..(1401): Also known as  Ceres CDNA ID no. 23431771
aaactaccaaacctacagaaatctctcttcttcttcttctctacaaaatttcaatggaagctgttcttgtcgcaatgtccgtccccgccacaacggaagacgacggattttcgttaatcaccgataaactttcatataatctaacgccgacgtcggacgttgagatcgttacctccgataaccgtcggattccggcacactccggcgttctggcttcagcttcaccggtactgatgaacatcatgaagaaaccgatgagacgttacagaggctgtggatctaaaagagtcatcaagattcttggcgttccatgcgacgccgtttcggtttttatcaaattcctctactcttctagtttgacggaggatgagatggagagatatggaatccatcttttagcgttgtctcacgtctacatggtcacccagctgaagcaacggtgctcaaaaggcgttgtacaacgtttaactacagagaacgtagtcgacgtcctccagctagctcggctctgcgacgcacccgatgtttgccttcgatctatgcgtctgatccattcgcagtttaagaccgttgagcagactgaaggatggaagtttattcaagaacatgatcctttcctcgagctcgacattctccagttcatcgatgacgccgaatcgaggaagaaaagaaggcgacgacatagaaaggagcaggatctttacatgcaactaagcgaggcaatggagtgcatagagcacatatgcacacaaggttgtacattggtcggtccatcaaacgtagtagataacaacaaaaagtcaatgactgcggaaaagtcagagccttgtaaggcgttttccacgtgttatggtcttcagcttttgatacgtcactttgccgtatgcaagaggaggaataacgataagggttgtcttcgttgcaagcggatgcttcaactctttagactccattctttgatttgtgatcaacccgattcttgtcgcgtccctctctgcaggcaatttaggaaacggggagaacaagacaagaaaatgggtgaagacaccaagtggaagcttctggtgacaagggttgtgtctgcaaaagctatgacgtcgttgtgtcagtcaaagaagaacaaatgtgaacaagcacaaggggtttaatcaaaaccaggaaggagttagttaggtttgaagaagattaagtaagaagctttcttataatttgatatccattctttttgtagtataatagtatttgttagttcgattctttattagaggggtttagtttgtataggagtaaacccttttaaattggctgtataagtaggtcatattcaattgttttgttctatttatctgaaaaatgtcagcatgtaatacaaaacaaataaatgttcaaattaaagggagg

SEQ ID NO: 1338 - protein, 1401 aa, Arabidopsis thaliana
  misc_feature: PFam Name: BTB; PFam Description: BTB/POZ domain
  misc_feature: PFam Name: zf-TAZ; PFam Description: TAZ zinc finger
  misc_feature: GI Number: 50902306; NR Description: P0497A05.15 [Oryza sativa (japonica cultivar-group)] >gi|20804890|dbj|BAB92571.1| P0497A05.15 [Oryza sativa (japonica cultivar-group)] >gi|20804925|dbj|BAB92604.1| P0456E05.3 [Oryza sativa (japonica
  misc_feature: GI Number: 57899800; NR Description: putative BTB and TAZ
  misc_feature: GI Number: 42561724; NR Description: TAZ zinc finger family
  misc_feature: GI Number: 42573822; NR Description: TAZ zinc finger family
  misc_feature: GI Number: 36955924; NR Description: BTB and TAZ domain protein 5 [Arabidopsis thaliana] >gi|18420081|ref|NP_568031.1| TAZ zinc finger family protein / BTB/POZ domain-containing protein
AAACTACCAAACCTACAGAAATCTCTCTTCTTCTTCTTCTCTACAAAATTTCAATGGAAGCTGTTCTTGTCGCAATGTCCGTCCCCGCCACAACGGAAGACGACGGATTTTCGTTAATCACCGATAAACTTTCATATAATCTAACGCCGACGTCGGACGTTGAGATCGTTACCTCCGATAACCGTCGGATTCCGGCACACTCCGGCGTTCTGGCTTCAGCTTCACCGGTACTGATGAACATCATGAAGAAACCGATGAGACGTTACAGAGGCTGTGGATCTAAAAGAGTCATCAAGATTCTTGGCGTTCCATGCGACGCCGTTTCGGTTTTTATCAAATTCCTCTACTCTTCTAGTTTGACGGAGGATGAGATGGAGAGATATGGAATCCATCTTTTAGCGTTGTCTCACGTCTACATGGTCACCCAGCTGAAGCAACGGTGCTCAAAAGGCGTTGTACAACGTTTAACTACAGAGAACGTAGTCGACGTCCTCCAGCTAGCTCGGCTCTGCGACGCACCCGATGTTTGCCTTCGATCTATGCGTCTGATCCATTCGCAGTTTAAGACCGTTGAGCAGACTGAAGGATGGAAGTTTATTCAAGAACATGATCCTTTCCTCGAGCTCGACATTCTCCAGTTCATCGATGACGCCGAATCGAGGAAGAAAAGAAGGCGACGACATAGAAAGGAGCAGGATCTTTACATGCAACTAAGCGAGGCAATGGAGTGCATAGAGCACATATGCACACAAGGTTGTACATTGGTCGGTCCATCAAACGTAGTAGATAACAACAAAAAGTCAATGACTGCGGAAAAGTCAGAGCCTTGTAAGGCGTTTTCCACGTGTTATGGTCTTCAGCTTTTGATACGTCACTTTGCCGTATGCAAGAGGAGGAATAACGATAAGGGTTGTCTTCGTTGCAAGCGGATGCTTCAACTCTTTAGACTCCATTCTTTGATTTGTGATCAACCCGATTCTTGTCGCGTCCCTCTCTGCAGGCAATTTAGGAAACGGGGAGAACAAGACAAGAAAATGGGTGAAGACACCAAGTGGAAGCTTCTGGTGACAAGGGTTGTGTCTGCAAAAGCTATGACGTCGTTGTGTCAGTCAAAGAAGAACAAATGTGAACAAGCACAAGGGGTTTAATCAAAACCAGGAAGGAGTTAGTTAGGTTTGAAGAAGATTAAGTAAGAAGCTTTCTTATAATTTGATATCCATTCTTTTTGTAGTATAATAGTATTTGTTAGTTCGATTCTTTATTAGAGGGGTTTAGTTTGTATAGGAGTAAACCCTTTTAAATTGGCTGTATAAGTAGGTCATATTCAATTGTTTTGTTCTATTTATCTGAAAAATGTCAGCATGTAATACAAAACAAATAAATGTTCAAATTAAAGGGAGG

SEQ ID NO: 1339 - DNA, 1641 bp, Arabidopsis thaliana
  misc_feature (1)..(1641): Ceres cDNA ID no. 12489203
  misc_feature (1)..(1641): Ceres CLONE  ID no. 1002421
  misc_feature (1)..(1641): Also known as  Ceres CDNA ID no. 23432074
atgaggagctttatatatttagcataatatctttcagaagtgtgaggccttgttaattaagctcttcttctctatctctctctctccctctcaacctctcaccatggtagctcaagctcctcatgatgatcatcaggatgatgagaaattagcagcagcgagacaaaaagagatcgaagattggttaccaattacttcatcaagaaatgcaaagtggtggtactctgcttttcacaatgtcaccgccatggtcggtgccggagttcttggactcccttacgccatgtctcagctcggatggggaccgggaattgcagtgttggttttgtcatgggtcataacactatacacattatggcaaatggtggaaatgcatgaaatggttcctggaaagcgttttgatcgttaccatgagctcggacaacacgcgtttggagaaaaactcggtctttatatcgttgtgccgcaacaattgatcgttgaaatcggtgtttgcatcgtttatatggtcactggaggcaaatctttaaagaaatttcatgagcttgtttgtgatgattgtaaaccaatcaagcttacttatttcatcatgatctttgcttcggttcacttcgtcctctctcatcttcctaatttcaattccatctccggcgtttctcttgctgctgccgttatgtctctcagctactcaacaatcgcatgggcatcatcagcaagcaaaggtgttcaagaagacgttcaatacggttacaaagcgaaaacaacagccggtacggttttcaatttcttcagcggtttaggtgatgtggcatttgcttacgcgggtcataatgtggtccttgagatccaagcaactatcccttcaacgcctgagaaaccctcaaaaggtcccatgtggagaggagtcatcgttgcttacatcgtcgtagcgctctgttatttccccgtggctctcgttggatactacattttcgggaacggagtcgaagataatattctcatgtcacttaagaaaccggcgtggttaatcgccacggcgaacatcttcgtcgtgatccatgtcattggtagttaccagatatatgcaatgccggtatttgatatgatggagactttattggtcaagaagctaaatttcagaccaaccacaactcttcggttctttgtccgtaatttctacgttgctgcaactatgtttgttggtatgacgtttccgttcttcggtgggcttttggcgttctttggtggattcgcgtttgccccaaccacatacttcctcccttgcgtcatttggttagccatctacaaacccaagaaatacagcttgtcttggtgggccaactgggtatgcatcgtgtttggtcttttcttgatggtcctatcgccaattggagggctaaggacaatcgttattcaagcaaaaggatacaagttttactcataaacgctatgtaattccactaattaagaaacatatctttatattaatatatgtgtgaagaagtttttaagagatcaacacgagacatttatagaagaatcaatggtctggtctgaatctaaatgtagcttttagggtttgtattttcgtgtgtgttatatatattatataaaacaataatattttgctcaaaaaaattt

SEQ ID NO: 1340 - protein, 1641 aa, Arabidopsis thaliana
  misc_feature: PFam Name: Aa_trans; PFam Description: Transmembrane amino
  misc_feature: PFam Name: Trp_Tyr_perm; PFam Description:
  misc_feature: GI Number: 22137070; NR Description: At5g40780/K1B16_3 [Arabidopsis thaliana] >gi|14194151|gb|AAK56270.1| AT5g40780/K1B16_3 [Arabidopsis thaliana] >gi|30693663|ref|NP_851109.1| lysine and histidine specific
  misc_feature: GI Number: 1906549; NR Description: amino acid permease [Nicotiana sylvestris] >gi|976402|gb|AAB48944.1| amino acid permease 1 >gi|7489096|pir||T15052 amino acid permease 1 - wood
  misc_feature: GI Number: 9293860; NR Description: amino acid transporter-like protein 2 [Arabidopsis thaliana] >gi|18395471|ref|NP_564217.1| lysine and histidine specific transporter, putative [Arabidopsis thaliana]
  misc_feature: GI Number: 30409136; NR Description: histidine amino acid
  misc_feature: GI Number: 2576361; NR Description: lysine and histidine
ATGAGGAGCTTTATATATTTAGCATAATATCTTTCAGAAGTGTGAGGCCTTGTTAATTAAGCTCTTCTTCTCTATCTCTCTCTCTCCCTCTCAACCTCTCACCATGGTAGCTCAAGCTCCTCATGATGATCATCAGGATGATGAGAAATTAGCAGCAGCGAGACAAAAAGAGATCGAAGATTGGTTACCAATTACTTCATCAAGAAATGCAAAGTGGTGGTACTCTGCTTTTCACAATGTCACCGCCATGGTCGGTGCCGGAGTTCTTGGACTCCCTTACGCCATGTCTCAGCTCGGATGGGGACCGGGAATTGCAGTGTTGGTTTTGTCATGGGTCATAACACTATACACATTATGGCAAATGGTGGAAATGCATGAAATGGTTCCTGGAAAGCGTTTTGATCGTTACCATGAGCTCGGACAACACGCGTTTGGAGAAAAACTCGGTCTTTATATCGTTGTGCCGCAACAATTGATCGTTGAAATCGGTGTTTGCATCGTTTATATGGTCACTGGAGGCAAATCTTTAAAGAAATTTCATGAGCTTGTTTGTGATGATTGTAAACCAATCAAGCTTACTTATTTCATCATGATCTTTGCTTCGGTTCACTTCGTCCTCTCTCATCTTCCTAATTTCAATTCCATCTCCGGCGTTTCTCTTGCTGCTGCCGTTATGTCTCTCAGCTACTCAACAATCGCATGGGCATCATCAGCAAGCAAAGGTGTTCAAGAAGACGTTCAATACGGTTACAAAGCGAAAACAACAGCCGGTACGGTTTTCAATTTCTTCAGCGGTTTAGGTGATGTGGCATTTGCTTACGCGGGTCATAATGTGGTCCTTGAGATCCAAGCAACTATCCCTTCAACGCCTGAGAAACCCTCAAAAGGTCCCATGTGGAGAGGAGTCATCGTTGCTTACATCGTCGTAGCGCTCTGTTATTTCCCCGTGGCTCTCGTTGGATACTACATTTTCGGGAACGGAGTCGAAGATAATATTCTCATGTCACTTAAGAAACCGGCGTGGTTAATCGCCACGGCGAACATCTTCGTCGTGATCCATGTCATTGGTAGTTACCAGATATATGCAATGCCGGTATTTGATATGATGGAGACTTTATTGGTCAAGAAGCTAAATTTCAGACCAACCACAACTCTTCGGTTCTTTGTCCGTAATTTCTACGTTGCTGCAACTATGTTTGTTGGTATGACGTTTCCGTTCTTCGGTGGGCTTTTGGCGTTCTTTGGTGGATTCGCGTTTGCCCCAACCACATACTTCCTCCCTTGCGTCATTTGGTTAGCCATCTACAAACCCAAGAAATACAGCTTGTCTTGGTGGGCCAACTGGGTATGCATCGTGTTTGGTCTTTTCTTGATGGTCCTATCGCCAATTGGAGGGCTAAGGACAATCGTTATTCAAGCAAAAGGATACAAGTTTTACTCATAAACGCTATGTAATTCCACTAATTAAGAAACATATCTTTATATTAATATATGTGTGAAGAAGTTTTTAAGAGATCAACACGAGACATTTATAGAAGAATCAATGGTCTGGTCTGAATCTAAATGTAGCTTTTAGGGTTTGTATTTTCGTGTGTGTTATATATATTATATAAAACAATAATATTTTGCTCAAAAAAATTT

SEQ ID NO: 1341 - DNA, 466 bp, Zea mays
  misc_feature (1)..(466): Ceres cDNA ID no. 12544993
  misc_feature (1)..(466): Ceres CLONE  ID no. 278780
  misc_feature (1)..(466): Also known as  Ceres CDNA ID no. 23757995
  misc_feature (115)..(115): n is a, c, t, g, unknown, or other
agagagagagagagagagggaggtgcagagagaggcgcgtgggctgtgggcacacacatggcgagtgaggaggtcgccacagtgtgtgccgacgccgaccaagaagcagckgcgncggcggcggcggcggcggccatgaaggaggaaggaggaaggggcaagatggcggaggaggaggcagccgaggaagggagasgaggaaggcgggaggaagaagtacgcgctggtgagctaccacgagctgcccgagtacatgaaggagaacgagttcatcctcaactactaccgctccgagtggcccgtcctcaacgccgtgctcagcctcttctcctggcacaacgagaccatcaacgtctggacgcacctgctcgggttcatgctcttcttcggcctcaccctggtgcacctcggccagtacttcccccaggtgtctgatctgattgggcatctctcctggccaatctcg

SEQ ID NO: 1342 - protein, 466 aa, Zea mays
  misc_feature: PFam Name: HlyIII; PFam Description: Haemolysin-III related
  misc_feature: PFam Name: Mucin; PFam Description: Mucin-like glycoprotein
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 48095650; NR Description: similar to CG7530-PA
  misc_feature: GI Number: 49257882; NR Description: Unknown (protein for
  misc_feature: GI Number: 28976160; NR Description: progestin and adipoQ receptor family member III [Homo sapiens] >gi|28703706|gb|AAH47510.1| Progestin and adipoQ receptor family
  misc_feature: GI Number: 45708699; NR Description: PAQR3 protein [Homo sapiens]
AGAGAGAGAGAGAGAGAGGGAGGTGCAGAGAGAGGCGCGTGGGCTGTGGGCACACACATGGCGAGTGAGGAGGTCGCCACAGTGTGTGCCGACGCCGACCAAGAAGCAGCKGCGNCGGCGGCGGCGGCGGCGGCCATGAAGGAGGAAGGAGGAAGGGGCAAGATGGCGGAGGAGGAGGCAGCCGAGGAAGGGAGASGAGGAAGGCGGGAGGAAGAAGTACGCGCTGGTGAGCTACCACGAGCTGCCCGAGTACATGAAGGAGAACGAGTTCATCCTCAACTACTACCGCTCCGAGTGGCCCGTCCTCAACGCCGTGCTCAGCCTCTTCTCCTGGCACAACGAGACCATCAACGTCTGGACGCACCTGCTCGGGTTCATGCTCTTCTTCGGCCTCACCCTGGTGCACCTCGGCCAGTACTTCCCCCAGGTGTCTGATCTGATTGGGCATCTCTCCTGGCCAATCTCG

SEQ ID NO: 1343 - DNA, 1472 bp, Zea mays
  misc_feature (1)..(1472): Ceres cDNA ID no. 12554648
  misc_feature (1)..(1472): Ceres CLONE  ID no. 238838
  misc_feature (1)..(1472): Also known as  Ceres CDNA ID no. 23782352
aggatgaatcggaagagagaatcctaccaaacctagctaccaactcgatcgtcgtcatcacgctcgaccgcacaactgcaccgaggggggaggagacctaaaaactactacatcttttagctacacatctagctaaagatcgagaggggtaaataaggacgagcgggcgcgagctagaagagcagctgcaggtactaccatcatcgtcgtcgtcgtcgccaggatgaccgttgtcgacgccgtctcctccaccgatgccggcgccgccgccgccacggtaccggcggggaacgggcagaccgtgtgcgtcaccggcgcggccgggtacatcgcctcgtggttagtgaagctgctgctcgagaagggatacactgtgaagggcaccgtgaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctattccccgagtaccccgtcccagccaggtgctccgacgaggtgaatccgcgaaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccacggccgagatgcagcagggagggatcgccatccgtgcctgagagggcgatgccacacatgaacacaaagcaatgttcatactgctgccctgcacctgcaccttcccctgctgtgtaaacaggcctgtgtttgttctggctgatagtgatgtaccctaagacttgtaacgtcatgttcgttcttgtg

SEQ ID NO: 1344 - protein, 1472 aa, Zea mays
  misc_feature: PFam Name: Epimerase; PFam Description: NAD dependent
  misc_feature: PFam Name: 3Beta_HSD; PFam Description: 3-beta
  misc_feature: PFam Name: FH2; PFam Description: Formin Homology 2 Domain
  misc_feature: PFam Name: Transferase; PFam Description: Transferase family
  misc_feature: PFam Name: Peptidase_S8; PFam Description: Subtilase family
  misc_feature: GI Number: 25140432; NR Description: cinnamoyl CoA reductase
  misc_feature: GI Number: 9964087; NR Description: cinnamoyl CoA reductase
  misc_feature: GI Number: 40233135; NR Description: cinnamoyl CoA reductase
  misc_feature: GI Number: 2239260; NR Description: cinnamoyl CoA reductase
  misc_feature: GI Number: 17978551; NR Description: cinnamoyl-CoA reductase [Lolium perenne] >gi|17978549|gb|AAL47182.1| cinnamoyl-CoA
AGGATGAATCGGAAGAGAGAATCCTACCAAACCTAGCTACCAACTCGATCGTCGTCATCACGCTCGACCGCACAACTGCACCGAGGGGGGAGGAGACCTAAAAACTACTACATCTTTTAGCTACACATCTAGCTAAAGATCGAGAGGGGTAAATAAGGACGAGCGGGCGCGAGCTAGAAGAGCAGCTGCAGGTACTACCATCATCGTCGTCGTCGTCGCCAGGATGACCGTTGTCGACGCCGTCTCCTCCACCGATGCCGGCGCCGCCGCCGCCACGGTACCGGCGGGGAACGGGCAGACCGTGTGCGTCACCGGCGCGGCCGGGTACATCGCCTCGTGGTTAGTGAAGCTGCTGCTCGAGAAGGGATACACTGTGAAGGGCACCGTGAGGAACCCAGATGACCCGAAGAACGCGCACCTCAAGGCGCTGGACGGCGCCGCCGAGCGGCTGATCCTCTGCAAGGCCGATCTGCTGGACTACGACGCCATCTGCCGCGCCGTGCAGGGCTGCCAGGGCGTCTTCCACACCGCCTCCCCCGTCACCGACGACCCGGAGCAAATGGTGGAGCCGGCGGTGCGCGGCACCGAGTACGTGATCAACGCGGCGGCGGAGGCCGGCACGGTGCGGCGGGTGGTGTTCACGTCGTCCATCGGCGCCGTGACCATGGACCCCAAGCGCGGGCCCGACGTCGTGGTCGACGAGTCGTGCTGGAGCGACCTCGAGTTCTGCGAGAAAACCAGGAACTGGTACTGCTACGGCAAGGCGGTGGCGGAGCAGGCGGCGTGGGAGACGGCCCGGCGGCGGGGCGTGGACCTGGTGGTGGTGAACCCCGTGCTGGTGGTGGGCCCCCTGCTGCAGGCGACGGTGAACGCCAGCATCGCGCACATCCTCAAGTACCTGGACGGCTCGGCCCGCACCTTCGCCAACGCCGTGCAGGCGTACGTGGACGTGCGCGACGTGGCCGACGCGCACCTCCGCGTCTTCGAGAGCCCCCGCGCGTCCGGCCGCCACCTCTGCGCCGAGCGCGTCCTCCACCGCGAGGACGTCGTCCGCATCCTCGCCAAGCTATTCCCCGAGTACCCCGTCCCAGCCAGGTGCTCCGACGAGGTGAATCCGCGAAAGCAGCCGTACAAGTTCTCCAACCAGAAGCTCCGGGACCTGGGGCTGCAGTTCCGGCCGGTCAGCCAGTCGCTTTACGACACGGTGAAGAACCTCCAGGAGAAGGGACACCTGCCGGTGCTCGGAGAGCGGACGACGACGGAGGCCGCCGACAAGGATGCCCCCACGGCCGAGATGCAGCAGGGAGGGATCGCCATCCGTGCCTGAGAGGGCGATGCCACACATGAACACAAAGCAATGTTCATACTGCTGCCCTGCACCTGCACCTTCCCCTGCTGTGTAAACAGGCCTGTGTTTGTTCTGGCTGATAGTGATGTACCCTAAGACTTGTAACGTCATGTTCGTTCTTGTG

SEQ ID NO: 1345 - DNA, 1880 bp, Arabidopsis thaliana
  misc_feature (1)..(1880): Ceres cDNA ID no. 12559206
  misc_feature (1)..(1880): Ceres CLONE  ID no. 1340340
  misc_feature (1)..(1880): Also known as  Ceres CDNA ID no. 12559206
gcactctatatatctctccatccctacttgccctcatttcaccaaaatcctcctaattcaccaattttagaattcccattctcattttctctctctttctatttctccaaatttgcctaaagattttacattttatcttcaatccttccttgatttacgtttgaaatatttcgacccaaaactatactgatggagagaacaaacagcattgagatggatcgagagagattaacggcggagatggcgtttcgagattcatcatcggccgttataagaattcgaagacgtttgccggatttattaacgtccgttaagctcaaatacgtgaagcttggacttcacaactcttgcaacgtgaccaccattctcttcttcttaattattcttcctttaaccggaaccgtgctggttcagctaaccggtctaacgttcgatacgttctctgagctttggtctaaccaggcggttcaactcgacacggcgacgagacttacctgcttggttttcctctccttcgttttgaccctctacgtggctaaccggtctaaaccggtttacctagtggatttctcctgctacaaaccggaagacgagcgtaaaatatcagtagattcgttcttgacgatgactgaggaaaatggatcattcaccgatgacacggttcagttccagcaaagaatctcgaaccgggccggtttgggagacgagacgtatctgccacgtggcataacttcaacgcccccgaagctaaatatgtcagaggcacgtgccgaagctgaagccgttatgtttggagccttagattccctcttcgagaaaaccggaattaaaccggccgaagtcggaatcttgatagtaaactgcagcttattcaatccgacgccgtctctatcagcgatgatcgtgaaccattacaagatgagagaagacatcaaaagttacaacctcggaggaatgggttgctccgccggattaatctcaatcgatctcgctaacaatctcctcaaagcaaaccctaattcttacgctgtcgtggtaagcacggaaaacataaccctaaactggtacttcggaaatgaccggtcaatgctcctctgcaactgcatcttccgaatgggcggagctgcgattctcctctctaaccgccgtcaagaccggaagaagtcaaagtactcgctggtcaacgtcgttcgaacacataaaggatcagacgacaagaactacaattgcgtgtaccagaaggaagacgagagaggaacaatcggtgtctctttagctagagagctcatgtctgtcgccggagacgctctgaaaacaaacatcacgactttaggaccgatggttcttccattgtcagagcagttgatgttcttgatttccttggtcaaaaggaagatgttcaagttaaaagttaaaccgtatattccggatttcaagctagctttcgagcatttctgtattcacgcaggaggtagagcggttctagacgaagtgcagaagaatcttgatctcaaagattggcacatggaaccttctagaatgactttgcacagatttggtaacacttcgagtagctcgctttggtatgagatggcttataccgaagctaagggtcgggttaaagctggtgaccgactttggcagattgcgtttggatcgggtttcaagtgtaatagtgcggtttggaaagcgttacgaccggtttcgacggaggagatgaccggtaatgcttgggctggttcgattgatcaatatccggttaaagttgtgcaatgattggttgaaccggataatcatatatgtaattgtgttcttcttgattttattttttaattgttgatgtaagttgtcgattgaaaatcatataatttaattaattt

SEQ ID NO: 1346 - protein, 1880 aa, Arabidopsis thaliana
GCACTCTATATATCTCTCCATCCCTACTTGCCCTCATTTCACCAAAATCCTCCTAATTCACCAATTTTAGAATTCCCATTCTCATTTTCTCTCTCTTTCTATTTCTCCAAATTTGCCTAAAGATTTTACATTTTATCTTCAATCCTTCCTTGATTTACGTTTGAAATATTTCGACCCAAAACTATACTGATGGAGAGAACAAACAGCATTGAGATGGATCGAGAGAGATTAACGGCGGAGATGGCGTTTCGAGATTCATCATCGGCCGTTATAAGAATTCGAAGACGTTTGCCGGATTTATTAACGTCCGTTAAGCTCAAATACGTGAAGCTTGGACTTCACAACTCTTGCAACGTGACCACCATTCTCTTCTTCTTAATTATTCTTCCTTTAACCGGAACCGTGCTGGTTCAGCTAACCGGTCTAACGTTCGATACGTTCTCTGAGCTTTGGTCTAACCAGGCGGTTCAACTCGACACGGCGACGAGACTTACCTGCTTGGTTTTCCTCTCCTTCGTTTTGACCCTCTACGTGGCTAACCGGTCTAAACCGGTTTACCTAGTGGATTTCTCCTGCTACAAACCGGAAGACGAGCGTAAAATATCAGTAGATTCGTTCTTGACGATGACTGAGGAAAATGGATCATTCACCGATGACACGGTTCAGTTCCAGCAAAGAATCTCGAACCGGGCCGGTTTGGGAGACGAGACGTATCTGCCACGTGGCATAACTTCAACGCCCCCGAAGCTAAATATGTCAGAGGCACGTGCCGAAGCTGAAGCCGTTATGTTTGGAGCCTTAGATTCCCTCTTCGAGAAAACCGGAATTAAACCGGCCGAAGTCGGAATCTTGATAGTAAACTGCAGCTTATTCAATCCGACGCCGTCTCTATCAGCGATGATCGTGAACCATTACAAGATGAGAGAAGACATCAAAAGTTACAACCTCGGAGGAATGGGTTGCTCCGCCGGATTAATCTCAATCGATCTCGCTAACAATCTCCTCAAAGCAAACCCTAATTCTTACGCTGTCGTGGTAAGCACGGAAAACATAACCCTAAACTGGTACTTCGGAAATGACCGGTCAATGCTCCTCTGCAACTGCATCTTCCGAATGGGCGGAGCTGCGATTCTCCTCTCTAACCGCCGTCAAGACCGGAAGAAGTCAAAGTACTCGCTGGTCAACGTCGTTCGAACACATAAAGGATCAGACGACAAGAACTACAATTGCGTGTACCAGAAGGAAGACGAGAGAGGAACAATCGGTGTCTCTTTAGCTAGAGAGCTCATGTCTGTCGCCGGAGACGCTCTGAAAACAAACATCACGACTTTAGGACCGATGGTTCTTCCATTGTCAGAGCAGTTGATGTTCTTGATTTCCTTGGTCAAAAGGAAGATGTTCAAGTTAAAAGTTAAACCGTATATTCCGGATTTCAAGCTAGCTTTCGAGCATTTCTGTATTCACGCAGGAGGTAGAGCGGTTCTAGACGAAGTGCAGAAGAATCTTGATCTCAAAGATTGGCACATGGAACCTTCTAGAATGACTTTGCACAGATTTGGTAACACTTCGAGTAGCTCGCTTTGGTATGAGATGGCTTATACCGAAGCTAAGGGTCGGGTTAAAGCTGGTGACCGACTTTGGCAGATTGCGTTTGGATCGGGTTTCAAGTGTAATAGTGCGGTTTGGAAAGCGTTACGACCGGTTTCGACGGAGGAGATGACCGGTAATGCTTGGGCTGGTTCGATTGATCAATATCCGGTTAAAGTTGTGCAATGATTGGTTGAACCGGATAATCATATATGTAATTGTGTTCTTCTTGATTTTATTTTTTAATTGTTGATGTAAGTTGTCGATTGAAAATCATATAATTTAATTAATTT

SEQ ID NO: 1347 - DNA, 1840 bp, Arabidopsis thaliana
  misc_feature (1)..(1840): Ceres cDNA ID no. 12559772
  misc_feature (1)..(1840): Ceres CLONE  ID no. 1139916
  misc_feature (1)..(1840): Also known as  Ceres CDNA ID no. 23447741
aacattttagggttttacgaaaaaaaaaccttcaccgtctctgctccgcgacgccgccttcgctttctcaaactccgatataatccttctcagagatatgtcagtaatggatgaatcaggcatgtttaacgttcaacaaaccattggaagtgtattgtgttgcaagtgtggtgttcccatggcaccaaacgcagccaacatgtgtgtgaattgtcttcgttccgaagtcgatatcaccgaaggtttacagaagagtattcagatcttctattgccctgaatgcacttgttacttacagccaccaaagacttggatcaaatgtcaatgggaatctaaagagcttttgacattttgtatcaagaggttgaagaatctcaataaggttaagctgaagaacgctgaattcgtttggactgagcctcattccaagaggattaaggttaagttgactgttcaagctgaggttcttaatggtgctgttcttgaacagtcttatcctgttgagtatacggttagggataatctgtgcgagtcgtgttcgaggtttcaggctaatcctgatcagtgggttgcttctattcagcttaggcagcatgtttcgcataggaggactttcttttatctcgaacagttgattcttaggcacgatgctgcttcacgtgccattagaatccagcaggtggatcaggggattgatttcttctttgggaataaaagtcatgctaatagctttgtggagtttctgaggaaagttgtccccattgaataccgtcaggaccaacagctggtgtctcatgatgtgaaaagcagtttgtacaactataagtacacttactctgttaagatctgtcctgtttgccgtgaggatcttgtttgcttgccttctaaagttgctagcggcttggggaaccttggtccacttgtggtttgcacaaaagtctctgataatatcactctacttgatccgagaactctaaggtgtgccttcttggatgcgagacagtactggaggtctgggttccgatctgcgctcaccagtagacaacttgtcaagtactttgtgtttgatgttgagccacctgttggtgaagcgactgttggtgggcaaaagtacgctctttcctatgtccagattgcccgtgaatcagacattggtaagatgttttatgtccaaactcatcttggacacattctgaaacctggggatcaagctttgggttatgacatctacggagctaatgtgaacgacaatgaaatggagaaataccgtctgagtgtgaagaatgggcttcctgaagcaattctgatcaagaaatgttacgaggagcagagagagaggaagcagaagaaatcccgtaactggaaactcaagtcgcttccaatggaaatggatgattcaagaggcagggttgatccagagaagacagacaaagaatacgaagagtttttgagggatcttgaagaaaaccctgagctaaggttcaacatatctttgtacagggacaaggattatcaagcttctgagactgcttcaatgacagatggagaaggtgcaccatctgttccaattgaagagttgcttgctgaccttgacctaagctttgaggaagaagacgatgatgacgaggacgacatggctgctgaataacttcgtttctccgatactcaacaaggtttcagtttgatcccaaatcttttatttgcttctcttgtgtttctctcagtagacctttaatcttttgttgtccaagttttgttttgaatgtaagctcaacagtttctggtctagcttacgttgctatatgtgttgacattttctggctattatatttttgtttgg

SEQ ID NO: 1348 - protein, 1840 aa, Arabidopsis thaliana
  misc_feature: PFam Name: NMD3; PFam Description: NMD3 family
  misc_feature: GI Number: 15810403; NR Description: putative
  misc_feature: GI Number: 22136400; NR Description: putative nonsense-mediated mRNA decay protein [Arabidopsis thaliana] >gi|20466624|gb|AAM20629.1| putative nonsense-mediated mRNA decay protein [Arabidopsis thaliana] >gi|4582430|gb|AAD24816.1|
  misc_feature: GI Number: 49115525; NR Description: MGC80914 protein
  misc_feature: GI Number: 60649637; NR Description: Unknown (protein for MGC:113103) [Danio rerio] gi|61806709|ref|NP_001013587.1|
  misc_feature: GI Number: 4680653; NR Description: CGI-07 protein [Homo sapiens]
AACATTTTAGGGTTTTACGAAAAAAAAACCTTCACCGTCTCTGCTCCGCGACGCCGCCTTCGCTTTCTCAAACTCCGATATAATCCTTCTCAGAGATATGTCAGTAATGGATGAATCAGGCATGTTTAACGTTCAACAAACCATTGGAAGTGTATTGTGTTGCAAGTGTGGTGTTCCCATGGCACCAAACGCAGCCAACATGTGTGTGAATTGTCTTCGTTCCGAAGTCGATATCACCGAAGGTTTACAGAAGAGTATTCAGATCTTCTATTGCCCTGAATGCACTTGTTACTTACAGCCACCAAAGACTTGGATCAAATGTCAATGGGAATCTAAAGAGCTTTTGACATTTTGTATCAAGAGGTTGAAGAATCTCAATAAGGTTAAGCTGAAGAACGCTGAATTCGTTTGGACTGAGCCTCATTCCAAGAGGATTAAGGTTAAGTTGACTGTTCAAGCTGAGGTTCTTAATGGTGCTGTTCTTGAACAGTCTTATCCTGTTGAGTATACGGTTAGGGATAATCTGTGCGAGTCGTGTTCGAGGTTTCAGGCTAATCCTGATCAGTGGGTTGCTTCTATTCAGCTTAGGCAGCATGTTTCGCATAGGAGGACTTTCTTTTATCTCGAACAGTTGATTCTTAGGCACGATGCTGCTTCACGTGCCATTAGAATCCAGCAGGTGGATCAGGGGATTGATTTCTTCTTTGGGAATAAAAGTCATGCTAATAGCTTTGTGGAGTTTCTGAGGAAAGTTGTCCCCATTGAATACCGTCAGGACCAACAGCTGGTGTCTCATGATGTGAAAAGCAGTTTGTACAACTATAAGTACACTTACTCTGTTAAGATCTGTCCTGTTTGCCGTGAGGATCTTGTTTGCTTGCCTTCTAAAGTTGCTAGCGGCTTGGGGAACCTTGGTCCACTTGTGGTTTGCACAAAAGTCTCTGATAATATCACTCTACTTGATCCGAGAACTCTAAGGTGTGCCTTCTTGGATGCGAGACAGTACTGGAGGTCTGGGTTCCGATCTGCGCTCACCAGTAGACAACTTGTCAAGTACTTTGTGTTTGATGTTGAGCCACCTGTTGGTGAAGCGACTGTTGGTGGGCAAAAGTACGCTCTTTCCTATGTCCAGATTGCCCGTGAATCAGACATTGGTAAGATGTTTTATGTCCAAACTCATCTTGGACACATTCTGAAACCTGGGGATCAAGCTTTGGGTTATGACATCTACGGAGCTAATGTGAACGACAATGAAATGGAGAAATACCGTCTGAGTGTGAAGAATGGGCTTCCTGAAGCAATTCTGATCAAGAAATGTTACGAGGAGCAGAGAGAGAGGAAGCAGAAGAAATCCCGTAACTGGAAACTCAAGTCGCTTCCAATGGAAATGGATGATTCAAGAGGCAGGGTTGATCCAGAGAAGACAGACAAAGAATACGAAGAGTTTTTGAGGGATCTTGAAGAAAACCCTGAGCTAAGGTTCAACATATCTTTGTACAGGGACAAGGATTATCAAGCTTCTGAGACTGCTTCAATGACAGATGGAGAAGGTGCACCATCTGTTCCAATTGAAGAGTTGCTTGCTGACCTTGACCTAAGCTTTGAGGAAGAAGACGATGATGACGAGGACGACATGGCTGCTGAATAACTTCGTTTCTCCGATACTCAACAAGGTTTCAGTTTGATCCCAAATCTTTTATTTGCTTCTCTTGTGTTTCTCTCAGTAGACCTTTAATCTTTTGTTGTCCAAGTTTTGTTTTGAATGTAAGCTCAACAGTTTCTGGTCTAGCTTACGTTGCTATATGTGTTGACATTTTCTGGCTATTATATTTTTGTTTGG

SEQ ID NO: 1349 - DNA, 1459 bp, Arabidopsis thaliana
  misc_feature (1)..(1459): Ceres cDNA ID no. 12560499
  misc_feature (1)..(1459): Ceres CLONE  ID no. 1145122
  misc_feature (1)..(1459): Also known as  Ceres CDNA ID no. 23448258
tttttcttttaatctttttttttatggctgccttcagtagtaacctctgagcttgagggaaactcatgtccatggcgctaattgtccggccattctttgttcctggaagtgctggaatttctgggagtagaaacatatgcaagaaaaatcaatggaggaagtatcttctgaaacccagtggatcatccattaattgctcatttagtacagagaagaatcctctattaccatctatccagcagttagccgatgctcgtctcatatacagtgtatctgcagcattgggtcataacaaggaatcacatccagaatgcagcgctagagttcctgccattgttaatgctctcgagatgaatgagctcactcctaagttccgtggctcacagattcttgaactcgcaaatttcaagactgcaactgtagaagacattgcaaatgttcacgacaaggcttatgtctttggcctagaaaaggcaatggatgaggcttcagattcgggactaattttcattgaaggctctggaccaacatatgccacttcaacgacattccaagattcacttatcgcagcaggagccggaatggctttagttgattcagtgatcgcagcatccagaaacagcgtagatccacccattggttttgcattgataagacctcctgggcaccacgccgtgccaaaaggtccgatggggttctgtgtttttggtaatgtggcaatcgcagctcgtcatgcccaacgcacacatggtctgaagcgcatcttcataattgacttcgatgttcaccacgggaatggcacaaatgatgcatttactgaggaccctgatatattctttttgtcaactcatcaggacggaagctaccctggaacagggaaaatcagtgacataggtaaaggaaaaggtgaaggtaccactctaaatttacctttgcctggaggttcaggtgatattgcaatgagaaccgtttttgaagaaatcattgttccatgtgctcaacggttcaagccagatattattcttgtttctgctgggtatgatgctcatgtcctggatccactagcaaatttacagttcacgaccgcaacatactactcattggcaaaagatataaagcggttagcaaaagaagtatgcggagggcggtgtgtgtttttcttggaaggaggatacaatcttgaatcactttcatcatctgtggcagactcgtttcgagcattgcttggagaagatagcttggcatcagagtttgataacccagcttacttgtacgatgaaccaatgagaaaggtgcgagatgcaattcagagagccaaaagcattcattgcttataaggtgaatttgtttgagaagttctgcatcttagtcgtcttaaactgcctgcctacttatgttttcttttgtaaaaatatcattgtaaacattgttgattagaaaattaaagttatgtaaacag

SEQ ID NO: 1350 - protein, 1459 aa, Arabidopsis thaliana
  misc_feature: PFam Name: Hist_deacetyl; PFam Description: Histone
  misc_feature: GI Number: 21360523; NR Description: AT4g33470/F17M5_230 [Arabidopsis thaliana] >gi|15529220|gb|AAK97704.1| AT4g33470/F17M5_230 [Arabidopsis thaliana] >gi|18418220|ref|NP_567921.1| histone deacetylase family protein
  misc_feature: GI Number: 52352410; NR Description: acetoin utilization
  misc_feature: GI Number: 52550445; NR Description: acetoin utilization
  misc_feature: GI Number: 52548847; NR Description: acetoin utilization
  misc_feature: GI Number: 52549274; NR Description: acetoin utilization
TTTTTCTTTTAATCTTTTTTTTTATGGCTGCCTTCAGTAGTAACCTCTGAGCTTGAGGGAAACTCATGTCCATGGCGCTAATTGTCCGGCCATTCTTTGTTCCTGGAAGTGCTGGAATTTCTGGGAGTAGAAACATATGCAAGAAAAATCAATGGAGGAAGTATCTTCTGAAACCCAGTGGATCATCCATTAATTGCTCATTTAGTACAGAGAAGAATCCTCTATTACCATCTATCCAGCAGTTAGCCGATGCTCGTCTCATATACAGTGTATCTGCAGCATTGGGTCATAACAAGGAATCACATCCAGAATGCAGCGCTAGAGTTCCTGCCATTGTTAATGCTCTCGAGATGAATGAGCTCACTCCTAAGTTCCGTGGCTCACAGATTCTTGAACTCGCAAATTTCAAGACTGCAACTGTAGAAGACATTGCAAATGTTCACGACAAGGCTTATGTCTTTGGCCTAGAAAAGGCAATGGATGAGGCTTCAGATTCGGGACTAATTTTCATTGAAGGCTCTGGACCAACATATGCCACTTCAACGACATTCCAAGATTCACTTATCGCAGCAGGAGCCGGAATGGCTTTAGTTGATTCAGTGATCGCAGCATCCAGAAACAGCGTAGATCCACCCATTGGTTTTGCATTGATAAGACCTCCTGGGCACCACGCCGTGCCAAAAGGTCCGATGGGGTTCTGTGTTTTTGGTAATGTGGCAATCGCAGCTCGTCATGCCCAACGCACACATGGTCTGAAGCGCATCTTCATAATTGACTTCGATGTTCACCACGGGAATGGCACAAATGATGCATTTACTGAGGACCCTGATATATTCTTTTTGTCAACTCATCAGGACGGAAGCTACCCTGGAACAGGGAAAATCAGTGACATAGGTAAAGGAAAAGGTGAAGGTACCACTCTAAATTTACCTTTGCCTGGAGGTTCAGGTGATATTGCAATGAGAACCGTTTTTGAAGAAATCATTGTTCCATGTGCTCAACGGTTCAAGCCAGATATTATTCTTGTTTCTGCTGGGTATGATGCTCATGTCCTGGATCCACTAGCAAATTTACAGTTCACGACCGCAACATACTACTCATTGGCAAAAGATATAAAGCGGTTAGCAAAAGAAGTATGCGGAGGGCGGTGTGTGTTTTTCTTGGAAGGAGGATACAATCTTGAATCACTTTCATCATCTGTGGCAGACTCGTTTCGAGCATTGCTTGGAGAAGATAGCTTGGCATCAGAGTTTGATAACCCAGCTTACTTGTACGATGAACCAATGAGAAAGGTGCGAGATGCAATTCAGAGAGCCAAAAGCATTCATTGCTTATAAGGTGAATTTGTTTGAGAAGTTCTGCATCTTAGTCGTCTTAAACTGCCTGCCTACTTATGTTTTCTTTTGTAAAAATATCATTGTAAACATTGTTGATTAGAAAATTAAAGTTATGTAAACAG

SEQ ID NO: 1351 - DNA, 2016 bp, Arabidopsis thaliana
  misc_feature (1)..(2016): Ceres cDNA ID no. 12560743
  misc_feature (1)..(2016): Ceres CLONE  ID no. 1162389
  misc_feature (1)..(2016): Also known as  Ceres CDNA ID no. 23448423
aagtcttgtggagtaaaaactgggtttcacacacttcacttgcctctcaatacccgggaaaacaaaatgtcggtttcacttgctacttttcccggaaagttacaaagtcattcccttttcaggttgtgaagtcacattaacataagagaagaagcaaaaaggcttggagctttattttttgcttttttttttctttcttctagaaaacatgatcttgagtttccgagtaagattcttttaaaaagagtttgcaaagaacgagaaaaatgatggctctgatgaattgtgcatattcatcttcttcttcgtcttcgtctacttcctctcccacttcttcatcatcttcttcttcatattctccaaggaacagagagagcatgtttttgcagagtgtagttgatgcgtcaccttcaagtttctcttccgacagaaaatctattttaccaattgagaagactttaataagacatcagaattccagtctctgcttgatcccaaagtcttcagaagaattgaagaaggagattgcatcaattgagatagagattctacacatggaacgatatctcttatctctttacagaaaatcatttgagcaacaacttcctaattccttctctaatctctctgttactactaccttacctcgttctgtgactacttcaccaacatcactaactcattatcaagcttaccaaaaaccaatctcatatcctcggagtttcaacactagtttaaaagccttatcttcaagggaagggactagagtagtttctggtactcacagtcttggagagcttttaggatcatctcatatagttgatcataacaacttcataaacccgaataaactctctgaagatatcatgagatgcatttcttctgtgtattgtacactttcaagaggatcaacgagtaccacttccacttgttttcctgcttctccggtttcctccaatgcctcaaccattttctcttccaaatttaattatgaagataaatggagcttgaatggcgcaagtgaggatcattttctgaatcactgtcaagatcaagacaatgttttgccttgtggtgttgttgtcatagaggctcttagagtacatttagacgatggtagtttcggttacgctgctcttatgcttcaaaacttcagatcactggttcaaaatcttgagaaagttgatccgagtagaatgaaacgcgaagagaagctcgcgttttggataaacattcacaatgctcttgtgatgcatgcttacttagcttatggaactcacaaccgcgcaagaaacacatcggttttgaaggcagcttatgatattggaggctatagaataaacccttatatcatccaaagctcaatcttaggaatcagacctcattacacatcaccatcacctttactccaaactctgttttccccttcaagaaagtcgaaaacttgcagtgttagacacatttacgcattggaataccccgaggctttagctcatttcgctatttcttcaggggcattcactgatcctacagttcgagtttacaccgcggatagaatcttccgggatctaagacaagcgaaacaagagtatatcagaagtaatgttcgtgtttacaaagggacaaagattttgttgccaaagatctttcaacattatgttaaagacatgtcaatggatgtgtctaagctcatggaagcaacatctcaatgtttaccagaagatgcaaggaaaattgctgagaaatgtttgaaagagaagaagagtaagaattttgaatggttaccggaaaatttgagcttccggtatgttatcgccggagaattggtcggagcaagaaataagacgtgaagggtttattcaagaaaagtgttttttttttgcctcctgatgtgattaaataatctgattacaattagtgttcaatttcattttttttttcaagtgagaaattgtaaaaccagtgtttgtttgtataatcttaataaaccgagaactactaaatactaattaaggt

SEQ ID NO: 1352 - protein, 2016 aa, Arabidopsis thaliana
  misc_feature: GI Number: 50947619; NR Description: ternary complex factor-like [Oryza sativa (japonica cultivar-group)] >gi|42408754|dbj|BAD09990.1| ternary complex factor-like [Oryza
  misc_feature: GI Number: 28916180; NR Description: putative ternary complex
  misc_feature: GI Number: 21618245; NR Description: unknown [Arabidopsis thaliana]
  misc_feature: GI Number: 53793306; NR Description: ternary complex factor MIP1-like [Oryza sativa (japonica cultivar-group)] >gi|53792826|dbj|BAD53859.1| ternary complex factor MIP1-like
  misc_feature: GI Number: 50725195; NR Description: ternary complex factor
AAGTCTTGTGGAGTAAAAACTGGGTTTCACACACTTCACTTGCCTCTCAATACCCGGGAAAACAAAATGTCGGTTTCACTTGCTACTTTTCCCGGAAAGTTACAAAGTCATTCCCTTTTCAGGTTGTGAAGTCACATTAACATAAGAGAAGAAGCAAAAAGGCTTGGAGCTTTATTTTTTGCTTTTTTTTTTCTTTCTTCTAGAAAACATGATCTTGAGTTTCCGAGTAAGATTCTTTTAAAAAGAGTTTGCAAAGAACGAGAAAAATGATGGCTCTGATGAATTGTGCATATTCATCTTCTTCTTCGTCTTCGTCTACTTCCTCTCCCACTTCTTCATCATCTTCTTCTTCATATTCTCCAAGGAACAGAGAGAGCATGTTTTTGCAGAGTGTAGTTGATGCGTCACCTTCAAGTTTCTCTTCCGACAGAAAATCTATTTTACCAATTGAGAAGACTTTAATAAGACATCAGAATTCCAGTCTCTGCTTGATCCCAAAGTCTTCAGAAGAATTGAAGAAGGAGATTGCATCAATTGAGATAGAGATTCTACACATGGAACGATATCTCTTATCTCTTTACAGAAAATCATTTGAGCAACAACTTCCTAATTCCTTCTCTAATCTCTCTGTTACTACTACCTTACCTCGTTCTGTGACTACTTCACCAACATCACTAACTCATTATCAAGCTTACCAAAAACCAATCTCATATCCTCGGAGTTTCAACACTAGTTTAAAAGCCTTATCTTCAAGGGAAGGGACTAGAGTAGTTTCTGGTACTCACAGTCTTGGAGAGCTTTTAGGATCATCTCATATAGTTGATCATAACAACTTCATAAACCCGAATAAACTCTCTGAAGATATCATGAGATGCATTTCTTCTGTGTATTGTACACTTTCAAGAGGATCAACGAGTACCACTTCCACTTGTTTTCCTGCTTCTCCGGTTTCCTCCAATGCCTCAACCATTTTCTCTTCCAAATTTAATTATGAAGATAAATGGAGCTTGAATGGCGCAAGTGAGGATCATTTTCTGAATCACTGTCAAGATCAAGACAATGTTTTGCCTTGTGGTGTTGTTGTCATAGAGGCTCTTAGAGTACATTTAGACGATGGTAGTTTCGGTTACGCTGCTCTTATGCTTCAAAACTTCAGATCACTGGTTCAAAATCTTGAGAAAGTTGATCCGAGTAGAATGAAACGCGAAGAGAAGCTCGCGTTTTGGATAAACATTCACAATGCTCTTGTGATGCATGCTTACTTAGCTTATGGAACTCACAACCGCGCAAGAAACACATCGGTTTTGAAGGCAGCTTATGATATTGGAGGCTATAGAATAAACCCTTATATCATCCAAAGCTCAATCTTAGGAATCAGACCTCATTACACATCACCATCACCTTTACTCCAAACTCTGTTTTCCCCTTCAAGAAAGTCGAAAACTTGCAGTGTTAGACACATTTACGCATTGGAATACCCCGAGGCTTTAGCTCATTTCGCTATTTCTTCAGGGGCATTCACTGATCCTACAGTTCGAGTTTACACCGCGGATAGAATCTTCCGGGATCTAAGACAAGCGAAACAAGAGTATATCAGAAGTAATGTTCGTGTTTACAAAGGGACAAAGATTTTGTTGCCAAAGATCTTTCAACATTATGTTAAAGACATGTCAATGGATGTGTCTAAGCTCATGGAAGCAACATCTCAATGTTTACCAGAAGATGCAAGGAAAATTGCTGAGAAATGTTTGAAAGAGAAGAAGAGTAAGAATTTTGAATGGTTACCGGAAAATTTGAGCTTCCGGTATGTTATCGCCGGAGAATTGGTCGGAGCAAGAAATAAGACGTGAAGGGTTTATTCAAGAAAAGTGTTTTTTTTTTGCCTCCTGATGTGATTAAATAATCTGATTACAATTAGTGTTCAATTTCATTTTTTTTTTCAAGTGAGAAATTGTAAAACCAGTGTTTGTTTGTATAATCTTAATAAACCGAGAACTACTAAATACTAATTAAGGT

SEQ ID NO: 1353 - DNA, 2105 bp, Arabidopsis thaliana
  misc_feature (1)..(2105): Ceres cDNA ID no. 12561375
  misc_feature (1)..(2105): Ceres CLONE  ID no. 1149156
  misc_feature (1)..(2105): Also known as  Ceres CDNA ID no. 23448745
aagataagaaggtgttttttttctctatctcatagcctcattggtatagacctttttgtgttttggcagtattgttttgggagaaaccaactggattttaacgaaatattgttaaaccaaaggtttgttttcttggagattgagcttagctttgtttggatcattcggccacttgtgtgagagtttgattgatggttagtcttttttatatcatcatcatgctttgatagttgagagagaggaagaggcagaatcatcacaagttctgataaaggacaaaaccttttctgatgcaactcacgttttcacttcacaagctccaaaagagtttacttgggaaaacaaaagtttgacgaatgcaaaaccaattttgttagcataagaccaaacctacttcttcgtctgcctctttgcctgtatttgagttgttcttgttttgagagaaagggtgagaaaatgtctgcctgtttgtgtcttgttttcctgttcttctctattgttgcagaagcaacgtattctccaggaggtttccaccatctttcttctctaagactaaagaagaaggtgtccaagtcaaaacatgagttaccttttgaaactcgttacttccctcaaaatcttgaccacttcagtttcacaccagacagctacaaagtcttccaccagaagtacctcatcaacaaccgtttctggcgaaaaggtggtcccatctttgtttacactggaaatgaaggagacatcgactggtttgcttccaacaccggtttcatgctggatattgctcccaagttccgggctcttcttgttttcattgaacaccggttctatggagaatcaacgccatttgggaagaagtcgcataagtcagctgagacattgggttacctaaactctcagcaagcgttggctgattatgcaatcctgataagaagcttgaagcagaatctatcgtctgaggcatcgcctgtggttgtctttggtggctcttatggtggaatgcttgcagcgtggttcagactcaagtatccccacataacaatcggtgcattggcatcctccgctccaatacttcatttcgataacattgtaccattgacaagcttctatgatgccatttctcaggattttaaggatgcaagtattaattgtttcaaagtcatcaagagaagctgggaagagctagaggcagtttcaactatgaaaaatggcttgcaagaactcagcaaaaagttccgaacttgcaagggccttcattctcaatattcagccagagattggttaagtggagcatttgtttatacagccatggttaattatccaactgcagctaatttcatggcgccactgcctggttatcccgtagagcagatgtgcaagatcatcgacgggttccctcgaggatccagtaatcttgaccgtgcctttgctgctgcaagcttatactacaactattcgggatcagaaaaatgcttcgagatggaacaacaaactgatgatcatggacttgatggttggcaatatcaggcgtgtacagagatggtgatgccaatgagctgctcgaaccagagcatgctccctccgtacgaaaatgactctgaggcattccaagaacaatgcatgactagatacggagtcaagcctcgaccccattggatcaccacagaatttggtggaatgaggatagagacagtactgaagagatttggaagcaacatcatattctccaatggaatgcaggacccttggagccgtggaggggttctgaagaacatttcaagtagcatcgttgcgcttgtgaccaagaaaggagctcaccatgcagatctcagggctgctacaaaagatgacccagagtggctgaaagagcagaggaggcaagaggttgccattatagagaaatggatcagtgagtattacagagatttaagagaagagcaatagaggagccaaacaaaagtttattgcactaaaaatcaacaaataaagaaactaggtgtttttgattcggttcgtgtaacaaagtaaaagcttcaccaggaatttgtattccctcaaacaaaataatctgatgtttgtttctctatggagtgaattctgtaactaat

SEQ ID NO: 1354 - protein, 2105 aa, Arabidopsis thaliana
  misc_feature: PFam Name: Peptidase_S28; PFam Description: Serine
  misc_feature: GI Number: 22655366; NR Description: At2g24280/F27D4.19 [Arabidopsis thaliana] >gi|16648801|gb|AAL25591.1| At2g24280/F27D4.19 [Arabidopsis thaliana] >gi|30682358|ref|NP_850050.1| serine carboxypeptidase S28 family
  misc_feature: GI Number: 20197495; NR Description: putative prolylcarboxypeptidase [Arabidopsis thaliana] >gi|25350513|pir||G84634 probable prolylcarboxypeptidase [imported]
  misc_feature: GI Number: 51535425; NR Description: putative prolylcarboxypeptidase isoform 1 [Oryza sativa (japonica
  misc_feature: GI Number: 53793554; NR Description: putative prolylcarboxypeptidase, isoform 1 [Oryza sativa (japonica cultivar-group)] >gi|53792444|dbj|BAD53352.1| putative prolylcarboxypeptidase, isoform 1 [Oryza sativa (japonica
  misc_feature: GI Number: 22328106; NR Description: serine carboxypeptidase
AAGATAAGAAGGTGTTTTTTTTCTCTATCTCATAGCCTCATTGGTATAGACCTTTTTGTGTTTTGGCAGTATTGTTTTGGGAGAAACCAACTGGATTTTAACGAAATATTGTTAAACCAAAGGTTTGTTTTCTTGGAGATTGAGCTTAGCTTTGTTTGGATCATTCGGCCACTTGTGTGAGAGTTTGATTGATGGTTAGTCTTTTTTATATCATCATCATGCTTTGATAGTTGAGAGAGAGGAAGAGGCAGAATCATCACAAGTTCTGATAAAGGACAAAACCTTTTCTGATGCAACTCACGTTTTCACTTCACAAGCTCCAAAAGAGTTTACTTGGGAAAACAAAAGTTTGACGAATGCAAAACCAATTTTGTTAGCATAAGACCAAACCTACTTCTTCGTCTGCCTCTTTGCCTGTATTTGAGTTGTTCTTGTTTTGAGAGAAAGGGTGAGAAAATGTCTGCCTGTTTGTGTCTTGTTTTCCTGTTCTTCTCTATTGTTGCAGAAGCAACGTATTCTCCAGGAGGTTTCCACCATCTTTCTTCTCTAAGACTAAAGAAGAAGGTGTCCAAGTCAAAACATGAGTTACCTTTTGAAACTCGTTACTTCCCTCAAAATCTTGACCACTTCAGTTTCACACCAGACAGCTACAAAGTCTTCCACCAGAAGTACCTCATCAACAACCGTTTCTGGCGAAAAGGTGGTCCCATCTTTGTTTACACTGGAAATGAAGGAGACATCGACTGGTTTGCTTCCAACACCGGTTTCATGCTGGATATTGCTCCCAAGTTCCGGGCTCTTCTTGTTTTCATTGAACACCGGTTCTATGGAGAATCAACGCCATTTGGGAAGAAGTCGCATAAGTCAGCTGAGACATTGGGTTACCTAAACTCTCAGCAAGCGTTGGCTGATTATGCAATCCTGATAAGAAGCTTGAAGCAGAATCTATCGTCTGAGGCATCGCCTGTGGTTGTCTTTGGTGGCTCTTATGGTGGAATGCTTGCAGCGTGGTTCAGACTCAAGTATCCCCACATAACAATCGGTGCATTGGCATCCTCCGCTCCAATACTTCATTTCGATAACATTGTACCATTGACAAGCTTCTATGATGCCATTTCTCAGGATTTTAAGGATGCAAGTATTAATTGTTTCAAAGTCATCAAGAGAAGCTGGGAAGAGCTAGAGGCAGTTTCAACTATGAAAAATGGCTTGCAAGAACTCAGCAAAAAGTTCCGAACTTGCAAGGGCCTTCATTCTCAATATTCAGCCAGAGATTGGTTAAGTGGAGCATTTGTTTATACAGCCATGGTTAATTATCCAACTGCAGCTAATTTCATGGCGCCACTGCCTGGTTATCCCGTAGAGCAGATGTGCAAGATCATCGACGGGTTCCCTCGAGGATCCAGTAATCTTGACCGTGCCTTTGCTGCTGCAAGCTTATACTACAACTATTCGGGATCAGAAAAATGCTTCGAGATGGAACAACAAACTGATGATCATGGACTTGATGGTTGGCAATATCAGGCGTGTACAGAGATGGTGATGCCAATGAGCTGCTCGAACCAGAGCATGCTCCCTCCGTACGAAAATGACTCTGAGGCATTCCAAGAACAATGCATGACTAGATACGGAGTCAAGCCTCGACCCCATTGGATCACCACAGAATTTGGTGGAATGAGGATAGAGACAGTACTGAAGAGATTTGGAAGCAACATCATATTCTCCAATGGAATGCAGGACCCTTGGAGCCGTGGAGGGGTTCTGAAGAACATTTCAAGTAGCATCGTTGCGCTTGTGACCAAGAAAGGAGCTCACCATGCAGATCTCAGGGCTGCTACAAAAGATGACCCAGAGTGGCTGAAAGAGCAGAGGAGGCAAGAGGTTGCCATTATAGAGAAATGGATCAGTGAGTATTACAGAGATTTAAGAGAAGAGCAATAGAGGAGCCAAACAAAAGTTTATTGCACTAAAAATCAACAAATAAAGAAACTAGGTGTTTTTGATTCGGTTCGTGTAACAAAGTAAAAGCTTCACCAGGAATTTGTATTCCCTCAAACAAAATAATCTGATGTTTGTTTCTCTATGGAGTGAATTCTGTAACTAAT

SEQ ID NO: 1355 - DNA, 1094 bp, Arabidopsis thaliana
  misc_feature (1)..(1094): Ceres cDNA ID no. 12561529
  misc_feature (1)..(1094): Also known as  Ceres CDNA ID no. 23448745
atgttctaccaatcgtcgtcgtctctcacgcaaattcttcattcgttctgtggaaacacagaaatggagactccatatccgaaactcatcgatccttcaaagactcgaataggatggattggcatcgggataatgggatcggccatggtttctcatattatcgccgcaggctattctgtcacagtttacgctcgcgacctccggaaaacaaaagatctgcaaaccaaaggagctcgcatagccaatagccccaaagagttagcggagatgagcgacgttgtgttcacgattgttggaaacttcaacgatgtccgatcattgcttctcggtgacgatggtgtactctctggtcttacgcccggtggagtaacagtggacatgactagtagcaaaccaggattggcgcgtgaaatacacgcagaagcgaggcgtaggaattgttgggcggtggatgcgccggtatcaggtggagacgctggagcacgagaggggacgttagggattttcgccggcggagattcagagattgtggagtggttgtccccggtgatgaagaatatagggactgttacttatatgggagaagcagggagtgggcaaagctgcaagatagggaatcagattgctggtgcgagcaacctggttggacttgctgaagggatagtgttcgctgagaaagcgggtttagatacagtgaaatggctcgaggcggtgaaggatggtgcagctggatcggcggttatgcggctgtttggggagatgattgtgaagagggattatagggcgactggctttgcggagtatatggtgaaagatttgggaatggctgcagaggcggcgatgcctggtgctgctctgagcaagcagttgttcactggaatggtggctaatggagatggcaagttaggtattcaaggcgtcgtctctgttattagaagacttaacggcatatcctgaaaacacttgtgttgtaaaacagagtgttccaatgatttcacgatcaactaggcaaacttgtcttcgatttggtttaagttgataataagaagaacatcgagtctcaccaatctcaataagaaacaaagggcatttat

SEQ ID NO: 1356 - protein, 1094 aa, Arabidopsis thaliana
  misc_feature: PFam Name: Peptidase_S28; PFam Description: Serine
  misc_feature: GI Number: 22655366; NR Description: At2g24280/F27D4.19 [Arabidopsis thaliana] >gi|16648801|gb|AAL25591.1| At2g24280/F27D4.19 [Arabidopsis thaliana] >gi|30682358|ref|NP_850050.1| serine carboxypeptidase S28 family
  misc_feature: GI Number: 20197495; NR Description: putative prolylcarboxypeptidase [Arabidopsis thaliana] >gi|25350513|pir||G84634 probable prolylcarboxypeptidase [imported]
  misc_feature: GI Number: 51535425; NR Description: putative prolylcarboxypeptidase isoform 1 [Oryza sativa (japonica
  misc_feature: GI Number: 53793554; NR Description: putative prolylcarboxypeptidase, isoform 1 [Oryza sativa (japonica cultivar-group)] >gi|53792444|dbj|BAD53352.1| putative prolylcarboxypeptidase, isoform 1 [Oryza sativa (japonica
  misc_feature: GI Number: 22328106; NR Description: serine carboxypeptidase
ATGTTCTACCAATCGTCGTCGTCTCTCACGCAAATTCTTCATTCGTTCTGTGGAAACACAGAAATGGAGACTCCATATCCGAAACTCATCGATCCTTCAAAGACTCGAATAGGATGGATTGGCATCGGGATAATGGGATCGGCCATGGTTTCTCATATTATCGCCGCAGGCTATTCTGTCACAGTTTACGCTCGCGACCTCCGGAAAACAAAAGATCTGCAAACCAAAGGAGCTCGCATAGCCAATAGCCCCAAAGAGTTAGCGGAGATGAGCGACGTTGTGTTCACGATTGTTGGAAACTTCAACGATGTCCGATCATTGCTTCTCGGTGACGATGGTGTACTCTCTGGTCTTACGCCCGGTGGAGTAACAGTGGACATGACTAGTAGCAAACCAGGATTGGCGCGTGAAATACACGCAGAAGCGAGGCGTAGGAATTGTTGGGCGGTGGATGCGCCGGTATCAGGTGGAGACGCTGGAGCACGAGAGGGGACGTTAGGGATTTTCGCCGGCGGAGATTCAGAGATTGTGGAGTGGTTGTCCCCGGTGATGAAGAATATAGGGACTGTTACTTATATGGGAGAAGCAGGGAGTGGGCAAAGCTGCAAGATAGGGAATCAGATTGCTGGTGCGAGCAACCTGGTTGGACTTGCTGAAGGGATAGTGTTCGCTGAGAAAGCGGGTTTAGATACAGTGAAATGGCTCGAGGCGGTGAAGGATGGTGCAGCTGGATCGGCGGTTATGCGGCTGTTTGGGGAGATGATTGTGAAGAGGGATTATAGGGCGACTGGCTTTGCGGAGTATATGGTGAAAGATTTGGGAATGGCTGCAGAGGCGGCGATGCCTGGTGCTGCTCTGAGCAAGCAGTTGTTCACTGGAATGGTGGCTAATGGAGATGGCAAGTTAGGTATTCAAGGCGTCGTCTCTGTTATTAGAAGACTTAACGGCATATCCTGAAAACACTTGTGTTGTAAAACAGAGTGTTCCAATGATTTCACGATCAACTAGGCAAACTTGTCTTCGATTTGGTTTAAGTTGATAATAAGAAGAACATCGAGTCTCACCAATCTCAATAAGAAACAAAGGGCATTTAT

SEQ ID NO: 1357 - DNA, 2010 bp, Arabidopsis thaliana
  misc_feature (1)..(2010): Ceres cDNA ID no. 12562039
  misc_feature (1)..(2010): Ceres CLONE  ID no. 1206421
  misc_feature (1)..(2010): Also known as  Ceres CDNA ID no. 12562039
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccacctcttccacttccttcaatgggtccgatatttaccggtgttactttctcgtctcatagctcatcgacggcttcaggaatggggtctgatgatgatgacgacgatatggacgttgatcaggctaacattgcgggttctagtagccgaaaacgcaaacgtggaaaccgcggtggaggcggtaaaatgatggaattgtttgaaggtttggtgagacaagtaatgcaaaagcaagcggctatgcaaaggagtttcttggaagctcttgagaagagagagcaagaacgtcttgatcgtgaagaagcttggaaacgtcaagaaatggctcggttagctcgagaacacgaggtcatgtctcaagaacgagccgcctctgcttctcgtgacgccgcaatcatttcattgattcagaaaattactggccataccattcagttacctccttctttgtcatctcaaccgcctccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaagccagaagaccttgtgatgagagagctgattcaacaacaacagcaactacaacaacaagaatcaatgataggtgagtatgaaaagattgaagagtctcacaattataataacatggaggaagaggaagatcaggaaatggatgaggaagaactagacgaggatgagaagtccgcggctttcgagattgcgtttcaaagccctgcaaacagaggaggcaatggccatacggaaccacctttcttgacaatggttcagtaa

SEQ ID NO: 1358 - protein, 2010 aa, Arabidopsis thaliana
ATGGAGCAAGGAGGAGGTGGTGGTGGTAATGAAGTTGTGGAGGAAGCTTCACCTATTAGTTCAAGACCTCCTGCTAACAACTTAGAAGAGCTTATGAGATTCTCAGCCGCCGCGGATGACGGTGGATTAGGAGGTGGAGGTGGAGGAGGAGGAGGAGGAAGTGCTTCTTCTTCATCGGGAAATCGATGGCCGAGAGAAGAAACTTTAGCTCTTCTTCGGATCCGATCCGATATGGATTCTACTTTTCGTGATGCTACTCTCAAAGCTCCTCTTTGGGAACATGTTTCCAGGAAGCTATTGGAGTTAGGTTACAAACGAAGTTCAAAGAAATGCAAAGAGAAATTCGAAAACGTTCAGAAATATTACAAACGTACTAAAGAAACTCGCGGTGGTCGTCATGATGGTAAAGCTTACAAGTTCTTCTCTCAGCTTGAAGCTCTCAACACTACTCCTCCTTCATCTTCCCTCGACGTTACTCCTCTCTCCGTCGCTAATCCCATTCTCATGCCTTCTTCTTCTTCTTCTCCATTTCCCGTATTCTCTCAACCGCAACCGCAAACGCAAACGCAACCGCCTCAAACGCATAATGTCTCTTTTACTCCTACTCCACCACCTCTTCCACTTCCTTCAATGGGTCCGATATTTACCGGTGTTACTTTCTCGTCTCATAGCTCATCGACGGCTTCAGGAATGGGGTCTGATGATGATGACGACGATATGGACGTTGATCAGGCTAACATTGCGGGTTCTAGTAGCCGAAAACGCAAACGTGGAAACCGCGGTGGAGGCGGTAAAATGATGGAATTGTTTGAAGGTTTGGTGAGACAAGTAATGCAAAAGCAAGCGGCTATGCAAAGGAGTTTCTTGGAAGCTCTTGAGAAGAGAGAGCAAGAACGTCTTGATCGTGAAGAAGCTTGGAAACGTCAAGAAATGGCTCGGTTAGCTCGAGAACACGAGGTCATGTCTCAAGAACGAGCCGCCTCTGCTTCTCGTGACGCCGCAATCATTTCATTGATTCAGAAAATTACTGGCCATACCATTCAGTTACCTCCTTCTTTGTCATCTCAACCGCCTCCACCGTATCAACCGCCACCCGCGGTCACTAAACGTGTGGCGGAACCACCATTATCAACAGCTCAATCTCAATCACAACAACCAATAATGGCGATTCCACAACAACAAATTCTTCCTCCTCCTCCTCCTTCTCATCCTCACGCTCATCAACCAGAACAGAAACAACAACAACAACCACAACAAGAGATGGTCATGAGCTCGGAACAATCATCATTACCATCATCATCAAGATGGCCAAAGGCAGAGATTCTAGCGCTTATAAACCTGAGAAGTGGAATGGAACCAAGGTACCAAGATAATGTACCTAAAGGACTTCTATGGGAAGAGATCTCAACTTCAATGAAGAGAATGGGATACAACAGAAACGCTAAGAGATGTAAAGAGAAATGGGAAAACATAAACAAATACTACAAGAAAGTTAAAGAAAGCAACAAGAAACGTCCTCAAGATGCTAAGACTTGTCCTTACTTTCACCGCCTCGATCTTCTTTACCGCAACAAAGTACTCGGTAGTGGCGGTGGTTCTAGCACTTCTGGTCTACCTCAAGACCAAAAACAGAGTCCGGTCACTGCGATGAAACCGCCACAAGAAGGACTTGTTAATGTTCAACAAACTCATGGGTCAGCTTCAACTGAGGAAGAAGAGCCTATAGAGGAAAGTCCACAAGGAACAGAAAAGCCAGAAGACCTTGTGATGAGAGAGCTGATTCAACAACAACAGCAACTACAACAACAAGAATCAATGATAGGTGAGTATGAAAAGATTGAAGAGTCTCACAATTATAATAACATGGAGGAAGAGGAAGATCAGGAAATGGATGAGGAAGAACTAGACGAGGATGAGAAGTCCGCGGCTTTCGAGATTGCGTTTCAAAGCCCTGCAAACAGAGGAGGCAATGGCCATACGGAACCACCTTTCTTGACAATGGTTCAGTAA

SEQ ID NO: 1359 - DNA, 1337 bp, Arabidopsis thaliana
  misc_feature (1)..(1337): Ceres cDNA ID no. 12562139
  misc_feature (1)..(1337): Ceres CLONE  ID no. 21891
  misc_feature (1)..(1337): Also known as  Ceres CDNA ID no. 23449242
  misc_feature (111)..(111): n is a, c, t, g, unknown, or other
tggaaagacggaagatggtatccatcatttcggtgttctcgaaggatggtttggtcaccattggtggaatggaagagctgctattcttctgattactactcttggtgtgtntgctccattggcttgcttcaagcgaatcgattctttgaaatttacatcggccttatccgtggctctggcggttgtgtttctcattattactgcgggaatttcaattatgaagttgatcagtggcggtgtggcgatgccaagattgttaccagatgttactgacttaacatctttctggaatctcttcacagttgtacctgttcttgtcacagcattcatttgccattacaatgttcacagcatacagaacgagctcgaagactcctctcagataagacctgttgttcgatcagcacttatgctctgctcatctgtttacataatgacaagtattttcgggttcctcttgtttggtgatgatactcttgatgatgtccttgcaaactttgacactgatcttggaatcccttttggttctatccttaatgatgcggttcgagttagctacgcgcttcatttgatgctcgtgttcccgattgttttctaccctcttcggattaacattgacgggctcttgttcccttccgctcgatcattatctacctcaaatgtgaggttcggttgcctcactgccggtcttatctctgtaatcttcttgggtgcaaacttcatcccaagcatttgggatgctttccaattcactggagcaaccgccgctgtctgtctcggcttcatcttcccagcttctattatactaaaggatcgtcatgacaaagcaacaaacagggacacaaccttagctattttcatgattgttcttgcggtattgtccaatgcaatcgccatttacagcgatgcttatgcactattcaagaagaacgcgcctcgtgagtagtcccgggaatgagaaaatgtgcagtttggtgtttctgtatgaagaaggaaaaaagcgtttgttttgtcttctatgtgaaatcaaataatgaagaagacaagacttctcttctcttatatgtttgtactattgtcgttgagtgttctaagcggacttttgcttcggggttatataccaccatgagtgttgtttgtaaaaaactctgtataaaaattgtaatgcagatacatattttgccttttcatgactctcttagctattgcttcataactatatacatatttaggcacaaagccacctagatttctcttagaaatgccatgttctaggcgtaaacatatactaatctgttgtatcattcatagtttataataaccaaaccaagcttttg

SEQ ID NO: 1360 - protein, 1337 aa, Arabidopsis thaliana
  misc_feature: PFam Name: Aa_trans; PFam Description: Transmembrane amino
  misc_feature: GI Number: 15241555; NR Description: amino acid transporter
  misc_feature: GI Number: 9758059; NR Description: amino acid
  misc_feature: GI Number: 50912345; NR Description: putative amino acid transporter [Oryza sativa (japonica cultivar-group)] >gi|46390604|dbj|BAD16088.1| putative amino acid transporter [Oryza
  misc_feature: GI Number: 51535770; NR Description: putative system A
  misc_feature: GI Number: 50905855; NR Description: putative amino acid transporter A1 [Oryza sativa (japonica cultivar-group)] >gi|46390972|dbj|BAD16485.1| putative amino acid transporter A1 [Oryza sativa (japonica cultivar-group)] [Oryza sativa (japonica
TGGAAAGACGGAAGATGGTATCCATCATTTCGGTGTTCTCGAAGGATGGTTTGGTCACCATTGGTGGAATGGAAGAGCTGCTATTCTTCTGATTACTACTCTTGGTGTGTNTGCTCCATTGGCTTGCTTCAAGCGAATCGATTCTTTGAAATTTACATCGGCCTTATCCGTGGCTCTGGCGGTTGTGTTTCTCATTATTACTGCGGGAATTTCAATTATGAAGTTGATCAGTGGCGGTGTGGCGATGCCAAGATTGTTACCAGATGTTACTGACTTAACATCTTTCTGGAATCTCTTCACAGTTGTACCTGTTCTTGTCACAGCATTCATTTGCCATTACAATGTTCACAGCATACAGAACGAGCTCGAAGACTCCTCTCAGATAAGACCTGTTGTTCGATCAGCACTTATGCTCTGCTCATCTGTTTACATAATGACAAGTATTTTCGGGTTCCTCTTGTTTGGTGATGATACTCTTGATGATGTCCTTGCAAACTTTGACACTGATCTTGGAATCCCTTTTGGTTCTATCCTTAATGATGCGGTTCGAGTTAGCTACGCGCTTCATTTGATGCTCGTGTTCCCGATTGTTTTCTACCCTCTTCGGATTAACATTGACGGGCTCTTGTTCCCTTCCGCTCGATCATTATCTACCTCAAATGTGAGGTTCGGTTGCCTCACTGCCGGTCTTATCTCTGTAATCTTCTTGGGTGCAAACTTCATCCCAAGCATTTGGGATGCTTTCCAATTCACTGGAGCAACCGCCGCTGTCTGTCTCGGCTTCATCTTCCCAGCTTCTATTATACTAAAGGATCGTCATGACAAAGCAACAAACAGGGACACAACCTTAGCTATTTTCATGATTGTTCTTGCGGTATTGTCCAATGCAATCGCCATTTACAGCGATGCTTATGCACTATTCAAGAAGAACGCGCCTCGTGAGTAGTCCCGGGAATGAGAAAATGTGCAGTTTGGTGTTTCTGTATGAAGAAGGAAAAAAGCGTTTGTTTTGTCTTCTATGTGAAATCAAATAATGAAGAAGACAAGACTTCTCTTCTCTTATATGTTTGTACTATTGTCGTTGAGTGTTCTAAGCGGACTTTTGCTTCGGGGTTATATACCACCATGAGTGTTGTTTGTAAAAAACTCTGTATAAAAATTGTAATGCAGATACATATTTTGCCTTTTCATGACTCTCTTAGCTATTGCTTCATAACTATATACATATTTAGGCACAAAGCCACCTAGATTTCTCTTAGAAATGCCATGTTCTAGGCGTAAACATATACTAATCTGTTGTATCATTCATAGTTTATAATAACCAAACCAAGCTTTTG

SEQ ID NO: 1361 - DNA, 1449 bp, Arabidopsis thaliana
  misc_feature (1)..(1449): Ceres cDNA ID no. 12562301
  misc_feature (1)..(1449): Also known as  Ceres CDNA ID no. 23449242
ctccgatgtttcaaaaacaaagtcgattacgctagaatccatggtcacgacatcttctacagcaattctcttcttcatccgaagatgaattcgtattgggcgaaacttccggtggttaaagctgcgatgcttgctcacccatttatggattgaagctttagagagaaaatgggtgatgaggcagagatcaaggaacatttaaagccacaagcttcatctgaaacaatagacaagaaacataatgtgaaagggaagaggttatggcagaaagtcaagtatcaattggtggagtttcattcattgcctgcttatttaagagacaatgagtacatcattggtcattaccgatccgaatggccgatcaaacagattcttctcagcatctttaccattcataatgagactttgaatgtttggacgcatttgattgggtttttcctgtttttggcactcactatatacactgcaacgaaagtaccgagtgtcgtggatcttcattcgcttcaacaccgtttacccgatttgttgaggaaaacagatctccacaaacttcattctgagctcatgtctcgccttccttctagtccatctagttggcatgtgatggaccttctttataactgtttgcctgaaagattttctcatggcaactacactgacatgtgtgttctgcattctgtgagggaagatcttgcaaacttgatagctcctttgatcttcaggccaattactcgatggccgttttatgcatttctaggtggtgctatattctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcctggagtttcgggtggtgagggcgtctctgttctttggaatgggattctctggcttagctccgattcttcacaagctgatcatcttttgggaccaacctgaagcccttcacatgacaggttatgagattttgatgggtttgctttatgggttaggagctgtggtttatgcaactaggatcccagagagatggatgccgggtaaattcgatatagcaggacatagccatcagttgtttcatgttctggttgttgctggtgcgttaacgcactatagagctgggctatgagagatattgaaggatgttgaagatgaagattgaagattagatggaatctttgatgttttaaatcttgtttgtagtagcttcatataaaagttggattatgtaaagtcttatctgtaatcaaacgtttaattgtttcttttattcaacaaaggattc

SEQ ID NO: 1362 - protein, 1449 aa, Arabidopsis thaliana
  misc_feature: PFam Name: Aa_trans; PFam Description: Transmembrane amino
  misc_feature: GI Number: 15241555; NR Description: amino acid transporter
  misc_feature: GI Number: 9758059; NR Description: amino acid
  misc_feature: GI Number: 50912345; NR Description: putative amino acid transporter [Oryza sativa (japonica cultivar-group)] >gi|46390604|dbj|BAD16088.1| putative amino acid transporter [Oryza
  misc_feature: GI Number: 51535770; NR Description: putative system A
  misc_feature: GI Number: 50905855; NR Description: putative amino acid transporter A1 [Oryza sativa (japonica cultivar-group)] >gi|46390972|dbj|BAD16485.1| putative amino acid transporter A1 [Oryza sativa (japonica cultivar-group)] [Oryza sativa (japonica
CTCCGATGTTTCAAAAACAAAGTCGATTACGCTAGAATCCATGGTCACGACATCTTCTACAGCAATTCTCTTCTTCATCCGAAGATGAATTCGTATTGGGCGAAACTTCCGGTGGTTAAAGCTGCGATGCTTGCTCACCCATTTATGGATTGAAGCTTTAGAGAGAAAATGGGTGATGAGGCAGAGATCAAGGAACATTTAAAGCCACAAGCTTCATCTGAAACAATAGACAAGAAACATAATGTGAAAGGGAAGAGGTTATGGCAGAAAGTCAAGTATCAATTGGTGGAGTTTCATTCATTGCCTGCTTATTTAAGAGACAATGAGTACATCATTGGTCATTACCGATCCGAATGGCCGATCAAACAGATTCTTCTCAGCATCTTTACCATTCATAATGAGACTTTGAATGTTTGGACGCATTTGATTGGGTTTTTCCTGTTTTTGGCACTCACTATATACACTGCAACGAAAGTACCGAGTGTCGTGGATCTTCATTCGCTTCAACACCGTTTACCCGATTTGTTGAGGAAAACAGATCTCCACAAACTTCATTCTGAGCTCATGTCTCGCCTTCCTTCTAGTCCATCTAGTTGGCATGTGATGGACCTTCTTTATAACTGTTTGCCTGAAAGATTTTCTCATGGCAACTACACTGACATGTGTGTTCTGCATTCTGTGAGGGAAGATCTTGCAAACTTGATAGCTCCTTTGATCTTCAGGCCAATTACTCGATGGCCGTTTTATGCATTTCTAGGTGGTGCTATATTCTGTCTATTAGCAAGCAGCACGTGCCACCTCCTCTCATGTCACTCCGAGCGAGTCTCCTACATAATGCTTAGGCTTGATTACGCCGGCATCGCAGCTCTAATAGCGACTTCCTTCTACCCTCCGGTTTATTACTCCTTCATGTGTGATCCTTTCTTCTGCAACCTCTACTTAGGATTCATAACCATCTTAGGAATCGCCACTGTGCTTGTTTCTCTCCTCCCGGTTTTCCAAAGCCTGGAGTTTCGGGTGGTGAGGGCGTCTCTGTTCTTTGGAATGGGATTCTCTGGCTTAGCTCCGATTCTTCACAAGCTGATCATCTTTTGGGACCAACCTGAAGCCCTTCACATGACAGGTTATGAGATTTTGATGGGTTTGCTTTATGGGTTAGGAGCTGTGGTTTATGCAACTAGGATCCCAGAGAGATGGATGCCGGGTAAATTCGATATAGCAGGACATAGCCATCAGTTGTTTCATGTTCTGGTTGTTGCTGGTGCGTTAACGCACTATAGAGCTGGGCTATGAGAGATATTGAAGGATGTTGAAGATGAAGATTGAAGATTAGATGGAATCTTTGATGTTTTAAATCTTGTTTGTAGTAGCTTCATATAAAAGTTGGATTATGTAAAGTCTTATCTGTAATCAAACGTTTAATTGTTTCTTTTATTCAACAAAGGATTC

SEQ ID NO: 1363 - DNA, 1259 bp, Arabidopsis thaliana
  misc_feature (1)..(1259): Ceres cDNA ID no. 12562527
  misc_feature (1)..(1259): Ceres CLONE  ID no. 152851
  misc_feature (1)..(1259): Also known as  Ceres CDNA ID no. 23449482
aaacaacacacacacaaatggctcctcgtgtgatcttcttacttctctcgcttgtttttctctagctcgcaaacacatcacactctttgagaaagtttcaatcatttctacaccctatttataaagacacggccaaaaatatatacaccatccctttgtccatcggctcaacttccagcgaaaaattcgtccttgacctcaacggagccgcaccgttattgcaaaactgtccaaccgccgccaaatccaccacctaccacccaatcagatgtggctccacaagatgcaaatacgcaaaccccaacttcccctgtcccaacaatgtcattgccaagaagaggaccgtgtgtctctcctccgacaattcccgcctattccgagacaccgtccccttgttatacacatttaatggagtttacactagggacagtgaaatgagttcttcattgactttgacttgcactgacggtgctcctgccttaaaacaaagaaccatcggtctcgctaacacccacttgtcgattccctcgcagctcatctccatgtaccagcttcctcataagatagctctttgtttgccttccaccgaacgaagtcagtctcataatggtgacctttggatcggtaaaggggaatattattatctgccttacgataaagatgtctctaagatctttgcctccacgcctctgatcggtaatggcaagtccggcgagtacttaatcgatgtgaagtccatccaaatcggtgcaaagaccgttcctataccctatggagccacaaagatcagcactttggctccttacaccgtattccaaacttccctttacaaggctctgctcacagctttcaccgaaaacatcaagatagctaaagctcccgcggtgaagcctttcggtgcgtgcttctactccaatggaggacgtggagttcccgtgatcgacctggtgctgagcggaggggctaagtggaggatctacgggtctaattccttggtgaaggtgaataaaaatgtggtttgtttagggtttgtggacggaggtgtgaagccgaagtaccctatagtgatcggaggatttcagatggaggataatttggtggagttcgatcttgaagcttccaaattttctttctcctcttctcttttgcttcacaacacttcttgctcagtgcaaaggttgtctcctttctaatgcacgtgatcgattattcatgttatcaagacatatcatcagtttcctttttaataaattaatgtc

SEQ ID NO: 1364 - protein, 1259 aa, Arabidopsis thaliana
  misc_feature: PFam Name: Asp; PFam Description: Eukaryotic aspartyl protease
  misc_feature: GI Number: 15239644; NR Description: extracellular dermal
  misc_feature: GI Number: 27372527; NR Description: xyloglucan-specific fungal endoglucanase inhibitor protein precursor [Lycopersicon
  misc_feature: GI Number: 32482806; NR Description: putative xyloglucanase
  misc_feature: GI Number: 10334495; NR Description: putative extracellular
  misc_feature: GI Number: 34907230; NR Description: putative dermal glycoprotein precursor [Oryza sativa (japonica cultivar-group)] >gi|20160768|dbj|BAB89709.1| putative dermal glycoprotein precursor
AAACAACACACACACAAATGGCTCCTCGTGTGATCTTCTTACTTCTCTCGCTTGTTTTTCTCTAGCTCGCAAACACATCACACTCTTTGAGAAAGTTTCAATCATTTCTACACCCTATTTATAAAGACACGGCCAAAAATATATACACCATCCCTTTGTCCATCGGCTCAACTTCCAGCGAAAAATTCGTCCTTGACCTCAACGGAGCCGCACCGTTATTGCAAAACTGTCCAACCGCCGCCAAATCCACCACCTACCACCCAATCAGATGTGGCTCCACAAGATGCAAATACGCAAACCCCAACTTCCCCTGTCCCAACAATGTCATTGCCAAGAAGAGGACCGTGTGTCTCTCCTCCGACAATTCCCGCCTATTCCGAGACACCGTCCCCTTGTTATACACATTTAATGGAGTTTACACTAGGGACAGTGAAATGAGTTCTTCATTGACTTTGACTTGCACTGACGGTGCTCCTGCCTTAAAACAAAGAACCATCGGTCTCGCTAACACCCACTTGTCGATTCCCTCGCAGCTCATCTCCATGTACCAGCTTCCTCATAAGATAGCTCTTTGTTTGCCTTCCACCGAACGAAGTCAGTCTCATAATGGTGACCTTTGGATCGGTAAAGGGGAATATTATTATCTGCCTTACGATAAAGATGTCTCTAAGATCTTTGCCTCCACGCCTCTGATCGGTAATGGCAAGTCCGGCGAGTACTTAATCGATGTGAAGTCCATCCAAATCGGTGCAAAGACCGTTCCTATACCCTATGGAGCCACAAAGATCAGCACTTTGGCTCCTTACACCGTATTCCAAACTTCCCTTTACAAGGCTCTGCTCACAGCTTTCACCGAAAACATCAAGATAGCTAAAGCTCCCGCGGTGAAGCCTTTCGGTGCGTGCTTCTACTCCAATGGAGGACGTGGAGTTCCCGTGATCGACCTGGTGCTGAGCGGAGGGGCTAAGTGGAGGATCTACGGGTCTAATTCCTTGGTGAAGGTGAATAAAAATGTGGTTTGTTTAGGGTTTGTGGACGGAGGTGTGAAGCCGAAGTACCCTATAGTGATCGGAGGATTTCAGATGGAGGATAATTTGGTGGAGTTCGATCTTGAAGCTTCCAAATTTTCTTTCTCCTCTTCTCTTTTGCTTCACAACACTTCTTGCTCAGTGCAAAGGTTGTCTCCTTTCTAATGCACGTGATCGATTATTCATGTTATCAAGACATATCATCAGTTTCCTTTTTAATAAATTAATGTC

SEQ ID NO: 1365 - DNA, 1555 bp, Arabidopsis thaliana
  misc_feature (1)..(1555): Ceres cDNA ID no. 12562703
  misc_feature (1)..(1555): Ceres CLONE  ID no. 35523
  misc_feature (1)..(1555): Also known as  Ceres CDNA ID no. 23449593
aaagttctctcagcttctttctctctctctccatcgcttttgagatcatcgaacacaatcgaaacgaataatcatttggagaataagaagatcgtgagaagcttaaagggttggatcccgtgttctgggaaatcgagtgggaggaataagacaaggaggaacggtgaccacaaactcgacaggaagtcttctgattgttctgtgtctacttcagagaaatctaaggccaagtcgtccttgagtgaatccaaaagtaaaggctctgatcacattgtggcacaaacgtttacattctctgagttagctactgccactagaaacttcagaaaagaatgtcttataggagaaggaggttttggtagagtttacaaaggatacttggccagcactagccagacagcggctatcaagcaacttgatcataatggtttacaaggaaacagggagttccttgtcgaggttctcatgttgagtcttcttcatcacccgaatcttgttaacttaataggatattgtgctgatggagatcaaaggcttctagtctacgagtacatgcccctaggttcacttgaagatcatttgcatgacatttcacctggtaagcagccacttgactggaacaccagaatgaaaatagctgccggtgctgcaaaaggattggagtatctgcatgacaaaactatgcctccagtgatctatcgagatttgaaatgctcaaatattttgctcgatgatgattactttccaaagctatccgacttcgggttggctaaacttggcccagtgggtgacaagtctcatgtgtccactcgtgttatgggaacatacggatactgtgctcccgagtatgcaatgacaggccaactaacactcaaatcagacgtttacagcttcggtgttgttctgctggagattataactggtaggaaagcaatagacagttcaagatctactggagaacagaatctagtcgcatgggcaaggcctttgtttaaagacaggatgaaattctctcaaatggctgatccaatgcttcaaggtcaataccctccgcgagggttataccaagcactcgctgtagcagcgatgtgcgtacaagagcagccaaatcttagacctctcattgctgacgtcgtcactgcactttcttacctcgcctcccaaaagtttgatcctctggctcagccagtccaaggatccctcttcgctcccgggactccacctagatcaaagagggtctgaaaataatcccgagaaccgcaatgctgtgtaagttatgtagcttaaacccattccgtgctgtctttcttggagaggaaaggtggatgattttcagactaagtgtgaatgtatggcttaagagctacttgtagatatgtgtaagaagagatagattcatatagaggccggtttataatgttgttataggtgatgttgtttaatgtaatgtttattgagcgcttgctttcaaatgtgacaatttctcattattgtactgaggatgtctgcttcgattccaaagttattgtataaatattaaagtactatagttttc

SEQ ID NO: 1366 - protein, 1555 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15238886; NR Description: protein kinase family
  misc_feature: GI Number: 30679773; NR Description: protein kinase family
  misc_feature: GI Number: 7413555; NR Description: protein kinase-like [Arabidopsis thaliana] >gi|11259782|pir||T48301 protein kinase-like
  misc_feature: GI Number: 37625033; NR Description: protein kinase-like
  misc_feature: GI Number: 10445209; NR Description: protein serine/threonine
AAAGTTCTCTCAGCTTCTTTCTCTCTCTCTCCATCGCTTTTGAGATCATCGAACACAATCGAAACGAATAATCATTTGGAGAATAAGAAGATCGTGAGAAGCTTAAAGGGTTGGATCCCGTGTTCTGGGAAATCGAGTGGGAGGAATAAGACAAGGAGGAACGGTGACCACAAACTCGACAGGAAGTCTTCTGATTGTTCTGTGTCTACTTCAGAGAAATCTAAGGCCAAGTCGTCCTTGAGTGAATCCAAAAGTAAAGGCTCTGATCACATTGTGGCACAAACGTTTACATTCTCTGAGTTAGCTACTGCCACTAGAAACTTCAGAAAAGAATGTCTTATAGGAGAAGGAGGTTTTGGTAGAGTTTACAAAGGATACTTGGCCAGCACTAGCCAGACAGCGGCTATCAAGCAACTTGATCATAATGGTTTACAAGGAAACAGGGAGTTCCTTGTCGAGGTTCTCATGTTGAGTCTTCTTCATCACCCGAATCTTGTTAACTTAATAGGATATTGTGCTGATGGAGATCAAAGGCTTCTAGTCTACGAGTACATGCCCCTAGGTTCACTTGAAGATCATTTGCATGACATTTCACCTGGTAAGCAGCCACTTGACTGGAACACCAGAATGAAAATAGCTGCCGGTGCTGCAAAAGGATTGGAGTATCTGCATGACAAAACTATGCCTCCAGTGATCTATCGAGATTTGAAATGCTCAAATATTTTGCTCGATGATGATTACTTTCCAAAGCTATCCGACTTCGGGTTGGCTAAACTTGGCCCAGTGGGTGACAAGTCTCATGTGTCCACTCGTGTTATGGGAACATACGGATACTGTGCTCCCGAGTATGCAATGACAGGCCAACTAACACTCAAATCAGACGTTTACAGCTTCGGTGTTGTTCTGCTGGAGATTATAACTGGTAGGAAAGCAATAGACAGTTCAAGATCTACTGGAGAACAGAATCTAGTCGCATGGGCAAGGCCTTTGTTTAAAGACAGGATGAAATTCTCTCAAATGGCTGATCCAATGCTTCAAGGTCAATACCCTCCGCGAGGGTTATACCAAGCACTCGCTGTAGCAGCGATGTGCGTACAAGAGCAGCCAAATCTTAGACCTCTCATTGCTGACGTCGTCACTGCACTTTCTTACCTCGCCTCCCAAAAGTTTGATCCTCTGGCTCAGCCAGTCCAAGGATCCCTCTTCGCTCCCGGGACTCCACCTAGATCAAAGAGGGTCTGAAAATAATCCCGAGAACCGCAATGCTGTGTAAGTTATGTAGCTTAAACCCATTCCGTGCTGTCTTTCTTGGAGAGGAAAGGTGGATGATTTTCAGACTAAGTGTGAATGTATGGCTTAAGAGCTACTTGTAGATATGTGTAAGAAGAGATAGATTCATATAGAGGCCGGTTTATAATGTTGTTATAGGTGATGTTGTTTAATGTAATGTTTATTGAGCGCTTGCTTTCAAATGTGACAATTTCTCATTATTGTACTGAGGATGTCTGCTTCGATTCCAAAGTTATTGTATAAATATTAAAGTACTATAGTTTTC

SEQ ID NO: 1367 - DNA, 1517 bp, Arabidopsis thaliana
  misc_feature (1)..(1517): Ceres cDNA ID no. 12562827
  misc_feature (1)..(1517): Ceres CLONE  ID no. 104716
  misc_feature (1)..(1517): Also known as  Ceres CDNA ID no. 23449682
atttctaaaaaagattttttagtttgttctttcatggtgtgacatgatatcatacgtttatggaaatcttcagtctcattttggaaacagtttgtgtagatatggtgaagcaggaacaaacagaaacagagctgtgtccgaatcaaagccaaatcttcatagaatatctttataattcacatctctcccagtgaatccaaagacggatcttgaacaaacatgcgtggggtttggctttatctcaagaagtctcttagctgctgcaaggcacagaagtcaactgtagcttgtgatccagacaagatccaaattcagaagaaggagaatccatctggatgctcaagaagatcaatgtcgaatctgagagatgtctttgtaactaatggagatgaaggagctatgcagaatgtaagctgctgcagctcacggtctcttgagagctccaggtttgtaaacacagtgaaatttgaggagaatgcaggttattcagacagattcaaaggtttgcttagcggagcatcttcttctgatttacttcccggtcgttgttcagagagatttgatgttgttggctctgacatctgcggtttcggagttcttgcttgtcaaaaatgtcatgagagagtcagagatcttgacgcgtttgaagcacattacctctctaaccactctgtcgttagactcttagcaggagatttctcaagaacaactgtggaactaatctgcaacacaggctattctcacaagctaggcaaaatgaaagggaacaacatttcagcgatctttaaaatccagaacttgcagagagttgttgcagactttgaagattacagagagctcgtgaaaataagagcaaacaagctttcaaagaagcactctcgttgtatggctgatggcaacgagtttcttgggttccacggtacaactctttcttgcactctcggtttcagtaacagctcttcaaacctctgtttctcggatcactgtgaagtttgtcatattctaagacatggtttcagtcctaaaacaagaccagatgggataaaaggagttctcacagcatcaactagctctacagctcttgaatctatcgaaaccgatcaaggaagaaatagaggttcattgatagctgttgtgctatgtagagtgattgcagggagggttcataaacctatgcagacgtttgaaaattctttagggttttctgagtttgattcactagctttgaaagttggacaaaattcaagaattgaagagctttacctgttgagtacaaaagctttgttaccttgctttgtgataatcttcaagccatgaaacaagcccgtatatgcaaaatttattctttaggtttttgtatagttttctcatcttcttttttcttgcaaaatttggtgggcctgtaataggttaaaaatgttgggctttccccaaaattgaaagatggaaaacttgctggacaagtctatgcccagcctctatatttaaagggtgaagaagactgtaactgttagtgc

SEQ ID NO: 1368 - protein, 1517 aa, Arabidopsis thaliana
  misc_feature: PFam Name: zf-C2H2; PFam Description: Zinc finger, C2H2 type
  misc_feature: GI Number: 6554199; NR Description: T23J18.16 [Arabidopsis
  misc_feature: GI Number: 15220394; NR Description: zinc finger (C2H2 type)
  misc_feature: GI Number: 52076893; NR Description: zinc finger (C2H2 type) protein-like [Oryza sativa (japonica cultivar-group)] >gi|52076647|dbj|BAD45547.1| zinc finger (C2H2 type) protein-like
  misc_feature: GI Number: 9802582; NR Description: T2E6.3 [Arabidopsis thaliana]
  misc_feature: GI Number: 15222333; NR Description: zinc finger (C2H2 type) family protein [Arabidopsis thaliana] >gi|9369383|gb|AAF87132.1|
ATTTCTAAAAAAGATTTTTTAGTTTGTTCTTTCATGGTGTGACATGATATCATACGTTTATGGAAATCTTCAGTCTCATTTTGGAAACAGTTTGTGTAGATATGGTGAAGCAGGAACAAACAGAAACAGAGCTGTGTCCGAATCAAAGCCAAATCTTCATAGAATATCTTTATAATTCACATCTCTCCCAGTGAATCCAAAGACGGATCTTGAACAAACATGCGTGGGGTTTGGCTTTATCTCAAGAAGTCTCTTAGCTGCTGCAAGGCACAGAAGTCAACTGTAGCTTGTGATCCAGACAAGATCCAAATTCAGAAGAAGGAGAATCCATCTGGATGCTCAAGAAGATCAATGTCGAATCTGAGAGATGTCTTTGTAACTAATGGAGATGAAGGAGCTATGCAGAATGTAAGCTGCTGCAGCTCACGGTCTCTTGAGAGCTCCAGGTTTGTAAACACAGTGAAATTTGAGGAGAATGCAGGTTATTCAGACAGATTCAAAGGTTTGCTTAGCGGAGCATCTTCTTCTGATTTACTTCCCGGTCGTTGTTCAGAGAGATTTGATGTTGTTGGCTCTGACATCTGCGGTTTCGGAGTTCTTGCTTGTCAAAAATGTCATGAGAGAGTCAGAGATCTTGACGCGTTTGAAGCACATTACCTCTCTAACCACTCTGTCGTTAGACTCTTAGCAGGAGATTTCTCAAGAACAACTGTGGAACTAATCTGCAACACAGGCTATTCTCACAAGCTAGGCAAAATGAAAGGGAACAACATTTCAGCGATCTTTAAAATCCAGAACTTGCAGAGAGTTGTTGCAGACTTTGAAGATTACAGAGAGCTCGTGAAAATAAGAGCAAACAAGCTTTCAAAGAAGCACTCTCGTTGTATGGCTGATGGCAACGAGTTTCTTGGGTTCCACGGTACAACTCTTTCTTGCACTCTCGGTTTCAGTAACAGCTCTTCAAACCTCTGTTTCTCGGATCACTGTGAAGTTTGTCATATTCTAAGACATGGTTTCAGTCCTAAAACAAGACCAGATGGGATAAAAGGAGTTCTCACAGCATCAACTAGCTCTACAGCTCTTGAATCTATCGAAACCGATCAAGGAAGAAATAGAGGTTCATTGATAGCTGTTGTGCTATGTAGAGTGATTGCAGGGAGGGTTCATAAACCTATGCAGACGTTTGAAAATTCTTTAGGGTTTTCTGAGTTTGATTCACTAGCTTTGAAAGTTGGACAAAATTCAAGAATTGAAGAGCTTTACCTGTTGAGTACAAAAGCTTTGTTACCTTGCTTTGTGATAATCTTCAAGCCATGAAACAAGCCCGTATATGCAAAATTTATTCTTTAGGTTTTTGTATAGTTTTCTCATCTTCTTTTTTCTTGCAAAATTTGGTGGGCCTGTAATAGGTTAAAAATGTTGGGCTTTCCCCAAAATTGAAAGATGGAAAACTTGCTGGACAAGTCTATGCCCAGCCTCTATATTTAAAGGGTGAAGAAGACTGTAACTGTTAGTGC

SEQ ID NO: 1369 - DNA, 469 bp, Zea mays
  misc_feature (1)..(469): Ceres cDNA ID no. 12566085
  misc_feature (1)..(469): Ceres CLONE  ID no. 276106
  misc_feature (1)..(469): Also known as  Ceres CDNA ID no. 12566085
  misc_feature (164)..(164): n is a, c, t, g, unknown, or other
  misc_feature (165)..(165): n is a, c, t, g, unknown, or other
  misc_feature (244)..(244): n is a, c, t, g, unknown, or other
attgawatcaatcgtgttcctcgcctgcacgacgagagcccgagaccaatccagccgccgcctccgccttcgcctcgcctagtattccctccgattcagaggccgatggagtgcatcgccgagatgccccgcgcgccgctggacagcaggctgcgcaasktcannctcggctgggacgtcggccctgccgagatgtataaggccgtgcggcgcgggcacgggtgggacgtcggccccgccgagnatgtatcagttagaactttgtggacaagaagttgtgaatgccatcagtgctgcagcgttgggcctttcgtcgggctgtgtttcttctcaagtcaaacaagagcagcttcatgatggttcccctcctctgagagaagatgacagggatgggcattatgtttttgctgttggagataacctcacatctcgctataagatcaatgcaaaaatgggaraaggtaccttt

SEQ ID NO: 1370 - protein, 469 aa, Zea mays
ATTGAWATCAATCGTGTTCCTCGCCTGCACGACGAGAGCCCGAGACCAATCCAGCCGCCGCCTCCGCCTTCGCCTCGCCTAGTATTCCCTCCGATTCAGAGGCCGATGGAGTGCATCGCCGAGATGCCCCGCGCGCCGCTGGACAGCAGGCTGCGCAASKTCANNCTCGGCTGGGACGTCGGCCCTGCCGAGATGTATAAGGCCGTGCGGCGCGGGCACGGGTGGGACGTCGGCCCCGCCGAGNATGTATCAGTTAGAACTTTGTGGACAAGAAGTTGTGAATGCCATCAGTGCTGCAGCGTTGGGCCTTTCGTCGGGCTGTGTTTCTTCTCAAGTCAAACAAGAGCAGCTTCATGATGGTTCCCCTCCTCTGAGAGAAGATGACAGGGATGGGCATTATGTTTTTGCTGTTGGAGATAACCTCACATCTCGCTATAAGATCAATGCAAAAATGGGARAAGGTACCTTT

SEQ ID NO: 1371 - DNA, 1848 bp, Zea mays
  misc_feature (1)..(1848): Ceres cDNA ID no. 12566326
  misc_feature (1)..(1848): Ceres CLONE  ID no. 320219
  misc_feature (1)..(1848): Also known as  Ceres CDNA ID no. 23782623
gcacgagaccattacctagaacatcctaatcgaaaaacaatctttcttgtatcactaagctagtggccacaactcgttggcaacgaggaagcagcaataagccgagaagctatgccgccgccatatatggcacaggctgccggcaccgccgatgccactgatgaggctccactgctgctggcctcgtcggcggcggggtcgacgccgtcgccgccagctgcagcaccgcgccggaacaggttcgccttcgtctgcgccacgctcgcctccgtcaccaccatgctacatggctacaacctgacgctgatgagcggcgcggagctgttcatgcgggaggacgtggggctcaccgacggcgaggtcgaggtgctggcggggtccatgaacgtgttcatgctcgcgtccatcctcgccgccggctgagtggccgaccacctgggacgccgccgcaccctcgtgctcgccaacgccttcctcatggccggcgcgctcgccatgtcgctcggcaccagcttcgccgcgctcatggcggcgcgcttcgtcaccagcgtcggctccgggttcgcgcgcgtcgtcgcccccgtctacaacgccgagatatcgcaggcggctacgcgtggcgtcctctcatccatgctcgatatattcatcaacgtcggcatcctgctcagctacgtgtccaactacgcgttcgcgggcctcccggtgcacatcgggtggcgtctcatgtacgccgtcggcgtcatcccgcccgtgctcatcgccgccggggtgctcgtcatcatgccagagtcaccgcggtggctcgcgatgcagggccgccacgccgacgcgcgcgcggtgctgctgcgcacgtcggacagcccggcagacgccgacttccggctcggggagatcaagcgagccgccgacgcgccgtcgcccgctgctgcggcgcgccacggtggcggcggtgtctggagggagctcttcgtccggccatccaccacaaccacgagcgtgcggcgcatcctcggctgcgtcctcggcctgcagttcttcgtgcaggcgtccggcgtcgacgccatcctcctctacagcccgctggtcttcaaggcggtcggcgtggcgtccacctccgccgtgctcggcgccaccgtgtccatcggagccgtcaagacgtgcttcatcctcgtcgccatgctcttcaccgaccgcctcggccggcgcccgctcctcctcgccagcaccgccggcgtcgccgtgaccgtgaccgccctcgccgtgacgctgtgcgtgggcacggcgtcgccggcgacggccgcggcgtgcctggcgtccgtgctggccttcgtggccgcgtactccatcggctacgggtccgtggtgtcgacgtacagcgcggaggtcttgccgctacggctgcgcgcgcagggctccagcctgggcgtggccgtgaacaggctcacgtgcggggtggtcagcatgacgttcatctcgctcgccgacgccatcaccatgcccgggtgcttcttcctctacgctgcggtgacggcggctgcgtttgtgttcgtgtacacgcggctgccggagaccaagggccggagcctagaagacatggaagtgctcttccgcaagtgagggtggccggtggccacgtatagttgccattagcacaaggtcgcgtttggcagagttagtagaaattatccacaattaccagcagatttggaactccggtaccgcgcgctcgtcggtcgcaccgtcgcagtcgcagctacccccacggtcccacctagagatctcaacatcagatttaaacaccatatactacccatacctatgaagttatatctatctctatctccg

SEQ ID NO: 1372 - protein, 1848 aa, Zea mays
  misc_feature: PFam Name: Sugar_tr; PFam Description: Sugar (and other)
  misc_feature: GI Number: 51849627; NR Description: sorbitol transporter
  misc_feature: GI Number: 30025133; NR Description: putative sorbitol
  misc_feature: GI Number: 28316433; NR Description: sorbitol transporter
  misc_feature: GI Number: 9293909; NR Description: sugar transporter protein [Arabidopsis thaliana] >gi|15230212|ref|NP_188513.1| mannitol
  misc_feature: GI Number: 16118827; NR Description: putative sugar
GCACGAGACCATTACCTAGAACATCCTAATCGAAAAACAATCTTTCTTGTATCACTAAGCTAGTGGCCACAACTCGTTGGCAACGAGGAAGCAGCAATAAGCCGAGAAGCTATGCCGCCGCCATATATGGCACAGGCTGCCGGCACCGCCGATGCCACTGATGAGGCTCCACTGCTGCTGGCCTCGTCGGCGGCGGGGTCGACGCCGTCGCCGCCAGCTGCAGCACCGCGCCGGAACAGGTTCGCCTTCGTCTGCGCCACGCTCGCCTCCGTCACCACCATGCTACATGGCTACAACCTGACGCTGATGAGCGGCGCGGAGCTGTTCATGCGGGAGGACGTGGGGCTCACCGACGGCGAGGTCGAGGTGCTGGCGGGGTCCATGAACGTGTTCATGCTCGCGTCCATCCTCGCCGCCGGCTGAGTGGCCGACCACCTGGGACGCCGCCGCACCCTCGTGCTCGCCAACGCCTTCCTCATGGCCGGCGCGCTCGCCATGTCGCTCGGCACCAGCTTCGCCGCGCTCATGGCGGCGCGCTTCGTCACCAGCGTCGGCTCCGGGTTCGCGCGCGTCGTCGCCCCCGTCTACAACGCCGAGATATCGCAGGCGGCTACGCGTGGCGTCCTCTCATCCATGCTCGATATATTCATCAACGTCGGCATCCTGCTCAGCTACGTGTCCAACTACGCGTTCGCGGGCCTCCCGGTGCACATCGGGTGGCGTCTCATGTACGCCGTCGGCGTCATCCCGCCCGTGCTCATCGCCGCCGGGGTGCTCGTCATCATGCCAGAGTCACCGCGGTGGCTCGCGATGCAGGGCCGCCACGCCGACGCGCGCGCGGTGCTGCTGCGCACGTCGGACAGCCCGGCAGACGCCGACTTCCGGCTCGGGGAGATCAAGCGAGCCGCCGACGCGCCGTCGCCCGCTGCTGCGGCGCGCCACGGTGGCGGCGGTGTCTGGAGGGAGCTCTTCGTCCGGCCATCCACCACAACCACGAGCGTGCGGCGCATCCTCGGCTGCGTCCTCGGCCTGCAGTTCTTCGTGCAGGCGTCCGGCGTCGACGCCATCCTCCTCTACAGCCCGCTGGTCTTCAAGGCGGTCGGCGTGGCGTCCACCTCCGCCGTGCTCGGCGCCACCGTGTCCATCGGAGCCGTCAAGACGTGCTTCATCCTCGTCGCCATGCTCTTCACCGACCGCCTCGGCCGGCGCCCGCTCCTCCTCGCCAGCACCGCCGGCGTCGCCGTGACCGTGACCGCCCTCGCCGTGACGCTGTGCGTGGGCACGGCGTCGCCGGCGACGGCCGCGGCGTGCCTGGCGTCCGTGCTGGCCTTCGTGGCCGCGTACTCCATCGGCTACGGGTCCGTGGTGTCGACGTACAGCGCGGAGGTCTTGCCGCTACGGCTGCGCGCGCAGGGCTCCAGCCTGGGCGTGGCCGTGAACAGGCTCACGTGCGGGGTGGTCAGCATGACGTTCATCTCGCTCGCCGACGCCATCACCATGCCCGGGTGCTTCTTCCTCTACGCTGCGGTGACGGCGGCTGCGTTTGTGTTCGTGTACACGCGGCTGCCGGAGACCAAGGGCCGGAGCCTAGAAGACATGGAAGTGCTCTTCCGCAAGTGAGGGTGGCCGGTGGCCACGTATAGTTGCCATTAGCACAAGGTCGCGTTTGGCAGAGTTAGTAGAAATTATCCACAATTACCAGCAGATTTGGAACTCCGGTACCGCGCGCTCGTCGGTCGCACCGTCGCAGTCGCAGCTACCCCCACGGTCCCACCTAGAGATCTCAACATCAGATTTAAACACCATATACTACCCATACCTATGAAGTTATATCTATCTCTATCTCCG

SEQ ID NO: 1373 - DNA, 1544 bp, Zea mays
  misc_feature (1)..(1544): Ceres cDNA ID no. 12566452
  misc_feature (1)..(1544): Ceres CLONE  ID no. 283300
  misc_feature (1)..(1544): Also known as  Ceres CDNA ID no. 23770918
aagtacacagagatacaaatacagagaggcagagggcaggcggaggcaccatctccctcccttcttcatcgcccacacaagtcctctcatctcctctctgtttcgtgcaagaaacttccttggacaaagatgggagtgcagagttactacaggttattctgctgcgggtgcggcgccaatgcggcggccggcgaccgggaaggcgacgaggacgggggtttcgaggcgttcgccgacaagggggccgccgaagccgggccgcgggggctgtcgtgggcgcaggtggaggcgatgacgggcaggttcacctcggccgtcgtcggcgagggcgggttcagcaccgtgtacctcgcgcgcctctccggcggcgcgctggccgccgtcaaggtccaccgcagcagcgagcgcctccaccgcgtgttccgccaggagctcgacgcgctccgacgcgtccgccacccgcacatcgtccgcctccttgccttctgcgaccagcaagaggaaggcgtgctggtgctggagttcgcggcgaacgggaacctgcacgagcggctccacggcgggggcaaggcggcgggcacgatgccgtgggcgcggcgggtgtcggcggcgctgcaggtggcgcgggcgctcgagtacctgcacgaccgctgcgagccgcaggtggtgcacggcgacgtgaaggcctccaacgtgctcctggacgcggccatgtccgccaagctgtgcgacttcgggtcggcgcggacggggttctcggccgccgtgcgcccgcggccgtccgcgcgcaccgccatgctcggctccccggggtacgtcgacccgcactacatccgctcgggcgtcgtcaccaagaagaccgacgtgtacagcttcggcgtcctgctcctggagctcctcacggggatggaggccttctgcgcggaggagggcggccgcctcctcaccgccgccgtcgcgccgcggctcagggccggcgacccgccccgcgggatggtcgacgagaggctcggcaccgcctacgacgccgccgaggccgccgccgtggcggcgctggccgctgcctgtgtcggcgagaaccccagcctccggccgtccatggccgacgtggtgcgcaccctggagcagagcgcgcagggatccatctccgccgtggggatggcatcggacggtcactggaaggtgtgagtcaccagtggaaagtcgtcgcctccgccgacgcgctcagatctggctccccgagtcgttaacttgcggtgctcatgcgcatgcgtcgcgcacgtggcgcccatccattggttgcgaggagaacaaagcgttgttagtaggcgagcatatcaaaaagaaagaggggacaaaagcgtggtgaaaaaacgttgatttccatagctaaattaggggaagacttggggagataaaaaggcagagctaagttgtgtgctgatggggatttccatcatattatgccaaagcggcatctacttgagagagacaaaaaaaagagaggatctttgcagcgcacgattccaagattttgttgattc

SEQ ID NO: 1374 - protein, 1544 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 37536060; NR Description: putative receptor protein kinase [Oryza sativa (japonica cultivar-group)] >gi|13786470|gb|AAK39595.1| putative receptor protein kinase [Oryza
  misc_feature: GI Number: 50911268; NR Description: putative serine/threonine-specific protein kinase [Oryza sativa (japonica cultivar-group)] >gi|49388396|dbj|BAD25532.1| putative serine/threonine-specific protein kinase [Oryza sativa (japonica
  misc_feature: GI Number: 50252107; NR Description: serine/threonine-specific receptor protein kinase-like protein [Oryza sativa (japonica cultivar-group)] >gi|50251992|dbj|BAD27925.1| serine/threonine-specific receptor protein kinase-like protein
  misc_feature: GI Number: 42571731; NR Description: protein kinase family
  misc_feature: GI Number: 42562481; NR Description: protein kinase family
AAGTACACAGAGATACAAATACAGAGAGGCAGAGGGCAGGCGGAGGCACCATCTCCCTCCCTTCTTCATCGCCCACACAAGTCCTCTCATCTCCTCTCTGTTTCGTGCAAGAAACTTCCTTGGACAAAGATGGGAGTGCAGAGTTACTACAGGTTATTCTGCTGCGGGTGCGGCGCCAATGCGGCGGCCGGCGACCGGGAAGGCGACGAGGACGGGGGTTTCGAGGCGTTCGCCGACAAGGGGGCCGCCGAAGCCGGGCCGCGGGGGCTGTCGTGGGCGCAGGTGGAGGCGATGACGGGCAGGTTCACCTCGGCCGTCGTCGGCGAGGGCGGGTTCAGCACCGTGTACCTCGCGCGCCTCTCCGGCGGCGCGCTGGCCGCCGTCAAGGTCCACCGCAGCAGCGAGCGCCTCCACCGCGTGTTCCGCCAGGAGCTCGACGCGCTCCGACGCGTCCGCCACCCGCACATCGTCCGCCTCCTTGCCTTCTGCGACCAGCAAGAGGAAGGCGTGCTGGTGCTGGAGTTCGCGGCGAACGGGAACCTGCACGAGCGGCTCCACGGCGGGGGCAAGGCGGCGGGCACGATGCCGTGGGCGCGGCGGGTGTCGGCGGCGCTGCAGGTGGCGCGGGCGCTCGAGTACCTGCACGACCGCTGCGAGCCGCAGGTGGTGCACGGCGACGTGAAGGCCTCCAACGTGCTCCTGGACGCGGCCATGTCCGCCAAGCTGTGCGACTTCGGGTCGGCGCGGACGGGGTTCTCGGCCGCCGTGCGCCCGCGGCCGTCCGCGCGCACCGCCATGCTCGGCTCCCCGGGGTACGTCGACCCGCACTACATCCGCTCGGGCGTCGTCACCAAGAAGACCGACGTGTACAGCTTCGGCGTCCTGCTCCTGGAGCTCCTCACGGGGATGGAGGCCTTCTGCGCGGAGGAGGGCGGCCGCCTCCTCACCGCCGCCGTCGCGCCGCGGCTCAGGGCCGGCGACCCGCCCCGCGGGATGGTCGACGAGAGGCTCGGCACCGCCTACGACGCCGCCGAGGCCGCCGCCGTGGCGGCGCTGGCCGCTGCCTGTGTCGGCGAGAACCCCAGCCTCCGGCCGTCCATGGCCGACGTGGTGCGCACCCTGGAGCAGAGCGCGCAGGGATCCATCTCCGCCGTGGGGATGGCATCGGACGGTCACTGGAAGGTGTGAGTCACCAGTGGAAAGTCGTCGCCTCCGCCGACGCGCTCAGATCTGGCTCCCCGAGTCGTTAACTTGCGGTGCTCATGCGCATGCGTCGCGCACGTGGCGCCCATCCATTGGTTGCGAGGAGAACAAAGCGTTGTTAGTAGGCGAGCATATCAAAAAGAAAGAGGGGACAAAAGCGTGGTGAAAAAACGTTGATTTCCATAGCTAAATTAGGGGAAGACTTGGGGAGATAAAAAGGCAGAGCTAAGTTGTGTGCTGATGGGGATTTCCATCATATTATGCCAAAGCGGCATCTACTTGAGAGAGACAAAAAAAAGAGAGGATCTTTGCAGCGCACGATTCCAAGATTTTGTTGATTC

SEQ ID NO: 1375 - DNA, 1896 bp, Zea mays
  misc_feature (1)..(1896): Ceres cDNA ID no. 12566503
  misc_feature (1)..(1896): Ceres CLONE  ID no. 278548
  misc_feature (1)..(1896): Also known as  Ceres CDNA ID no. 23759638
accccggaccgacaaagcagagcacgcgctggcagccaagtgcacacagacacgtctctctgttcgttctcagcttgctatagcaacctctagtaggtagccatggagatggtcctggactggcgctcgctgggctccctgctggcgaccgtcgtggtgttccgcaccgcgctgcgtaacttcctgccgccggaggccgagatgctcctgcgccgcttcctcgcgtgggtcgccgccgcgttccgcccgcccagcgacaccatcctcatcgacgaggcggacgggcccacggggagcgccaacgacctctacgagtcggcgcagctctacctcagcgcgcgctgcctcgccaccgcgcccgccgtgcgcctgcacaagccgcgccagtcgccgcgccccgtggcgtcgctcccggactcgcacaccaccgacgacaccttccgcggggtccgcgtcaagtggacctccaccacgcgcaccgtcgaccgcagcggcagcggcggcggcggtaacccgtacaacatattcggccgcggcggcgaccagcgcggcctcgagctccagttcccgcgccagcaccgggacctcgtccaccaccactacatcccgcacctcatcgacgaggccacccggatgcggctcaagtcgcgggagcgccgcctctacaccaaccgcggccacggggccctgcgacgaccaccaccgcctctggacgtcgcacgccttcgcgcacccgtccacgttcgacacgctggcgctcgacccggcgctgcgcgacgaggtccgcgccgacctgctgcgcttcgccgcgcgccgggaccactacgcgcgcgtcggccgcgcctggaagcgggggtacctgctccacggcccgcccggcacgggcaagaccagcctcgtcgctgccatcgccaacctgctcgacttcgacgtctacgacctggagctcaccacggtgcccaccaactcccacctccgccgcctgctcgtctccaccacgcccaagtccgtcgtcgtcgtcgaggacatcgactgctccctcgacctctccgaccgcaacaagaagacaaagaagggtgctggcgtcggcgtcggcatcggcaccgccggcgacgaagacgccgcagcacagctcgccgtcatgtcggtgtcgccggtcgcggcggccgtgatggggcgcgagtccgtcagcctctccggggtgctcaacttcgtcgacgggctctggtcgtcctgcgtcggcgagcgcctgatggtgttcacgaccaaccacccggagcggctcgacccggcgctgctccgcccgggccgcatggaccgcaagatcgagctcggctactgcacgccgcccgcgctgcgtgtgctcgccaagaactacctcggcgtcggcgacgagggctgcgacgacgccgacgcggaccccgacacggtcaacgccctcatggcggaggccgagggcctgctcgccgccgccgaggtgcaaatcacacccgccgacatcgccgaggtgttcatgggctgcgacggcgcgggcgccgccgccgcgctgaggaagctcgtgggcgagctgcggcggaggcgggatgctgctgcccttgccacggccgtagcaccgccggaataaaaccagccagggatcctacgtagcgcgccaccatgcatagctgcctagtcagcttccattactttgatgctaggtggtttatttattgagtcgtgacggtgcaatgcgaagtgtcgtgtgtcaggtgtttcccttctcatttagtttgggttcgtgtttttgtgtcgtgctagtacgtacggatcccgtaggctaggcagccaataagccaataatggacgctgattacccaggcacaacaatactgttatatgacagagctcgcccattgc

SEQ ID NO: 1376 - protein, 1896 aa, Zea mays
  misc_feature: PFam Name: AAA; PFam Description: ATPase family associated
  misc_feature: PFam Name: Podocalyxin; PFam Description: Podocalyxin
  misc_feature: PFam Name: MAGE; PFam Description: MAGE family
  misc_feature: PFam Name: Mucin; PFam Description: Mucin-like glycoprotein
  misc_feature: PFam Name: Pyr_redox_2; PFam Description: Pyridine
  misc_feature: GI Number: 53793232; NR Description: AAA ATPase-like [Oryza
  misc_feature: GI Number: 53793233; NR Description: AAA-type ATPase-like
  misc_feature: GI Number: 50510118; NR Description: AAA-type ATPase-like
  misc_feature: GI Number: 50510113; NR Description: AAA-type ATPase-like
  misc_feature: GI Number: 61656797; NR Description: Cell Division Protein AAA ATPase family [Triticum turgidum] gi|61656792|emb|CAH10057.1|
ACCCCGGACCGACAAAGCAGAGCACGCGCTGGCAGCCAAGTGCACACAGACACGTCTCTCTGTTCGTTCTCAGCTTGCTATAGCAACCTCTAGTAGGTAGCCATGGAGATGGTCCTGGACTGGCGCTCGCTGGGCTCCCTGCTGGCGACCGTCGTGGTGTTCCGCACCGCGCTGCGTAACTTCCTGCCGCCGGAGGCCGAGATGCTCCTGCGCCGCTTCCTCGCGTGGGTCGCCGCCGCGTTCCGCCCGCCCAGCGACACCATCCTCATCGACGAGGCGGACGGGCCCACGGGGAGCGCCAACGACCTCTACGAGTCGGCGCAGCTCTACCTCAGCGCGCGCTGCCTCGCCACCGCGCCCGCCGTGCGCCTGCACAAGCCGCGCCAGTCGCCGCGCCCCGTGGCGTCGCTCCCGGACTCGCACACCACCGACGACACCTTCCGCGGGGTCCGCGTCAAGTGGACCTCCACCACGCGCACCGTCGACCGCAGCGGCAGCGGCGGCGGCGGTAACCCGTACAACATATTCGGCCGCGGCGGCGACCAGCGCGGCCTCGAGCTCCAGTTCCCGCGCCAGCACCGGGACCTCGTCCACCACCACTACATCCCGCACCTCATCGACGAGGCCACCCGGATGCGGCTCAAGTCGCGGGAGCGCCGCCTCTACACCAACCGCGGCCACGGGGCCCTGCGACGACCACCACCGCCTCTGGACGTCGCACGCCTTCGCGCACCCGTCCACGTTCGACACGCTGGCGCTCGACCCGGCGCTGCGCGACGAGGTCCGCGCCGACCTGCTGCGCTTCGCCGCGCGCCGGGACCACTACGCGCGCGTCGGCCGCGCCTGGAAGCGGGGGTACCTGCTCCACGGCCCGCCCGGCACGGGCAAGACCAGCCTCGTCGCTGCCATCGCCAACCTGCTCGACTTCGACGTCTACGACCTGGAGCTCACCACGGTGCCCACCAACTCCCACCTCCGCCGCCTGCTCGTCTCCACCACGCCCAAGTCCGTCGTCGTCGTCGAGGACATCGACTGCTCCCTCGACCTCTCCGACCGCAACAAGAAGACAAAGAAGGGTGCTGGCGTCGGCGTCGGCATCGGCACCGCCGGCGACGAAGACGCCGCAGCACAGCTCGCCGTCATGTCGGTGTCGCCGGTCGCGGCGGCCGTGATGGGGCGCGAGTCCGTCAGCCTCTCCGGGGTGCTCAACTTCGTCGACGGGCTCTGGTCGTCCTGCGTCGGCGAGCGCCTGATGGTGTTCACGACCAACCACCCGGAGCGGCTCGACCCGGCGCTGCTCCGCCCGGGCCGCATGGACCGCAAGATCGAGCTCGGCTACTGCACGCCGCCCGCGCTGCGTGTGCTCGCCAAGAACTACCTCGGCGTCGGCGACGAGGGCTGCGACGACGCCGACGCGGACCCCGACACGGTCAACGCCCTCATGGCGGAGGCCGAGGGCCTGCTCGCCGCCGCCGAGGTGCAAATCACACCCGCCGACATCGCCGAGGTGTTCATGGGCTGCGACGGCGCGGGCGCCGCCGCCGCGCTGAGGAAGCTCGTGGGCGAGCTGCGGCGGAGGCGGGATGCTGCTGCCCTTGCCACGGCCGTAGCACCGCCGGAATAAAACCAGCCAGGGATCCTACGTAGCGCGCCACCATGCATAGCTGCCTAGTCAGCTTCCATTACTTTGATGCTAGGTGGTTTATTTATTGAGTCGTGACGGTGCAATGCGAAGTGTCGTGTGTCAGGTGTTTCCCTTCTCATTTAGTTTGGGTTCGTGTTTTTGTGTCGTGCTAGTACGTACGGATCCCGTAGGCTAGGCAGCCAATAAGCCAATAATGGACGCTGATTACCCAGGCACAACAATACTGTTATATGACAGAGCTCGCCCATTGC

SEQ ID NO: 1377 - DNA, 1973 bp, Zea mays
  misc_feature (1)..(1973): Ceres cDNA ID no. 12567152
  misc_feature (1)..(1973): Ceres CLONE  ID no. 490001
  misc_feature (1)..(1973): Also known as  Ceres CDNA ID no. 23818672
  misc_feature (901)..(901): n is a, c, t, g, unknown, or other
  misc_feature (905)..(905): n is a, c, t, g, unknown, or other
  misc_feature (919)..(919): n is a, c, t, g, unknown, or other
  misc_feature (929)..(929): n is a, c, t, g, unknown, or other
  misc_feature (930)..(930): n is a, c, t, g, unknown, or other
  misc_feature (938)..(938): n is a, c, t, g, unknown, or other
  misc_feature (939)..(939): n is a, c, t, g, unknown, or other
  misc_feature (1108)..(1108): n is a, c, t, g, unknown, or other
  misc_feature (1143)..(1143): n is a, c, t, g, unknown, or other
  misc_feature (1276)..(1276): n is a, c, t, g, unknown, or other
aagggagaagggtacgttggtgatatcccgcgtccccagcgaggatgctgtcattgcgctgccacgccgccgcgccggcgacccgcggcgtcgcatgtgaacacggggcgcgttcatcgtttccacctaggcagagataaataagatctgcggaatcaagaagctctgtccaaggaggaagccagcggcacggcagtgccctcggcggtgatgaagtacgtctccgggccgtacttcgaaccggacttcgacccgctactcgaccgcttcggcaccccaggggtcgtcgtcgacaatgagacacgcgaggactgcacgctcgtcaaggttgacagcgtgaaccgggacggcgtgctgctggagatggtgcagctgctcaccgatctcgacctcgtcatctccaagtcgtacatctcctccgacggcggctggctcatggatgtgttccatgtgacggaccagatcgggcgcaagctgacggacccgtcgctgcccgagttcatccagcgcgcgctcgtgccgacccaccggccgggcaacggcccgtctccgaggttcaccacgtgcctgggcaacgtggtcgggccgggcggccccgacgtttcgggctgcgccgcgctcgagttcacggtgcacgaccgcccggggctcctgtcctccatcacgtccgtgctggccgacaacgggtgccacgtcgcgtccgggcaggcgtggacgcacaacggccgcgcggctggggtgctgtacgtgacggacaccgcgggcggcgccgcgctgctcccgggccggtgcgcgcgcatcgagcggctggtgaacgccgtggtggacgcgcgcgagaacgtgaccggggagcgccactgggtgcgcgtgtcggagcccgcgcagggccgcgtgcacacgnagcnccgcctgcaccaantcatgcacgnngacagggnntacgagtccggcccggccccgacccccgtcgacgaggacctcttcagcgtgggcgaaaaggcggcgaccgcgcggacggcccgccgcgccgtgacgcgggtgtccatcgacagctgggaggagcggggctacgccgtcgtcaagatgacgagcagggaccgccccaggntgctcttcgacacggtgtgcgcgctcaccgacatncagtacgtcgtcttccacgctaccgtcggatcccaggggcctcttgccattcaggagtattacatccggcacaaggacgggcgcacggtcgacaacagcgccgagaggcagaaggtctcccggtgcctcgtgnccgcggtggagcggagggccactcatgtcaggctcgaccattcctcgccgccatacttatcgggcgccgaccgccgcctcgttaaactaacacgcggccggcgttgaacgttgcagggcgtcagggtggaggtgcgcgccgccgaccggtcgggcttgctatcggatttcaccagggtgctgcgggagcacggcctgtcgctgctgagagttgagctcaagaggcacaaggacgaggccttcggcatattttacctcgtcacggacaccggaggcgaggtgcgcgctgagtcgttgcgcgccgtgcaggcgagggtcgccgagatggatatctcgctcgacgttgtgaaggaggcccctggctggccgccggtgaggaagactagcgtaccagccccgcccgccgccgggtctcagcctcaggagaggcccagaccttccctggggagcctcctatggtcacaccttgggaagctctcgaataacttcaacaacatcaggtcttgatacctgttcgcagaatgcacctgttgttctgcatagacgcttccattggtgcgtcggttccaataacttcctggacctcgagtaccaagaatttatgtcaggaagcagtacaaaactgtacataaagtgtatcagataaaagtaagcagagtgacgttcaatttatcaagaacttaggtgtgtttggttcg

SEQ ID NO: 1378 - protein, 1973 aa, Zea mays
  misc_feature: PFam Name: ACT; PFam Description: ACT domain
  misc_feature: PFam Name: HlyD; PFam Description: HlyD family secretion protein
  misc_feature: PFam Name: Peptidase_S8; PFam Description: Subtilase family
  misc_feature: GI Number: 50918431; NR Description: putative ACT domain containing protein [Oryza sativa (japonica cultivar-group)] >gi|28273389|gb|AAO38475.1| putative ACT domain containing protein
  misc_feature: GI Number: 21593552; NR Description: unknown [Arabidopsis thaliana]
  misc_feature: GI Number: 14532892; NR Description: putative uridylyl transferases [Arabidopsis thaliana] >gi|13430688|gb|AAK25966.1| putative uridylyl transferases [Arabidopsis thaliana] >gi|9759573|dbj|BAB11136.1| uridylyl transferases-like
  misc_feature: GI Number: 51964082; NR Description: PREDICTED P0470G10.34 gene product [Oryza sativa (japonica cultivar-group)] >gi|50909425|ref|XP_466201.1| putative ACT domain-containing protein [Oryza sativa (japonica cultivar-group)] [Oryza sativa
  misc_feature: GI Number: 22138098; NR Description: ACR4 [Arabidopsis thaliana] >gi|15221589|ref|NP_177067.1| ACT domain containing
AAGGGAGAAGGGTACGTTGGTGATATCCCGCGTCCCCAGCGAGGATGCTGTCATTGCGCTGCCACGCCGCCGCGCCGGCGACCCGCGGCGTCGCATGTGAACACGGGGCGCGTTCATCGTTTCCACCTAGGCAGAGATAAATAAGATCTGCGGAATCAAGAAGCTCTGTCCAAGGAGGAAGCCAGCGGCACGGCAGTGCCCTCGGCGGTGATGAAGTACGTCTCCGGGCCGTACTTCGAACCGGACTTCGACCCGCTACTCGACCGCTTCGGCACCCCAGGGGTCGTCGTCGACAATGAGACACGCGAGGACTGCACGCTCGTCAAGGTTGACAGCGTGAACCGGGACGGCGTGCTGCTGGAGATGGTGCAGCTGCTCACCGATCTCGACCTCGTCATCTCCAAGTCGTACATCTCCTCCGACGGCGGCTGGCTCATGGATGTGTTCCATGTGACGGACCAGATCGGGCGCAAGCTGACGGACCCGTCGCTGCCCGAGTTCATCCAGCGCGCGCTCGTGCCGACCCACCGGCCGGGCAACGGCCCGTCTCCGAGGTTCACCACGTGCCTGGGCAACGTGGTCGGGCCGGGCGGCCCCGACGTTTCGGGCTGCGCCGCGCTCGAGTTCACGGTGCACGACCGCCCGGGGCTCCTGTCCTCCATCACGTCCGTGCTGGCCGACAACGGGTGCCACGTCGCGTCCGGGCAGGCGTGGACGCACAACGGCCGCGCGGCTGGGGTGCTGTACGTGACGGACACCGCGGGCGGCGCCGCGCTGCTCCCGGGCCGGTGCGCGCGCATCGAGCGGCTGGTGAACGCCGTGGTGGACGCGCGCGAGAACGTGACCGGGGAGCGCCACTGGGTGCGCGTGTCGGAGCCCGCGCAGGGCCGCGTGCACACGNAGCNCCGCCTGCACCAANTCATGCACGNNGACAGGGNNTACGAGTCCGGCCCGGCCCCGACCCCCGTCGACGAGGACCTCTTCAGCGTGGGCGAAAAGGCGGCGACCGCGCGGACGGCCCGCCGCGCCGTGACGCGGGTGTCCATCGACAGCTGGGAGGAGCGGGGCTACGCCGTCGTCAAGATGACGAGCAGGGACCGCCCCAGGNTGCTCTTCGACACGGTGTGCGCGCTCACCGACATNCAGTACGTCGTCTTCCACGCTACCGTCGGATCCCAGGGGCCTCTTGCCATTCAGGAGTATTACATCCGGCACAAGGACGGGCGCACGGTCGACAACAGCGCCGAGAGGCAGAAGGTCTCCCGGTGCCTCGTGNCCGCGGTGGAGCGGAGGGCCACTCATGTCAGGCTCGACCATTCCTCGCCGCCATACTTATCGGGCGCCGACCGCCGCCTCGTTAAACTAACACGCGGCCGGCGTTGAACGTTGCAGGGCGTCAGGGTGGAGGTGCGCGCCGCCGACCGGTCGGGCTTGCTATCGGATTTCACCAGGGTGCTGCGGGAGCACGGCCTGTCGCTGCTGAGAGTTGAGCTCAAGAGGCACAAGGACGAGGCCTTCGGCATATTTTACCTCGTCACGGACACCGGAGGCGAGGTGCGCGCTGAGTCGTTGCGCGCCGTGCAGGCGAGGGTCGCCGAGATGGATATCTCGCTCGACGTTGTGAAGGAGGCCCCTGGCTGGCCGCCGGTGAGGAAGACTAGCGTACCAGCCCCGCCCGCCGCCGGGTCTCAGCCTCAGGAGAGGCCCAGACCTTCCCTGGGGAGCCTCCTATGGTCACACCTTGGGAAGCTCTCGAATAACTTCAACAACATCAGGTCTTGATACCTGTTCGCAGAATGCACCTGTTGTTCTGCATAGACGCTTCCATTGGTGCGTCGGTTCCAATAACTTCCTGGACCTCGAGTACCAAGAATTTATGTCAGGAAGCAGTACAAAACTGTACATAAAGTGTATCAGATAAAAGTAAGCAGAGTGACGTTCAATTTATCAAGAACTTAGGTGTGTTTGGTTCG

SEQ ID NO: 1379 - DNA, 1502 bp, Arabidopsis thaliana
  misc_feature (1)..(1502): Ceres cDNA ID no. 12574166
  misc_feature (1)..(1502): Ceres CLONE  ID no. 1190670
  misc_feature (1)..(1502): Also known as  Ceres CDNA ID no. 23651942
acaaatgttaagtgatttcatcaaagctctggtggatcattgcttctccaccaccaataccaatggcttccctttacctcaattccttacttccacttcctccttctcacccccagaaacttttagaaccttcttcttcctctttgttgagcacttctaatggtaacgaacttgctctgaagccgattgtcatcaatggagatccacccactttcgtctctgctcctgctcgtcgtatcgttgcagttggagaccttcatggcgatctgggtaaagccagagacgcacttcagttggctggcgtcttgagctccgacggacgagaccagtgggtcggccaagacaccgtactagttcaggtaggagatatacttgatcgcggtgatgatgaaatcgcaatactctccttattgaggtcacttgatgatcaggccaaggctaatggtggagctgttttccaggttaatgggaaccacgagacaatgaatgttgaaggggatttcagatatgtagatgcgagagcatttgatgagtgtactgattttcttgactacttggaggactatgcacaagactgggacaaagcgtttaggaattggatttttgagtcaagacaatggaaagaagataggaggagttctcaaacctattgggatcaatggaatgtagtaaagaggcaaaagggagtaattgcaaggtcggtccttctcagaccaggtggtcgtttagcatgtgaattgtcgcgtcacggagttattctccgtgttaataactggctcttctgccacggtggtctccttcctcaccatgttgcatacggcatagagaggataaacagagaagtctctacttggatgagaagccctactaactatgaagacagtcctcagatgccgttcattgcgactcgaggatatgacagtgtagtctggagccgactttactcaagagagacttctgagcttgaggactatcaaattgaacaggtaaataaaattcttcacgacactcttgaagctgtaggtgccaaagcgatggtggtcgggcatactccccagttatcaggggttaactgtgaatatggttgcggcatatggagagttgatgtaggaatgtccagtggtgttcttgactctagaccagaggttctggagataagaggggacaaagctagagtaataaggagcaaccgtgacagacttcatgaacttcaggttgcagattacatttaaaaaaaagaaccagactctcatgttcaagattcaaactttatcaccgtatttgtcatcatacacataataaagcatcagaaggtttcagtctttcagacaaggtccagatgcagttgagcgaggccatactttgaactctatgtacgtatctatgtatatatgtgtgtgaatcatcagatacaacatactatactcatcaagtaaaggttttgtatagcaaaaacactggttagtgttacttaaagagtggtgaaattctctggtttttat

SEQ ID NO: 1380 - protein, 1502 aa, Arabidopsis thaliana
  misc_feature: PFam Name: Metallophos; PFam Description: Calcineurin-like
  misc_feature: GI Number: 19310495; NR Description: At1g07010/F10K1_19
  misc_feature: GI Number: 23308175; NR Description: At1g18480/F15H18_1 [Arabidopsis thaliana] >gi|16226290|gb|AAL16125.1| At1g18480/F15H18_1 [Arabidopsis thaliana] >gi|18394613|ref|NP_564053.1| calcineurin-like phosphoesterase
  misc_feature: GI Number: 21536655; NR Description: unknown [Arabidopsis thaliana]
  misc_feature: GI Number: 58743497; NR Description: Putative [Brassica oleracea]
  misc_feature: GI Number: 25402861; NR Description: protein F15H18.4 [imported] - Arabidopsis thaliana >gi|6714305|gb|AAF26001.1|
ACAAATGTTAAGTGATTTCATCAAAGCTCTGGTGGATCATTGCTTCTCCACCACCAATACCAATGGCTTCCCTTTACCTCAATTCCTTACTTCCACTTCCTCCTTCTCACCCCCAGAAACTTTTAGAACCTTCTTCTTCCTCTTTGTTGAGCACTTCTAATGGTAACGAACTTGCTCTGAAGCCGATTGTCATCAATGGAGATCCACCCACTTTCGTCTCTGCTCCTGCTCGTCGTATCGTTGCAGTTGGAGACCTTCATGGCGATCTGGGTAAAGCCAGAGACGCACTTCAGTTGGCTGGCGTCTTGAGCTCCGACGGACGAGACCAGTGGGTCGGCCAAGACACCGTACTAGTTCAGGTAGGAGATATACTTGATCGCGGTGATGATGAAATCGCAATACTCTCCTTATTGAGGTCACTTGATGATCAGGCCAAGGCTAATGGTGGAGCTGTTTTCCAGGTTAATGGGAACCACGAGACAATGAATGTTGAAGGGGATTTCAGATATGTAGATGCGAGAGCATTTGATGAGTGTACTGATTTTCTTGACTACTTGGAGGACTATGCACAAGACTGGGACAAAGCGTTTAGGAATTGGATTTTTGAGTCAAGACAATGGAAAGAAGATAGGAGGAGTTCTCAAACCTATTGGGATCAATGGAATGTAGTAAAGAGGCAAAAGGGAGTAATTGCAAGGTCGGTCCTTCTCAGACCAGGTGGTCGTTTAGCATGTGAATTGTCGCGTCACGGAGTTATTCTCCGTGTTAATAACTGGCTCTTCTGCCACGGTGGTCTCCTTCCTCACCATGTTGCATACGGCATAGAGAGGATAAACAGAGAAGTCTCTACTTGGATGAGAAGCCCTACTAACTATGAAGACAGTCCTCAGATGCCGTTCATTGCGACTCGAGGATATGACAGTGTAGTCTGGAGCCGACTTTACTCAAGAGAGACTTCTGAGCTTGAGGACTATCAAATTGAACAGGTAAATAAAATTCTTCACGACACTCTTGAAGCTGTAGGTGCCAAAGCGATGGTGGTCGGGCATACTCCCCAGTTATCAGGGGTTAACTGTGAATATGGTTGCGGCATATGGAGAGTTGATGTAGGAATGTCCAGTGGTGTTCTTGACTCTAGACCAGAGGTTCTGGAGATAAGAGGGGACAAAGCTAGAGTAATAAGGAGCAACCGTGACAGACTTCATGAACTTCAGGTTGCAGATTACATTTAAAAAAAAGAACCAGACTCTCATGTTCAAGATTCAAACTTTATCACCGTATTTGTCATCATACACATAATAAAGCATCAGAAGGTTTCAGTCTTTCAGACAAGGTCCAGATGCAGTTGAGCGAGGCCATACTTTGAACTCTATGTACGTATCTATGTATATATGTGTGTGAATCATCAGATACAACATACTATACTCATCAAGTAAAGGTTTTGTATAGCAAAAACACTGGTTAGTGTTACTTAAAGAGTGGTGAAATTCTCTGGTTTTTAT

SEQ ID NO: 1381 - DNA, 1197 bp, Arabidopsis thaliana
  misc_feature (1)..(1197): Ceres cDNA ID no. 12574522
  misc_feature (1)..(1197): Ceres CLONE  ID no. 1190172
  misc_feature (1)..(1197): Also known as  Ceres CDNA ID no. 23457552
ggagtttttttttttccatttcttctcattctcaaattctctttcttagtttggttgttttgatgcagaaatcgactgagttcgtaacttgttgttgtctgatcttttaaagattcaaccttttttggtccgatcatggctgttgctgagaatgctggtgtcaaagtggactcttctggtcagaatttagacaacaacaacactgctgcttcagctaccgagacgacaaagccgccatgtcctgatgatgatcaaagccctaaatctgactcatccactcctcttaccatcgattcgactcctgaaactgacgatcggatcaatgagactgctcaaaaggttcagactttaaatgggtttagtggaaatggtgagagagataacaatggagagatcaaagatttggctgatgcgttttctaagcttaatccgatggctcaggagtttgttcctccttctcttgctcgaagtcaatctggggttttgagaaatggattagggtttactaacaattttgcagccccacctaaacttgctgatgggaatgatcattttcctagaaggagaaggagttttggccaagggaagcgaagaatgaacaaaaggacaagcttggctcagaaggatgatgtaatcaggagaactgtatatgtctctgacatcgaccaacaggttacagaggagaacctcgcaggtgtctttattaactgtggacaggttgttgattgtcgtgtatgcggtgatccaaattctgtccttcgtttcgctttcattgaatttaccaatgaagagggagctagagctgctttgagcatgtcgggtactgtgctaggtttttaccctcttaaggttcttccttccaaaacagctattgctcctgttaacccgacttttcttccacgatctgaggatgagcgtgagatgtgcgttaggactgtttactgtaccaacattgacaagcggatcactcaaattgacttgaaaggcttctttgaaatgctttgcggggaggttcatcgtctgaggcttggagactatcaccaccaaacccgtattgcttttgttgagtttgcgatggcggaaagcgcaattgctgcgcttcactgcagcggtattgtcttgggggcactcccaataagggtaagtccatcgaagacaccagtaaggccgcattttccccgcgctgagttcaagtga

SEQ ID NO: 1382 - protein, 1197 aa, Arabidopsis thaliana
  misc_feature: PFam Name: RRM_1; PFam Description: RNA recognition motif.
  misc_feature: GI Number: 6723409; NR Description: RNA-binding-like protein [Arabidopsis thaliana] >gi|11358815|pir||T45844 RNA-binding-like protein - Arabidopsis thaliana >gi|12324442|gb|AAG52182.1| putative RNA-binding protein; 38450-35693 [Arabidopsis thaliana]
  misc_feature: GI Number: 6714278; NR Description: F6N18.17 [Arabidopsis thaliana] gi|25403416|pir||F86452 protein F6N18.17 [imported] - Arabidopsis thaliana gi|15223304|ref|NP_174556.1| RNA-binding
  misc_feature: GI Number: 21592407; NR Description: RNA-binding protein [Arabidopsis thaliana] >gi|4539439|emb|CAB40027.1| RNA-binding protein [Arabidopsis thaliana] >gi|7267758|emb|CAB78184.1| RNA-binding protein [Arabidopsis thaliana]
  misc_feature: GI Number: 1174153; NR Description: RNA-binding protein
  misc_feature: GI Number: 50940511; NR Description: putative RNA-binding protein RBP37 [Oryza sativa (japonica cultivar-group)] >gi|50725622|dbj|BAD33089.1| putative RNA-binding protein RBP37
GGAGTTTTTTTTTTTCCATTTCTTCTCATTCTCAAATTCTCTTTCTTAGTTTGGTTGTTTTGATGCAGAAATCGACTGAGTTCGTAACTTGTTGTTGTCTGATCTTTTAAAGATTCAACCTTTTTTGGTCCGATCATGGCTGTTGCTGAGAATGCTGGTGTCAAAGTGGACTCTTCTGGTCAGAATTTAGACAACAACAACACTGCTGCTTCAGCTACCGAGACGACAAAGCCGCCATGTCCTGATGATGATCAAAGCCCTAAATCTGACTCATCCACTCCTCTTACCATCGATTCGACTCCTGAAACTGACGATCGGATCAATGAGACTGCTCAAAAGGTTCAGACTTTAAATGGGTTTAGTGGAAATGGTGAGAGAGATAACAATGGAGAGATCAAAGATTTGGCTGATGCGTTTTCTAAGCTTAATCCGATGGCTCAGGAGTTTGTTCCTCCTTCTCTTGCTCGAAGTCAATCTGGGGTTTTGAGAAATGGATTAGGGTTTACTAACAATTTTGCAGCCCCACCTAAACTTGCTGATGGGAATGATCATTTTCCTAGAAGGAGAAGGAGTTTTGGCCAAGGGAAGCGAAGAATGAACAAAAGGACAAGCTTGGCTCAGAAGGATGATGTAATCAGGAGAACTGTATATGTCTCTGACATCGACCAACAGGTTACAGAGGAGAACCTCGCAGGTGTCTTTATTAACTGTGGACAGGTTGTTGATTGTCGTGTATGCGGTGATCCAAATTCTGTCCTTCGTTTCGCTTTCATTGAATTTACCAATGAAGAGGGAGCTAGAGCTGCTTTGAGCATGTCGGGTACTGTGCTAGGTTTTTACCCTCTTAAGGTTCTTCCTTCCAAAACAGCTATTGCTCCTGTTAACCCGACTTTTCTTCCACGATCTGAGGATGAGCGTGAGATGTGCGTTAGGACTGTTTACTGTACCAACATTGACAAGCGGATCACTCAAATTGACTTGAAAGGCTTCTTTGAAATGCTTTGCGGGGAGGTTCATCGTCTGAGGCTTGGAGACTATCACCACCAAACCCGTATTGCTTTTGTTGAGTTTGCGATGGCGGAAAGCGCAATTGCTGCGCTTCACTGCAGCGGTATTGTCTTGGGGGCACTCCCAATAAGGGTAAGTCCATCGAAGACACCAGTAAGGCCGCATTTTCCCCGCGCTGAGTTCAAGTGA

SEQ ID NO: 1383 - DNA, 2128 bp, Arabidopsis thaliana
  misc_feature (1)..(2128): Ceres cDNA ID no. 12574549
  misc_feature (1)..(2128): Ceres CLONE  ID no. 1186388
  misc_feature (1)..(2128): Also known as  Ceres CDNA ID no. 23652321
aaaaaactgaaacttggtggagcttttatcattcactcatcaatggtggctggtaaggttcgtgtaacaatgggttttcacaaatcaccttctactaaaaaaaccaaagacatgccttctcctttacctcttcctcctcctcctcctcctccacttaaaccaccttcttccggttccgctactactaaaccaccgattaatcctagtaaaccgggtttcactcgctctttcggtgtttatttcccacgcgcttccgctcaagttcacgccactgctgctgctgcttctcataacggcgtcgtttctgagcttcgtcgtcaagtcgaggagcttcgtgagagagaagctctgttgaaaacagagaatctcgaggtcaagcttcttagagaatctgtttctgttattccgttgcttgaatcgcagatcgctgataagaacggcgaaatcgatgagcttaggaaagagacggcgagattagcggaggacaacgagagattacggcgagaatttgaccggagcgaggaaatgaggagagagtgtgagacgagggagaaggaaatggaggcggagattgttgagcttcggaaacttgtttcgtcggagagtgacgaccacgcgctctctgtttctcagaggtttcagggtttaatggatgtgtcggcgaaatctaacctaatcagaagtttaaaacgggtcgggtcgttgaggaatttacccgaaccgattacgaatcaagagaataccaacaagagcatttcatcatccggagacgccgacggcgacatttatcggaaagacgagatcgagagttattcacggagtagtaactcggaggaactcactgagtcatcgtctctctcaaccgtcagatctagagttccgagagtccctaaaccaccgccgaaacggtctatttcgttaggtgattccacggagaacagagcagacccgccaccgcagaaatcgattccgcctcctcctcctccacctccgccaccgcttcttcaacaaccaccaccacctccgtctgtttccaaagctcctcctccgcctcctccaccaccgccgccgaagagtttaagcattgcgtcggcgaaagtgagaagagtaccggaagtggttgagttttatcactcgttgatgcgaagagactccacaaactcgagaagagattccaccggcggtggaaacgccgccgcggaagcaatacttgctaactccaacgccagagacatgatcggagaaatcgaaaaccgatcggtttatctcctcgcgataaaaaccgacgtagaaacgcaaggagatttcataaggttcttgatcaaagaagtcggaaacgctgcgttttcagacattgaagacgttgttcctttcgtcaaatggctcgacgacgaactctcttacctggttgatgagagagcagtgttgaaacatttcgagtggccggagcaaaaagctgatgctttacgtgaagcagcgttttgttatttcgatctaaagaaactcatatcagaagcttctcgtttccgggaagatcctcgtcaatcttctagctctgctcttaagaaaatgcaagctttgtttgaaaagttagagcatggtgtttatagtctttcgaggatgagagaatcggcggcaacaaaattcaagagtttccagattccggttgattggatgctcgaaaccggtattactagccagattaaactggcatccgtgaaactagcgatgaagtatatgaagagagtatccgcagagctagaggctattgaaggtggtggccctgaagaggaagagctaattgtccaaggtgttcgattcgcattccgtgttcatcagtttgccggaggatttgatgcagaaacaatgaaggcatttgaagagctaagagataaagcaagatcatgtcatgttcagtgtcaaagccaaacacatcaacataaactttgttttcgatctaccccttgttaaagaagcaatcttagcttcatatataatccacctcttgttgtcattttctcgatttaatttgtttttttgttctttcgtcttaaaagacctataactcttgtgaatatacgttctcgatcgtcttgctgaaaaaggattaaaacagttgatattcaaa

SEQ ID NO: 1384 - protein, 2128 aa, Arabidopsis thaliana
  misc_feature: PFam Name: Extensin_2; PFam Description: Extensin-like region
  misc_feature: PFam Name: FH2; PFam Description: Formin Homology 2 Domain
  misc_feature: PFam Name: GATase_2; PFam Description: Glutamine
  misc_feature: PFam Name: LMBR1; PFam Description: LMBR1-like membrane protein
  misc_feature: PFam Name: Drf_FH1; PFam Description: Formin Homology Region 1
  misc_feature: GI Number: 22135814; NR Description: AT4g18560/F28J12_220 [Arabidopsis thaliana] >gi|28416477|gb|AAO42769.1| At4g18560/F28J12_220 [Arabidopsis thaliana] >gi|30684447|ref|NP_193591.2| proline-rich family protein
  misc_feature: GI Number: 34911862; NR Description: pherophorin - like protein [Oryza sativa (japonica cultivar-group)] >gi|19571144|dbj|BAB86567.1| pherophorin - like protein [Oryza
  misc_feature: GI Number: 50940793; NR Description: proline-rich protein family-like [Oryza sativa (japonica cultivar-group)] >gi|29467527|dbj|BAC66716.1| proline-rich protein family-like
  misc_feature: GI Number: 55297080; NR Description: pherophorin-like protein
  misc_feature: GI Number: 8778962; NR Description: F11A17.16 [Arabidopsis thaliana] >gi|25405258|pir||G96522 F11A17.16 [imported] - Arabidopsis thaliana >gi|18402131|ref|NP_564524.1| hydroxyproline-rich glycoprotein family protein [Arabidopsis
AAAAAACTGAAACTTGGTGGAGCTTTTATCATTCACTCATCAATGGTGGCTGGTAAGGTTCGTGTAACAATGGGTTTTCACAAATCACCTTCTACTAAAAAAACCAAAGACATGCCTTCTCCTTTACCTCTTCCTCCTCCTCCTCCTCCTCCACTTAAACCACCTTCTTCCGGTTCCGCTACTACTAAACCACCGATTAATCCTAGTAAACCGGGTTTCACTCGCTCTTTCGGTGTTTATTTCCCACGCGCTTCCGCTCAAGTTCACGCCACTGCTGCTGCTGCTTCTCATAACGGCGTCGTTTCTGAGCTTCGTCGTCAAGTCGAGGAGCTTCGTGAGAGAGAAGCTCTGTTGAAAACAGAGAATCTCGAGGTCAAGCTTCTTAGAGAATCTGTTTCTGTTATTCCGTTGCTTGAATCGCAGATCGCTGATAAGAACGGCGAAATCGATGAGCTTAGGAAAGAGACGGCGAGATTAGCGGAGGACAACGAGAGATTACGGCGAGAATTTGACCGGAGCGAGGAAATGAGGAGAGAGTGTGAGACGAGGGAGAAGGAAATGGAGGCGGAGATTGTTGAGCTTCGGAAACTTGTTTCGTCGGAGAGTGACGACCACGCGCTCTCTGTTTCTCAGAGGTTTCAGGGTTTAATGGATGTGTCGGCGAAATCTAACCTAATCAGAAGTTTAAAACGGGTCGGGTCGTTGAGGAATTTACCCGAACCGATTACGAATCAAGAGAATACCAACAAGAGCATTTCATCATCCGGAGACGCCGACGGCGACATTTATCGGAAAGACGAGATCGAGAGTTATTCACGGAGTAGTAACTCGGAGGAACTCACTGAGTCATCGTCTCTCTCAACCGTCAGATCTAGAGTTCCGAGAGTCCCTAAACCACCGCCGAAACGGTCTATTTCGTTAGGTGATTCCACGGAGAACAGAGCAGACCCGCCACCGCAGAAATCGATTCCGCCTCCTCCTCCTCCACCTCCGCCACCGCTTCTTCAACAACCACCACCACCTCCGTCTGTTTCCAAAGCTCCTCCTCCGCCTCCTCCACCACCGCCGCCGAAGAGTTTAAGCATTGCGTCGGCGAAAGTGAGAAGAGTACCGGAAGTGGTTGAGTTTTATCACTCGTTGATGCGAAGAGACTCCACAAACTCGAGAAGAGATTCCACCGGCGGTGGAAACGCCGCCGCGGAAGCAATACTTGCTAACTCCAACGCCAGAGACATGATCGGAGAAATCGAAAACCGATCGGTTTATCTCCTCGCGATAAAAACCGACGTAGAAACGCAAGGAGATTTCATAAGGTTCTTGATCAAAGAAGTCGGAAACGCTGCGTTTTCAGACATTGAAGACGTTGTTCCTTTCGTCAAATGGCTCGACGACGAACTCTCTTACCTGGTTGATGAGAGAGCAGTGTTGAAACATTTCGAGTGGCCGGAGCAAAAAGCTGATGCTTTACGTGAAGCAGCGTTTTGTTATTTCGATCTAAAGAAACTCATATCAGAAGCTTCTCGTTTCCGGGAAGATCCTCGTCAATCTTCTAGCTCTGCTCTTAAGAAAATGCAAGCTTTGTTTGAAAAGTTAGAGCATGGTGTTTATAGTCTTTCGAGGATGAGAGAATCGGCGGCAACAAAATTCAAGAGTTTCCAGATTCCGGTTGATTGGATGCTCGAAACCGGTATTACTAGCCAGATTAAACTGGCATCCGTGAAACTAGCGATGAAGTATATGAAGAGAGTATCCGCAGAGCTAGAGGCTATTGAAGGTGGTGGCCCTGAAGAGGAAGAGCTAATTGTCCAAGGTGTTCGATTCGCATTCCGTGTTCATCAGTTTGCCGGAGGATTTGATGCAGAAACAATGAAGGCATTTGAAGAGCTAAGAGATAAAGCAAGATCATGTCATGTTCAGTGTCAAAGCCAAACACATCAACATAAACTTTGTTTTCGATCTACCCCTTGTTAAAGAAGCAATCTTAGCTTCATATATAATCCACCTCTTGTTGTCATTTTCTCGATTTAATTTGTTTTTTTGTTCTTTCGTCTTAAAAGACCTATAACTCTTGTGAATATACGTTCTCGATCGTCTTGCTGAAAAAGGATTAAAACAGTTGATATTCAAA

SEQ ID NO: 1385 - DNA, 2391 bp, Arabidopsis thaliana
  misc_feature (1)..(2391): Ceres cDNA ID no. 12574947
  misc_feature (1)..(2391): Ceres CLONE  ID no. 1189286
  misc_feature (1)..(2391): Also known as  Ceres CDNA ID no. 23652505
gagagcaaagacttgacctttttcacttccttctcactgatcgtcgaacaataaggccgtcgcatctcccagttatggctatggccggagaatcttccggcaaaaaaattggagactgtgacggtaaagtcgcggggaacagacagcgaaaggtgggtcttatttacgacgagacgatgtgcaaacacgacacacctgacggcgaggatcaccctgagtgtcccgaccgcatcagagttatctgggagaagcttcagctcgccggagtttctcaaagatgtgtggttcttggtagtagcaaagcagaagataagcatctccaattggttcacacaaaggaccatgttaatttagttaagagtattagcacaaaacagaaagattatcggagaaacaggattgcttcacagttgaattcgatttatctgaatggaggttcatctgaagccgcatatcttgcagctggttctgttgtaaagttggcagaaaaagttgcagaaggagagttagattgtggttttgctattgtcaggcccccagggcaccatgctgaggcagatgaagccatgggtttttgtttattcaacaatgttgccgttgctgctagttttttactaaacgaaagaccggatctaggggtcaagaaaattctgatcgttgattgggatgtccatcacggaaatggtacccagaagatgttttggaaagatcctcgtgtactatttttctctgttcataggcatgagtatgggggtttctatccagcgggtgatgatggcgattataacatggttggggaaggtccaggtgaagggtttaacataaatgttccatgggatcaaggacgatgtggagatgcagattatcttgctgcatgggaccatatcttgattcctgtggcgagggaatttaacccggatgttatttttctttcagctggatttgatgcagctattaatgatccgctagggggttgttgtgtgaccccatatggatattcagttatgttgaagaagctgatggagtttgcacaaggaaagatagtgctggcgttagagggagggtacaatcttgactcaattgcaaagtcttcacttgcatgtgtccaagttttgcttgaagacaaacaaattcaaggacctccggaagcatacccattcgagtcgacatggcgtgtcatacaagcggtgcgcaagaggctatgcacatattggccttcacttgcagatgaattatcgtggaagctaattaatcagaaaactcctactccaatcatccttatctcaagctccgactctgaaactgaagacaacgcccaaggactcctggatcaaatgtcgaaactcagcattgaaaaccctcaaggtacactacttgaaaaccaccaagtagaacctgcatctacatcttggagagctgatctcgcaaaggttgacgtttggtatgcctcttttggatccaacatgtggaaaccaaggtttctttgctatattcaagggggacaggtcgatggattgaaaaaggtatgtgttggctcaatggataaaagtccaccaaaggaaacagtgtgggaaacatttccacatagattgttctttggccgtgaatcttcagttggttggggtgtaggaggagttgctttcaccaacccccttgctaatctcattgatcaaactcacatgtgtttgtaccgtatcacgcttgagcagttcaatgacgttctgtctcaagaaaatggtttgaatgtggattcagattctccggtctttgatctagctgctttgcagttagtagataacaaaggatccattttagaagctcctttgaatagttggtatggaaatgttgtctgcttgggaaaagaacgcgacattcctatacttacaatgacttgcacgctttccgctgttgagaaattcaaatccggtgagatccctataagacctcctgcaaaagcttatgccaacactttaataaggggacttgtggaaggaggaagattatctaaagaagaagctgaggcttacatagacaaggctgtgtctaaacctctctagtgtataattatttactcagaaaccgcccgtttgaacacgatttggagcttcgggtttctgagttattcaattaggataaaaaccacaagtttaggaatattgtgagacctttgaatttgtcttttgaaagagaggactgtgtcctctgttagctgtgttgtgcttgctccctaagcaaactctcaatgtattttagttatcttcgggttttaggctttaccaagaagctgtattcggtaaatgtattaaagaaccctccaaactgctttatattgaccggagagaaacattcttattcttcggaatggtactttgaagtttgaagagttatttt

SEQ ID NO: 1386 - protein, 2391 aa, Arabidopsis thaliana
  misc_feature: PFam Name: Hist_deacetyl; PFam Description: Histone
  misc_feature: GI Number: 32968028; NR Description: HDA1 [Zea mays]
  misc_feature: GI Number: 21105769; NR Description: HDA18 [Arabidopsis thaliana] >gi|22327996|ref|NP_200915.2| histone deacetylase family
  misc_feature: GI Number: 23197730; NR Description: histone deacetylase-like protein [Arabidopsis thaliana] >gi|20259320|gb|AAM13986.1| putative histone deacetylase [Arabidopsis thaliana] >gi|21539579|gb|AAM53342.1| histone deacetylase-like protein
  misc_feature: GI Number: 50939065; NR Description: putative histone deacetylase [Oryza sativa (japonica cultivar-group)] >gi|34394912|dbj|BAC84464.1| putative histone deacetylase [Oryza
  misc_feature: GI Number: 34933421; NR Description: histone deacetylase 6
GAGAGCAAAGACTTGACCTTTTTCACTTCCTTCTCACTGATCGTCGAACAATAAGGCCGTCGCATCTCCCAGTTATGGCTATGGCCGGAGAATCTTCCGGCAAAAAAATTGGAGACTGTGACGGTAAAGTCGCGGGGAACAGACAGCGAAAGGTGGGTCTTATTTACGACGAGACGATGTGCAAACACGACACACCTGACGGCGAGGATCACCCTGAGTGTCCCGACCGCATCAGAGTTATCTGGGAGAAGCTTCAGCTCGCCGGAGTTTCTCAAAGATGTGTGGTTCTTGGTAGTAGCAAAGCAGAAGATAAGCATCTCCAATTGGTTCACACAAAGGACCATGTTAATTTAGTTAAGAGTATTAGCACAAAACAGAAAGATTATCGGAGAAACAGGATTGCTTCACAGTTGAATTCGATTTATCTGAATGGAGGTTCATCTGAAGCCGCATATCTTGCAGCTGGTTCTGTTGTAAAGTTGGCAGAAAAAGTTGCAGAAGGAGAGTTAGATTGTGGTTTTGCTATTGTCAGGCCCCCAGGGCACCATGCTGAGGCAGATGAAGCCATGGGTTTTTGTTTATTCAACAATGTTGCCGTTGCTGCTAGTTTTTTACTAAACGAAAGACCGGATCTAGGGGTCAAGAAAATTCTGATCGTTGATTGGGATGTCCATCACGGAAATGGTACCCAGAAGATGTTTTGGAAAGATCCTCGTGTACTATTTTTCTCTGTTCATAGGCATGAGTATGGGGGTTTCTATCCAGCGGGTGATGATGGCGATTATAACATGGTTGGGGAAGGTCCAGGTGAAGGGTTTAACATAAATGTTCCATGGGATCAAGGACGATGTGGAGATGCAGATTATCTTGCTGCATGGGACCATATCTTGATTCCTGTGGCGAGGGAATTTAACCCGGATGTTATTTTTCTTTCAGCTGGATTTGATGCAGCTATTAATGATCCGCTAGGGGGTTGTTGTGTGACCCCATATGGATATTCAGTTATGTTGAAGAAGCTGATGGAGTTTGCACAAGGAAAGATAGTGCTGGCGTTAGAGGGAGGGTACAATCTTGACTCAATTGCAAAGTCTTCACTTGCATGTGTCCAAGTTTTGCTTGAAGACAAACAAATTCAAGGACCTCCGGAAGCATACCCATTCGAGTCGACATGGCGTGTCATACAAGCGGTGCGCAAGAGGCTATGCACATATTGGCCTTCACTTGCAGATGAATTATCGTGGAAGCTAATTAATCAGAAAACTCCTACTCCAATCATCCTTATCTCAAGCTCCGACTCTGAAACTGAAGACAACGCCCAAGGACTCCTGGATCAAATGTCGAAACTCAGCATTGAAAACCCTCAAGGTACACTACTTGAAAACCACCAAGTAGAACCTGCATCTACATCTTGGAGAGCTGATCTCGCAAAGGTTGACGTTTGGTATGCCTCTTTTGGATCCAACATGTGGAAACCAAGGTTTCTTTGCTATATTCAAGGGGGACAGGTCGATGGATTGAAAAAGGTATGTGTTGGCTCAATGGATAAAAGTCCACCAAAGGAAACAGTGTGGGAAACATTTCCACATAGATTGTTCTTTGGCCGTGAATCTTCAGTTGGTTGGGGTGTAGGAGGAGTTGCTTTCACCAACCCCCTTGCTAATCTCATTGATCAAACTCACATGTGTTTGTACCGTATCACGCTTGAGCAGTTCAATGACGTTCTGTCTCAAGAAAATGGTTTGAATGTGGATTCAGATTCTCCGGTCTTTGATCTAGCTGCTTTGCAGTTAGTAGATAACAAAGGATCCATTTTAGAAGCTCCTTTGAATAGTTGGTATGGAAATGTTGTCTGCTTGGGAAAAGAACGCGACATTCCTATACTTACAATGACTTGCACGCTTTCCGCTGTTGAGAAATTCAAATCCGGTGAGATCCCTATAAGACCTCCTGCAAAAGCTTATGCCAACACTTTAATAAGGGGACTTGTGGAAGGAGGAAGATTATCTAAAGAAGAAGCTGAGGCTTACATAGACAAGGCTGTGTCTAAACCTCTCTAGTGTATAATTATTTACTCAGAAACCGCCCGTTTGAACACGATTTGGAGCTTCGGGTTTCTGAGTTATTCAATTAGGATAAAAACCACAAGTTTAGGAATATTGTGAGACCTTTGAATTTGTCTTTTGAAAGAGAGGACTGTGTCCTCTGTTAGCTGTGTTGTGCTTGCTCCCTAAGCAAACTCTCAATGTATTTTAGTTATCTTCGGGTTTTAGGCTTTACCAAGAAGCTGTATTCGGTAAATGTATTAAAGAACCCTCCAAACTGCTTTATATTGACCGGAGAGAAACATTCTTATTCTTCGGAATGGTACTTTGAAGTTTGAAGAGTTATTTT

SEQ ID NO: 1387 - DNA, 1882 bp, Arabidopsis thaliana
  misc_feature (1)..(1882): Ceres cDNA ID no. 12575282
  misc_feature (1)..(1882): Ceres CLONE  ID no. 1193374
  misc_feature (1)..(1882): Also known as  Ceres CDNA ID no. 12575282
tctctctctcttctgagatttttccgtcgaaatattaaaaagaaatttgcagatacagaacttgttctaatctctctctgttttttttccctatgaattttatataatacgaaagagacacacaacactgtattatctttgcttctctcttctctctctttctatctctacagagtaaagttctgatcgtgtctcttatcgtttacccaaaaacccttgtttgatctctcgtctcttgttttcttctgccctcgaagttttcaggttatgtggtggaggttgtttccaatttaaagtatgtacctttaggttagaaattaggcttatttgtttctccagtgggtttcattgtagaaacaaattgaattttaggtgttaatgtgagattaggaaacagaatctctgcttttaacaaggtaataggagaatagggtttagtagaagaaaggttaaaactttgtgatgggtaataagttgggaaggaagaggcaagtggtggaagaaaggtatacaaagcctcaaggtttgtatgtgaataaagatgtcgacgttaaaaagctcagaaaactgattgtggagtctaagcttgctccttgctatcctggagacgatgaaagctgtcatgatcttgaagaatgtccaatttgttttctgtactatcctagcctcaatagatcaagatgttgcatgaaaagcatttgtacagagtgttttttgcaaatgaagaatcctaattcagctcggcctactcagtgccctttttgtaaaactcccaactatgctgtcgagtatcgtggagtcaagtcaaaggaggaaaagggcattgaacaagttgaagagcaacgggtaatagaagccaaaataaggatgaggcagaaagaaatgcaggatgatgaagagaaaatgcagaaacgtcttgaatcatgttcctctagcacaagcgcaatgactggcgagatggaatatggttcaacttcagccatatcttataactccctcatggatgacggggaaattgctccatcgcagaacgcatctgttgttagacaacattcccgcccgcgaggaaacagggaggatgaggttgacgttgaccttgaggaattgatggtcatggaagcaatatggctctctgttcaggaaacagggacgcagagaaattcagcttcaggggaaattacctcttctaggcagtatgtaacagataatcatagttatgtttcttcaccaccacgagtgactccaatcgtagaaccagcaacaccgtcttcatcatctggtgggctttcttgtgcaatctccgcacttgctgaacgccaaatggttggcgaatcctccagtcacaatcataatcacaatgtcaacgtttcttcatacagtatgcttcccggaaattgtgacagttactacgacatagaacaagaggtagatggcatagacaaccatcatcatcatcgtcatcattacgagatgggagaaacaggaagcagcaacagctatgtaagttcttacatgacaggcgagggcttccacaactttcctcctcctccacctctggtcattgttccagagagttttgaggaacagatgatgatggctatggctgtgtctatggcagaggttcatgccacgacgacatgtgcaccaactgaagttacctggcaataaataggataataatggaaactcatgggtctgaatctgatgatgattataacttcattcatatatgtctgttcctataggaagaaagaaaagaaacgaaatgatttccagttttaatagaaaaaggttgggttgtgttacagcttctttaattctttgtggttcttctttttcaatctgcattgacaaaaaatttgaagatcacttgttttgtgtc

SEQ ID NO: 1388 - protein, 1882 aa, Arabidopsis thaliana
TCTCTCTCTCTTCTGAGATTTTTCCGTCGAAATATTAAAAAGAAATTTGCAGATACAGAACTTGTTCTAATCTCTCTCTGTTTTTTTTCCCTATGAATTTTATATAATACGAAAGAGACACACAACACTGTATTATCTTTGCTTCTCTCTTCTCTCTCTTTCTATCTCTACAGAGTAAAGTTCTGATCGTGTCTCTTATCGTTTACCCAAAAACCCTTGTTTGATCTCTCGTCTCTTGTTTTCTTCTGCCCTCGAAGTTTTCAGGTTATGTGGTGGAGGTTGTTTCCAATTTAAAGTATGTACCTTTAGGTTAGAAATTAGGCTTATTTGTTTCTCCAGTGGGTTTCATTGTAGAAACAAATTGAATTTTAGGTGTTAATGTGAGATTAGGAAACAGAATCTCTGCTTTTAACAAGGTAATAGGAGAATAGGGTTTAGTAGAAGAAAGGTTAAAACTTTGTGATGGGTAATAAGTTGGGAAGGAAGAGGCAAGTGGTGGAAGAAAGGTATACAAAGCCTCAAGGTTTGTATGTGAATAAAGATGTCGACGTTAAAAAGCTCAGAAAACTGATTGTGGAGTCTAAGCTTGCTCCTTGCTATCCTGGAGACGATGAAAGCTGTCATGATCTTGAAGAATGTCCAATTTGTTTTCTGTACTATCCTAGCCTCAATAGATCAAGATGTTGCATGAAAAGCATTTGTACAGAGTGTTTTTTGCAAATGAAGAATCCTAATTCAGCTCGGCCTACTCAGTGCCCTTTTTGTAAAACTCCCAACTATGCTGTCGAGTATCGTGGAGTCAAGTCAAAGGAGGAAAAGGGCATTGAACAAGTTGAAGAGCAACGGGTAATAGAAGCCAAAATAAGGATGAGGCAGAAAGAAATGCAGGATGATGAAGAGAAAATGCAGAAACGTCTTGAATCATGTTCCTCTAGCACAAGCGCAATGACTGGCGAGATGGAATATGGTTCAACTTCAGCCATATCTTATAACTCCCTCATGGATGACGGGGAAATTGCTCCATCGCAGAACGCATCTGTTGTTAGACAACATTCCCGCCCGCGAGGAAACAGGGAGGATGAGGTTGACGTTGACCTTGAGGAATTGATGGTCATGGAAGCAATATGGCTCTCTGTTCAGGAAACAGGGACGCAGAGAAATTCAGCTTCAGGGGAAATTACCTCTTCTAGGCAGTATGTAACAGATAATCATAGTTATGTTTCTTCACCACCACGAGTGACTCCAATCGTAGAACCAGCAACACCGTCTTCATCATCTGGTGGGCTTTCTTGTGCAATCTCCGCACTTGCTGAACGCCAAATGGTTGGCGAATCCTCCAGTCACAATCATAATCACAATGTCAACGTTTCTTCATACAGTATGCTTCCCGGAAATTGTGACAGTTACTACGACATAGAACAAGAGGTAGATGGCATAGACAACCATCATCATCATCGTCATCATTACGAGATGGGAGAAACAGGAAGCAGCAACAGCTATGTAAGTTCTTACATGACAGGCGAGGGCTTCCACAACTTTCCTCCTCCTCCACCTCTGGTCATTGTTCCAGAGAGTTTTGAGGAACAGATGATGATGGCTATGGCTGTGTCTATGGCAGAGGTTCATGCCACGACGACATGTGCACCAACTGAAGTTACCTGGCAATAAATAGGATAATAATGGAAACTCATGGGTCTGAATCTGATGATGATTATAACTTCATTCATATATGTCTGTTCCTATAGGAAGAAAGAAAAGAAACGAAATGATTTCCAGTTTTAATAGAAAAAGGTTGGGTTGTGTTACAGCTTCTTTAATTCTTTGTGGTTCTTCTTTTTCAATCTGCATTGACAAAAAATTTGAAGATCACTTGTTTTGTGTC

SEQ ID NO: 1389 - DNA, 1740 bp, Arabidopsis thaliana
  misc_feature (1)..(1740): Ceres cDNA ID no. 12575490
  misc_feature (1)..(1740): Ceres CLONE  ID no. 1207929
  misc_feature (1)..(1740): Also known as  Ceres CDNA ID no. 23655076
atggctttcgctgtctcggttcagtcacatttcgcaatcagagcgttaaaacgagaccacttcaagaacccttctcctcgtactttctgctcgtgttttaaatcgaggcctgactcgtcttaccttagtttaaaggaacgtacttgcttcgtttccaaaccgggtttagtcactactagatacagacatatattccaggtcggagctgagacgggaggagagttcgccgacagtggagaagtagctgattcgcttgcttctgatgcaccagagtcattttcttggtcttctgtgatactcccgtttatcttcccggctttgggaggattattgtttgggtatgacattggggctacctccggtgctacgctctcacttcagtcacctgcgcttagcggaactacatggtttaacttctcacctgttcagctaggacttgtggttagcggatccttgtatggagcccttcttggctcaatttctgtctatggcgttgctgatttccttggaagaaggcgggaacttattatagctgctgttctctatctcctcgggtctctgatcactggctgtgcccctgatcttaatattctcttagttggaaggcttctctatggctttggtattggtttggtgagctccggaaacctgaatcgttatgacatgcccatctcaaatccgtggaactttgatatctctgaaagaactcttcatcgtattgggaattttggtaagtgtctgatgtcaatctcttcccagtatgatttctgcgtaaatattgatttccttcttgtgcagttgggtttttctgttggaagcttccagattgatgtagttggagggtggcgttacatgtatggatttggtacgcctgttgctttgctgatgggactaggcatgtggagtctccctgcatctcctcgctggttgctgcttagagctgtccaaggtaaaggacaattacaagaatacaaagagaaggccatgcttgccctcagcaaattacgtggcagacctccaggtgataaaatctcagagaagttggtagatgatgcctatttatctgtgaaaacggcctatgaagatgagaaatctgggggaaacttcctggaagtattccaagggcctaatttgaaagctttgacaattggtggaggtttagtcctcttccaacagataactggacagcctagtgttctttattatgcgggttcgattcttcagactgctggattctctgctgctgctgatgcaactcgagtctctgttattattggtgttttcaagttactgatgacatgggtagctgttgcgaaagttgatgatctcggcagacgacctttactgattggaggtgtcagcggcattgcgttgtccttgtttctactgtcagcatactacaagtttctcggaggctttccccttgtcgctgttggtgcactgcttctctatgttggttgttaccagatctcatttggacccatcagctggctaatggtgtcagagattttcccgctccgcacaagagggagagggatcagtcttgcagttcttacaaactttggctccaatgctattgtgacatttgcattttcacctttaaaggaatttcttggagccgagaatcttttccttctctttgggggcatagcactggtatcactgctgtttgtaatactagtagttccagagaccaagggtctcagcttggaagaaattgaatcaaaaatcttgaagtga

SEQ ID NO: 1390 - protein, 1740 aa, Arabidopsis thaliana
  misc_feature: PFam Name: Sugar_tr; PFam Description: Sugar (and other)
  misc_feature: PFam Name: MFS_1; PFam Description: Major Facilitator Superfamily
  misc_feature: GI Number: 50897170; NR Description: At5g17010 [Arabidopsis thaliana] >gi|42570524|ref|NP_850835.2| sugar transporter family
  misc_feature: GI Number: 37537174; NR Description: putative sugar transporter protein [Oryza sativa (japonica cultivar-group)] >gi|12039393|gb|AAG46179.1| putative sugar transporter protein [Oryza sativa] >gi|31433692|gb|AAP55176.1| putative sugar
  misc_feature: GI Number: 34897404; NR Description: putative sugar transporter protein [Oryza sativa (japonica cultivar-group)] >gi|27545039|gb|AAO18445.1| putative sugar transporter protein
  misc_feature: GI Number: 9755702; NR Description: sugar transporter-like protein [Arabidopsis thaliana] >gi|11358865|pir||T51556 sugar transporter-like protein - Arabidopsis thaliana >gi|30686158|ref|NP_850836.1| sugar transporter family protein
  misc_feature: GI Number: 29653696; NR Description: d-xylose-proton symporter, putative [Coxiella burnetii RSA 493] >gi|29540959|gb|AAO89902.1| d-xylose-proton symporter, putative
ATGGCTTTCGCTGTCTCGGTTCAGTCACATTTCGCAATCAGAGCGTTAAAACGAGACCACTTCAAGAACCCTTCTCCTCGTACTTTCTGCTCGTGTTTTAAATCGAGGCCTGACTCGTCTTACCTTAGTTTAAAGGAACGTACTTGCTTCGTTTCCAAACCGGGTTTAGTCACTACTAGATACAGACATATATTCCAGGTCGGAGCTGAGACGGGAGGAGAGTTCGCCGACAGTGGAGAAGTAGCTGATTCGCTTGCTTCTGATGCACCAGAGTCATTTTCTTGGTCTTCTGTGATACTCCCGTTTATCTTCCCGGCTTTGGGAGGATTATTGTTTGGGTATGACATTGGGGCTACCTCCGGTGCTACGCTCTCACTTCAGTCACCTGCGCTTAGCGGAACTACATGGTTTAACTTCTCACCTGTTCAGCTAGGACTTGTGGTTAGCGGATCCTTGTATGGAGCCCTTCTTGGCTCAATTTCTGTCTATGGCGTTGCTGATTTCCTTGGAAGAAGGCGGGAACTTATTATAGCTGCTGTTCTCTATCTCCTCGGGTCTCTGATCACTGGCTGTGCCCCTGATCTTAATATTCTCTTAGTTGGAAGGCTTCTCTATGGCTTTGGTATTGGTTTGGTGAGCTCCGGAAACCTGAATCGTTATGACATGCCCATCTCAAATCCGTGGAACTTTGATATCTCTGAAAGAACTCTTCATCGTATTGGGAATTTTGGTAAGTGTCTGATGTCAATCTCTTCCCAGTATGATTTCTGCGTAAATATTGATTTCCTTCTTGTGCAGTTGGGTTTTTCTGTTGGAAGCTTCCAGATTGATGTAGTTGGAGGGTGGCGTTACATGTATGGATTTGGTACGCCTGTTGCTTTGCTGATGGGACTAGGCATGTGGAGTCTCCCTGCATCTCCTCGCTGGTTGCTGCTTAGAGCTGTCCAAGGTAAAGGACAATTACAAGAATACAAAGAGAAGGCCATGCTTGCCCTCAGCAAATTACGTGGCAGACCTCCAGGTGATAAAATCTCAGAGAAGTTGGTAGATGATGCCTATTTATCTGTGAAAACGGCCTATGAAGATGAGAAATCTGGGGGAAACTTCCTGGAAGTATTCCAAGGGCCTAATTTGAAAGCTTTGACAATTGGTGGAGGTTTAGTCCTCTTCCAACAGATAACTGGACAGCCTAGTGTTCTTTATTATGCGGGTTCGATTCTTCAGACTGCTGGATTCTCTGCTGCTGCTGATGCAACTCGAGTCTCTGTTATTATTGGTGTTTTCAAGTTACTGATGACATGGGTAGCTGTTGCGAAAGTTGATGATCTCGGCAGACGACCTTTACTGATTGGAGGTGTCAGCGGCATTGCGTTGTCCTTGTTTCTACTGTCAGCATACTACAAGTTTCTCGGAGGCTTTCCCCTTGTCGCTGTTGGTGCACTGCTTCTCTATGTTGGTTGTTACCAGATCTCATTTGGACCCATCAGCTGGCTAATGGTGTCAGAGATTTTCCCGCTCCGCACAAGAGGGAGAGGGATCAGTCTTGCAGTTCTTACAAACTTTGGCTCCAATGCTATTGTGACATTTGCATTTTCACCTTTAAAGGAATTTCTTGGAGCCGAGAATCTTTTCCTTCTCTTTGGGGGCATAGCACTGGTATCACTGCTGTTTGTAATACTAGTAGTTCCAGAGACCAAGGGTCTCAGCTTGGAAGAAATTGAATCAAAAATCTTGAAGTGA

SEQ ID NO: 1391 - DNA, 1800 bp, Arabidopsis thaliana
  misc_feature (1)..(1800): Ceres cDNA ID no. 12575678
  misc_feature (1)..(1800): Ceres CLONE  ID no. 1202370
  misc_feature (1)..(1800): Also known as  Ceres CDNA ID no. 23655184
acaaatacaacaacaaaaaattgtgtgtggactctttctctcttctttgctggttttgaggagaatcgtgtcggctaaatttgtgtcagacacaccacactctgattgcaaagtcttcctcttcttcttccaccagagacaattccatcatcatcatcaaatagacaagggaagaattcaatttcccctttctttattggcgcgaagatctttcacagaatcaatcaccaacgaaaaatcgagaatggatgtttgcttgagctattcatataatatggatgatgagattgctaagttcatcagaagagtgaatccaccaagggttgtgatcgataacgaagtctgcaaagatgttactgtcattaaggtggatagtgcgaataaacatgggatacttctggaggttgttcaagttttgactgagcttaatctgactattaagaaagcttatatctcctctgatggtggctggtttatggatgttttcaatgttactgatcaagatgggaacaaagttaccgatgaaattgttcttgaatatatccgtaaatctcttggtcctgatgagtcttcttgcttcagtccatcaatgagatcaaccattggggttaaacaatctgtcgactacactgtggttgagctaacaggaactgatagacccggtttgttgtctgagttatgtgctgttcttatggacctccaatgcaatgtggtaaacgctgaaatttggacacatagagcaaaagcagcagcggttttgcaagtgaccgatgaagaaacgtgctctgcaatcactgatccagagaggttgtccaaaatcaggaaacttcttggttatgtgcttacaggtggaagcagtggcagaagattccgtgaaccgaaaaccactgtttcttctgctcttaatgagactcacacggaccgtaagcttcatcaattgatgtttgcagatagagattatgatgaatgggagaacaatgtcgatgacgaggataaatgtgggagagtaattccagatgtggatgtctccaatttgcatgatttggattactccattgtgatgatcaagtgtaaagacagaccgaagcttcttttcgataccgtcttcactctgacagatatgaattatgtcgtttcacatgctagcattgacgctgaaggcccccaagcttatcaggaatactacataagacatacggatggatctcctgtcaaatccgaggcagaaagacagcgagtgatcaaatgtctaaaagcagctattcaaagaagagtctctgaggggttgaagcttgagctttgcacttcagatagagtcgggttactctcggatgtgactcgaatcttccgcgaaaacagtctcacagtaacaagagctgaagtgaaaacaaaaggagacaaagctcttaacacattctacgtgagggacgcttctggctaccaagttgataccaagaccatagaatccattagacaagtcatcggtcagacgatacttcaagtgaaaggcggaaacacagacgcgaaaccgagtcctcaagattcaccaacagggtttcttttcggggttttcaagtcgagatctttcgtcaatttcgggttgataagatcttaaaacttgaaagaggtgttacctctatttgtaaataaccatagtacattgtgtgaatatgtagataaagcttttaggaaagtaaagtttagattcatttttacagggttctatagtatagattcttgtgtagtaagtaaatgttggttttttatatttgtggttgtatataaaatggattcttcttg

SEQ ID NO: 1392 - protein, 1800 aa, Arabidopsis thaliana
  misc_feature: PFam Name: ACT; PFam Description: ACT domain
  misc_feature: GI Number: 22138098; NR Description: ACR4 [Arabidopsis thaliana] >gi|15221589|ref|NP_177067.1| ACT domain containing
  misc_feature: GI Number: 22138100; NR Description: ACR5 [Arabidopsis thaliana] >gi|25370626|pir||F84451 probable uridylyl transferase
  misc_feature: GI Number: 42572033; NR Description: ACT domain containing
  misc_feature: GI Number: 25370627; NR Description: protein F4N2.2 [imported] - Arabidopsis thaliana >gi|6730631|gb|AAF27052.1| F4N2.2
  misc_feature: GI Number: 50916533; NR Description: putative ACT domain containing protein, ACR4, with alternative splicing forms [Oryza sativa (japonica cultivar-group)] >gi|41469089|gb|AAS07063.1|
ACAAATACAACAACAAAAAATTGTGTGTGGACTCTTTCTCTCTTCTTTGCTGGTTTTGAGGAGAATCGTGTCGGCTAAATTTGTGTCAGACACACCACACTCTGATTGCAAAGTCTTCCTCTTCTTCTTCCACCAGAGACAATTCCATCATCATCATCAAATAGACAAGGGAAGAATTCAATTTCCCCTTTCTTTATTGGCGCGAAGATCTTTCACAGAATCAATCACCAACGAAAAATCGAGAATGGATGTTTGCTTGAGCTATTCATATAATATGGATGATGAGATTGCTAAGTTCATCAGAAGAGTGAATCCACCAAGGGTTGTGATCGATAACGAAGTCTGCAAAGATGTTACTGTCATTAAGGTGGATAGTGCGAATAAACATGGGATACTTCTGGAGGTTGTTCAAGTTTTGACTGAGCTTAATCTGACTATTAAGAAAGCTTATATCTCCTCTGATGGTGGCTGGTTTATGGATGTTTTCAATGTTACTGATCAAGATGGGAACAAAGTTACCGATGAAATTGTTCTTGAATATATCCGTAAATCTCTTGGTCCTGATGAGTCTTCTTGCTTCAGTCCATCAATGAGATCAACCATTGGGGTTAAACAATCTGTCGACTACACTGTGGTTGAGCTAACAGGAACTGATAGACCCGGTTTGTTGTCTGAGTTATGTGCTGTTCTTATGGACCTCCAATGCAATGTGGTAAACGCTGAAATTTGGACACATAGAGCAAAAGCAGCAGCGGTTTTGCAAGTGACCGATGAAGAAACGTGCTCTGCAATCACTGATCCAGAGAGGTTGTCCAAAATCAGGAAACTTCTTGGTTATGTGCTTACAGGTGGAAGCAGTGGCAGAAGATTCCGTGAACCGAAAACCACTGTTTCTTCTGCTCTTAATGAGACTCACACGGACCGTAAGCTTCATCAATTGATGTTTGCAGATAGAGATTATGATGAATGGGAGAACAATGTCGATGACGAGGATAAATGTGGGAGAGTAATTCCAGATGTGGATGTCTCCAATTTGCATGATTTGGATTACTCCATTGTGATGATCAAGTGTAAAGACAGACCGAAGCTTCTTTTCGATACCGTCTTCACTCTGACAGATATGAATTATGTCGTTTCACATGCTAGCATTGACGCTGAAGGCCCCCAAGCTTATCAGGAATACTACATAAGACATACGGATGGATCTCCTGTCAAATCCGAGGCAGAAAGACAGCGAGTGATCAAATGTCTAAAAGCAGCTATTCAAAGAAGAGTCTCTGAGGGGTTGAAGCTTGAGCTTTGCACTTCAGATAGAGTCGGGTTACTCTCGGATGTGACTCGAATCTTCCGCGAAAACAGTCTCACAGTAACAAGAGCTGAAGTGAAAACAAAAGGAGACAAAGCTCTTAACACATTCTACGTGAGGGACGCTTCTGGCTACCAAGTTGATACCAAGACCATAGAATCCATTAGACAAGTCATCGGTCAGACGATACTTCAAGTGAAAGGCGGAAACACAGACGCGAAACCGAGTCCTCAAGATTCACCAACAGGGTTTCTTTTCGGGGTTTTCAAGTCGAGATCTTTCGTCAATTTCGGGTTGATAAGATCTTAAAACTTGAAAGAGGTGTTACCTCTATTTGTAAATAACCATAGTACATTGTGTGAATATGTAGATAAAGCTTTTAGGAAAGTAAAGTTTAGATTCATTTTTACAGGGTTCTATAGTATAGATTCTTGTGTAGTAAGTAAATGTTGGTTTTTTATATTTGTGGTTGTATATAAAATGGATTCTTCTTG

SEQ ID NO: 1393 - DNA, 2250 bp, Arabidopsis thaliana
  misc_feature (1)..(2250): Ceres cDNA ID no. 12576055
  misc_feature (1)..(2250): Ceres CLONE  ID no. 1179170
  misc_feature (1)..(2250): Also known as  Ceres CDNA ID no. 12576055
gttggctgtgactggatcctccccctttcttccgggttcttgtcgtgcgtatccggcgaaatgagaagtgtgtagagcaaacagaggtgaagctgagaagttgatcactcactcaatctaagagtgcatgtaattgaagcagcaaccatttctacttttcgaatcttctctgcttcaatccacacccaagggtttcaaggaatatgggtctttcccgttagctaaagataattaattttgtgtccgatggcgtccactcgtaaacccagtggtcatggagctgaagtcgaagctcagaagcgctcctcttcgaatagtagtactaagtcagccaaagccgagacttttgagccgatgcaattacaaagatcagtaacaaacccaagagctgttggaattccggagagtaaacggttgccagagtcttttaggaagcgatctagcgacccggctgtttgtaaacccgatttcagctccctatccactgttcttgagcatgtagattcattgaccattgatgaaaagaaaacatctggctttggcagcgtcaagaccagctctgcttcagccaaattgagtgatggtacgagcagtcttggcaagactagtggaagtgccaagctaagtggccgccttgatttcatggagagtggcaagagcagtatctgcagaggaagcacaagcagtgatgtgagtgacgagagtagctgcagcagctttagtagcactgtcaacaaaccccacaaggccaatgacttaagatgggaagcaatccaggctgttagggttcgtgatgggcttttaggtcttagtcatttcaggctccttaagcggttaggctgcggggacatcgggagtgtttatctctctgagctgagcgggactaagtgttactttgctatgaaggttatggacaagacatcccttgccagtcgcaagaagcttctccgagctcagactgaaagagagattctccagtctttggatcatccatttctccctaccctctacactcactttgagactgagaaattctcatgcctggtgatggaattctgtcccggaggagatttgcatactctcaggcaacgccagccggggaaacatttttctgagcaagcggtaaaattttacatagcagagtcattgttagctttggaatacctgcacatgcttgggattgtgtatcgagatcttaagcctgaaaacgttctagttcgagaagacggacatataatgctctctgattttgacctttctctccgatgtcttgtcagcccgactctagtgaaatctgccgccatcgagtcagatcctttacggaaaaacgtttactgtgtgcagcccgcttgcattgagccctcctgcattcaaccgtcttgcaccgtccccaccacttgcttctccccacgtttgttctcaagcaaatctaagaaggaccgtaaacccaagaatgacaccgcaaatcaagttaggccattgccagagctggtagccgagccaaccgatgcacgttccatgtcatttgtgggcacacacgagtacttggccccagagatcatcaaaggcgaagggcatggcagtgcagtggattggtggacttttgggatattcctttacgagcttctctttgggagaacgcccttcaagggctcaggaaaccgacaaacactgttcaatgtggtgggtcagcctctgcggttcccagaaacgcctgtggtgagttttgcagcgagagacctcatccggggcttgctcatgaaggagccgcagcagcggctggggttcaaacggggagccactgaggttaagcagcaccctttcttcgaaggtgtgaactgggctttgattcggtgtgcgactcccccggaaataccaaagccggttgagctggaaaaaggagctgtgagtgttgcagaggcaccatcaagccagaagacagcagcgggtttggttctgaatgctcagaaagggtctgataactatttggaatttgatttcttctagcgttacggttagacatatggtactctattcttccttagaagactatgtgataaaagatgatcaggtgttgatgtttcgctctttatagattgccatgaattgtaagcttgtttgtatgcataagctgctgtagtttataaaaatgttgtaactgtttctcgtaaccttattagttgttatcagagttcctttttactcgctctatccaaacacaaaacattacatcaaatgtattgtctctgc

SEQ ID NO: 1394 - protein, 2250 aa, Arabidopsis thaliana
GTTGGCTGTGACTGGATCCTCCCCCTTTCTTCCGGGTTCTTGTCGTGCGTATCCGGCGAAATGAGAAGTGTGTAGAGCAAACAGAGGTGAAGCTGAGAAGTTGATCACTCACTCAATCTAAGAGTGCATGTAATTGAAGCAGCAACCATTTCTACTTTTCGAATCTTCTCTGCTTCAATCCACACCCAAGGGTTTCAAGGAATATGGGTCTTTCCCGTTAGCTAAAGATAATTAATTTTGTGTCCGATGGCGTCCACTCGTAAACCCAGTGGTCATGGAGCTGAAGTCGAAGCTCAGAAGCGCTCCTCTTCGAATAGTAGTACTAAGTCAGCCAAAGCCGAGACTTTTGAGCCGATGCAATTACAAAGATCAGTAACAAACCCAAGAGCTGTTGGAATTCCGGAGAGTAAACGGTTGCCAGAGTCTTTTAGGAAGCGATCTAGCGACCCGGCTGTTTGTAAACCCGATTTCAGCTCCCTATCCACTGTTCTTGAGCATGTAGATTCATTGACCATTGATGAAAAGAAAACATCTGGCTTTGGCAGCGTCAAGACCAGCTCTGCTTCAGCCAAATTGAGTGATGGTACGAGCAGTCTTGGCAAGACTAGTGGAAGTGCCAAGCTAAGTGGCCGCCTTGATTTCATGGAGAGTGGCAAGAGCAGTATCTGCAGAGGAAGCACAAGCAGTGATGTGAGTGACGAGAGTAGCTGCAGCAGCTTTAGTAGCACTGTCAACAAACCCCACAAGGCCAATGACTTAAGATGGGAAGCAATCCAGGCTGTTAGGGTTCGTGATGGGCTTTTAGGTCTTAGTCATTTCAGGCTCCTTAAGCGGTTAGGCTGCGGGGACATCGGGAGTGTTTATCTCTCTGAGCTGAGCGGGACTAAGTGTTACTTTGCTATGAAGGTTATGGACAAGACATCCCTTGCCAGTCGCAAGAAGCTTCTCCGAGCTCAGACTGAAAGAGAGATTCTCCAGTCTTTGGATCATCCATTTCTCCCTACCCTCTACACTCACTTTGAGACTGAGAAATTCTCATGCCTGGTGATGGAATTCTGTCCCGGAGGAGATTTGCATACTCTCAGGCAACGCCAGCCGGGGAAACATTTTTCTGAGCAAGCGGTAAAATTTTACATAGCAGAGTCATTGTTAGCTTTGGAATACCTGCACATGCTTGGGATTGTGTATCGAGATCTTAAGCCTGAAAACGTTCTAGTTCGAGAAGACGGACATATAATGCTCTCTGATTTTGACCTTTCTCTCCGATGTCTTGTCAGCCCGACTCTAGTGAAATCTGCCGCCATCGAGTCAGATCCTTTACGGAAAAACGTTTACTGTGTGCAGCCCGCTTGCATTGAGCCCTCCTGCATTCAACCGTCTTGCACCGTCCCCACCACTTGCTTCTCCCCACGTTTGTTCTCAAGCAAATCTAAGAAGGACCGTAAACCCAAGAATGACACCGCAAATCAAGTTAGGCCATTGCCAGAGCTGGTAGCCGAGCCAACCGATGCACGTTCCATGTCATTTGTGGGCACACACGAGTACTTGGCCCCAGAGATCATCAAAGGCGAAGGGCATGGCAGTGCAGTGGATTGGTGGACTTTTGGGATATTCCTTTACGAGCTTCTCTTTGGGAGAACGCCCTTCAAGGGCTCAGGAAACCGACAAACACTGTTCAATGTGGTGGGTCAGCCTCTGCGGTTCCCAGAAACGCCTGTGGTGAGTTTTGCAGCGAGAGACCTCATCCGGGGCTTGCTCATGAAGGAGCCGCAGCAGCGGCTGGGGTTCAAACGGGGAGCCACTGAGGTTAAGCAGCACCCTTTCTTCGAAGGTGTGAACTGGGCTTTGATTCGGTGTGCGACTCCCCCGGAAATACCAAAGCCGGTTGAGCTGGAAAAAGGAGCTGTGAGTGTTGCAGAGGCACCATCAAGCCAGAAGACAGCAGCGGGTTTGGTTCTGAATGCTCAGAAAGGGTCTGATAACTATTTGGAATTTGATTTCTTCTAGCGTTACGGTTAGACATATGGTACTCTATTCTTCCTTAGAAGACTATGTGATAAAAGATGATCAGGTGTTGATGTTTCGCTCTTTATAGATTGCCATGAATTGTAAGCTTGTTTGTATGCATAAGCTGCTGTAGTTTATAAAAATGTTGTAACTGTTTCTCGTAACCTTATTAGTTGTTATCAGAGTTCCTTTTTACTCGCTCTATCCAAACACAAAACATTACATCAAATGTATTGTCTCTGC

SEQ ID NO: 1395 - DNA, 1066 bp, Arabidopsis thaliana
  misc_feature (1)..(1066): Ceres cDNA ID no. 12576107
  misc_feature (1)..(1066): Ceres CLONE  ID no. 1353134
  misc_feature (1)..(1066): Also known as  Ceres CDNA ID no. 12576107
agaaaaatgacttcttcagtactaaccccaagcttaaagcttttagctatgacgaattcttcctcttcgacccttttttgtattccttctatcttcaacatctcgtcctctgaatctcaccgcttcaatttttccttatcctcacgacccgttaatctcacactctctctcaaatccaaaactcttcgtaactcatctcctgttgttactttcgtttcccaaacttcgaattgggctgaggaagaagaaggtgaggatggaagcatcggaggtacttcagtcactgtagatgagagtttcgagtctgaagacggtgttggattcccggagccaccggaagaggctaaattattcgtcggaaacttgccgtacgatgttgatagtcaagctttagctatgctctttgaacaagctggtactgttgagatttcagaggttatatacaatagggacactgatcaaagtcgtggatttgggtttgtaacaatgagtacagttgaagaagcagagaaagctgttgagaagttcaatagttttgaagtgaatgggaggcgtttgacagtaaacagagcagctccaagaggatcaagacctgaacgacaacctcgtgtatatgatgctgcgtttaggatctatgttgggaacctgccatgggatgtggatagtggtcgtttggaacgattatttagcgagcatgggaaagtagttgatgcccgagtggtttctgatagagagacaggtcgttcacgtgggtttgggtttgttcaaatgtcgaatgagaatgaagttaacgttgccattgctgctcttgatggacagaatttggaaggcagagcaattaaagtgaacgtggctgaggaacgaacaaggcgttgattttgatagctcagtgagtgttaatattgtgagttatgattagaaatgttctcacttacaattccaatgtagcgagtatgtgaaaccaaacttgagttcaagcttttgtaaacatattttctttattacccatcaaaacatattacaaaacattacacaaccttttatatgtacactaagacgtgggatg

SEQ ID NO: 1396 - protein, 1066 aa, Arabidopsis thaliana
AGAAAAATGACTTCTTCAGTACTAACCCCAAGCTTAAAGCTTTTAGCTATGACGAATTCTTCCTCTTCGACCCTTTTTTGTATTCCTTCTATCTTCAACATCTCGTCCTCTGAATCTCACCGCTTCAATTTTTCCTTATCCTCACGACCCGTTAATCTCACACTCTCTCTCAAATCCAAAACTCTTCGTAACTCATCTCCTGTTGTTACTTTCGTTTCCCAAACTTCGAATTGGGCTGAGGAAGAAGAAGGTGAGGATGGAAGCATCGGAGGTACTTCAGTCACTGTAGATGAGAGTTTCGAGTCTGAAGACGGTGTTGGATTCCCGGAGCCACCGGAAGAGGCTAAATTATTCGTCGGAAACTTGCCGTACGATGTTGATAGTCAAGCTTTAGCTATGCTCTTTGAACAAGCTGGTACTGTTGAGATTTCAGAGGTTATATACAATAGGGACACTGATCAAAGTCGTGGATTTGGGTTTGTAACAATGAGTACAGTTGAAGAAGCAGAGAAAGCTGTTGAGAAGTTCAATAGTTTTGAAGTGAATGGGAGGCGTTTGACAGTAAACAGAGCAGCTCCAAGAGGATCAAGACCTGAACGACAACCTCGTGTATATGATGCTGCGTTTAGGATCTATGTTGGGAACCTGCCATGGGATGTGGATAGTGGTCGTTTGGAACGATTATTTAGCGAGCATGGGAAAGTAGTTGATGCCCGAGTGGTTTCTGATAGAGAGACAGGTCGTTCACGTGGGTTTGGGTTTGTTCAAATGTCGAATGAGAATGAAGTTAACGTTGCCATTGCTGCTCTTGATGGACAGAATTTGGAAGGCAGAGCAATTAAAGTGAACGTGGCTGAGGAACGAACAAGGCGTTGATTTTGATAGCTCAGTGAGTGTTAATATTGTGAGTTATGATTAGAAATGTTCTCACTTACAATTCCAATGTAGCGAGTATGTGAAACCAAACTTGAGTTCAAGCTTTTGTAAACATATTTTCTTTATTACCCATCAAAACATATTACAAAACATTACACAACCTTTTATATGTACACTAAGACGTGGGATG

SEQ ID NO: 1397 - DNA, 1684 bp, Arabidopsis thaliana
  misc_feature (1)..(1684): Ceres cDNA ID no. 12576352
  misc_feature (1)..(1684): Also known as  Ceres CDNA ID no. 12576107
tgtttgtcactaagctctctctctctccttcttcttcgacttttttttttcttcctctcttctctttggttttttggtgttgggttttatctgggttcctgatttcttcaacgaggaaggaaggaagaagaagagaaaagggacaagcgagaattactcttttctccttcaatttccgatgggttgtttcggatgcagtaagaaatcgagcaaacgatccgagactaacaaagatactgtcataaatagaaaaattgtcggtggtactacgagcgttgctaagagtgataagcgagacgatcagactcagcccagttcagattcaacaaaagtcagtccatatagagatgtaaacaatgaaggaggagttggtaaggaagatcagttatctttggatgtgaagggtttgaatctaaatgaccaagtcacagggaagaaagcacagacttttacttttcaagaacttgcagaagctacgggaaactttagatcggattgttttcttggtgaaggaggtttcggaaaagttttcaagggaactatagagaaattggatcaggttgttgcaatcaagcaacttgatcgtaatggggttcaaggaatcagggaatttgtggttgaggtattgactctaagtcttgctgaccatccgaatcttgtgaagcttattgggttttgtgctgagggtgatcagagactactggtgtacgagtatatgccgcaaggatcccttgaagatcatctacatgttctcccttctggtaaaaagcctcttgactggaacacccggatgaaaatagcagctggtgcagcaagaggtttagagtatctgcatgacagaatgacgccccctgtgatttaccgagatcttaaatgttcgaatattttgcttggtgaagactatcaaccgaaactatctgactttgggttggctaaagtaggaccaagcggggataaaacccatgtctcgacaagggttatgggaacgtacggatactgtgctcctgactacgctatgacgggtcagctcacatttaaatccgatatatacagttttggagtagtccttctcgagcttatcaccggaaggaaagcgattgacaatacaaaaacgcgtaaagatcagaatttggttggatgggcacgaccattgttcaaagacaggaggaacttcccaaaaatggttgatccattgcttcagggacaatacccagttagaggactgtaccaagcactagcaatatcagcaatgtgcgttcaagagcagcctaccatgagaccagtggtatctgatgtagtattggctctcaacttcttagcctcttctaaatatgatccgaatagccctagcagcagcagcgggaagaacccttcttttcacagagacagagatgatgaagagaaaagaccacacctcgtcaaggaaactgaatgtgaagggtcctcataggatatccaataagagagtggtaaaaaatcaaatctaattttggcttcaccaagaaattggggaaaaatataaaaccaactcaggtacatttttaacatctattgtggatgtaaatcttgactcggcttctttgtatgtagaatgtttctgttctgtagaaaaggaaaaaaaaaaaaaaccattttgttttgggacatatatacatatattgaacaaaaacaaatatcgttggtc

SEQ ID NO: 1398 - protein, 1684 aa, Arabidopsis thaliana
TGTTTGTCACTAAGCTCTCTCTCTCTCCTTCTTCTTCGACTTTTTTTTTTCTTCCTCTCTTCTCTTTGGTTTTTTGGTGTTGGGTTTTATCTGGGTTCCTGATTTCTTCAACGAGGAAGGAAGGAAGAAGAAGAGAAAAGGGACAAGCGAGAATTACTCTTTTCTCCTTCAATTTCCGATGGGTTGTTTCGGATGCAGTAAGAAATCGAGCAAACGATCCGAGACTAACAAAGATACTGTCATAAATAGAAAAATTGTCGGTGGTACTACGAGCGTTGCTAAGAGTGATAAGCGAGACGATCAGACTCAGCCCAGTTCAGATTCAACAAAAGTCAGTCCATATAGAGATGTAAACAATGAAGGAGGAGTTGGTAAGGAAGATCAGTTATCTTTGGATGTGAAGGGTTTGAATCTAAATGACCAAGTCACAGGGAAGAAAGCACAGACTTTTACTTTTCAAGAACTTGCAGAAGCTACGGGAAACTTTAGATCGGATTGTTTTCTTGGTGAAGGAGGTTTCGGAAAAGTTTTCAAGGGAACTATAGAGAAATTGGATCAGGTTGTTGCAATCAAGCAACTTGATCGTAATGGGGTTCAAGGAATCAGGGAATTTGTGGTTGAGGTATTGACTCTAAGTCTTGCTGACCATCCGAATCTTGTGAAGCTTATTGGGTTTTGTGCTGAGGGTGATCAGAGACTACTGGTGTACGAGTATATGCCGCAAGGATCCCTTGAAGATCATCTACATGTTCTCCCTTCTGGTAAAAAGCCTCTTGACTGGAACACCCGGATGAAAATAGCAGCTGGTGCAGCAAGAGGTTTAGAGTATCTGCATGACAGAATGACGCCCCCTGTGATTTACCGAGATCTTAAATGTTCGAATATTTTGCTTGGTGAAGACTATCAACCGAAACTATCTGACTTTGGGTTGGCTAAAGTAGGACCAAGCGGGGATAAAACCCATGTCTCGACAAGGGTTATGGGAACGTACGGATACTGTGCTCCTGACTACGCTATGACGGGTCAGCTCACATTTAAATCCGATATATACAGTTTTGGAGTAGTCCTTCTCGAGCTTATCACCGGAAGGAAAGCGATTGACAATACAAAAACGCGTAAAGATCAGAATTTGGTTGGATGGGCACGACCATTGTTCAAAGACAGGAGGAACTTCCCAAAAATGGTTGATCCATTGCTTCAGGGACAATACCCAGTTAGAGGACTGTACCAAGCACTAGCAATATCAGCAATGTGCGTTCAAGAGCAGCCTACCATGAGACCAGTGGTATCTGATGTAGTATTGGCTCTCAACTTCTTAGCCTCTTCTAAATATGATCCGAATAGCCCTAGCAGCAGCAGCGGGAAGAACCCTTCTTTTCACAGAGACAGAGATGATGAAGAGAAAAGACCACACCTCGTCAAGGAAACTGAATGTGAAGGGTCCTCATAGGATATCCAATAAGAGAGTGGTAAAAAATCAAATCTAATTTTGGCTTCACCAAGAAATTGGGGAAAAATATAAAACCAACTCAGGTACATTTTTAACATCTATTGTGGATGTAAATCTTGACTCGGCTTCTTTGTATGTAGAATGTTTCTGTTCTGTAGAAAAGGAAAAAAAAAAAAAACCATTTTGTTTTGGGACATATATACATATATTGAACAAAAACAAATATCGTTGGTC

SEQ ID NO: 1399 - DNA, 1826 bp, Arabidopsis thaliana
  misc_feature (1)..(1826): Ceres cDNA ID no. 12576641
  misc_feature (1)..(1826): Also known as  Ceres CDNA ID no. 12576107
aaaccaaacggtcaaacctcactcaccatgagacaccttagctcacctccatggcctctcctccttctcctcctcctctcttctttcacctccggcgaatcctctctgtccgcagaaaaaaacaaattgcacaccggtggtctcagtagacagagttttcctaaaggattcgtgtttggaaccgccacgtcagcttatcaagtcgaaggcgagactcatcaagacggtcgtggcccaagcatttgggatgccttcgtcaagattcctgggaagatcgccaagaatgccacggctgagataacagtggaccagtatcaccgttacaaggaagatgtggatttgatgaagaaactgaacttcgatgcttacagattttccatttcatggtccaggatattccctgagggaagtggtaaagtcaactggaaaggagttgcttattacaatagattgattgattacatggttcaaaaagggattacaccttatgctaatctgtaccactacgatcttccattggctttggaaaacaagtataaaggcttgcttggtagacaagtagtgtaagcaccaatatgcaaagctcttttatgcattcctcaaaagttacaaactttgataatgcaaattttacaggaaagattttgcggattacgctgagttttgttacaagacatttggtgatagagtgaaaaattggatgacgttcaacgagccgcgtgtggtagctgctttaggttatgataatggtattttcgcaccgggtagatgctcaaaagcatttggaaattgcactgaaggaaactccgcgacagagccatacatagttactcatcaccttatcttggcccacgcagcagcagtccaaagataccgcaaatattaccaagcgaaacaaaagggaagggttgggatacttttagatttcgtttggtatgagccgcttactagaagtaaagcagataatcttgcagctcaaagagcaagagacttccatatcggatggtttattcacccattagtatatggagagtatccaaagacaatgcagaacattgtgaaagagaggcttccaaagttcacggagaaagaagtgaaaatggtgaaaggttccatagattttgtgggaataaaccaatacacgacttattacatgtccgaaccacatcccaccaccaaacctaaggatttgggttatcaacaagattggaatgtggaatttggctttgctaagttggggaagccaataggtccaagggcttactcgtcttggttatacaacgtaccatggggaatgtacaaggccttgatgtatatgaaggaacgttacggcaaccctactatgatcctctctgaaaacggtatggatgacccgggaaacgttactctagctcaaggactacatgacaccacgagaatcaagtattacaaagattacttaaccaaccttaagaaagctagggatgatggagccaatgtggttggatattttgcgtggtcattgctagataatttcgaatggttatcaggatatacttcaaggtttgggatcgtttatgttgattacaaaacattgaagaggtaccccaagatgtctgctcagtggtttaagcaacttctgaaacgaaacaacaaatgatctcaatgtatcaatgccgggtggatttagtttttaaaaaggttggaattgatgattgaagaaataatggggccggtttagtcactttgtttattataaggggggtgaattgtaacttgaactctctccttcttcagttctttgacttttcaacacaaataaaataaaagtttaagaataaatttgc

SEQ ID NO: 1400 - protein, 1826 aa, Arabidopsis thaliana
AAACCAAACGGTCAAACCTCACTCACCATGAGACACCTTAGCTCACCTCCATGGCCTCTCCTCCTTCTCCTCCTCCTCTCTTCTTTCACCTCCGGCGAATCCTCTCTGTCCGCAGAAAAAAACAAATTGCACACCGGTGGTCTCAGTAGACAGAGTTTTCCTAAAGGATTCGTGTTTGGAACCGCCACGTCAGCTTATCAAGTCGAAGGCGAGACTCATCAAGACGGTCGTGGCCCAAGCATTTGGGATGCCTTCGTCAAGATTCCTGGGAAGATCGCCAAGAATGCCACGGCTGAGATAACAGTGGACCAGTATCACCGTTACAAGGAAGATGTGGATTTGATGAAGAAACTGAACTTCGATGCTTACAGATTTTCCATTTCATGGTCCAGGATATTCCCTGAGGGAAGTGGTAAAGTCAACTGGAAAGGAGTTGCTTATTACAATAGATTGATTGATTACATGGTTCAAAAAGGGATTACACCTTATGCTAATCTGTACCACTACGATCTTCCATTGGCTTTGGAAAACAAGTATAAAGGCTTGCTTGGTAGACAAGTAGTGTAAGCACCAATATGCAAAGCTCTTTTATGCATTCCTCAAAAGTTACAAACTTTGATAATGCAAATTTTACAGGAAAGATTTTGCGGATTACGCTGAGTTTTGTTACAAGACATTTGGTGATAGAGTGAAAAATTGGATGACGTTCAACGAGCCGCGTGTGGTAGCTGCTTTAGGTTATGATAATGGTATTTTCGCACCGGGTAGATGCTCAAAAGCATTTGGAAATTGCACTGAAGGAAACTCCGCGACAGAGCCATACATAGTTACTCATCACCTTATCTTGGCCCACGCAGCAGCAGTCCAAAGATACCGCAAATATTACCAAGCGAAACAAAAGGGAAGGGTTGGGATACTTTTAGATTTCGTTTGGTATGAGCCGCTTACTAGAAGTAAAGCAGATAATCTTGCAGCTCAAAGAGCAAGAGACTTCCATATCGGATGGTTTATTCACCCATTAGTATATGGAGAGTATCCAAAGACAATGCAGAACATTGTGAAAGAGAGGCTTCCAAAGTTCACGGAGAAAGAAGTGAAAATGGTGAAAGGTTCCATAGATTTTGTGGGAATAAACCAATACACGACTTATTACATGTCCGAACCACATCCCACCACCAAACCTAAGGATTTGGGTTATCAACAAGATTGGAATGTGGAATTTGGCTTTGCTAAGTTGGGGAAGCCAATAGGTCCAAGGGCTTACTCGTCTTGGTTATACAACGTACCATGGGGAATGTACAAGGCCTTGATGTATATGAAGGAACGTTACGGCAACCCTACTATGATCCTCTCTGAAAACGGTATGGATGACCCGGGAAACGTTACTCTAGCTCAAGGACTACATGACACCACGAGAATCAAGTATTACAAAGATTACTTAACCAACCTTAAGAAAGCTAGGGATGATGGAGCCAATGTGGTTGGATATTTTGCGTGGTCATTGCTAGATAATTTCGAATGGTTATCAGGATATACTTCAAGGTTTGGGATCGTTTATGTTGATTACAAAACATTGAAGAGGTACCCCAAGATGTCTGCTCAGTGGTTTAAGCAACTTCTGAAACGAAACAACAAATGATCTCAATGTATCAATGCCGGGTGGATTTAGTTTTTAAAAAGGTTGGAATTGATGATTGAAGAAATAATGGGGCCGGTTTAGTCACTTTGTTTATTATAAGGGGGGTGAATTGTAACTTGAACTCTCTCCTTCTTCAGTTCTTTGACTTTTCAACACAAATAAAATAAAAGTTTAAGAATAAATTTGC

SEQ ID NO: 1401 - DNA, 1066 bp, Arabidopsis thaliana
  misc_feature (1)..(1066): Ceres cDNA ID no. 12576886
  misc_feature (1)..(1066): Also known as  Ceres CDNA ID no. 12576107
gcaacttgtgttacagatactctcgcaaagtctcatcctttctcagcaaaaaacactaggaaatggttgaaaggcatggagagttttgatttgctgcttaagatatatcatgtcgcagtgcgttgacggtatcaagcatttatgcacctctgttttagggtgttttgatcttgatttgtataaacaatctggtggccttggagatcctgaattgcttgcaagagacactgtttttagtgtgagtgaaatagaagctctttatgagctttttaagaaaatcagcagtgccgtgattgatgatgggctaataaacaaggaagagtttcagttggctttgtttaagacaaataaaaaagagagtttgtttgcagatcgggttttcgatttgtttgatacaaagcacaatggaatactggggtttgaggaatttgctcgtgctctctccgtctttcacccaaatgcgcctatagatgacaaaattcacttttcatttcagctatatgatcttaaacagcaagggtttatcgaacggcaagaggtgaaacaaatggttgtcgctacgcttgctgaatctggaatgaatttgaaggatactgtcattgaggatataatcgacaagacgtttgaggaagcagacacaaaacacgatggaaagatcgataaggaagagtggagaagccttgttcttagacatcccagccttctgaagaacatgactcttcaatatctcaaggatatcacgactacgtttccaagctttgtgttccattctcaggttgaagatacctgaaaaagcaaaagcaaaagcaagcagcggcaagacatcattgtattgttgaaggttgttctttcgttatggttctttatttgttacatttctaaatctctgaactcattttattttttattgagctttttttgtgaagcaaaattcttctttttagtttggtttttgtcctttttgatttcgctcggtctatctgtagatacaacttttgcatcttgatgttatggtaatgtaaagtttttcagtttatttattaatccaattaaaaagatttgcttc

SEQ ID NO: 1402 - protein, 1066 aa, Arabidopsis thaliana
GCAACTTGTGTTACAGATACTCTCGCAAAGTCTCATCCTTTCTCAGCAAAAAACACTAGGAAATGGTTGAAAGGCATGGAGAGTTTTGATTTGCTGCTTAAGATATATCATGTCGCAGTGCGTTGACGGTATCAAGCATTTATGCACCTCTGTTTTAGGGTGTTTTGATCTTGATTTGTATAAACAATCTGGTGGCCTTGGAGATCCTGAATTGCTTGCAAGAGACACTGTTTTTAGTGTGAGTGAAATAGAAGCTCTTTATGAGCTTTTTAAGAAAATCAGCAGTGCCGTGATTGATGATGGGCTAATAAACAAGGAAGAGTTTCAGTTGGCTTTGTTTAAGACAAATAAAAAAGAGAGTTTGTTTGCAGATCGGGTTTTCGATTTGTTTGATACAAAGCACAATGGAATACTGGGGTTTGAGGAATTTGCTCGTGCTCTCTCCGTCTTTCACCCAAATGCGCCTATAGATGACAAAATTCACTTTTCATTTCAGCTATATGATCTTAAACAGCAAGGGTTTATCGAACGGCAAGAGGTGAAACAAATGGTTGTCGCTACGCTTGCTGAATCTGGAATGAATTTGAAGGATACTGTCATTGAGGATATAATCGACAAGACGTTTGAGGAAGCAGACACAAAACACGATGGAAAGATCGATAAGGAAGAGTGGAGAAGCCTTGTTCTTAGACATCCCAGCCTTCTGAAGAACATGACTCTTCAATATCTCAAGGATATCACGACTACGTTTCCAAGCTTTGTGTTCCATTCTCAGGTTGAAGATACCTGAAAAAGCAAAAGCAAAAGCAAGCAGCGGCAAGACATCATTGTATTGTTGAAGGTTGTTCTTTCGTTATGGTTCTTTATTTGTTACATTTCTAAATCTCTGAACTCATTTTATTTTTTATTGAGCTTTTTTTGTGAAGCAAAATTCTTCTTTTTAGTTTGGTTTTTGTCCTTTTTGATTTCGCTCGGTCTATCTGTAGATACAACTTTTGCATCTTGATGTTATGGTAATGTAAAGTTTTTCAGTTTATTTATTAATCCAATTAAAAAGATTTGCTTC

SEQ ID NO: 1403 - DNA, 1333 bp, Arabidopsis thaliana
  misc_feature (1)..(1333): Ceres cDNA ID no. 12577021
  misc_feature (1)..(1333): Also known as  Ceres CDNA ID no. 12576107
acatttggtgtctgctgctggcgttgagaagaagaagaagaagaaaggcacacaaaataacccatgtctggtttatacaataactcatcttacttctctcctgctcgagctgcttctcctcagattagaagcactcctgagatcgacagctctcagtacttgacggagcttctcgctgaacatcaaaagcttactccttttatgcaggtcctacccatatgtagccgtctattgaatcaagagatgttcagggtctctggaatgatgtctaaccaaggatttggtgattttgatagacttcgacacagaagtcccagccctatggcttcttctaatcttatgtctaatgtctctaataccgggttaggaggctggaacggcctctctcaggagagacttagtggaacacctggaatgacaatggattggcaaggtgcacctggaagccccagttcatacaccgtcaaaaggatattgcgtctggagattcctgtagataactatcctaatttcaattttgttggacgacttctcggccctagaggcaactcgttaaaacgcgttgaagctaccaccggttgccgagtattcatcagagggaaagggtcaatcaaggatcccgaaaaggaagataaattaaggggaagacctggctatgaacacttgaatgagcagcttcacatcttaatagaggcagatcttccagctagtattgtggagatacgtctgcgacaagctcaagaaattatagaagagttactaaagcctgtggacgagtcgcaagatttcataaagagacagcagctgagggaactggcattgctaaactcgaacaacctgagggaagagagtccggggccaagcggaggtggaagcgtttcgcctttcaattcaagtggtaaacgcccgaaaacaggatgctaagtagcgttttgtacgtctcgcccaaaacgctccttcaagccttataatggttacttcaaccaaaagtacatgtctgcatgcattacacagacgcacatgtgtatatctggtttctccagtagtggctgcaatggtggtggtctggtcaaggcctgccctggtctctctcgggtgagcgaccctgtggctttcgtttttcttcttctttattttaaacttttgtttttctttttcctcatcaaaaattcattacagattatttaaaaaagattcatgcaaaaaaaaaaaaaaagagtatgagatatataatatatatagggagaaaaagatgtggtggcttgggagggcgtggactgaaaattcttattgtataaacataaacaaaaaacacatttattggattgattct

SEQ ID NO: 1404 - protein, 1333 aa, Arabidopsis thaliana
ACATTTGGTGTCTGCTGCTGGCGTTGAGAAGAAGAAGAAGAAGAAAGGCACACAAAATAACCCATGTCTGGTTTATACAATAACTCATCTTACTTCTCTCCTGCTCGAGCTGCTTCTCCTCAGATTAGAAGCACTCCTGAGATCGACAGCTCTCAGTACTTGACGGAGCTTCTCGCTGAACATCAAAAGCTTACTCCTTTTATGCAGGTCCTACCCATATGTAGCCGTCTATTGAATCAAGAGATGTTCAGGGTCTCTGGAATGATGTCTAACCAAGGATTTGGTGATTTTGATAGACTTCGACACAGAAGTCCCAGCCCTATGGCTTCTTCTAATCTTATGTCTAATGTCTCTAATACCGGGTTAGGAGGCTGGAACGGCCTCTCTCAGGAGAGACTTAGTGGAACACCTGGAATGACAATGGATTGGCAAGGTGCACCTGGAAGCCCCAGTTCATACACCGTCAAAAGGATATTGCGTCTGGAGATTCCTGTAGATAACTATCCTAATTTCAATTTTGTTGGACGACTTCTCGGCCCTAGAGGCAACTCGTTAAAACGCGTTGAAGCTACCACCGGTTGCCGAGTATTCATCAGAGGGAAAGGGTCAATCAAGGATCCCGAAAAGGAAGATAAATTAAGGGGAAGACCTGGCTATGAACACTTGAATGAGCAGCTTCACATCTTAATAGAGGCAGATCTTCCAGCTAGTATTGTGGAGATACGTCTGCGACAAGCTCAAGAAATTATAGAAGAGTTACTAAAGCCTGTGGACGAGTCGCAAGATTTCATAAAGAGACAGCAGCTGAGGGAACTGGCATTGCTAAACTCGAACAACCTGAGGGAAGAGAGTCCGGGGCCAAGCGGAGGTGGAAGCGTTTCGCCTTTCAATTCAAGTGGTAAACGCCCGAAAACAGGATGCTAAGTAGCGTTTTGTACGTCTCGCCCAAAACGCTCCTTCAAGCCTTATAATGGTTACTTCAACCAAAAGTACATGTCTGCATGCATTACACAGACGCACATGTGTATATCTGGTTTCTCCAGTAGTGGCTGCAATGGTGGTGGTCTGGTCAAGGCCTGCCCTGGTCTCTCTCGGGTGAGCGACCCTGTGGCTTTCGTTTTTCTTCTTCTTTATTTTAAACTTTTGTTTTTCTTTTTCCTCATCAAAAATTCATTACAGATTATTTAAAAAAGATTCATGCAAAAAAAAAAAAAAAGAGTATGAGATATATAATATATATAGGGAGAAAAAGATGTGGTGGCTTGGGAGGGCGTGGACTGAAAATTCTTATTGTATAAACATAAACAAAAAACACATTTATTGGATTGATTCT

SEQ ID NO: 1405 - DNA, 1566 bp, Arabidopsis thaliana
  misc_feature (1)..(1566): Ceres cDNA ID no. 12578221
  misc_feature (1)..(1566): Ceres CLONE  ID no. 1331403
  misc_feature (1)..(1566): Also known as  Ceres CDNA ID no. 12578221
gtcttcaacactttatcatcttcaattgaaaaaaaaaaaaaaatcaacccaaagctctgcttcgttgagctaaaacaatggcggaaacaactcccaaagtgaaaggccacgtcgtaatcttaccatacccagttcaaggccacctaaacccaatggttcaattcgctaaacgtctagtctccaaaaacgtcaaagtcacaatcgccaccactacctacaccgcctcctcaatcacaacaccatcactctccgtcgaaccaatctccgatggattcgatttcatccccataggtatccccggtttcagcgtcgatacttactcagaatccttcaagctcaacggatccgaaaccctaactctcctaatcgagaaattcaaatccacagattcaccaatcgattgcttaatctacgattcgtttcttccttggggacttgaagttgctagatctatggaactttcagctgcttctttcttcactaataatctcactgtttgttctgtgttgcgtaaattctctaacggtgactttcctcttcccgctgatcctaattcggcgccgtttcgtatccgtggcttaccgtctttgagctacgatgagttaccttcgtttgtgggacgtcattggttgactcatcctgagcatggcagagttcttctgaatcagtttcctaaccatgaaaatgctgattggttattcgttaatggctttgaagggttagaagaaacacaagattgtgaaaatggtgagtctgatgcaatgaaggcgacgttgatcggaccgatgattccatcggcttatcttgatgatcggatggaagatgataaagactatggtgcgagtctgttgaaaccgatatcgaaggagtgtatggagtggcttgagactaagcaggctcagtcagtagcatttgtttcgtttggttcgtttgggattctctttgagaagcaacttgcagaggtagctattgcgctacaagaatcggatttgaacttcttgtgggtgattaaagaagctcatatagcgaaattgcctgaagggtttgtggaatcgactaaagatagagccttgttggtttcttggtgtaaccagcttgaggttttagctcatgaatcgataggttgctttttgactcattgtggttggaactctacgttggaagggttgagtttgggagttccgatggttggtgtgcctcagtggagtgatcagatgaatgatgctaagtttgtggaggaagtttggaaagttgggtatagagcgaaagaggaagctggggaagtaatcgtgaagagtgaagaattggtgaggtgtttgaaaggagtgatggaaggagagagtagtgtgaagattagagagagttcgaagaagtggaaagatttggctgtgaaggcaatgagtgaaggaggaagctctgatcgaagcattaacgagtttatagagagtttagggaagtaacattattgattcaactttgtaaatcatgaaatgtaagtgtttgttgatgttgtataagagcattgtaccacgatgactgtgattcaataataaaccaattgtgatt

SEQ ID NO: 1406 - protein, 1566 aa, Arabidopsis thaliana
GTCTTCAACACTTTATCATCTTCAATTGAAAAAAAAAAAAAAATCAACCCAAAGCTCTGCTTCGTTGAGCTAAAACAATGGCGGAAACAACTCCCAAAGTGAAAGGCCACGTCGTAATCTTACCATACCCAGTTCAAGGCCACCTAAACCCAATGGTTCAATTCGCTAAACGTCTAGTCTCCAAAAACGTCAAAGTCACAATCGCCACCACTACCTACACCGCCTCCTCAATCACAACACCATCACTCTCCGTCGAACCAATCTCCGATGGATTCGATTTCATCCCCATAGGTATCCCCGGTTTCAGCGTCGATACTTACTCAGAATCCTTCAAGCTCAACGGATCCGAAACCCTAACTCTCCTAATCGAGAAATTCAAATCCACAGATTCACCAATCGATTGCTTAATCTACGATTCGTTTCTTCCTTGGGGACTTGAAGTTGCTAGATCTATGGAACTTTCAGCTGCTTCTTTCTTCACTAATAATCTCACTGTTTGTTCTGTGTTGCGTAAATTCTCTAACGGTGACTTTCCTCTTCCCGCTGATCCTAATTCGGCGCCGTTTCGTATCCGTGGCTTACCGTCTTTGAGCTACGATGAGTTACCTTCGTTTGTGGGACGTCATTGGTTGACTCATCCTGAGCATGGCAGAGTTCTTCTGAATCAGTTTCCTAACCATGAAAATGCTGATTGGTTATTCGTTAATGGCTTTGAAGGGTTAGAAGAAACACAAGATTGTGAAAATGGTGAGTCTGATGCAATGAAGGCGACGTTGATCGGACCGATGATTCCATCGGCTTATCTTGATGATCGGATGGAAGATGATAAAGACTATGGTGCGAGTCTGTTGAAACCGATATCGAAGGAGTGTATGGAGTGGCTTGAGACTAAGCAGGCTCAGTCAGTAGCATTTGTTTCGTTTGGTTCGTTTGGGATTCTCTTTGAGAAGCAACTTGCAGAGGTAGCTATTGCGCTACAAGAATCGGATTTGAACTTCTTGTGGGTGATTAAAGAAGCTCATATAGCGAAATTGCCTGAAGGGTTTGTGGAATCGACTAAAGATAGAGCCTTGTTGGTTTCTTGGTGTAACCAGCTTGAGGTTTTAGCTCATGAATCGATAGGTTGCTTTTTGACTCATTGTGGTTGGAACTCTACGTTGGAAGGGTTGAGTTTGGGAGTTCCGATGGTTGGTGTGCCTCAGTGGAGTGATCAGATGAATGATGCTAAGTTTGTGGAGGAAGTTTGGAAAGTTGGGTATAGAGCGAAAGAGGAAGCTGGGGAAGTAATCGTGAAGAGTGAAGAATTGGTGAGGTGTTTGAAAGGAGTGATGGAAGGAGAGAGTAGTGTGAAGATTAGAGAGAGTTCGAAGAAGTGGAAAGATTTGGCTGTGAAGGCAATGAGTGAAGGAGGAAGCTCTGATCGAAGCATTAACGAGTTTATAGAGAGTTTAGGGAAGTAACATTATTGATTCAACTTTGTAAATCATGAAATGTAAGTGTTTGTTGATGTTGTATAAGAGCATTGTACCACGATGACTGTGATTCAATAATAAACCAATTGTGATT

SEQ ID NO: 1407 - DNA, 895 bp, Arabidopsis thaliana
  misc_feature (1)..(895): Ceres cDNA ID no. 12578273
  misc_feature (1)..(895): Ceres CLONE  ID no. 1332696
  misc_feature (1)..(895): Also known as  Ceres CDNA ID no. 23461320
atactcttaactctcatgaattattggtctctctattatagttttttaagtaacaatctaattgtagtacggatgtctcttgagatgttcaagaattaagaaataaagaaagagggatcggagaatgaattttgaggatcaagaagaagatatggagatgtcaggtgttaatcccccctgcggttacgactctctaagcggtgagggagccacatctagtggtggtggaggagtaggaaggagtaaaggagttggagcgaagataaggtatagagagtgcttgaagaaccatgctgttaacataggtggccacgccgtggacggttgttgcgagtttatgccttccggtgaagatggaacgctcgacgctcttaagtgtgcagcttgcggctgccaccgcaacttccaccgcaaggaaaccgaaagcatcggcggtagagcccacagagttcccacgtactacaaccgcccgccgcagccgcatcagccgcctggatatcttcatctaacatctcccgcggcgccttacaggccacccgcggcatcgggggacgaggaggatacatcaaatcctagcagcagcggcgggaccacgaagaggtttagaacgaagttcacggcggaacagaaagagaagatgttagcctttgcggagaggttggggtggagaattcagaagcatgatgacgtggcggttgagcagttctgtgcggagactggtgttaggagacaagtgcttaaaatctggatgcataacaacaagaactctcttggtaagaaaccctaattttgctcgagacatgatttaaaacactagaggatcataattgtttctttttttggtatgactcttctgtaactacttctgcttattagttatgttattttttcctgg

SEQ ID NO: 1408 - protein, 895 aa, Arabidopsis thaliana
  misc_feature: PFam Name: ZF-HD_dimer; PFam Description: ZF-HD protein
  misc_feature: PFam Name: Homeobox; PFam Description: Homeobox domain
  misc_feature: GI Number: 50946893; NR Description: putative ZF-HD homeobox protein [Oryza sativa (japonica cultivar-group)] >gi|42408573|dbj|BAD09750.1| putative ZF-HD homeobox protein [Oryza
  misc_feature: GI Number: 50900288; NR Description: putative ZF-HD homeobox protein [Oryza sativa (japonica cultivar-group)] >gi|46806323|dbj|BAD17515.1| putative ZF-HD homeobox protein [Oryza
  misc_feature: GI Number: 62733875; NR Description: ZF-HD protein dimerisation region, putative [Oryza sativa (japonica
  misc_feature: GI Number: 53689757; NR Description: ZF-HD homeobox
  misc_feature: GI Number: 48057668; NR Description: putative ZF-HD homeobox
ATACTCTTAACTCTCATGAATTATTGGTCTCTCTATTATAGTTTTTTAAGTAACAATCTAATTGTAGTACGGATGTCTCTTGAGATGTTCAAGAATTAAGAAATAAAGAAAGAGGGATCGGAGAATGAATTTTGAGGATCAAGAAGAAGATATGGAGATGTCAGGTGTTAATCCCCCCTGCGGTTACGACTCTCTAAGCGGTGAGGGAGCCACATCTAGTGGTGGTGGAGGAGTAGGAAGGAGTAAAGGAGTTGGAGCGAAGATAAGGTATAGAGAGTGCTTGAAGAACCATGCTGTTAACATAGGTGGCCACGCCGTGGACGGTTGTTGCGAGTTTATGCCTTCCGGTGAAGATGGAACGCTCGACGCTCTTAAGTGTGCAGCTTGCGGCTGCCACCGCAACTTCCACCGCAAGGAAACCGAAAGCATCGGCGGTAGAGCCCACAGAGTTCCCACGTACTACAACCGCCCGCCGCAGCCGCATCAGCCGCCTGGATATCTTCATCTAACATCTCCCGCGGCGCCTTACAGGCCACCCGCGGCATCGGGGGACGAGGAGGATACATCAAATCCTAGCAGCAGCGGCGGGACCACGAAGAGGTTTAGAACGAAGTTCACGGCGGAACAGAAAGAGAAGATGTTAGCCTTTGCGGAGAGGTTGGGGTGGAGAATTCAGAAGCATGATGACGTGGCGGTTGAGCAGTTCTGTGCGGAGACTGGTGTTAGGAGACAAGTGCTTAAAATCTGGATGCATAACAACAAGAACTCTCTTGGTAAGAAACCCTAATTTTGCTCGAGACATGATTTAAAACACTAGAGGATCATAATTGTTTCTTTTTTTGGTATGACTCTTCTGTAACTACTTCTGCTTATTAGTTATGTTATTTTTTCCTGG

SEQ ID NO: 1409 - DNA, 1605 bp, Arabidopsis thaliana
  misc_feature (1)..(1605): Ceres cDNA ID no. 12578286
  misc_feature (1)..(1605): Ceres CLONE  ID no. 1333155
  misc_feature (1)..(1605): Also known as  Ceres CDNA ID no. 23461328
aagtttctctcacgttctcttttttaattttaatttctcgccggaaacaatctcatctcccggcgaacgaaacttccggtgtggtactgcaaacggagaaaaaaataaccaaagaagagagaaactcaaaagctactaagatggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtgaaactagaagtgggagtatgcgcgagtgctagccagggagggagttgtgcatagaagtatcggttcggcctttggagaaaagtcgaagatagcaaagtagagaagagatcatgaacaaagctaaatttggtggtggtggtgaaaagggtttttgtaaagttggaacctttttttggtagggaagaaagtagcaaggttgtgtaatggtccgaactccaatgctattgtatgttcttacatccaaaaaaaagaaaagcagaagagaagtgatgtacaatgagaagcttattttattgtaactcaagaataattcaggtaattagttt

SEQ ID NO: 1410 - protein, 1605 aa, Arabidopsis thaliana
  misc_feature: PFam Name: HLH; PFam Description: Helix-loop-helix
  misc_feature: GI Number: 52421281; NR Description: At2g42280 [Arabidopsis thaliana] >gi|51536448|gb|AAU05462.1| At2g42280 [Arabidopsis thaliana] >gi|42569863|ref|NP_181757.2| basic helix-loop-helix
  misc_feature: GI Number: 50947455; NR Description: putative transcription factor RAU1 [Oryza sativa (japonica cultivar-group)] >gi|42408931|dbj|BAD10188.1| putative transcription factor RAU1
  misc_feature: GI Number: 6166283; NR Description: helix-loop-helix protein
  misc_feature: GI Number: 19401700; NR Description: transcription factor
  misc_feature: GI Number: 20127088; NR Description: putative bHLH transcription factor [Arabidopsis thaliana] >gi|20147401|gb|AAM10410.1| At1g35460/F12A4_2 [Arabidopsis thaliana] >gi|15724178|gb|AAL06481.1| At1g35460/F12A4_2
AAGTTTCTCTCACGTTCTCTTTTTTAATTTTAATTTCTCGCCGGAAACAATCTCATCTCCCGGCGAACGAAACTTCCGGTGTGGTACTGCAAACGGAGAAAAAAATAACCAAAGAAGAGAGAAACTCAAAAGCTACTAAGATGGAATCAGAATTCCAGCAACATCACTTCCTTCTCCACGATCATCAACACCAGAGACCAAGAAACTCAGGATTGATTCGTTACCAATCAGCACCAAGTTCGTACTTTTCGAGTTTCGGTGAATCAATCGAAGAGTTTTTAGATCGACCCACAAGTCCTGAAACTGAGCGAATCTTATCTGGCTTTTTACAAACCACCGACACAAGCGACAACGTTGATAGTTTCCTTCACCATACTTTTAACAGTGATGGAACTGAGAAGAAACCTCCGGAAGTTAAAACAGAGGACGAAGATGCTGAAATTCCGGTGACTGCGACGGCGACGGCGATGGAGGTTGTTGTTTCCGGTGATGGTGAAATCTCAGTGAATCCTGAAGTATCGATTGGGTATGTGGCTTCGGTTTCGAGGAATAAGAGACCAAGAGAGAAAGATGATCGGACTCCGGTGAATAATCTAGCTCGTCATAATAGTTCACCGGCCGGATTATTTTCATCCATTGATGTTGAAACAGCTTATGCAGCTGTAATGAAAAGTATGGGAGGTTTTGGAGGAAGTAATGTGATGAGTACAAGCAATACTGAAGCTTCGTCTCTTACTCCTAGAAGCAAGTTACTTCCTCCTACTTCTAGAGCGATGAGTCCGATCTCTGAGGTTGATGTTAAACCCGGTTTCTCGTCTAGATTGCCTCCTCGGACGCTTTCCGGTGGGTTTAATCGTTCTTTTGGGAATGAAGGGTCTGCTTCTTCCAAGCTTACAGCTCTTGCTAGGACCCAATCTGGAGGTCTAGATCAATACAAAACCAAGGATGAGGATTCAGCAAGTAGACGTCCTCCTTTGGCACATCACATGAGTTTGCCCAAGTCTTTATCAGATATTGAACAGTTACTGTCAGATTCTATCCCATGTAAGATCAGAGCCAAGCGGGGTTGTGCAACTCATCCTCGAAGCATAGCCGAGAGGGTGAGAAGAACCAAGATCAGTGAAAGAATGAGGAAGCTGCAAGACCTTGTTCCAAACATGGACACGCAAACAAACACAGCAGACATGTTGGATCTTGCGGTTCAATACATCAAGGACCTGCAAGAACAAGTGAAGGCGCTCGAAGAGAGTCGGGCAAGATGTAGATGCTCTAGTGCGTGAAACTAGAAGTGGGAGTATGCGCGAGTGCTAGCCAGGGAGGGAGTTGTGCATAGAAGTATCGGTTCGGCCTTTGGAGAAAAGTCGAAGATAGCAAAGTAGAGAAGAGATCATGAACAAAGCTAAATTTGGTGGTGGTGGTGAAAAGGGTTTTTGTAAAGTTGGAACCTTTTTTTGGTAGGGAAGAAAGTAGCAAGGTTGTGTAATGGTCCGAACTCCAATGCTATTGTATGTTCTTACATCCAAAAAAAAGAAAAGCAGAAGAGAAGTGATGTACAATGAGAAGCTTATTTTATTGTAACTCAAGAATAATTCAGGTAATTAGTTT

SEQ ID NO: 1411 - DNA, 1462 bp, Arabidopsis thaliana
  misc_feature (1)..(1462): Ceres cDNA ID no. 12578784
  misc_feature (1)..(1462): Ceres CLONE  ID no. 27047
  misc_feature (1)..(1462): Also known as  Ceres CDNA ID no. 23462116
ctccgatgtttcaaaaacaaagtcgattacgctagaatccatggtcacgacatcttctacagcaattctcttcttcatccgaagatgaattcgtattgggcgaaacttccggtggttaaagctgcgatgcttgctcacccatttatggattgaagctttagagagaaaatgggtgatgaggcagagatcaaggaacatttaaagccacaagcttcatctgaaacaatagacaagaaacataatgtgaaagggaagaggttatggcagaaagtcaagtatcaattggtggagtttcattcattgcctgcttatttaagagacaatgagtacatcattggtcattaccgatccgaatggcggatcaaacagattcttctcagcatctttaccattcataatgagactttgaatgtttggacgcatttgattgggtttttcctgtttttggcactcactatatacactgcaacgaaagtaccgagtgtcgtggatcttcattcgcttcaacaccgtttacccgatttgttgaggaaaacagatctccacaaacttcattctgagctcatgtctcgccttccttctagtccatctagttggcatgtgatggaccttctttataactgtttgcctgaaagattttctcatggcaactacactgacatgtgtgttctgcattctgtgagggaagatcttgcaaacttgatagctcctttgatcttcaggccaattactcgatggccgttttatgcatttctaggtggtgctatattctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcctggagtttcgggtggtgagggcgtctctgttctttggaatgggattctctggcttagctccgattcttcacaagctgatcatcttttgggaccaacctgaagcccttcacatgacaggttatgagattttgatgggtttgctttatgggttaggagctgtggtttatgcaactaggatcccagagagatggatgccgggtaaattcgatatagcaggacatagccatcagttgtttcatgttctggttgttgctggtgcgttaacgcactatagagctgggctagtgtatcttaagtggagagatattgaaggatgttgaagatgaagattgaagattagatggaatctttgatgttttaaatcttgtttgtagtagcttcatataaaagttggattatgtaaagtcttatctgtaatcaaacgtttaattgtttcttttattcaacaaaggattc

SEQ ID NO: 1412 - protein, 1462 aa, Arabidopsis thaliana
  misc_feature: PFam Name: HlyIII; PFam Description: Haemolysin-III related
  misc_feature: PFam Name: Glyco_transf_34; PFam Description: galactosyl
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 31209635; NR Description: ENSANGP00000012224 [Anopheles gambiae] >gi|30176836|gb|EAA09141.2| ENSANGP00000012224
  misc_feature: GI Number: 17555616; NR Description: i-45 protein (3G466)
  misc_feature: GI Number: 25396071; NR Description: protein C43G2.1
  misc_feature: GI Number: 51593696; NR Description: MGC85478 protein
CTCCGATGTTTCAAAAACAAAGTCGATTACGCTAGAATCCATGGTCACGACATCTTCTACAGCAATTCTCTTCTTCATCCGAAGATGAATTCGTATTGGGCGAAACTTCCGGTGGTTAAAGCTGCGATGCTTGCTCACCCATTTATGGATTGAAGCTTTAGAGAGAAAATGGGTGATGAGGCAGAGATCAAGGAACATTTAAAGCCACAAGCTTCATCTGAAACAATAGACAAGAAACATAATGTGAAAGGGAAGAGGTTATGGCAGAAAGTCAAGTATCAATTGGTGGAGTTTCATTCATTGCCTGCTTATTTAAGAGACAATGAGTACATCATTGGTCATTACCGATCCGAATGGCGGATCAAACAGATTCTTCTCAGCATCTTTACCATTCATAATGAGACTTTGAATGTTTGGACGCATTTGATTGGGTTTTTCCTGTTTTTGGCACTCACTATATACACTGCAACGAAAGTACCGAGTGTCGTGGATCTTCATTCGCTTCAACACCGTTTACCCGATTTGTTGAGGAAAACAGATCTCCACAAACTTCATTCTGAGCTCATGTCTCGCCTTCCTTCTAGTCCATCTAGTTGGCATGTGATGGACCTTCTTTATAACTGTTTGCCTGAAAGATTTTCTCATGGCAACTACACTGACATGTGTGTTCTGCATTCTGTGAGGGAAGATCTTGCAAACTTGATAGCTCCTTTGATCTTCAGGCCAATTACTCGATGGCCGTTTTATGCATTTCTAGGTGGTGCTATATTCTGTCTATTAGCAAGCAGCACGTGCCACCTCCTCTCATGTCACTCCGAGCGAGTCTCCTACATAATGCTTAGGCTTGATTACGCCGGCATCGCAGCTCTAATAGCGACTTCCTTCTACCCTCCGGTTTATTACTCCTTCATGTGTGATCCTTTCTTCTGCAACCTCTACTTAGGATTCATAACCATCTTAGGAATCGCCACTGTGCTTGTTTCTCTCCTCCCGGTTTTCCAAAGCCTGGAGTTTCGGGTGGTGAGGGCGTCTCTGTTCTTTGGAATGGGATTCTCTGGCTTAGCTCCGATTCTTCACAAGCTGATCATCTTTTGGGACCAACCTGAAGCCCTTCACATGACAGGTTATGAGATTTTGATGGGTTTGCTTTATGGGTTAGGAGCTGTGGTTTATGCAACTAGGATCCCAGAGAGATGGATGCCGGGTAAATTCGATATAGCAGGACATAGCCATCAGTTGTTTCATGTTCTGGTTGTTGCTGGTGCGTTAACGCACTATAGAGCTGGGCTAGTGTATCTTAAGTGGAGAGATATTGAAGGATGTTGAAGATGAAGATTGAAGATTAGATGGAATCTTTGATGTTTTAAATCTTGTTTGTAGTAGCTTCATATAAAAGTTGGATTATGTAAAGTCTTATCTGTAATCAAACGTTTAATTGTTTCTTTTATTCAACAAAGGATTC

SEQ ID NO: 1413 - DNA, 2633 bp, Zea mays
  misc_feature (1)..(2633): Ceres cDNA ID no. 12579310
  misc_feature (1)..(2633): Ceres CLONE  ID no. 378366
  misc_feature (1)..(2633): Also known as  Ceres CDNA ID no. 23829784
gcacgagaccattacctagaacatcctaatcgaaaaacgagaggagagagagagagagagagagtgcgtgcgaatgcggagttactcggggactggtacgagcggagcaggggtgggcggtgggggaagcgagtggaagattgggagccaagagcacggagagtgccccgggatcttcacctcccatcattcgagggtggagtgctgtctgcgcagaaatctgctcaccgggtgccaggaaacaggtagctgtagagaattgcttggggattcgtcaagaaacgacccagtaggtggttgtgcacttgttatgctgagactgaatggaggctgtagacaagattgctgagcccaaagacccttttgtgctcactgcccagaaggttcagagctcggagccaccgatacctataaaggcgtcatgtgaagggaatgactcccaacagcaagaagagacggatttgccagatgatggcgaagagagcttccggagcatggattcctctgatgaaggtgtccggagctccttctctggggctagtcaccctccagagcctattgacatggatatcatgaagacagtctatgttgcaatcgacgagaagtccgagccaccggttagtttagtgcgaggagtctcggtgaaggggcctttcatagatgacctctcgatccgtgttacaggcgcaaaggcaaatctggtggtaggtgcaggcggtgctgaaggtatggctgaagagaggaaggtatctgcttctgcagtggcatcagtcaccacagcaaggtcgtctcaggctacctctttgcctcaggactcggaggagaaggagtgcgtctgggacgcttcactccctccgagtggcaatgttagccctcacagtagtattgacagcatgggtgtggtcactgctatgagcaccctcaacagctgcacgagcacatataaaagcgagaccatagctggtgaagcaatgctcaatgtggagaggaactgtgagagtgtaaagggtgttcgaggtgacttactagaaagtgcaaaaaccagcatgagtcgagcaagtgatagcagtgttgttagtgatgacagcagctggagccacatcactggaggtgccagcaagcctcacaaggggaatgatcctagatggaaggcaattcatgctgtacgaactcgtgatagcgtgcttggaatgagccattttagactactaaagcgtcttggttgtggtgacattggcagtgtttacctctcagaattaagtggaactcggtgctactttgcaatgaaggtaatggacaaggcatccttggcaagtaggaaaaagttaaatagggctcaaactgaaagggagattctacagcttcttgaccacccattcctcccaacgttgtatacacattttgaaaccgacaggttctcttgtttggtgatggaattctgtccaggtggtgatctgcatactttgcgacagagacaaccaggaaagcatttctctgagtatgctgcaaggttttatgccgcagaagtacttctagctctggagtatctacacatgttgggagtggtctatagagatctgaagcctgaaaatgttcttgtgcgcgatgatgggcacataatgctttcagactttgacctctcgctgagatgtgcagtctcacctacactcatcagaacatcagctttcgattctgatcccagaagagcaggtggttctttctgtgtacagcctgcttgcatagaacctacttcagcttgtatccagcctgcgtgcttcctccccaaattcttcggacagaagagcaagaagaagactcgaaaggcaaggtctgagttgggacataacgccggcaccctgcccgagcttgttgccgagccaacatcagctcggtcgatgtcatttgtcgggacccatgaatacttggcccctgaaatcatcaaaggcgaagggcacggaagcgctgtcgactggtggaccttcggcatcttcctgcatgagctgctgtacggcaagaccccgttcaaggggtcagggaaccgcgccaccctgttcaacgtggtaggccagcaactgaaatttccggagtcgccgtccacaagctactcgagcagagacctcatccgtgggctcttggtcaaggagccgcagagccgcctgggcgtgaagcggggagcgacagagataaagcagcatgccttcttcgagggtgttaactgggctctcatccggtgcagcactcctcccgaggtcccgaggcctgttgaggccgagctgcctgtgaagtatggggtggcggaggcgatcgggagcaacagcaagcgggtagtcggagcagacgtgaagtcggccggaaaatacctggactttgagttcttttaagagcagtgcgtgcccagtggcagctattgtttgcgtactgtccgtgtatggtcggttttgatttttgtgtgattcgatatggtgatttgtgcctcgccgtcgatgcacaattgtcaggtttgaatcgaccaaaattaggtaggtgtgtgttgccatttgcctgctttggcacatttcgagtttatgtatggaactatgtatagagtatgcattgcaatttgcagcaaacctgaaaagcagctaagaaggccc

SEQ ID NO: 1414 - protein, 2633 aa, Zea mays
  misc_feature: PFam Name: Pkinase; PFam Description: Protein kinase domain
  misc_feature: GI Number: 19310387; NR Description: At2g44830/T13E15.16
  misc_feature: GI Number: 34365765; NR Description: At3g27580 [Arabidopsis thaliana] >gi|11994185|dbj|BAB01288.1| serine/threonine-protein kinase [Arabidopsis thaliana] >gi|303500|dbj|BAA01716.1| serine/threonine protein kinase [Arabidopsis thaliana]
  misc_feature: GI Number: 125568; NR Description: Protein kinase PVPK-1 >gi|100013|pir||A30311 protein kinase C (EC 2.7.1.-) homolog -
  misc_feature: GI Number: 20259910; NR Description: protein kinase 5 [Arabidopsis thaliana] >gi|17064850|gb|AAL32579.1| protein kinase 5
  misc_feature: GI Number: 7716430; NR Description: protein kinase KIPK
GCACGAGACCATTACCTAGAACATCCTAATCGAAAAACGAGAGGAGAGAGAGAGAGAGAGAGAGTGCGTGCGAATGCGGAGTTACTCGGGGACTGGTACGAGCGGAGCAGGGGTGGGCGGTGGGGGAAGCGAGTGGAAGATTGGGAGCCAAGAGCACGGAGAGTGCCCCGGGATCTTCACCTCCCATCATTCGAGGGTGGAGTGCTGTCTGCGCAGAAATCTGCTCACCGGGTGCCAGGAAACAGGTAGCTGTAGAGAATTGCTTGGGGATTCGTCAAGAAACGACCCAGTAGGTGGTTGTGCACTTGTTATGCTGAGACTGAATGGAGGCTGTAGACAAGATTGCTGAGCCCAAAGACCCTTTTGTGCTCACTGCCCAGAAGGTTCAGAGCTCGGAGCCACCGATACCTATAAAGGCGTCATGTGAAGGGAATGACTCCCAACAGCAAGAAGAGACGGATTTGCCAGATGATGGCGAAGAGAGCTTCCGGAGCATGGATTCCTCTGATGAAGGTGTCCGGAGCTCCTTCTCTGGGGCTAGTCACCCTCCAGAGCCTATTGACATGGATATCATGAAGACAGTCTATGTTGCAATCGACGAGAAGTCCGAGCCACCGGTTAGTTTAGTGCGAGGAGTCTCGGTGAAGGGGCCTTTCATAGATGACCTCTCGATCCGTGTTACAGGCGCAAAGGCAAATCTGGTGGTAGGTGCAGGCGGTGCTGAAGGTATGGCTGAAGAGAGGAAGGTATCTGCTTCTGCAGTGGCATCAGTCACCACAGCAAGGTCGTCTCAGGCTACCTCTTTGCCTCAGGACTCGGAGGAGAAGGAGTGCGTCTGGGACGCTTCACTCCCTCCGAGTGGCAATGTTAGCCCTCACAGTAGTATTGACAGCATGGGTGTGGTCACTGCTATGAGCACCCTCAACAGCTGCACGAGCACATATAAAAGCGAGACCATAGCTGGTGAAGCAATGCTCAATGTGGAGAGGAACTGTGAGAGTGTAAAGGGTGTTCGAGGTGACTTACTAGAAAGTGCAAAAACCAGCATGAGTCGAGCAAGTGATAGCAGTGTTGTTAGTGATGACAGCAGCTGGAGCCACATCACTGGAGGTGCCAGCAAGCCTCACAAGGGGAATGATCCTAGATGGAAGGCAATTCATGCTGTACGAACTCGTGATAGCGTGCTTGGAATGAGCCATTTTAGACTACTAAAGCGTCTTGGTTGTGGTGACATTGGCAGTGTTTACCTCTCAGAATTAAGTGGAACTCGGTGCTACTTTGCAATGAAGGTAATGGACAAGGCATCCTTGGCAAGTAGGAAAAAGTTAAATAGGGCTCAAACTGAAAGGGAGATTCTACAGCTTCTTGACCACCCATTCCTCCCAACGTTGTATACACATTTTGAAACCGACAGGTTCTCTTGTTTGGTGATGGAATTCTGTCCAGGTGGTGATCTGCATACTTTGCGACAGAGACAACCAGGAAAGCATTTCTCTGAGTATGCTGCAAGGTTTTATGCCGCAGAAGTACTTCTAGCTCTGGAGTATCTACACATGTTGGGAGTGGTCTATAGAGATCTGAAGCCTGAAAATGTTCTTGTGCGCGATGATGGGCACATAATGCTTTCAGACTTTGACCTCTCGCTGAGATGTGCAGTCTCACCTACACTCATCAGAACATCAGCTTTCGATTCTGATCCCAGAAGAGCAGGTGGTTCTTTCTGTGTACAGCCTGCTTGCATAGAACCTACTTCAGCTTGTATCCAGCCTGCGTGCTTCCTCCCCAAATTCTTCGGACAGAAGAGCAAGAAGAAGACTCGAAAGGCAAGGTCTGAGTTGGGACATAACGCCGGCACCCTGCCCGAGCTTGTTGCCGAGCCAACATCAGCTCGGTCGATGTCATTTGTCGGGACCCATGAATACTTGGCCCCTGAAATCATCAAAGGCGAAGGGCACGGAAGCGCTGTCGACTGGTGGACCTTCGGCATCTTCCTGCATGAGCTGCTGTACGGCAAGACCCCGTTCAAGGGGTCAGGGAACCGCGCCACCCTGTTCAACGTGGTAGGCCAGCAACTGAAATTTCCGGAGTCGCCGTCCACAAGCTACTCGAGCAGAGACCTCATCCGTGGGCTCTTGGTCAAGGAGCCGCAGAGCCGCCTGGGCGTGAAGCGGGGAGCGACAGAGATAAAGCAGCATGCCTTCTTCGAGGGTGTTAACTGGGCTCTCATCCGGTGCAGCACTCCTCCCGAGGTCCCGAGGCCTGTTGAGGCCGAGCTGCCTGTGAAGTATGGGGTGGCGGAGGCGATCGGGAGCAACAGCAAGCGGGTAGTCGGAGCAGACGTGAAGTCGGCCGGAAAATACCTGGACTTTGAGTTCTTTTAAGAGCAGTGCGTGCCCAGTGGCAGCTATTGTTTGCGTACTGTCCGTGTATGGTCGGTTTTGATTTTTGTGTGATTCGATATGGTGATTTGTGCCTCGCCGTCGATGCACAATTGTCAGGTTTGAATCGACCAAAATTAGGTAGGTGTGTGTTGCCATTTGCCTGCTTTGGCACATTTCGAGTTTATGTATGGAACTATGTATAGAGTATGCATTGCAATTTGCAGCAAACCTGAAAAGCAGCTAAGAAGGCCC

SEQ ID NO: 1415 - DNA, 649 bp, Arabidopsis thaliana
  misc_feature (1)..(649): Ceres cDNA ID no. 12579460
  misc_feature (1)..(649): Ceres CLONE  ID no. 18023
  misc_feature (1)..(649): Also known as  Ceres CDNA ID no. 23462277
  misc_feature (630)..(630): n is a, c, t, g, unknown, or other
atcagctcctctatctctctctttcctgattgtcttcatcaaaaactggaaaaagcaaatcaagaaaagagaagaagaagcagatgtgtccgttaaggcttgatctcatcactcactatcaacaactccatctgcttcttcctctcgatccccattccaactctccactcctcaacaatcatcttagcattcagaaactgatcccaaaaaacaggaaatgtaagcaacggtactcccgaacatatcccttccaatgtcgagttatacccgcaatgcgtccaaaacccgcctatagccgcatgacacaaaacacgtagctgatcacaccagctcaccacaacacccaagctaccttcaagagcctccttaagctttaactcacccccacgagccacccaaaagaacttaactccagcctctctaactcctacaacaatctcctccatctgagcttcggagactgaaagaaaactcccttgagatatgtaaagaacagagctttcaggttgctaatcaagccacttaaagtaatcaagttctctattctcatttccaacggatagttcttccaagggtattaacggaccagtggagtaaaccgggaaatcaaacttggaagtgaaaaagtcnatggcttttggttaagatg

SEQ ID NO: 1416 - protein, 649 aa, Arabidopsis thaliana
ATCAGCTCCTCTATCTCTCTCTTTCCTGATTGTCTTCATCAAAAACTGGAAAAAGCAAATCAAGAAAAGAGAAGAAGAAGCAGATGTGTCCGTTAAGGCTTGATCTCATCACTCACTATCAACAACTCCATCTGCTTCTTCCTCTCGATCCCCATTCCAACTCTCCACTCCTCAACAATCATCTTAGCATTCAGAAACTGATCCCAAAAAACAGGAAATGTAAGCAACGGTACTCCCGAACATATCCCTTCCAATGTCGAGTTATACCCGCAATGCGTCCAAAACCCGCCTATAGCCGCATGACACAAAACACGTAGCTGATCACACCAGCTCACCACAACACCCAAGCTACCTTCAAGAGCCTCCTTAAGCTTTAACTCACCCCCACGAGCCACCCAAAAGAACTTAACTCCAGCCTCTCTAACTCCTACAACAATCTCCTCCATCTGAGCTTCGGAGACTGAAAGAAAACTCCCTTGAGATATGTAAAGAACAGAGCTTTCAGGTTGCTAATCAAGCCACTTAAAGTAATCAAGTTCTCTATTCTCATTTCCAACGGATAGTTCTTCCAAGGGTATTAACGGACCAGTGGAGTAAACCGGGAAATCAAACTTGGAAGTGAAAAAGTCNATGGCTTTTGGTTAAGATG

SEQ ID NO: 1417 - DNA, 977 bp, Arabidopsis thaliana
  misc_feature (1)..(977): Ceres cDNA ID no. 12579830
  misc_feature (1)..(977): Ceres CLONE  ID no. 206263
  misc_feature (1)..(977): Also known as  Ceres CDNA ID no. 23462598
atcgagaaacctcgaaatcaaaaagcacgtcggtgatggttcttacaccgttggagatttcgccaccgagactctcacaatcggctcaactctagttcaaaacgtcgccgttggttgtggacacagcaacgaatggttgttcgtcggcgccgccggtttacttggactcggcggtggtttgttagctcttccgtcgcagctcaacacgacgtcgttctcgtactgtctcgttgaccgtgactcagactcggcttcgaccgtggatttcgggacttctctttctcctgacgccgtcgtggctccgttgctacgtaaccaccagctcgacacgttttactacctaggcctcaccggaataagcgtcggcggcgagttgcttcagattcctcagtcttctttcgagatggacgagtcaggcagcggtgggatcatcatcgactcaggaaccgccgtgactcgtctccagaccgaaatctataactcgcttagagactcgttcgtgaaaggaacgtcggacttggaaaaagcagccggggtggcgatgtttgacacgtgttataacctttcggctaagacgacggtagaagtcccgaccgtggcttttcatttccccggcgggaagatgttggctttgccggcgaagaactacatgattccggttgactcggtggggacattttgtttggcatttgcaccgacggcgagttcactagcgattatcggaaacgtgcagcaacaagggacacgtgtcactttcgatttggcaaattctctcattggattctcgtctaataaatgctaagctgttttcatcaaaaaaaacaaaaatgctaagctgttttttctataaatatatttgagttacaatgaaaaggaaaagtcacttaaaagatagtaatgttaagttagagtactgtactactgtttggttgtgtttgtttcttgtacttgttgttgcaatgcatagagtgaaaaag

SEQ ID NO: 1418 - protein, 977 aa, Arabidopsis thaliana
  misc_feature: PFam Name: Asp; PFam Description: Eukaryotic aspartyl protease
  misc_feature: GI Number: 34895664; NR Description: nucleoid DNA-binding protein cnd41-like protein [Oryza sativa (japonica cultivar-group)] >gi|12328547|dbj|BAB21205.1| nucleoid DNA-binding protein
  misc_feature: GI Number: 19424106; NR Description: putative chloroplast
  misc_feature: GI Number: 23297732; NR Description: putative chloroplast nucleoid DNA-binding protein [Arabidopsis thaliana] >gi|11994113|dbj|BAB01116.1| CND41, chloroplast nucleoid DNA binding protein-like [Arabidopsis thaliana]
  misc_feature: GI Number: 15231010; NR Description: aspartyl protease family
  misc_feature: GI Number: 21594980; NR Description: chloroplast nucleoid DNA
ATCGAGAAACCTCGAAATCAAAAAGCACGTCGGTGATGGTTCTTACACCGTTGGAGATTTCGCCACCGAGACTCTCACAATCGGCTCAACTCTAGTTCAAAACGTCGCCGTTGGTTGTGGACACAGCAACGAATGGTTGTTCGTCGGCGCCGCCGGTTTACTTGGACTCGGCGGTGGTTTGTTAGCTCTTCCGTCGCAGCTCAACACGACGTCGTTCTCGTACTGTCTCGTTGACCGTGACTCAGACTCGGCTTCGACCGTGGATTTCGGGACTTCTCTTTCTCCTGACGCCGTCGTGGCTCCGTTGCTACGTAACCACCAGCTCGACACGTTTTACTACCTAGGCCTCACCGGAATAAGCGTCGGCGGCGAGTTGCTTCAGATTCCTCAGTCTTCTTTCGAGATGGACGAGTCAGGCAGCGGTGGGATCATCATCGACTCAGGAACCGCCGTGACTCGTCTCCAGACCGAAATCTATAACTCGCTTAGAGACTCGTTCGTGAAAGGAACGTCGGACTTGGAAAAAGCAGCCGGGGTGGCGATGTTTGACACGTGTTATAACCTTTCGGCTAAGACGACGGTAGAAGTCCCGACCGTGGCTTTTCATTTCCCCGGCGGGAAGATGTTGGCTTTGCCGGCGAAGAACTACATGATTCCGGTTGACTCGGTGGGGACATTTTGTTTGGCATTTGCACCGACGGCGAGTTCACTAGCGATTATCGGAAACGTGCAGCAACAAGGGACACGTGTCACTTTCGATTTGGCAAATTCTCTCATTGGATTCTCGTCTAATAAATGCTAAGCTGTTTTCATCAAAAAAAACAAAAATGCTAAGCTGTTTTTTCTATAAATATATTTGAGTTACAATGAAAAGGAAAAGTCACTTAAAAGATAGTAATGTTAAGTTAGAGTACTGTACTACTGTTTGGTTGTGTTTGTTTCTTGTACTTGTTGTTGCAATGCATAGAGTGAAAAAG

SEQ ID NO: 1419 - DNA, 1097 bp, Arabidopsis thaliana
  misc_feature (1)..(1097): Ceres cDNA ID no. 12579976
  misc_feature (1)..(1097): Ceres CLONE  ID no. 4527
  misc_feature (1)..(1097): Also known as  Ceres CDNA ID no. 24418205
cccctcactttaagctcttcttcactcacactctctcaaaaatcaccaaacgaaactcttcactctctccaacaatggccaagaagatgagttctctcatcatcatcttcaacattctccttctcctcacaactcaaacccacgcgcacaacgtcacgcgcctcctagcaaaccacccatcattctcttccttcagccatttcctaacacaaacacacctcgccgacgaaatcaaccggagaagaaccataaccgtttgcgcagtagataacgccgccatgtcagcattaacctctaaaggctatacactctcaactctcaaaaacattctctccctccacgtccttttagattacttcggaaccaaaaaactccaccagatccgtgacggctctgctctcgccgctactctgtttcaagccaccggagctgctcctggaacctcaggattcgttaacataacggatctgagaggtggtaaagttgggtttggtcctgacggtggagatctgtcttctttctttgttaaatctattgaagaagttccgtataacatctccattattcagatcagtagagttttaccgtcggagactgcggcggctccgactcctgctccggcggagatgaatcttaccggaataatgtcggctcatggatgcaaagtggtgctgagactcttctcactaaccctggagcttcaaaaacctatcaggagagtttagaaggaggcatgacagtgttctgtccaggagatgatgcaatgaaaggtttcttgcccaaatacaagaacttgacagctccaaagaaagaagcatttctcgatttcctcgctgtcccgacatattactcaatggcgatgctcaaatccaacaatggtccgatgaacacacttgcgacagatggagctaacaagtttgagcttactgtacagaacgatggagagaaggttaccctcaagacaaggatcaacactgtcaagatcgttgatactcttattgatgagcagcctttagctatatatgcgactgataaggttttgttgcctaaagagttgttaaagatattaaaagctcatcttaatgaaagattgattc

SEQ ID NO: 1420 - protein, 1097 aa, Arabidopsis thaliana
  misc_feature: PFam Name: Fasciclin; PFam Description: Fasciclin domain
  misc_feature: GI Number: 22655474; NR Description: At4g12730/T20K18_80 [Arabidopsis thaliana] >gi|4586249|emb|CAB40990.1| putative pollen surface protein [Arabidopsis thaliana] >gi|7267974|emb|CAB78315.1| putative pollen surface protein
  misc_feature: GI Number: 13377778; NR Description: fasciclin-like
  misc_feature: GI Number: 21593810; NR Description: putative pollen surface
  misc_feature: GI Number: 14190409; NR Description: AT3g60900/T4C21_310
  misc_feature: GI Number: 21593224; NR Description: endosperm specific protein-like [Arabidopsis thaliana] >gi|7329700|emb|CAB82694.1| endosperm specific protein-like [Arabidopsis thaliana] >gi|38257776|sp|Q9LZX4|FA10_ARATH Fasciclin-like arabinogalactan
CCCCTCACTTTAAGCTCTTCTTCACTCACACTCTCTCAAAAATCACCAAACGAAACTCTTCACTCTCTCCAACAATGGCCAAGAAGATGAGTTCTCTCATCATCATCTTCAACATTCTCCTTCTCCTCACAACTCAAACCCACGCGCACAACGTCACGCGCCTCCTAGCAAACCACCCATCATTCTCTTCCTTCAGCCATTTCCTAACACAAACACACCTCGCCGACGAAATCAACCGGAGAAGAACCATAACCGTTTGCGCAGTAGATAACGCCGCCATGTCAGCATTAACCTCTAAAGGCTATACACTCTCAACTCTCAAAAACATTCTCTCCCTCCACGTCCTTTTAGATTACTTCGGAACCAAAAAACTCCACCAGATCCGTGACGGCTCTGCTCTCGCCGCTACTCTGTTTCAAGCCACCGGAGCTGCTCCTGGAACCTCAGGATTCGTTAACATAACGGATCTGAGAGGTGGTAAAGTTGGGTTTGGTCCTGACGGTGGAGATCTGTCTTCTTTCTTTGTTAAATCTATTGAAGAAGTTCCGTATAACATCTCCATTATTCAGATCAGTAGAGTTTTACCGTCGGAGACTGCGGCGGCTCCGACTCCTGCTCCGGCGGAGATGAATCTTACCGGAATAATGTCGGCTCATGGATGCAAAGTGGTGCTGAGACTCTTCTCACTAACCCTGGAGCTTCAAAAACCTATCAGGAGAGTTTAGAAGGAGGCATGACAGTGTTCTGTCCAGGAGATGATGCAATGAAAGGTTTCTTGCCCAAATACAAGAACTTGACAGCTCCAAAGAAAGAAGCATTTCTCGATTTCCTCGCTGTCCCGACATATTACTCAATGGCGATGCTCAAATCCAACAATGGTCCGATGAACACACTTGCGACAGATGGAGCTAACAAGTTTGAGCTTACTGTACAGAACGATGGAGAGAAGGTTACCCTCAAGACAAGGATCAACACTGTCAAGATCGTTGATACTCTTATTGATGAGCAGCCTTTAGCTATATATGCGACTGATAAGGTTTTGTTGCCTAAAGAGTTGTTAAAGATATTAAAAGCTCATCTTAATGAAAGATTGATTC

SEQ ID NO: 1421 - DNA, 999 bp, Arabidopsis thaliana
  misc_feature (1)..(999): Ceres cDNA ID no. 12580301
  misc_feature (1)..(999): Ceres CLONE  ID no. 1007935
  misc_feature (1)..(999): Also known as  Ceres CDNA ID no. 23462982
  misc_feature (431)..(431): n is a, c, t, g, unknown, or other
  misc_feature (494)..(494): n is a, c, t, g, unknown, or other
  misc_feature (512)..(512): n is a, c, t, g, unknown, or other
  misc_feature (514)..(514): n is a, c, t, g, unknown, or other
  misc_feature (646)..(646): n is a, c, t, g, unknown, or other
  misc_feature (674)..(674): n is a, c, t, g, unknown, or other
  misc_feature (800)..(800): n is a, c, t, g, unknown, or other
aaaattcaatgggagaggaagataagaaaatggaggagaagaaatctgaagagccacaagcgaaatcagaagataagaaaccagaagaagagaaaaagaaagaacctcaagagattgtgcttaagatttttatgcattgtgaaggttgtgctaaaaaaatccatagatgtcttaaaggctttgaaggagtggaggatgtaactactgattgtaagactagtaaagttgtggtgaaaggagagaaggcagatccattaaaagtgttgcaaagattgcagaggaagagccatcgtcaagtggagcttatctcaccgattccggagcctaaaccggtttctgataaaccggagaaaaaggagaaggagaaacctaaacctgaggagaaaaaagaagaggtagtgacagtggtgctgagagttcacatgcattgngaagcatgtgccatggagattcaaaagaggatcatgagaatgaaaggagtggagtctgtgganccagattttaaagcatcncnagtgagcgtgaaaggagtttttacgccggaaaagctagttgagttcatttacaagagaatcgggaagcatgccgcggttgtcaagcaagatccgccgccaaaacctccggagaaagaaaaagaaacgaaagncaaagacgagaagaaaaaggaagagggncagcccaaagaaggaaaagaggccaaggaaaacggtggtggaggaggtgctaaaggcgatggtgctgccgcggaggaggggaacaaagtggtagacttgaagaagaacgaatatcagtaccagccnccgaggtaccccgtggagatgtttgcttatccaccgcagatattcagtgatgaaaaccccaatgcttgtaccattatgtaataaaatcgtcggtttaaggggttgtaggatttgttatttttttactttatttctatgcagaattttaatttaaatgtatttttggtaatttttagtttcaaccgaattgaatgatcgc

SEQ ID NO: 1422 - protein, 999 aa, Arabidopsis thaliana
  misc_feature: PFam Name: HMA; PFam Description: Heavy-metal-associated domain
  misc_feature: PFam Name: Dehydrin; PFam Description: Dehydrin
  misc_feature: GI Number: 4097547; NR Description: ATFP3 [Arabidopsis thaliana]
  misc_feature: GI Number: 50908877; NR Description: putative farnesylated protein [Oryza sativa (japonica cultivar-group)] >gi|48716470|dbj|BAD23076.1| putative farnesylated protein [Oryza
  misc_feature: GI Number: 50936147; NR Description: putative heavy-metal-associated domain-containing protein [Oryza sativa (japonica cultivar-group)] >gi|34394290|dbj|BAC84772.1| putative heavy-metal-associated domain-containing protein [Oryza sativa
  misc_feature: GI Number: 20197942; NR Description: putative farnesylated protein [Arabidopsis thaliana] >gi|18404283|ref|NP_565855.1| heavy-metal-associated domain-containing protein [Arabidopsis
  misc_feature: GI Number: 25408515; NR Description: probable farnesylated
AAAATTCAATGGGAGAGGAAGATAAGAAAATGGAGGAGAAGAAATCTGAAGAGCCACAAGCGAAATCAGAAGATAAGAAACCAGAAGAAGAGAAAAAGAAAGAACCTCAAGAGATTGTGCTTAAGATTTTTATGCATTGTGAAGGTTGTGCTAAAAAAATCCATAGATGTCTTAAAGGCTTTGAAGGAGTGGAGGATGTAACTACTGATTGTAAGACTAGTAAAGTTGTGGTGAAAGGAGAGAAGGCAGATCCATTAAAAGTGTTGCAAAGATTGCAGAGGAAGAGCCATCGTCAAGTGGAGCTTATCTCACCGATTCCGGAGCCTAAACCGGTTTCTGATAAACCGGAGAAAAAGGAGAAGGAGAAACCTAAACCTGAGGAGAAAAAAGAAGAGGTAGTGACAGTGGTGCTGAGAGTTCACATGCATTGNGAAGCATGTGCCATGGAGATTCAAAAGAGGATCATGAGAATGAAAGGAGTGGAGTCTGTGGANCCAGATTTTAAAGCATCNCNAGTGAGCGTGAAAGGAGTTTTTACGCCGGAAAAGCTAGTTGAGTTCATTTACAAGAGAATCGGGAAGCATGCCGCGGTTGTCAAGCAAGATCCGCCGCCAAAACCTCCGGAGAAAGAAAAAGAAACGAAAGNCAAAGACGAGAAGAAAAAGGAAGAGGGNCAGCCCAAAGAAGGAAAAGAGGCCAAGGAAAACGGTGGTGGAGGAGGTGCTAAAGGCGATGGTGCTGCCGCGGAGGAGGGGAACAAAGTGGTAGACTTGAAGAAGAACGAATATCAGTACCAGCCNCCGAGGTACCCCGTGGAGATGTTTGCTTATCCACCGCAGATATTCAGTGATGAAAACCCCAATGCTTGTACCATTATGTAATAAAATCGTCGGTTTAAGGGGTTGTAGGATTTGTTATTTTTTTACTTTATTTCTATGCAGAATTTTAATTTAAATGTATTTTTGGTAATTTTTAGTTTCAACCGAATTGAATGATCGC

SEQ ID NO: 1423 - DNA, 1642 bp, Arabidopsis thaliana
  misc_feature (1)..(1642): Ceres cDNA ID no. 12580332
  misc_feature (1)..(1642): Ceres CLONE  ID no. 42933
  misc_feature (1)..(1642): Also known as  Ceres CDNA ID no. 23463013
attattatcccttcttcttcttcttcttcgtcttcgtctttgattctcctgattcatgtcgcttaaatttttagcgatcttcgaatcccattttccttcgggaatctgacattttttctcgggaaattttttacccaaatcggagtaaagtatcgaatctagagaatccgctatggatgagacctattttgatctattgaatttctttaagaatccctcttttacagagacatttgtcgacatcttactatgcgcagttccgatttggctcgccgttatgatcgggttattaatcggatggtcttggcgtccaagatggaccggtttgatctatttagggtttcgttctaagcttcggtttttatggaccgcaccgcctgggtttggtgctcgtcggctttggcttgctttcaccgctctctctgctttctccgtttgccgaaccatctggtcaaggaatgacaccagagctaataaatcggcgaccggttcagcttcgtcgcagacgcctgttgaggataatgatgaatcaggattggcctcaagaggtagcgataacgggacggtgacagaggatattgtgacagagaatgatttagagcatctgcttcagctgcttgaagttggaaatgcagctttggaatggcaatctatgatggataagactactccaaatatgagctaccaggcttggcgtcatgagcctgagacaggtcctgttatttatcgcagccggactgtgtttgaggatgcaactccagatattgttagggatttcttctgggatgatgagtttcgacctaaatgggatttcatgcttgccaacttcaaaacgttggaggaggacactcagacaggaacaatgattgttcagtggagaaaaaagtttccttttttctgtagtgaccgagagtatatcattggccggagaatatgggagtctgggaagaagtattattgtgtcacaaagggagttccttatccagctctaccaaagcgtgataagccaaggcgtgttgagctttatttctcaagttgggttatcatagcggttgaatcccgaaaaggagatggacagcaaacggcttgtgaagtttcccttgtccactacgaagacatgggcatcccaaaagacgtagcaaagttaggtgtccgtcatggcatgtggggagctgtcaagaagctaaactccggtttacgagcgtaccaatccgccagaaaatcagactcatctctatctcggatcgcccaaatggcaagaatctctacaaaactgaacatggattctgcagaatcttcttcaagagatgaagacagaagcagagcaatggaatatgcgagacaacgggaccatttgagaatggactggaaatgggttgttgtaggaggtgtcgcattggcttgtggccttcactctgggatcattggcaaggctttactggctggagctggccagagactggctcgtaggtgagaaaccttgtcgtattcttattatatcttcccttgacagaaaagagaaacatatgcatataactaagggaaatgtattatttttgcaactcctctgagaagggcatgtggttttggtggtgaaccatgtagagtagtagctttaaactatggagtcataagttatttg

SEQ ID NO: 1424 - protein, 1642 aa, Arabidopsis thaliana
  misc_feature: PFam Name: START; PFam Description: START domain
  misc_feature: GI Number: 50934753; NR Description: putative membrane related protein CP5 [Oryza sativa (japonica cultivar-group)] >gi|34393225|dbj|BAC83004.1| putative membrane related protein CP5 [Oryza sativa (japonica cultivar-group)] [Oryza sativa
  misc_feature: GI Number: 23197608; NR Description: membrane related protein CP5, putative [Arabidopsis thaliana] >gi|22135902|gb|AAM91533.1|
  misc_feature: GI Number: 46798907; NR Description: membrane related protein
  misc_feature: GI Number: 18033654; NR Description: putative nodule membrane
  misc_feature: GI Number: 50904921; NR Description: putative membrane related protein CP5 [Oryza sativa (japonica cultivar-group)] >gi|41053035|dbj|BAD07966.1| putative membrane related protein CP5
ATTATTATCCCTTCTTCTTCTTCTTCTTCGTCTTCGTCTTTGATTCTCCTGATTCATGTCGCTTAAATTTTTAGCGATCTTCGAATCCCATTTTCCTTCGGGAATCTGACATTTTTTCTCGGGAAATTTTTTACCCAAATCGGAGTAAAGTATCGAATCTAGAGAATCCGCTATGGATGAGACCTATTTTGATCTATTGAATTTCTTTAAGAATCCCTCTTTTACAGAGACATTTGTCGACATCTTACTATGCGCAGTTCCGATTTGGCTCGCCGTTATGATCGGGTTATTAATCGGATGGTCTTGGCGTCCAAGATGGACCGGTTTGATCTATTTAGGGTTTCGTTCTAAGCTTCGGTTTTTATGGACCGCACCGCCTGGGTTTGGTGCTCGTCGGCTTTGGCTTGCTTTCACCGCTCTCTCTGCTTTCTCCGTTTGCCGAACCATCTGGTCAAGGAATGACACCAGAGCTAATAAATCGGCGACCGGTTCAGCTTCGTCGCAGACGCCTGTTGAGGATAATGATGAATCAGGATTGGCCTCAAGAGGTAGCGATAACGGGACGGTGACAGAGGATATTGTGACAGAGAATGATTTAGAGCATCTGCTTCAGCTGCTTGAAGTTGGAAATGCAGCTTTGGAATGGCAATCTATGATGGATAAGACTACTCCAAATATGAGCTACCAGGCTTGGCGTCATGAGCCTGAGACAGGTCCTGTTATTTATCGCAGCCGGACTGTGTTTGAGGATGCAACTCCAGATATTGTTAGGGATTTCTTCTGGGATGATGAGTTTCGACCTAAATGGGATTTCATGCTTGCCAACTTCAAAACGTTGGAGGAGGACACTCAGACAGGAACAATGATTGTTCAGTGGAGAAAAAAGTTTCCTTTTTTCTGTAGTGACCGAGAGTATATCATTGGCCGGAGAATATGGGAGTCTGGGAAGAAGTATTATTGTGTCACAAAGGGAGTTCCTTATCCAGCTCTACCAAAGCGTGATAAGCCAAGGCGTGTTGAGCTTTATTTCTCAAGTTGGGTTATCATAGCGGTTGAATCCCGAAAAGGAGATGGACAGCAAACGGCTTGTGAAGTTTCCCTTGTCCACTACGAAGACATGGGCATCCCAAAAGACGTAGCAAAGTTAGGTGTCCGTCATGGCATGTGGGGAGCTGTCAAGAAGCTAAACTCCGGTTTACGAGCGTACCAATCCGCCAGAAAATCAGACTCATCTCTATCTCGGATCGCCCAAATGGCAAGAATCTCTACAAAACTGAACATGGATTCTGCAGAATCTTCTTCAAGAGATGAAGACAGAAGCAGAGCAATGGAATATGCGAGACAACGGGACCATTTGAGAATGGACTGGAAATGGGTTGTTGTAGGAGGTGTCGCATTGGCTTGTGGCCTTCACTCTGGGATCATTGGCAAGGCTTTACTGGCTGGAGCTGGCCAGAGACTGGCTCGTAGGTGAGAAACCTTGTCGTATTCTTATTATATCTTCCCTTGACAGAAAAGAGAAACATATGCATATAACTAAGGGAAATGTATTATTTTTGCAACTCCTCTGAGAAGGGCATGTGGTTTTGGTGGTGAACCATGTAGAGTAGTAGCTTTAAACTATGGAGTCATAAGTTATTTG

SEQ ID NO: 1425 - DNA, 1357 bp, Arabidopsis thaliana
  misc_feature (1)..(1357): Ceres cDNA ID no. 12580720
  misc_feature (1)..(1357): Also known as  Ceres CDNA ID no. 23463013
ataactgaaaaataaaaataagacagaaaacaaagttaaaaataaaataaaaacggaagagagaaaataaataaataaaatcactcaaaggatttccacagtttttctttccatgttgatttagcccattcgtagacttcctccgcgccgccgttagacgccgcctcggaagtatcagcaaccgccgtggtgttcgtcgccttcaaagagatctgaatttgagatgtttaaaaaaatgagtgctactacaagcaagacggatcagaaagcggcattagacattgcatcatggctattcaatgtggttacttccgttggaatcatcctcgttaacaaagctttaatggctacttatggctttagtttcgctactacattaaccggtttgcatttcggaacaacgacattgttgacaactttcttgacatggcttggttatatccaaccttctcagcttccttggcctgatcttttgaaattcgttttgttcgctaacttctctatcgttgggatgaacgtcagtctcatgtggaattctgttggcttctaccagattgcgaagctgagtatgatcccggtttcttgtcttctagaagttatgcttgacaatgtcaggtattcaagagatacaaagcttagcattttgttagttcttgctggtgttgccgtctgtactgtaaccgatgttagtgtcaatctcaacggatttctagctgccgctattgctgtctggagcaccgcgcttcagcaatactatgtacattatctacaacggaaatattcactcggttctttcaatttactggcgcataccgctccagttcaagctgcgtcattgttgttggtcggaccatttctagactactggttgactaaccaaagagtggatgcatacaacttttcatttgtatctctgttcttcttaatactctcgtgcagtatcgcggttgggaccaatctcagccaattcatctgtattggaagattcacggcggtgtctttccaagtacttggtcacatgaagacaattctggttttggttttgggattcactttcttcggtaaggaaggattaaacctacaagtagtgcttggaatgctgattgctatactcggtatgatctggtacggtaatgcatcttctaaaccgggtggtaaagaacgtcgtagcctgtctattcccataaccaagtcacagaaactatctgaaacaaacgaatctgatgaaaaggtgtagaagaaagaagtgaatcgcattgacatagaaacaaaaacaagatactcagatacaaacaggtagagttatcaaatgggatattatttataaaccaaaaaaaagaaagggatttaattattt

SEQ ID NO: 1426 - protein, 1357 aa, Arabidopsis thaliana
  misc_feature: PFam Name: START; PFam Description: START domain
  misc_feature: GI Number: 50934753; NR Description: putative membrane related protein CP5 [Oryza sativa (japonica cultivar-group)] >gi|34393225|dbj|BAC83004.1| putative membrane related protein CP5 [Oryza sativa (japonica cultivar-group)] [Oryza sativa
  misc_feature: GI Number: 23197608; NR Description: membrane related protein CP5, putative [Arabidopsis thaliana] >gi|22135902|gb|AAM91533.1|
  misc_feature: GI Number: 46798907; NR Description: membrane related protein
  misc_feature: GI Number: 18033654; NR Description: putative nodule membrane
  misc_feature: GI Number: 50904921; NR Description: putative membrane related protein CP5 [Oryza sativa (japonica cultivar-group)] >gi|41053035|dbj|BAD07966.1| putative membrane related protein CP5
ATAACTGAAAAATAAAAATAAGACAGAAAACAAAGTTAAAAATAAAATAAAAACGGAAGAGAGAAAATAAATAAATAAAATCACTCAAAGGATTTCCACAGTTTTTCTTTCCATGTTGATTTAGCCCATTCGTAGACTTCCTCCGCGCCGCCGTTAGACGCCGCCTCGGAAGTATCAGCAACCGCCGTGGTGTTCGTCGCCTTCAAAGAGATCTGAATTTGAGATGTTTAAAAAAATGAGTGCTACTACAAGCAAGACGGATCAGAAAGCGGCATTAGACATTGCATCATGGCTATTCAATGTGGTTACTTCCGTTGGAATCATCCTCGTTAACAAAGCTTTAATGGCTACTTATGGCTTTAGTTTCGCTACTACATTAACCGGTTTGCATTTCGGAACAACGACATTGTTGACAACTTTCTTGACATGGCTTGGTTATATCCAACCTTCTCAGCTTCCTTGGCCTGATCTTTTGAAATTCGTTTTGTTCGCTAACTTCTCTATCGTTGGGATGAACGTCAGTCTCATGTGGAATTCTGTTGGCTTCTACCAGATTGCGAAGCTGAGTATGATCCCGGTTTCTTGTCTTCTAGAAGTTATGCTTGACAATGTCAGGTATTCAAGAGATACAAAGCTTAGCATTTTGTTAGTTCTTGCTGGTGTTGCCGTCTGTACTGTAACCGATGTTAGTGTCAATCTCAACGGATTTCTAGCTGCCGCTATTGCTGTCTGGAGCACCGCGCTTCAGCAATACTATGTACATTATCTACAACGGAAATATTCACTCGGTTCTTTCAATTTACTGGCGCATACCGCTCCAGTTCAAGCTGCGTCATTGTTGTTGGTCGGACCATTTCTAGACTACTGGTTGACTAACCAAAGAGTGGATGCATACAACTTTTCATTTGTATCTCTGTTCTTCTTAATACTCTCGTGCAGTATCGCGGTTGGGACCAATCTCAGCCAATTCATCTGTATTGGAAGATTCACGGCGGTGTCTTTCCAAGTACTTGGTCACATGAAGACAATTCTGGTTTTGGTTTTGGGATTCACTTTCTTCGGTAAGGAAGGATTAAACCTACAAGTAGTGCTTGGAATGCTGATTGCTATACTCGGTATGATCTGGTACGGTAATGCATCTTCTAAACCGGGTGGTAAAGAACGTCGTAGCCTGTCTATTCCCATAACCAAGTCACAGAAACTATCTGAAACAAACGAATCTGATGAAAAGGTGTAGAAGAAAGAAGTGAATCGCATTGACATAGAAACAAAAACAAGATACTCAGATACAAACAGGTAGAGTTATCAAATGGGATATTATTTATAAACCAAAAAAAAGAAAGGGATTTAATTATTT

SEQ ID NO: 1427 - DNA, 1959 bp, Arabidopsis thaliana
  misc_feature (1)..(1959): Ceres cDNA ID no. 12580899
  misc_feature (1)..(1959): Also known as  Ceres CDNA ID no. 23463013
agaaaacacagtttaaaggaacataaaaagcaactcttttgagagatcacagaaaccctaatttgctaagaaccctaatctcaatttccatcttccaaagttcagattctgtatgtaaatgcatctgaagaattctactgtagcagaacggcggtacatcggaaaagaaaccgccggttatttaacttcttcctccgatttggatccgaaacctaagattaaacatcatcgtcctcttcaggtacctgagattttgactccagacattggtgctggtgctggattcagtgtgtataataatcaagttcaagctcagagtcgtcatcatctgacggttgaaatcccagattcatcgtctcacaatcttacatctaagagacctgtggtggttcaatcttctaatccgttcaacgttgacgatttccgaagacaacaacgcgcaagcttgggtccgatttcatcttattgtccgtcgtatcttttatcgtggttttcttcttctcttccatcgatccatcggccactaatcagaagcttctccgtcatgttcttagagtccgtttgatatgtttccatcttcgtttcttacttcttctctctgttcctcctctctacatcttcttcttgttgattagtttcagattcttccttctctttgtcttctcgattatcgctttttctttcgtcctttcgatctctctcaaattcgctcttcctcacttaccatcgattcgtttgattatcgctcggttactttctctcaagcttacccctaccagatcatcctcttcatctcaggagaacactaaacatgttatttggtcaattgggtctaagcctgtgactgagaagaagaccagctctggctcatgggttcagaagtacagctctggtgatgtatacgagggagagtttcatagggggaagtgttcaggaagtggagtttattactattctatgaagggtaaatacgaaggggattggattgatgggaagtatgatggatatggagttgaaacttgggctaaagggagtaggtaccgaggtcaatacaggcaagggatgagacatggaactggtatctacagattttatacaggggatgtatatgctggtgagtggtctaatggacagagccatggctgtggtgtgtatacctctgaggatggtagtcgttttgttggagagtttaaatggggtgtcaaacatggccttggtcattatcatttcagaaatggtgatacatatgctggggagtattttgcagacaggatgcatggttttggagtgtatcaatttggaaacgggcatcggtatgaaggagcctggcatgaggggagaaggcaaggacttggtatgtacacgttcaggaatggtgagacacaggcaggccattgggaagacggagttcttaactgtcctaccgagcagaccactcgccctgattcatcgttttccatcagtcattccaaggttgtcgacactgtccagcaagcaaggaaagcagccaagaaagcacgcgaagttgtgaaagttgaagagagagtgaacagagcagtgatggtcgcaaaccgagcagcaaatgctgctagagttgctgctacaaaggctgtccaaacccaaacatttcattgtagtagtggtgacgatcccttgtgagttcctgcggcaaagattttgacataatcgcagtcatgaccttacctcgaacttctacgaagacagaagagtgaaagagagatgtttagagacagcgtcagaattcgcaatctccgttgagattttcttgaaggtgaaccacttggaaccaatgtcgagatctcataagtaataagtaagagatctggctatggagcaagtattacaggtttactttttcttttctcccacttgttttatgagcaggctggtttaaaactgtacatatgttgttgaagagtaagcaatgtgtgttaacaa

SEQ ID NO: 1428 - protein, 1959 aa, Arabidopsis thaliana
  misc_feature: PFam Name: START; PFam Description: START domain
  misc_feature: GI Number: 50934753; NR Description: putative membrane related protein CP5 [Oryza sativa (japonica cultivar-group)] >gi|34393225|dbj|BAC83004.1| putative membrane related protein CP5 [Oryza sativa (japonica cultivar-group)] [Oryza sativa
  misc_feature: GI Number: 23197608; NR Description: membrane related protein CP5, putative [Arabidopsis thaliana] >gi|22135902|gb|AAM91533.1|
  misc_feature: GI Number: 46798907; NR Description: membrane related protein
  misc_feature: GI Number: 18033654; NR Description: putative nodule membrane
  misc_feature: GI Number: 50904921; NR Description: putative membrane related protein CP5 [Oryza sativa (japonica cultivar-group)] >gi|41053035|dbj|BAD07966.1| putative membrane related protein CP5
AGAAAACACAGTTTAAAGGAACATAAAAAGCAACTCTTTTGAGAGATCACAGAAACCCTAATTTGCTAAGAACCCTAATCTCAATTTCCATCTTCCAAAGTTCAGATTCTGTATGTAAATGCATCTGAAGAATTCTACTGTAGCAGAACGGCGGTACATCGGAAAAGAAACCGCCGGTTATTTAACTTCTTCCTCCGATTTGGATCCGAAACCTAAGATTAAACATCATCGTCCTCTTCAGGTACCTGAGATTTTGACTCCAGACATTGGTGCTGGTGCTGGATTCAGTGTGTATAATAATCAAGTTCAAGCTCAGAGTCGTCATCATCTGACGGTTGAAATCCCAGATTCATCGTCTCACAATCTTACATCTAAGAGACCTGTGGTGGTTCAATCTTCTAATCCGTTCAACGTTGACGATTTCCGAAGACAACAACGCGCAAGCTTGGGTCCGATTTCATCTTATTGTCCGTCGTATCTTTTATCGTGGTTTTCTTCTTCTCTTCCATCGATCCATCGGCCACTAATCAGAAGCTTCTCCGTCATGTTCTTAGAGTCCGTTTGATATGTTTCCATCTTCGTTTCTTACTTCTTCTCTCTGTTCCTCCTCTCTACATCTTCTTCTTGTTGATTAGTTTCAGATTCTTCCTTCTCTTTGTCTTCTCGATTATCGCTTTTTCTTTCGTCCTTTCGATCTCTCTCAAATTCGCTCTTCCTCACTTACCATCGATTCGTTTGATTATCGCTCGGTTACTTTCTCTCAAGCTTACCCCTACCAGATCATCCTCTTCATCTCAGGAGAACACTAAACATGTTATTTGGTCAATTGGGTCTAAGCCTGTGACTGAGAAGAAGACCAGCTCTGGCTCATGGGTTCAGAAGTACAGCTCTGGTGATGTATACGAGGGAGAGTTTCATAGGGGGAAGTGTTCAGGAAGTGGAGTTTATTACTATTCTATGAAGGGTAAATACGAAGGGGATTGGATTGATGGGAAGTATGATGGATATGGAGTTGAAACTTGGGCTAAAGGGAGTAGGTACCGAGGTCAATACAGGCAAGGGATGAGACATGGAACTGGTATCTACAGATTTTATACAGGGGATGTATATGCTGGTGAGTGGTCTAATGGACAGAGCCATGGCTGTGGTGTGTATACCTCTGAGGATGGTAGTCGTTTTGTTGGAGAGTTTAAATGGGGTGTCAAACATGGCCTTGGTCATTATCATTTCAGAAATGGTGATACATATGCTGGGGAGTATTTTGCAGACAGGATGCATGGTTTTGGAGTGTATCAATTTGGAAACGGGCATCGGTATGAAGGAGCCTGGCATGAGGGGAGAAGGCAAGGACTTGGTATGTACACGTTCAGGAATGGTGAGACACAGGCAGGCCATTGGGAAGACGGAGTTCTTAACTGTCCTACCGAGCAGACCACTCGCCCTGATTCATCGTTTTCCATCAGTCATTCCAAGGTTGTCGACACTGTCCAGCAAGCAAGGAAAGCAGCCAAGAAAGCACGCGAAGTTGTGAAAGTTGAAGAGAGAGTGAACAGAGCAGTGATGGTCGCAAACCGAGCAGCAAATGCTGCTAGAGTTGCTGCTACAAAGGCTGTCCAAACCCAAACATTTCATTGTAGTAGTGGTGACGATCCCTTGTGAGTTCCTGCGGCAAAGATTTTGACATAATCGCAGTCATGACCTTACCTCGAACTTCTACGAAGACAGAAGAGTGAAAGAGAGATGTTTAGAGACAGCGTCAGAATTCGCAATCTCCGTTGAGATTTTCTTGAAGGTGAACCACTTGGAACCAATGTCGAGATCTCATAAGTAATAAGTAAGAGATCTGGCTATGGAGCAAGTATTACAGGTTTACTTTTTCTTTTCTCCCACTTGTTTTATGAGCAGGCTGGTTTAAAACTGTACATATGTTGTTGAAGAGTAAGCAATGTGTGTTAACAA

SEQ ID NO: 1429 - DNA, 1553 bp, Arabidopsis thaliana
  misc_feature (1)..(1553): Ceres cDNA ID no. 12580903
  misc_feature (1)..(1553): Also known as  Ceres CDNA ID no. 23463013
ctcgactcctcccagcgcttcaatatctcccaagacccaaccatcggagggagggggcgagatgatgggattgagttccttggtctttaccgagtttcacagcctcggcttctctgaccttatagtttttgttgcgccactctggattgctgtggctgccggtgttttggttggttgggtttggaggcccaagtgggcttatctcgattctaaactcttgtccaattcacctaaattcctcaatcttcagcttcccacttccatcctcaaaacttcttctcaccacgttaaccccagcctttcttccaaagagaaaactgggtttgtaacggacgatgattttaggcatctatggaagttggttgaggtcaaagatggcggtccttgttggattcaaatgatggaccgatcaaccccaaccttctcatatcaagcttggaggcgagatcctgagaatgggcctccccagtaccgtagcagaactgtgtttgaggatgccactcccgagatggtcagggacttcttttgggatgatgagttccgttccaagtgggatgatatgcttttgtattcttctactctcgagcgttgcaaggacacgggcactatggttgtgcaatgggtgcgaaagttccccttcttttgtagcgacagggagtatattataggccgtcgtatatgggatgctggccgagtcttttactgcattactaagggagtacaatacccgtctgtacctagacaaaacaagccaaggcgagtcgacttgtactattcaagctggtgtatccgtgcagttgaatcaaaaagaggcgatggtgagatgacatcatgtgaggtactactatttcaccatgaagatatgggaataccgtgggagattgcaaagcttggggtgagacagggtatgtggggtgcagtcaagaagattgagccaggcctacgtgcatatcagagggctaaagcagcgggagcaggtttatccccgagtgccataatggctcacatcaacaccaaagtgagtgcagaggagttcatgaatgagaggggttcgatagcagaggttacaggagacaagccgacggggaaaaacataccaaagatactagtggtaggaggggcgattgcacttgcatgtacattggacaaagggctgttgacaaaggcggtgatattcggagtagccagaagatttgcaagaatgggaaaaaggatgtaggagagagtgtacatgtaagtagacagagaacgaatgagggaatgagagaggtgaaaagactatctctttagtcattgtcttgctggatgtatcaatcatgtaatagcaaagagaaaaagaagcgagagttattctttcagtgttgaatttctgagagcgcggaaagatagttccaccgcgctgtgctaatgaacatctccgtcttttcttgtctaagtttctgatggagtgaaggtaatagaaattataaaaacaaacacgagaggaagatattaaactgattttgcttcttctcaatcgttctaagttccatagagttctcacaattttcagt

SEQ ID NO: 1430 - protein, 1553 aa, Arabidopsis thaliana
  misc_feature: PFam Name: START; PFam Description: START domain
  misc_feature: GI Number: 50934753; NR Description: putative membrane related protein CP5 [Oryza sativa (japonica cultivar-group)] >gi|34393225|dbj|BAC83004.1| putative membrane related protein CP5 [Oryza sativa (japonica cultivar-group)] [Oryza sativa
  misc_feature: GI Number: 23197608; NR Description: membrane related protein CP5, putative [Arabidopsis thaliana] >gi|22135902|gb|AAM91533.1|
  misc_feature: GI Number: 46798907; NR Description: membrane related protein
  misc_feature: GI Number: 18033654; NR Description: putative nodule membrane
  misc_feature: GI Number: 50904921; NR Description: putative membrane related protein CP5 [Oryza sativa (japonica cultivar-group)] >gi|41053035|dbj|BAD07966.1| putative membrane related protein CP5
CTCGACTCCTCCCAGCGCTTCAATATCTCCCAAGACCCAACCATCGGAGGGAGGGGGCGAGATGATGGGATTGAGTTCCTTGGTCTTTACCGAGTTTCACAGCCTCGGCTTCTCTGACCTTATAGTTTTTGTTGCGCCACTCTGGATTGCTGTGGCTGCCGGTGTTTTGGTTGGTTGGGTTTGGAGGCCCAAGTGGGCTTATCTCGATTCTAAACTCTTGTCCAATTCACCTAAATTCCTCAATCTTCAGCTTCCCACTTCCATCCTCAAAACTTCTTCTCACCACGTTAACCCCAGCCTTTCTTCCAAAGAGAAAACTGGGTTTGTAACGGACGATGATTTTAGGCATCTATGGAAGTTGGTTGAGGTCAAAGATGGCGGTCCTTGTTGGATTCAAATGATGGACCGATCAACCCCAACCTTCTCATATCAAGCTTGGAGGCGAGATCCTGAGAATGGGCCTCCCCAGTACCGTAGCAGAACTGTGTTTGAGGATGCCACTCCCGAGATGGTCAGGGACTTCTTTTGGGATGATGAGTTCCGTTCCAAGTGGGATGATATGCTTTTGTATTCTTCTACTCTCGAGCGTTGCAAGGACACGGGCACTATGGTTGTGCAATGGGTGCGAAAGTTCCCCTTCTTTTGTAGCGACAGGGAGTATATTATAGGCCGTCGTATATGGGATGCTGGCCGAGTCTTTTACTGCATTACTAAGGGAGTACAATACCCGTCTGTACCTAGACAAAACAAGCCAAGGCGAGTCGACTTGTACTATTCAAGCTGGTGTATCCGTGCAGTTGAATCAAAAAGAGGCGATGGTGAGATGACATCATGTGAGGTACTACTATTTCACCATGAAGATATGGGAATACCGTGGGAGATTGCAAAGCTTGGGGTGAGACAGGGTATGTGGGGTGCAGTCAAGAAGATTGAGCCAGGCCTACGTGCATATCAGAGGGCTAAAGCAGCGGGAGCAGGTTTATCCCCGAGTGCCATAATGGCTCACATCAACACCAAAGTGAGTGCAGAGGAGTTCATGAATGAGAGGGGTTCGATAGCAGAGGTTACAGGAGACAAGCCGACGGGGAAAAACATACCAAAGATACTAGTGGTAGGAGGGGCGATTGCACTTGCATGTACATTGGACAAAGGGCTGTTGACAAAGGCGGTGATATTCGGAGTAGCCAGAAGATTTGCAAGAATGGGAAAAAGGATGTAGGAGAGAGTGTACATGTAAGTAGACAGAGAACGAATGAGGGAATGAGAGAGGTGAAAAGACTATCTCTTTAGTCATTGTCTTGCTGGATGTATCAATCATGTAATAGCAAAGAGAAAAAGAAGCGAGAGTTATTCTTTCAGTGTTGAATTTCTGAGAGCGCGGAAAGATAGTTCCACCGCGCTGTGCTAATGAACATCTCCGTCTTTTCTTGTCTAAGTTTCTGATGGAGTGAAGGTAATAGAAATTATAAAAACAAACACGAGAGGAAGATATTAAACTGATTTTGCTTCTTCTCAATCGTTCTAAGTTCCATAGAGTTCTCACAATTTTCAGT

SEQ ID NO: 1431 - DNA, 1553 bp, Arabidopsis thaliana
  misc_feature (1)..(1553): Ceres cDNA ID no. 12581163
  misc_feature (1)..(1553): Also known as  Ceres CDNA ID no. 23463013
aacacatgttggtacgtaggttggattttgagagctaattaaatagttaagatgatggaaatagcttatcagcctcggattgattccgagattgaatcactcgtcgagagaatcaatcctccaagggtttgtgtagacaacgactctgacccagagtgcacacttattaaggtagatagcgcgaacaagtacgggatattactggacatggttcaagtgttagccgatcttgatctcgttatctccaaatgttacatctcatctgatggcgaatggttcatggatgtgtttcacgtgacagaccaactcgggaataagctcaccgaccgaagccttattctctacattcaacaggcaatatgttctagtagaacgggaggtataacaaaggagatgcagagtaatctaaaacgggaggtgcaacagcgccacgtgtcaacagaacacacggcctttgagataaccggaatcaatagaccgggtctactatccgaaatatctgccgtactttccgacattggatgtcacgtgacggctgctgttgcatggacccaccacgagcgagcggctatggtgatttatctagaagacgggtttaacggtgggcccattatcgacccaataagaaaggcccaagtaaaggatcatctggatacagtcatggaggcccatcacatagttggcgatgtgtctcatgtcgtcgtgagggtcgtcgaggctaaaggagttccggtcgggtgggctcacactgagcgacgacttcacgagctaatgtacggagaaggagattacgagaattgcttcgactgcgattgtttcggagacaggtgcgatgctttgtggagaggaagatgcgagaggatacacgtgacaatcgaagcatgtaatggctattcaatggtgaatgttaagtgtagagacagaccaaaactacttttcgacacggtgtgtgctttgaaagagttacaattcgttgtgtttcacgccgtcgccggagctaaaggctccactgcagagcaagaatatttcataagaaagaagaacgggggcacgttagaaacggaagggcaaagagagagactaaggcattgtttggttgctgcgatttcgagacgtgcttcacaaggattgaaactcgagattcggacagagaacaagatgggtttgttgtcggatgtgactagagttgtgagagaaaacggtttatcgataacgagagctgagatgtgcacgcaaggtgagattgcggttggctcgttttatgttacggatgtgaatggtggtgagacgggtcctagtgaggttgaagcggttgtacgagaattgggaggagcggttgtgtcagcggttaaaggggttggaatgatgccgaggaggattggttcgacgagtgatagtgtggagcaggacaaagctaagtcgtctattgggagaatgttttggtctaaattagagaggttgtcaacgtctataagatcgttgtgaagtgtttgattagtggtttttgcctctctggttctcgtgattatcgatcgttgtatatatagatgaac

SEQ ID NO: 1432 - protein, 1553 aa, Arabidopsis thaliana
  misc_feature: PFam Name: START; PFam Description: START domain
  misc_feature: GI Number: 50934753; NR Description: putative membrane related protein CP5 [Oryza sativa (japonica cultivar-group)] >gi|34393225|dbj|BAC83004.1| putative membrane related protein CP5 [Oryza sativa (japonica cultivar-group)] [Oryza sativa
  misc_feature: GI Number: 23197608; NR Description: membrane related protein CP5, putative [Arabidopsis thaliana] >gi|22135902|gb|AAM91533.1|
  misc_feature: GI Number: 46798907; NR Description: membrane related protein
  misc_feature: GI Number: 18033654; NR Description: putative nodule membrane
  misc_feature: GI Number: 50904921; NR Description: putative membrane related protein CP5 [Oryza sativa (japonica cultivar-group)] >gi|41053035|dbj|BAD07966.1| putative membrane related protein CP5
AACACATGTTGGTACGTAGGTTGGATTTTGAGAGCTAATTAAATAGTTAAGATGATGGAAATAGCTTATCAGCCTCGGATTGATTCCGAGATTGAATCACTCGTCGAGAGAATCAATCCTCCAAGGGTTTGTGTAGACAACGACTCTGACCCAGAGTGCACACTTATTAAGGTAGATAGCGCGAACAAGTACGGGATATTACTGGACATGGTTCAAGTGTTAGCCGATCTTGATCTCGTTATCTCCAAATGTTACATCTCATCTGATGGCGAATGGTTCATGGATGTGTTTCACGTGACAGACCAACTCGGGAATAAGCTCACCGACCGAAGCCTTATTCTCTACATTCAACAGGCAATATGTTCTAGTAGAACGGGAGGTATAACAAAGGAGATGCAGAGTAATCTAAAACGGGAGGTGCAACAGCGCCACGTGTCAACAGAACACACGGCCTTTGAGATAACCGGAATCAATAGACCGGGTCTACTATCCGAAATATCTGCCGTACTTTCCGACATTGGATGTCACGTGACGGCTGCTGTTGCATGGACCCACCACGAGCGAGCGGCTATGGTGATTTATCTAGAAGACGGGTTTAACGGTGGGCCCATTATCGACCCAATAAGAAAGGCCCAAGTAAAGGATCATCTGGATACAGTCATGGAGGCCCATCACATAGTTGGCGATGTGTCTCATGTCGTCGTGAGGGTCGTCGAGGCTAAAGGAGTTCCGGTCGGGTGGGCTCACACTGAGCGACGACTTCACGAGCTAATGTACGGAGAAGGAGATTACGAGAATTGCTTCGACTGCGATTGTTTCGGAGACAGGTGCGATGCTTTGTGGAGAGGAAGATGCGAGAGGATACACGTGACAATCGAAGCATGTAATGGCTATTCAATGGTGAATGTTAAGTGTAGAGACAGACCAAAACTACTTTTCGACACGGTGTGTGCTTTGAAAGAGTTACAATTCGTTGTGTTTCACGCCGTCGCCGGAGCTAAAGGCTCCACTGCAGAGCAAGAATATTTCATAAGAAAGAAGAACGGGGGCACGTTAGAAACGGAAGGGCAAAGAGAGAGACTAAGGCATTGTTTGGTTGCTGCGATTTCGAGACGTGCTTCACAAGGATTGAAACTCGAGATTCGGACAGAGAACAAGATGGGTTTGTTGTCGGATGTGACTAGAGTTGTGAGAGAAAACGGTTTATCGATAACGAGAGCTGAGATGTGCACGCAAGGTGAGATTGCGGTTGGCTCGTTTTATGTTACGGATGTGAATGGTGGTGAGACGGGTCCTAGTGAGGTTGAAGCGGTTGTACGAGAATTGGGAGGAGCGGTTGTGTCAGCGGTTAAAGGGGTTGGAATGATGCCGAGGAGGATTGGTTCGACGAGTGATAGTGTGGAGCAGGACAAAGCTAAGTCGTCTATTGGGAGAATGTTTTGGTCTAAATTAGAGAGGTTGTCAACGTCTATAAGATCGTTGTGAAGTGTTTGATTAGTGGTTTTTGCCTCTCTGGTTCTCGTGATTATCGATCGTTGTATATATAGATGAAC

SEQ ID NO: 1433 - DNA, 438 bp, Zea mays
  misc_feature (1)..(438): Ceres cDNA ID no. 12589160
  misc_feature (1)..(438): Ceres CLONE  ID no. 496249
  misc_feature (1)..(438): Also known as  Ceres CDNA ID no. 0
aattcggaggcacgcactcggctaggcgcagaggctttctcctcccccaagccgaaacaccagagggcgagactcgagagagaagagcggcgcggcggaggacagcactggatggagccctcgccggcggcgggagagcttggcgcgatgcttcgtgcggccgctgacttcgcgtcctacccagggttgcatagtgatgatactgtgaggcagttcctggaacgatgtccgctgcctaagctcttaggtgcattgcagagtgaagcagatgtacctgggatggttgaaactgtcacagagtgtctagacaaaatattttcctcaagatatggagcgtcacttctgccaaactacggtgcatttattcaagctgggttgctcacagactcgaagcaaatcagaaaattagcctgcaaagctgtactccatcttcttgac

SEQ ID NO: 1434 - protein, 438 aa, Zea mays
AATTCGGAGGCACGCACTCGGCTAGGCGCAGAGGCTTTCTCCTCCCCCAAGCCGAAACACCAGAGGGCGAGACTCGAGAGAGAAGAGCGGCGCGGCGGAGGACAGCACTGGATGGAGCCCTCGCCGGCGGCGGGAGAGCTTGGCGCGATGCTTCGTGCGGCCGCTGACTTCGCGTCCTACCCAGGGTTGCATAGTGATGATACTGTGAGGCAGTTCCTGGAACGATGTCCGCTGCCTAAGCTCTTAGGTGCATTGCAGAGTGAAGCAGATGTACCTGGGATGGTTGAAACTGTCACAGAGTGTCTAGACAAAATATTTTCCTCAAGATATGGAGCGTCACTTCTGCCAAACTACGGTGCATTTATTCAAGCTGGGTTGCTCACAGACTCGAAGCAAATCAGAAAATTAGCCTGCAAAGCTGTACTCCATCTTCTTGAC

SEQ ID NO: 1435 - DNA, 1659 bp, Arabidopsis thaliana
  misc_feature (1)..(1659): Ceres cDNA ID no. 12591509
  misc_feature (1)..(1659): Ceres CLONE  ID no. 1346233
  misc_feature (1)..(1659): Also known as  Ceres CDNA ID no. 23467688
atgaatgagaatcacattcaaagtgatcacatgaacaacaccattcatgtaacaaacaaaaaactcccaaacttcctcttatccgtacgtctcaaatatgttaaacttggttaccattacctaatctcgaatgccgtctacattctcatactccccgtcggcctcctcgccgcaacctcctcctcctttagtctcaccgatctcacactcttatacaaccaccttctcaaattccacttcctctcttccactctcttcgccgctcttcttatctttctaaccaccctctacttcacaactcgtcctcgcagaatctttctcctcgatttcgcttgttacaaacccgactcttctctaatatgcacacgagaaacgttcatggaccggtctcagcgtgtcggtatcttcacagaagacaacctcgctttccaacaaaagatcctcgaacgttccggtcttggacaaaagacttacttcccggaggctctcttacgtgtcccgcctaatccttgtatgtctgaagcaaggaaagaagccgagacggttatgtttggagctatagacgcagtgcttgagaaaaccggagtgaatcctaaggatattgggatacttgtcgtgaattgtagcttgtttaatccgacgccttcgttatcggctatgatcgtgaataaatataagctcagaggaaacgttttgagctataaccttggtggaatgggttgtagtgctggtcttatctccattgatctcgctaaacagcttcttcaggttcaaccaaattcatatgcactagtagtgagcacagagaacataaccctaaactggtatttaggcaacgaccgatcaatgcttctctcaaactgcatcttccgaatgggtggcgccgccgttctcctctctaaccgctcctccgaccgctgccgctccaaataccaactcatccacaccgtccgtacacacaaaggatctgacgacaacgcctttaactgcgtttaccaacgcgaagacaacgacgacaacaaacaaatcggtgtctcactttccaaaaacctaatggctatagctggagaagctctcaagacgaacataaccactctgggaccgctagttctaccaatgtctgaacaacttctctttttcgcaacactagtggcgcgaaaagtctttaatgtgaagaaaataaaaccttatattcctgatttcaagctagctttcgagcacttctgcatccacgcgggaggcagagcagtgctcgatgagattgagaagaatttggatttatctgagtggcatatggaaccttcgaggatgactttgaaccggtttggaaatacttcgagtagctcgctttggtatgagcttgcgtatagtgaggctaaaggaaggattaagagaggagataggacttggcagattgcttttggatccggttttaagtgtaatagtgcggtttggagagctttgagaactatcgatccgtccaaggagaagaagaagaagactaatccttggattgatgagattcatgagtttcccgtgccggttccaaggacatctccggtgacatcttcctcggaatctcgatagttaacttttttaaattttctttcatgtataatactatggttcacatcacatctatctcaaaatcttcaatcc

SEQ ID NO: 1436 - protein, 1659 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 62001805; NR Description: beta-ketoacyl-CoA
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGAATGAGAATCACATTCAAAGTGATCACATGAACAACACCATTCATGTAACAAACAAAAAACTCCCAAACTTCCTCTTATCCGTACGTCTCAAATATGTTAAACTTGGTTACCATTACCTAATCTCGAATGCCGTCTACATTCTCATACTCCCCGTCGGCCTCCTCGCCGCAACCTCCTCCTCCTTTAGTCTCACCGATCTCACACTCTTATACAACCACCTTCTCAAATTCCACTTCCTCTCTTCCACTCTCTTCGCCGCTCTTCTTATCTTTCTAACCACCCTCTACTTCACAACTCGTCCTCGCAGAATCTTTCTCCTCGATTTCGCTTGTTACAAACCCGACTCTTCTCTAATATGCACACGAGAAACGTTCATGGACCGGTCTCAGCGTGTCGGTATCTTCACAGAAGACAACCTCGCTTTCCAACAAAAGATCCTCGAACGTTCCGGTCTTGGACAAAAGACTTACTTCCCGGAGGCTCTCTTACGTGTCCCGCCTAATCCTTGTATGTCTGAAGCAAGGAAAGAAGCCGAGACGGTTATGTTTGGAGCTATAGACGCAGTGCTTGAGAAAACCGGAGTGAATCCTAAGGATATTGGGATACTTGTCGTGAATTGTAGCTTGTTTAATCCGACGCCTTCGTTATCGGCTATGATCGTGAATAAATATAAGCTCAGAGGAAACGTTTTGAGCTATAACCTTGGTGGAATGGGTTGTAGTGCTGGTCTTATCTCCATTGATCTCGCTAAACAGCTTCTTCAGGTTCAACCAAATTCATATGCACTAGTAGTGAGCACAGAGAACATAACCCTAAACTGGTATTTAGGCAACGACCGATCAATGCTTCTCTCAAACTGCATCTTCCGAATGGGTGGCGCCGCCGTTCTCCTCTCTAACCGCTCCTCCGACCGCTGCCGCTCCAAATACCAACTCATCCACACCGTCCGTACACACAAAGGATCTGACGACAACGCCTTTAACTGCGTTTACCAACGCGAAGACAACGACGACAACAAACAAATCGGTGTCTCACTTTCCAAAAACCTAATGGCTATAGCTGGAGAAGCTCTCAAGACGAACATAACCACTCTGGGACCGCTAGTTCTACCAATGTCTGAACAACTTCTCTTTTTCGCAACACTAGTGGCGCGAAAAGTCTTTAATGTGAAGAAAATAAAACCTTATATTCCTGATTTCAAGCTAGCTTTCGAGCACTTCTGCATCCACGCGGGAGGCAGAGCAGTGCTCGATGAGATTGAGAAGAATTTGGATTTATCTGAGTGGCATATGGAACCTTCGAGGATGACTTTGAACCGGTTTGGAAATACTTCGAGTAGCTCGCTTTGGTATGAGCTTGCGTATAGTGAGGCTAAAGGAAGGATTAAGAGAGGAGATAGGACTTGGCAGATTGCTTTTGGATCCGGTTTTAAGTGTAATAGTGCGGTTTGGAGAGCTTTGAGAACTATCGATCCGTCCAAGGAGAAGAAGAAGAAGACTAATCCTTGGATTGATGAGATTCATGAGTTTCCCGTGCCGGTTCCAAGGACATCTCCGGTGACATCTTCCTCGGAATCTCGATAGTTAACTTTTTTAAATTTTCTTTCATGTATAATACTATGGTTCACATCACATCTATCTCAAAATCTTCAATCC

SEQ ID NO: 1437 - DNA, 1779 bp, Arabidopsis thaliana
  misc_feature (1)..(1779): Ceres cDNA ID no. 12591709
  misc_feature (1)..(1779): Ceres CLONE  ID no. 1353621
  misc_feature (1)..(1779): Also known as  Ceres CDNA ID no. 12591709
gagcttcattttgcctttgtatacttttgagtagatagatagacagactatagtctatataagatccatgtgacaatagttaaaatcctcatattttcatttccaatggagcgcaaagtcttgaataccctcgccttctccgtctttgccgttctcttcttcacctcctctgcttcttcccaataccaaactcttgtcgtcaacactcttccttcttccgcaacactctcatggcccgagtccgaatctttaactgatgaatctttatccgagtccacaacttcactctctgtccatttatcacacgtggatgctctgtcttccttctccgacgcatctccggcggacctcttcaacctccgtctccaacgagactctctccgcgtcaaatctattaccagcctcgccgccgtatcaaccggacgaaatgctacgaaaagaactccacgtaccgccggtggatttagcggcgcagttatctctggcctctcacaaggaagcggagagtattttatgaggttaggtgttggaactccggcgactaacgtttacatggtgctcgacacaggaagcgacgtcgtttggctccaatgctctccttgcaaagcctgttacaaccagaccgacgccatttttgacccgaagaaatccaaaactttcgccaccgtaccatgtggatctcgcctttgccggagactagacgactcgtcggaatgtgtcactcgtcgaagcaagacttgtctctaccaagtatcgtacggtgacggatcattcaccgaaggagatttctcaactgaaacgctgacgtttcatggagcgcgtgttgatcacgtgccgttaggatgcggtcacgataacgaaggcttgttcgttggtgcggctgggcttttgggcttgggccgtggtgggttatctttcccgtcgcagacgaaaaaccgttataacggaaaattctcttactgtttggttgaccggacgagttccggttcttcttctaaaccaccgtcaacaatcgtgtttggaaacgccgccgttccgaaaacctctgttttcacgccgttactaacgaacccgaaactcgacacgttttattacttgcagcttcttggaatcagcgttggtggttcgcgcgttcccggcgtttcggagtcgcagttcaagcttgacgccaccggaaacggcggtgtcattatagattccggtacttcggttactcggctgacgcaacctgcttacgtagcgcttagagacgcttttagacttggtgctacgaagctgaaacgtgctccatcgtattctttgttcgacacgtgttttgatctctcgggaatgacgactgtgaaggttccgacggttgtgtttcatttcggaggcggagaggtttcgcttccggcgagtaattatctgatcccggttaacactgaaggacggttctgttttgcgtttgccggaactatggggagtttgtcaatcattggaaacatacagcaacaaggtttccgggtcgcttatgacttggtcgggtcacgggtcgggtttttgtctcgcgcgtgttagattttgagcttgagttgactgatttattcccaaagactttttgggagaaaattgacaaagcaaattatcaaacattgttatcatcatcgactatcatactactcattagtcatcattcatgaagatccctagattaaatattgtactagtacttctgtactgtcaaaagtcaaagagaagtgaatcttaaaggtgcttttgtcctttgaaatttcttaaacc

SEQ ID NO: 1438 - protein, 1779 aa, Arabidopsis thaliana
GAGCTTCATTTTGCCTTTGTATACTTTTGAGTAGATAGATAGACAGACTATAGTCTATATAAGATCCATGTGACAATAGTTAAAATCCTCATATTTTCATTTCCAATGGAGCGCAAAGTCTTGAATACCCTCGCCTTCTCCGTCTTTGCCGTTCTCTTCTTCACCTCCTCTGCTTCTTCCCAATACCAAACTCTTGTCGTCAACACTCTTCCTTCTTCCGCAACACTCTCATGGCCCGAGTCCGAATCTTTAACTGATGAATCTTTATCCGAGTCCACAACTTCACTCTCTGTCCATTTATCACACGTGGATGCTCTGTCTTCCTTCTCCGACGCATCTCCGGCGGACCTCTTCAACCTCCGTCTCCAACGAGACTCTCTCCGCGTCAAATCTATTACCAGCCTCGCCGCCGTATCAACCGGACGAAATGCTACGAAAAGAACTCCACGTACCGCCGGTGGATTTAGCGGCGCAGTTATCTCTGGCCTCTCACAAGGAAGCGGAGAGTATTTTATGAGGTTAGGTGTTGGAACTCCGGCGACTAACGTTTACATGGTGCTCGACACAGGAAGCGACGTCGTTTGGCTCCAATGCTCTCCTTGCAAAGCCTGTTACAACCAGACCGACGCCATTTTTGACCCGAAGAAATCCAAAACTTTCGCCACCGTACCATGTGGATCTCGCCTTTGCCGGAGACTAGACGACTCGTCGGAATGTGTCACTCGTCGAAGCAAGACTTGTCTCTACCAAGTATCGTACGGTGACGGATCATTCACCGAAGGAGATTTCTCAACTGAAACGCTGACGTTTCATGGAGCGCGTGTTGATCACGTGCCGTTAGGATGCGGTCACGATAACGAAGGCTTGTTCGTTGGTGCGGCTGGGCTTTTGGGCTTGGGCCGTGGTGGGTTATCTTTCCCGTCGCAGACGAAAAACCGTTATAACGGAAAATTCTCTTACTGTTTGGTTGACCGGACGAGTTCCGGTTCTTCTTCTAAACCACCGTCAACAATCGTGTTTGGAAACGCCGCCGTTCCGAAAACCTCTGTTTTCACGCCGTTACTAACGAACCCGAAACTCGACACGTTTTATTACTTGCAGCTTCTTGGAATCAGCGTTGGTGGTTCGCGCGTTCCCGGCGTTTCGGAGTCGCAGTTCAAGCTTGACGCCACCGGAAACGGCGGTGTCATTATAGATTCCGGTACTTCGGTTACTCGGCTGACGCAACCTGCTTACGTAGCGCTTAGAGACGCTTTTAGACTTGGTGCTACGAAGCTGAAACGTGCTCCATCGTATTCTTTGTTCGACACGTGTTTTGATCTCTCGGGAATGACGACTGTGAAGGTTCCGACGGTTGTGTTTCATTTCGGAGGCGGAGAGGTTTCGCTTCCGGCGAGTAATTATCTGATCCCGGTTAACACTGAAGGACGGTTCTGTTTTGCGTTTGCCGGAACTATGGGGAGTTTGTCAATCATTGGAAACATACAGCAACAAGGTTTCCGGGTCGCTTATGACTTGGTCGGGTCACGGGTCGGGTTTTTGTCTCGCGCGTGTTAGATTTTGAGCTTGAGTTGACTGATTTATTCCCAAAGACTTTTTGGGAGAAAATTGACAAAGCAAATTATCAAACATTGTTATCATCATCGACTATCATACTACTCATTAGTCATCATTCATGAAGATCCCTAGATTAAATATTGTACTAGTACTTCTGTACTGTCAAAAGTCAAAGAGAAGTGAATCTTAAAGGTGCTTTTGTCCTTTGAAATTTCTTAAACC

SEQ ID NO: 1439 - DNA, 1783 bp, Arabidopsis thaliana
  misc_feature (1)..(1783): Ceres cDNA ID no. 12591998
  misc_feature (1)..(1783): Ceres CLONE  ID no. 1344861
  misc_feature (1)..(1783): Also known as  Ceres CDNA ID no. 12591998
gaaacgccttttgtgagagagagaagagaagagaagagaagagaagagaagagaagagatcgcaccacacaaaaactacaattttgttttggaaattactctcacccacctgaattttgttgctagagagacaacacttaggttttgggcggagttctgatgtgaaatgaatcggcgtagaaaattttcaggatcctccaattcgtcagagagtgtagcgaggagtgtctgatccgttcgctgattctaatggctggacgggtcttcgaagcctggaagggaagtaataagtttctgtttggtgggagattgatatttgggccagatgcttggtctattccttttaccttcctgctcatcataactcccgtttgtttcttttctgtatttgttgcaacacatcttcgccgcgagctcttaccaaacaatgcgggacatgtgttcttagtggcaggagttctatttactgtctttgtactgatccttctcttcctcacttctgcgcgggatcctggaatcgttccaagaaattcgcatccgccagaggaagaactatgctatgatacaactgtatcaagtgatggaagacaaacacccactgttcaaattcctaggacgaaggaagtcatggtttatggcgtttctgttagagttaaatattgtgatacatgcatgctttatcggcctcctcgatgctcccattgttccatttgcaacaactgtgttgagcgctttgatcatcattgcccttggagaaactataggtacttctttatgtttgtttcttcggcaactattctctgcatctacattttttcgatgtcggcattatacatcaaggttctgatggataaccatcaaggtactgtgtggagggcaatgcgagaatcaccctgggcggttatgctgatgatatattgctttatttccctgtggtttgttggagggcttactgggtttcacttgtacctcattagcacaaaccagacgacctatgagaatttccggtacagatcagacaatagaatcaacgtttataaccgtgggtgttcaaacaatttttttgagacattttgctcaaaagttaaaccctcaaggaatgacttcagagcgttcatcaaagaagaacctccaaggaatattacattggctaccacatgggaacgaccagaagaagcagatgaagaaaacagggaggaacggcgccagaaggtggaagacgatctagacatcgatgaagatgttatgaaactgcagcagcgtttaagtgacgaagagggcagcgatacagcgcatcacaagatcgatattgaccaaatgagaatcgggtctaatgagagagcgccaacaattcgatcagaagccaggcatggaaactggggagcaagaagcaatgcacaggaggaggacgtaattgctggttcttcagtaagagaaagtagaagctatgcagctgcagaggagggacggtgatgagtgaacgatggtagtagggtaattattttgaagctttttctttcttactaagtttttattgttttcaatttttcattattttgtgggtttggtttgatttgggagttgtgaacactatttgtgaataagtttagtgtaagcttgggtagaggtcgaattaagttataagtaatcaactttttgaatgttttgccgtgatgatgatttctaatgatgatttaggttactctggtttttgccttaaaatagacagaaccacagttttattttactgtttttctttctaaataaagaaaggcgataagat

SEQ ID NO: 1440 - protein, 1783 aa, Arabidopsis thaliana
GAAACGCCTTTTGTGAGAGAGAGAAGAGAAGAGAAGAGAAGAGAAGAGAAGAGAAGAGATCGCACCACACAAAAACTACAATTTTGTTTTGGAAATTACTCTCACCCACCTGAATTTTGTTGCTAGAGAGACAACACTTAGGTTTTGGGCGGAGTTCTGATGTGAAATGAATCGGCGTAGAAAATTTTCAGGATCCTCCAATTCGTCAGAGAGTGTAGCGAGGAGTGTCTGATCCGTTCGCTGATTCTAATGGCTGGACGGGTCTTCGAAGCCTGGAAGGGAAGTAATAAGTTTCTGTTTGGTGGGAGATTGATATTTGGGCCAGATGCTTGGTCTATTCCTTTTACCTTCCTGCTCATCATAACTCCCGTTTGTTTCTTTTCTGTATTTGTTGCAACACATCTTCGCCGCGAGCTCTTACCAAACAATGCGGGACATGTGTTCTTAGTGGCAGGAGTTCTATTTACTGTCTTTGTACTGATCCTTCTCTTCCTCACTTCTGCGCGGGATCCTGGAATCGTTCCAAGAAATTCGCATCCGCCAGAGGAAGAACTATGCTATGATACAACTGTATCAAGTGATGGAAGACAAACACCCACTGTTCAAATTCCTAGGACGAAGGAAGTCATGGTTTATGGCGTTTCTGTTAGAGTTAAATATTGTGATACATGCATGCTTTATCGGCCTCCTCGATGCTCCCATTGTTCCATTTGCAACAACTGTGTTGAGCGCTTTGATCATCATTGCCCTTGGAGAAACTATAGGTACTTCTTTATGTTTGTTTCTTCGGCAACTATTCTCTGCATCTACATTTTTTCGATGTCGGCATTATACATCAAGGTTCTGATGGATAACCATCAAGGTACTGTGTGGAGGGCAATGCGAGAATCACCCTGGGCGGTTATGCTGATGATATATTGCTTTATTTCCCTGTGGTTTGTTGGAGGGCTTACTGGGTTTCACTTGTACCTCATTAGCACAAACCAGACGACCTATGAGAATTTCCGGTACAGATCAGACAATAGAATCAACGTTTATAACCGTGGGTGTTCAAACAATTTTTTTGAGACATTTTGCTCAAAAGTTAAACCCTCAAGGAATGACTTCAGAGCGTTCATCAAAGAAGAACCTCCAAGGAATATTACATTGGCTACCACATGGGAACGACCAGAAGAAGCAGATGAAGAAAACAGGGAGGAACGGCGCCAGAAGGTGGAAGACGATCTAGACATCGATGAAGATGTTATGAAACTGCAGCAGCGTTTAAGTGACGAAGAGGGCAGCGATACAGCGCATCACAAGATCGATATTGACCAAATGAGAATCGGGTCTAATGAGAGAGCGCCAACAATTCGATCAGAAGCCAGGCATGGAAACTGGGGAGCAAGAAGCAATGCACAGGAGGAGGACGTAATTGCTGGTTCTTCAGTAAGAGAAAGTAGAAGCTATGCAGCTGCAGAGGAGGGACGGTGATGAGTGAACGATGGTAGTAGGGTAATTATTTTGAAGCTTTTTCTTTCTTACTAAGTTTTTATTGTTTTCAATTTTTCATTATTTTGTGGGTTTGGTTTGATTTGGGAGTTGTGAACACTATTTGTGAATAAGTTTAGTGTAAGCTTGGGTAGAGGTCGAATTAAGTTATAAGTAATCAACTTTTTGAATGTTTTGCCGTGATGATGATTTCTAATGATGATTTAGGTTACTCTGGTTTTTGCCTTAAAATAGACAGAACCACAGTTTTATTTTACTGTTTTTCTTTCTAAATAAAGAAAGGCGATAAGAT

SEQ ID NO: 1441 - DNA, 1478 bp, Arabidopsis thaliana
  misc_feature (1)..(1478): Ceres cDNA ID no. 12592132
  misc_feature (1)..(1478): Ceres CLONE  ID no. 1345296
  misc_feature (1)..(1478): Also known as  Ceres CDNA ID no. 23468080
aaagtagccgcctcatcctcctcgtctcttctcgttagctctctcaatgaggagcccgatttagggtttcctccattggttatatcaattcgatcatctccacaaagctctcgaagactctttcggtgatctcatcttcttcttcttgtttagcctcctggaggttactttgtttgttactagttccaaaacatgccgaaagagaggaaagaacggtccgtatctcttgataagtataaacgatcgccactgtgttgtgaggcaagccttgctttgaagccgagtgagaaacaagttaaagaatgggaagaggctcgttgtcctgtttgtatggaacatcctcacaatgggattcttctcatttgttcttcttatgaaaatggttgtcgaccttacatgtgcgacactagccatcggcattctaactgtttcgatcagttccgcaaagcttctaaagagaaaccttctttgtctttacttcgtgaggaagaggaaagtaatgaaccaactgagatggaagatgtggattcagactcaactgctgtaaatctattaggagaagctgcatctgagataacagttgtggatttaagtgatggtgagagaggagaagaagaagtagaagaagaagaagaagaagtagtagtagaagaagaagaagaaggaattgtaacaacagaagaagatcaagaaaaaaacaaaccacaaaagcttacttgtccgttatgtcgtggacatataaaagaatgggtagttgttaaagcagctcgatgtttcatgaactcaaaacatagaagctgttcttgtgagacttgtgatttcagtggaagctattccgatctgagaaagcacgcaaggcttctacatccaggagttaggccatcagaagcagatccagagagacagagaagctggaggaggctagaaaggcagagcgatttaggggatttacttagcacactccaatcttcttttggaggagatgaaataagtaacgatgatgggtttctatttgctgatactcgcttgcttacagtgtactttctcatccgcgtgtttagaccagaatcgagtggctcaaggagtagtagctggtctggtacatctagagctaggacacatacaagtgggagaagaagatcttcaagacctgcaagtctttggggagagagctatgaaggtaatacaggaacatcacctagagatgaggagaataatcaatcttctgatgaacaagtgtctggaactcggagacgtcgttctagaagaagaactgtcattgatgatgatgatgaagaagaagaaccgtgatgctctgcagtttggaaatttggtctttggagtttatgataaaatgggggaaaccttgtagtaataaccccacttatgaaaccctattatgtaaaatttctttggagattgaaaaaagtttctactattgggaaacaaaatgttcaatatttcattaccgtttaaat

SEQ ID NO: 1442 - protein, 1478 aa, Arabidopsis thaliana
  misc_feature: GI Number: 34912600; NR Description: P0046B10.17 [Oryza sativa (japonica cultivar-group)] >gi|11034559|dbj|BAB17083.1| P0410E01.4 [Oryza sativa (japonica cultivar-group)] >gi|21104687|dbj|BAB93277.1| P0046B10.17 [Oryza sativa (japonica
  misc_feature: GI Number: 5103842; NR Description: F9L1.39 [Arabidopsis thaliana]
AAAGTAGCCGCCTCATCCTCCTCGTCTCTTCTCGTTAGCTCTCTCAATGAGGAGCCCGATTTAGGGTTTCCTCCATTGGTTATATCAATTCGATCATCTCCACAAAGCTCTCGAAGACTCTTTCGGTGATCTCATCTTCTTCTTCTTGTTTAGCCTCCTGGAGGTTACTTTGTTTGTTACTAGTTCCAAAACATGCCGAAAGAGAGGAAAGAACGGTCCGTATCTCTTGATAAGTATAAACGATCGCCACTGTGTTGTGAGGCAAGCCTTGCTTTGAAGCCGAGTGAGAAACAAGTTAAAGAATGGGAAGAGGCTCGTTGTCCTGTTTGTATGGAACATCCTCACAATGGGATTCTTCTCATTTGTTCTTCTTATGAAAATGGTTGTCGACCTTACATGTGCGACACTAGCCATCGGCATTCTAACTGTTTCGATCAGTTCCGCAAAGCTTCTAAAGAGAAACCTTCTTTGTCTTTACTTCGTGAGGAAGAGGAAAGTAATGAACCAACTGAGATGGAAGATGTGGATTCAGACTCAACTGCTGTAAATCTATTAGGAGAAGCTGCATCTGAGATAACAGTTGTGGATTTAAGTGATGGTGAGAGAGGAGAAGAAGAAGTAGAAGAAGAAGAAGAAGAAGTAGTAGTAGAAGAAGAAGAAGAAGGAATTGTAACAACAGAAGAAGATCAAGAAAAAAACAAACCACAAAAGCTTACTTGTCCGTTATGTCGTGGACATATAAAAGAATGGGTAGTTGTTAAAGCAGCTCGATGTTTCATGAACTCAAAACATAGAAGCTGTTCTTGTGAGACTTGTGATTTCAGTGGAAGCTATTCCGATCTGAGAAAGCACGCAAGGCTTCTACATCCAGGAGTTAGGCCATCAGAAGCAGATCCAGAGAGACAGAGAAGCTGGAGGAGGCTAGAAAGGCAGAGCGATTTAGGGGATTTACTTAGCACACTCCAATCTTCTTTTGGAGGAGATGAAATAAGTAACGATGATGGGTTTCTATTTGCTGATACTCGCTTGCTTACAGTGTACTTTCTCATCCGCGTGTTTAGACCAGAATCGAGTGGCTCAAGGAGTAGTAGCTGGTCTGGTACATCTAGAGCTAGGACACATACAAGTGGGAGAAGAAGATCTTCAAGACCTGCAAGTCTTTGGGGAGAGAGCTATGAAGGTAATACAGGAACATCACCTAGAGATGAGGAGAATAATCAATCTTCTGATGAACAAGTGTCTGGAACTCGGAGACGTCGTTCTAGAAGAAGAACTGTCATTGATGATGATGATGAAGAAGAAGAACCGTGATGCTCTGCAGTTTGGAAATTTGGTCTTTGGAGTTTATGATAAAATGGGGGAAACCTTGTAGTAATAACCCCACTTATGAAACCCTATTATGTAAAATTTCTTTGGAGATTGAAAAAAGTTTCTACTATTGGGAAACAAAATGTTCAATATTTCATTACCGTTTAAAT

SEQ ID NO: 1443 - DNA, 1824 bp, Zea mays
  misc_feature (1)..(1824): Ceres cDNA ID no. 12593647
  misc_feature (1)..(1824): Ceres CLONE  ID no. 237096
  misc_feature (1)..(1824): Also known as  Ceres CDNA ID no. 23755693
gcacgagaccattacctagaacatcctaatcgaaaaatttcattctttgtttgtttcagcctttcacggaagaggggcggagtacgtaaggtgaacccggtcgtctgaagagaagcgaggacgacgtaggagaggggaggacagcgagatggccggcgggtttggcagcggcggggcagccgccgggagggccgagctctacgagggcaagatcaccggctacttcatcctcgcttgcatcgtcggctccttcggcggatccctcttcggctatgacctcggagtctccagcggcgtgacttccatggacgacttcctggtgaagttcttcccggacgtgtaccggcggaagcaggcgcacctccacgagacggactactgcaagtacgacaaccaggtgctgacgctcttcacctcgtcgctctacttcgcgggcctcgtctccaccttcggcgcctcctacgtgaccaagcgccacggccggcgcgccagcatcatggtgggcgccgccagcttcttcctcggcggcgccatcaacgcggccgccatgaacatcgccatgctcatcgtcggccgcgtgctcctcggcgtcggcatcggcttcggcaaccaggccgtgccgctctacctctcggagatcgcgccctaccgcatccgcggcgccgtgaaccagctcttccagctcaccacctgcctcggcatcctcgtcgccgacgtcatcaactacttcaccgaccgcctgcacccctgggggtggcgcctctcgctgggcctcgccatgggcccggccaccgccatcttcgtcggcgcgctcttccttcccgagacgcccaacagcctcgtcgagcgcgggcacctggaggaggcccgccgcgtgctggagaaggtgcgcggcacgcacaaggtggacgccgagttcgaggacctcaaggaggccagccaggccgcgcgcgccgtcacgggcacgttccggaacctgctcgccgtgcgcaaccgcccgcagctcatcatcggcgcgctcggcatcccggcgttccagcagctgtcgggcatgaactccatcctcttctactcgcccgtcatcttccagagccttggattcggctcctccgcggcgctctactcctccatcatcaccggctccatgctcgtcgtcggcgcgctcatctccatggttaccgtcgaccgccttggccgccgcttcctcttcatcgaggcgggcattcagatggtctcatccatggtcgtggtggctgtgatccttgccctcaagttcggaaaaggcgaggagctgagcaagggcgtgagcacggtgctggtggtggccatctgcctcttcgtggtggcctacggatggtcctgggggcccctcggatggctggtgccgagcgagctgttcccgctggagatgcggtcggcggggcagagcgtggtggtgtgcgtcaacctcttctggacggcttccgtagcgcagtgcttcctcgccgcgctgtgccacctccggtggggcgtcttcgtgctcttcgccgcgctcatcgtcgtcatgtccatcttcgtcatcctcctgctgccggagaccaagcaggtgcccatcgaggagatatggatgctctttgacaggcactggtactggaagcgcatcgtccgcagggacccaaaataccagggcaacctccaccagcagcaggagatgtccagaatatgaacatggttaattagcgatgtggtttaataagttttctatccctaaacatataggatatgatgattactactagattattaagacgaatgtggtgtgatccttgatgcaatccaaagagg

SEQ ID NO: 1444 - protein, 1824 aa, Zea mays
  misc_feature: PFam Name: Sugar_tr; PFam Description: Sugar (and other)
  misc_feature: PFam Name: MFS_1; PFam Description: Major Facilitator Superfamily
  misc_feature: GI Number: 2258137; NR Description: PaMst-1 [Picea abies] >gi|7446723|pir||T14864 probable monosaccharide transport protein
  misc_feature: GI Number: 347855; NR Description: glucose transporter
  misc_feature: GI Number: 19885; NR Description: monosaccharid transporter [Nicotiana tabacum] >gi|100347|pir||S25015 monosaccharide transport
  misc_feature: GI Number: 33636086; NR Description: monosaccharide
  misc_feature: GI Number: 50253006; NR Description: putative glucose transporter [Oryza sativa (japonica cultivar-group)] >gi|50251542|dbj|BAD28916.1| putative glucose transporter [Oryza
GCACGAGACCATTACCTAGAACATCCTAATCGAAAAATTTCATTCTTTGTTTGTTTCAGCCTTTCACGGAAGAGGGGCGGAGTACGTAAGGTGAACCCGGTCGTCTGAAGAGAAGCGAGGACGACGTAGGAGAGGGGAGGACAGCGAGATGGCCGGCGGGTTTGGCAGCGGCGGGGCAGCCGCCGGGAGGGCCGAGCTCTACGAGGGCAAGATCACCGGCTACTTCATCCTCGCTTGCATCGTCGGCTCCTTCGGCGGATCCCTCTTCGGCTATGACCTCGGAGTCTCCAGCGGCGTGACTTCCATGGACGACTTCCTGGTGAAGTTCTTCCCGGACGTGTACCGGCGGAAGCAGGCGCACCTCCACGAGACGGACTACTGCAAGTACGACAACCAGGTGCTGACGCTCTTCACCTCGTCGCTCTACTTCGCGGGCCTCGTCTCCACCTTCGGCGCCTCCTACGTGACCAAGCGCCACGGCCGGCGCGCCAGCATCATGGTGGGCGCCGCCAGCTTCTTCCTCGGCGGCGCCATCAACGCGGCCGCCATGAACATCGCCATGCTCATCGTCGGCCGCGTGCTCCTCGGCGTCGGCATCGGCTTCGGCAACCAGGCCGTGCCGCTCTACCTCTCGGAGATCGCGCCCTACCGCATCCGCGGCGCCGTGAACCAGCTCTTCCAGCTCACCACCTGCCTCGGCATCCTCGTCGCCGACGTCATCAACTACTTCACCGACCGCCTGCACCCCTGGGGGTGGCGCCTCTCGCTGGGCCTCGCCATGGGCCCGGCCACCGCCATCTTCGTCGGCGCGCTCTTCCTTCCCGAGACGCCCAACAGCCTCGTCGAGCGCGGGCACCTGGAGGAGGCCCGCCGCGTGCTGGAGAAGGTGCGCGGCACGCACAAGGTGGACGCCGAGTTCGAGGACCTCAAGGAGGCCAGCCAGGCCGCGCGCGCCGTCACGGGCACGTTCCGGAACCTGCTCGCCGTGCGCAACCGCCCGCAGCTCATCATCGGCGCGCTCGGCATCCCGGCGTTCCAGCAGCTGTCGGGCATGAACTCCATCCTCTTCTACTCGCCCGTCATCTTCCAGAGCCTTGGATTCGGCTCCTCCGCGGCGCTCTACTCCTCCATCATCACCGGCTCCATGCTCGTCGTCGGCGCGCTCATCTCCATGGTTACCGTCGACCGCCTTGGCCGCCGCTTCCTCTTCATCGAGGCGGGCATTCAGATGGTCTCATCCATGGTCGTGGTGGCTGTGATCCTTGCCCTCAAGTTCGGAAAAGGCGAGGAGCTGAGCAAGGGCGTGAGCACGGTGCTGGTGGTGGCCATCTGCCTCTTCGTGGTGGCCTACGGATGGTCCTGGGGGCCCCTCGGATGGCTGGTGCCGAGCGAGCTGTTCCCGCTGGAGATGCGGTCGGCGGGGCAGAGCGTGGTGGTGTGCGTCAACCTCTTCTGGACGGCTTCCGTAGCGCAGTGCTTCCTCGCCGCGCTGTGCCACCTCCGGTGGGGCGTCTTCGTGCTCTTCGCCGCGCTCATCGTCGTCATGTCCATCTTCGTCATCCTCCTGCTGCCGGAGACCAAGCAGGTGCCCATCGAGGAGATATGGATGCTCTTTGACAGGCACTGGTACTGGAAGCGCATCGTCCGCAGGGACCCAAAATACCAGGGCAACCTCCACCAGCAGCAGGAGATGTCCAGAATATGAACATGGTTAATTAGCGATGTGGTTTAATAAGTTTTCTATCCCTAAACATATAGGATATGATGATTACTACTAGATTATTAAGACGAATGTGGTGTGATCCTTGATGCAATCCAAAGAGG

SEQ ID NO: 1445 - DNA, 1962 bp, Zea mays
  misc_feature (1)..(1962): Ceres cDNA ID no. 12593736
  misc_feature (1)..(1962): Ceres CLONE  ID no. 227113
  misc_feature (1)..(1962): Also known as  Ceres CDNA ID no. 24373662
acacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgtaccaaattgaaggtgcttggaatgaagatggaaagggggaaagcaactgggatcacttctgccacaatcatccggaaaggatactggacgggagcaattcagacattggagcgaattcgtaccatatgtacaaaacggacgtcagattgctcaaggaaatgggcatggacgcatataggttctctatctcttggcccagaatactgccgaagggaaccaaagaaggaggtattaacccggatggcatcaagtactacagaaacctcatcaacttgttgctggaaaacggcatagagccatatgtaacaattttccactgggatgtacctcaagcactagaagagaagtacggcggcttcctagataagagtcataagagcattgtagaagattacacctacttcgctaaggtgtgctttgataacttcggcgacaaggtgaagaattggttgacctttaatgagccccagacatttacttccttttcctacggaactggggtctttgccccagggcggtgctcacctggactagactgtgcctacccaactgggaattcactcgtcgagccttacactgctggccataacattctcctagcccacgctgaggctgttgatctttacaacaagcattacaagcgcgacgacacccgcatagggcttgcgtttgacgtaatgggtcgtgtgccatacggaacatcgtttctggataaacaggccgaagaaaggtcatgggacatcaacctaggatggttcttagagccagtggttcgtggtgactaccccttctccatgagatcattggctagggaacgactacccttcttcaaggacgagcagaaggagaagctcgccggttcctataacatgttggggttaaactactacacctcacggttctccaaaaacatcgacatctcaccaaactactcacctgtgctcaacactgacgacgcctacgccagtcaagaagttaacgggcctgacgggaagcccattggtcctcctatgggaaatccatggatctacatgtaccctgagggcttgaaggatctccttatgataatgaagaacaaatacggaaacccacctatctacatcaccgagaacggaatcggggatgttgataccaaagagacacctctacccatggaggctgccttaaatgactacaaaaggctagattacatccagcgccacatcgctactcttaaggaatcaatagacttgggatcaaatgtgcaaggctacttcgcttggtctctgctggacaactttgaatggtttgccggcttcaccgaacgttatggcattgtctacgtcgaccgcaacaataactgcacgcgctacatgaaggagtctgccaagtggttgaaagagttcaacaccgcgaaaaagcccagcaagaagattcttacgccagcttaaaaatcgggggcctcatgatgtgggtgcagcccataaaaacctgtgtggtttggaaccgaagattttctctttttttttctgccacgagaggttctctggaggcatactctccagcaccgtggctaataacgcgttgttccaattcagtctggccttgtcatgcatgcaataaataaagtgatgggtttccctgtttcaatatc

SEQ ID NO: 1446 - protein, 1962 aa, Zea mays
  misc_feature: PFam Name: Glyco_hydro_1; PFam Description: Glycosyl
  misc_feature: GI Number: 49259431; NR Description: Chain A, Crystal
  misc_feature: GI Number: 13399869; NR Description: Chain B, Crystal Structure Of A Monocot (Maize Zmglu1) Beta-Glucosidase In Complex With P-Nitrophenyl-Beta-D-Thioglucoside >gi|13399868|pdb|1E1F|A Chain A, Crystal Structure Of A Monocot (Maize Zmglu1)
  misc_feature: GI Number: 29726258; NR Description: Chain B, Crystal Structure Of The Inactive Double Mutant Of The Maize Beta-Glucosidase Zmglu1-E191d-F198v In Complex With Dimboa-Glucoside >gi|29726257|pdb|1H49|A Chain A, Crystal Structure
  misc_feature: GI Number: 28373359; NR Description: Chain B, Crystal Structure Of The Maize Zm-P60.1 Beta-Glucosidase >gi|28373358|pdb|1HXJ|A Chain A, Crystal Structure Of The Maize
  misc_feature: GI Number: 49259434; NR Description: Chain B, Crystal Structure Of The Zea Maze Beta-Glucosidase-1 In Complex With Gluco-Tetrazole >gi|49259433|pdb|1V08|A Chain A, Crystal Structure Of The Zea Maze Beta-Glucosidase-1 In Complex
ACACACTTCACAAGCAGCTCAAAGCTCTAGTTCTAGCTAGCTAGCAAAGGGGGGGAAAATGGCTCCGCTTCTCGCTGCTGCCATGAACCACGCTGCAGCCCATCCTGGCCTTAGGAGCCACCTAGTAGGACCCAACAATGAGAGTTTCTCACGGCACCACCTGCCGTCTTCTTCTCCACAGAGCAGCAAGCGAAGGTGTAACCTTAGCTTTACTACACGATCTGCAAGAGTAGGCAGCCAAAATGGAGTCCAAATGTTGAGCCCCTCGGAAATCCCACAAAGGGACTGGTTCCCCTCTGACTTCACCTTCGGTGCCGCCACTTCAGCGTACCAAATTGAAGGTGCTTGGAATGAAGATGGAAAGGGGGAAAGCAACTGGGATCACTTCTGCCACAATCATCCGGAAAGGATACTGGACGGGAGCAATTCAGACATTGGAGCGAATTCGTACCATATGTACAAAACGGACGTCAGATTGCTCAAGGAAATGGGCATGGACGCATATAGGTTCTCTATCTCTTGGCCCAGAATACTGCCGAAGGGAACCAAAGAAGGAGGTATTAACCCGGATGGCATCAAGTACTACAGAAACCTCATCAACTTGTTGCTGGAAAACGGCATAGAGCCATATGTAACAATTTTCCACTGGGATGTACCTCAAGCACTAGAAGAGAAGTACGGCGGCTTCCTAGATAAGAGTCATAAGAGCATTGTAGAAGATTACACCTACTTCGCTAAGGTGTGCTTTGATAACTTCGGCGACAAGGTGAAGAATTGGTTGACCTTTAATGAGCCCCAGACATTTACTTCCTTTTCCTACGGAACTGGGGTCTTTGCCCCAGGGCGGTGCTCACCTGGACTAGACTGTGCCTACCCAACTGGGAATTCACTCGTCGAGCCTTACACTGCTGGCCATAACATTCTCCTAGCCCACGCTGAGGCTGTTGATCTTTACAACAAGCATTACAAGCGCGACGACACCCGCATAGGGCTTGCGTTTGACGTAATGGGTCGTGTGCCATACGGAACATCGTTTCTGGATAAACAGGCCGAAGAAAGGTCATGGGACATCAACCTAGGATGGTTCTTAGAGCCAGTGGTTCGTGGTGACTACCCCTTCTCCATGAGATCATTGGCTAGGGAACGACTACCCTTCTTCAAGGACGAGCAGAAGGAGAAGCTCGCCGGTTCCTATAACATGTTGGGGTTAAACTACTACACCTCACGGTTCTCCAAAAACATCGACATCTCACCAAACTACTCACCTGTGCTCAACACTGACGACGCCTACGCCAGTCAAGAAGTTAACGGGCCTGACGGGAAGCCCATTGGTCCTCCTATGGGAAATCCATGGATCTACATGTACCCTGAGGGCTTGAAGGATCTCCTTATGATAATGAAGAACAAATACGGAAACCCACCTATCTACATCACCGAGAACGGAATCGGGGATGTTGATACCAAAGAGACACCTCTACCCATGGAGGCTGCCTTAAATGACTACAAAAGGCTAGATTACATCCAGCGCCACATCGCTACTCTTAAGGAATCAATAGACTTGGGATCAAATGTGCAAGGCTACTTCGCTTGGTCTCTGCTGGACAACTTTGAATGGTTTGCCGGCTTCACCGAACGTTATGGCATTGTCTACGTCGACCGCAACAATAACTGCACGCGCTACATGAAGGAGTCTGCCAAGTGGTTGAAAGAGTTCAACACCGCGAAAAAGCCCAGCAAGAAGATTCTTACGCCAGCTTAAAAATCGGGGGCCTCATGATGTGGGTGCAGCCCATAAAAACCTGTGTGGTTTGGAACCGAAGATTTTCTCTTTTTTTTTCTGCCACGAGAGGTTCTCTGGAGGCATACTCTCCAGCACCGTGGCTAATAACGCGTTGTTCCAATTCAGTCTGGCCTTGTCATGCATGCAATAAATAAAGTGATGGGTTTCCCTGTTTCAATATC

SEQ ID NO: 1447 - DNA, 818 bp, Zea mays
  misc_feature (1)..(818): Ceres cDNA ID no. 12595235
  misc_feature (1)..(818): Ceres CLONE  ID no. 367695
  misc_feature (1)..(818): Also known as  Ceres CDNA ID no. 0
aatcacaactcaaacactctacttgtatctcacaatggcaggcacaaagctaatatcacttgggctccttgttctcataggcataggactagccaatgctgtgagggtggctagatactctagtgctgatgggactggcacaggagagggacagggtggtggatacgtgaatggtgggggatcaggatctgggtccggcaccggatctggtgatagtagtccttatggtgtccatacaagtgctggagggggtggtgcaggtggtggagctagccaaaacggtgggtctggatatggttcaggatcagggtcagggtcagggtcaagtacgtacagtcagggagggtattattcaggttatggagaatcttctaatgctggtggtactggtgggggtgggggtggaggacaagctggaggttcttggaattccaacgctcaaggatccggtagtggcaccggttctggttctagctatgctaacaggaattgggatggatcaagtggaggtgcaaatgctaatggcaatggtggtggcacgggaaatagtcaaaatggtgggggcggcggtggttcaggtgatgggtctggatatgccaatgcctacccatgaacttgatatcagttaatctaatgttgggcccgccatccatccttgtttgaatttgttggattattattttccttggctctttgtcgtggttttggtagaaccgaattaataaagggtccaactatcttgtaaggtccaacgtataagatgatgttgtaacagtgtctgttaatgaaaactatatatcaacaaatttcttatgttt

SEQ ID NO: 1448 - protein, 818 aa, Zea mays
AATCACAACTCAAACACTCTACTTGTATCTCACAATGGCAGGCACAAAGCTAATATCACTTGGGCTCCTTGTTCTCATAGGCATAGGACTAGCCAATGCTGTGAGGGTGGCTAGATACTCTAGTGCTGATGGGACTGGCACAGGAGAGGGACAGGGTGGTGGATACGTGAATGGTGGGGGATCAGGATCTGGGTCCGGCACCGGATCTGGTGATAGTAGTCCTTATGGTGTCCATACAAGTGCTGGAGGGGGTGGTGCAGGTGGTGGAGCTAGCCAAAACGGTGGGTCTGGATATGGTTCAGGATCAGGGTCAGGGTCAGGGTCAAGTACGTACAGTCAGGGAGGGTATTATTCAGGTTATGGAGAATCTTCTAATGCTGGTGGTACTGGTGGGGGTGGGGGTGGAGGACAAGCTGGAGGTTCTTGGAATTCCAACGCTCAAGGATCCGGTAGTGGCACCGGTTCTGGTTCTAGCTATGCTAACAGGAATTGGGATGGATCAAGTGGAGGTGCAAATGCTAATGGCAATGGTGGTGGCACGGGAAATAGTCAAAATGGTGGGGGCGGCGGTGGTTCAGGTGATGGGTCTGGATATGCCAATGCCTACCCATGAACTTGATATCAGTTAATCTAATGTTGGGCCCGCCATCCATCCTTGTTTGAATTTGTTGGATTATTATTTTCCTTGGCTCTTTGTCGTGGTTTTGGTAGAACCGAATTAATAAAGGGTCCAACTATCTTGTAAGGTCCAACGTATAAGATGATGTTGTAACAGTGTCTGTTAATGAAAACTATATATCAACAAATTTCTTATGTTT

SEQ ID NO: 1449 - DNA, 1652 bp, Arabidopsis thaliana
  misc_feature (1)..(1652): Ceres cDNA ID no. 12599962
  misc_feature (1)..(1652): Ceres CLONE  ID no. 104275
  misc_feature (1)..(1652): Also known as  Ceres CDNA ID no. 23471176
gttaacggtcggaatctaaaaaatgtctcctaactactccttcttcttcttcatcttcttcctcacttcacactcttctgttttctccagaatcttaccagagacctccacaaccactacctcaattctcaatgtcgctgactccatccacagaaccaagtatacgtcgtcgtttcggttaaaccagcaagaagaacagactcactctgcttcttcttctttcagcttgcagcttcattcacgagtttccgtccgaggaactgaacactcagactataagtcactcacactagccagactcaaccgtgacacagcccgagtcaaatctctcataacccgtttagatctagccatcaacaacatatccaaagcagatctcaaacccatcagcacaatgtacaccactgaggaacaagatatcgaagctcctttaatctccggcacgactcaaggaagtggcgagtacttcacacgcgtcggtatcggaaaaccggcgcgtgaagtttatatggttctagatactggaagtgacgtgaactggctacaatgtactccttgcgctgactgttaccaccaaaccgaaccaatcttcgagccatcgtcgtcttcttcttacgagcctctctcttgtgacactccacagtgcaatgcccttgaagtctcagaatgtagaaacgccacgtgtctttacgaggtttcttacggtgatggttcttacaccgttggagatttcgccaccgagactctcacaatcggctcaactctagttcaaaacgtcgccgttggttgtggacacagcaacgaagggttgttcgtcggcgccgccggtttacttggactcggcggtggtttgttagctcttccgtcgcagctcaacacgacgtcgttctcgtactgtctcgttgaccgtgactcagactcggcttcgaccgtggatttcgggacttctctttctcctgacgccgtcgtggctccgttgctacgtaaccaccagctcgacacgttttactacctaggcctcaccggaataagcgtcggcggcgagttgcttcagattcctcagtcttctttcgagatggacgagtcaggcagcggtgggatcatcatcgactcaggaaccgccgtgactcgtctccagaccgaaatctataactcgcttagagactcgttcgtgaaaggaacgttggacttggaaaaagcagccggggtggcgatgtttgacacgtgttataacctttcggctaagacgacggtagaagtcccgaccgtggcttttcatttccccggcgggaagatgttggctttgccggcgaagaactacatgattccggttgactcggtggggacattttgtttggcatttgcaccgacggcgagttcactagcgattatcggaaacgtgcagcaacaagggacacgtgtcactttcgatttggcaaattctctcattggattctcgtctaataaatgctaagctgttttcatcaaaaaaaacaaaaatgctaagctgttttttctataaatatatttgagttacaatgaaaaggaaaagtcacttaaaagatagtaatgttaagttagagtactgtactactgtttggttgtgtttgtttcttgtacttgttgttgcaatgcatagagtgaaaaagagt

SEQ ID NO: 1450 - protein, 1652 aa, Arabidopsis thaliana
  misc_feature: PFam Name: Asp; PFam Description: Eukaryotic aspartyl protease
  misc_feature: GI Number: 34895664; NR Description: nucleoid DNA-binding protein cnd41-like protein [Oryza sativa (japonica cultivar-group)] >gi|12328547|dbj|BAB21205.1| nucleoid DNA-binding protein
  misc_feature: GI Number: 19424106; NR Description: putative chloroplast
  misc_feature: GI Number: 23297732; NR Description: putative chloroplast nucleoid DNA-binding protein [Arabidopsis thaliana] >gi|11994113|dbj|BAB01116.1| CND41, chloroplast nucleoid DNA binding protein-like [Arabidopsis thaliana]
  misc_feature: GI Number: 21594980; NR Description: chloroplast nucleoid DNA
  misc_feature: GI Number: 15231010; NR Description: aspartyl protease family
GTTAACGGTCGGAATCTAAAAAATGTCTCCTAACTACTCCTTCTTCTTCTTCATCTTCTTCCTCACTTCACACTCTTCTGTTTTCTCCAGAATCTTACCAGAGACCTCCACAACCACTACCTCAATTCTCAATGTCGCTGACTCCATCCACAGAACCAAGTATACGTCGTCGTTTCGGTTAAACCAGCAAGAAGAACAGACTCACTCTGCTTCTTCTTCTTTCAGCTTGCAGCTTCATTCACGAGTTTCCGTCCGAGGAACTGAACACTCAGACTATAAGTCACTCACACTAGCCAGACTCAACCGTGACACAGCCCGAGTCAAATCTCTCATAACCCGTTTAGATCTAGCCATCAACAACATATCCAAAGCAGATCTCAAACCCATCAGCACAATGTACACCACTGAGGAACAAGATATCGAAGCTCCTTTAATCTCCGGCACGACTCAAGGAAGTGGCGAGTACTTCACACGCGTCGGTATCGGAAAACCGGCGCGTGAAGTTTATATGGTTCTAGATACTGGAAGTGACGTGAACTGGCTACAATGTACTCCTTGCGCTGACTGTTACCACCAAACCGAACCAATCTTCGAGCCATCGTCGTCTTCTTCTTACGAGCCTCTCTCTTGTGACACTCCACAGTGCAATGCCCTTGAAGTCTCAGAATGTAGAAACGCCACGTGTCTTTACGAGGTTTCTTACGGTGATGGTTCTTACACCGTTGGAGATTTCGCCACCGAGACTCTCACAATCGGCTCAACTCTAGTTCAAAACGTCGCCGTTGGTTGTGGACACAGCAACGAAGGGTTGTTCGTCGGCGCCGCCGGTTTACTTGGACTCGGCGGTGGTTTGTTAGCTCTTCCGTCGCAGCTCAACACGACGTCGTTCTCGTACTGTCTCGTTGACCGTGACTCAGACTCGGCTTCGACCGTGGATTTCGGGACTTCTCTTTCTCCTGACGCCGTCGTGGCTCCGTTGCTACGTAACCACCAGCTCGACACGTTTTACTACCTAGGCCTCACCGGAATAAGCGTCGGCGGCGAGTTGCTTCAGATTCCTCAGTCTTCTTTCGAGATGGACGAGTCAGGCAGCGGTGGGATCATCATCGACTCAGGAACCGCCGTGACTCGTCTCCAGACCGAAATCTATAACTCGCTTAGAGACTCGTTCGTGAAAGGAACGTTGGACTTGGAAAAAGCAGCCGGGGTGGCGATGTTTGACACGTGTTATAACCTTTCGGCTAAGACGACGGTAGAAGTCCCGACCGTGGCTTTTCATTTCCCCGGCGGGAAGATGTTGGCTTTGCCGGCGAAGAACTACATGATTCCGGTTGACTCGGTGGGGACATTTTGTTTGGCATTTGCACCGACGGCGAGTTCACTAGCGATTATCGGAAACGTGCAGCAACAAGGGACACGTGTCACTTTCGATTTGGCAAATTCTCTCATTGGATTCTCGTCTAATAAATGCTAAGCTGTTTTCATCAAAAAAAACAAAAATGCTAAGCTGTTTTTTCTATAAATATATTTGAGTTACAATGAAAAGGAAAAGTCACTTAAAAGATAGTAATGTTAAGTTAGAGTACTGTACTACTGTTTGGTTGTGTTTGTTTCTTGTACTTGTTGTTGCAATGCATAGAGTGAAAAAGAGT

SEQ ID NO: 1451 - DNA, 1445 bp, Arabidopsis thaliana
  misc_feature (1)..(1445): Ceres cDNA ID no. 12600075
  misc_feature (1)..(1445): Ceres CLONE  ID no. 6351
  misc_feature (1)..(1445): Also known as  Ceres CDNA ID no. 23471222
aagggtggtgtcataagcgtttactgtgagtctctcaaagaaaccaaaggcagagaaaagagataacacacacaaaaaaaaatggcatcaacctcactcctcaaggcttctccggtgttggacaaatccgaatgggtcaagggacaaagcgttctcttccgtcagccttcttccgcttctgtcgtcctccgcaaccgtgccacctccctcaccgtccgtgccgcttcctcctacgccgatgagcttgttaagacagcgaaaactattgcgtctcccggacgtggaatcttggcgatggacgagtcaaacgcgacttgcgggaaacgtttggattcgatagggctagagaacactgaggcaaatcgtcaagctttccggactttgctggtctctgcaccgggactcggacagtacgtctccggcgcaattctatttgaggagactctgtaccagtctaccaccgaaggcaagaaaatggtcgacgtcctcgtcgagcagaacattgtccctggtatcaaagtcgacaagggtttggtgccacttgttggatccaacaatgagtcatggggccaaggactagatggtctatcatctcgaactgctgcttactatcaacagggtgcgcgtttcgccaaatggcgtactgtcgtgagcattcctaacggtccgtctgccctcgccgtcaaagaagctgcttggggtcttgctcgatacgctgccatttcacaggacagcggtttggttccgattgttgagccagagatcttgttggatggagaacacgacattgacagaacatacgacgtagcagagaaggtttgggctgaggttttcttttaccttgctcagaacaatgtcatgtttgaaggtatcctcctaaaaccgagcatggtgactcccggagctgagtctaaagacagagctactcctgaacaagttgccgcctacaccctcaagctcctccgcaacagagtccctcccgcagtccccggaatcatgtttttgtccggaggacagtcggaggtggaggcaacactcaacttgaacgcaatgaaccaggcaccaaacccatggcacgtgtccttctcctacgcacgtgcgttgcagaacacttgtctgaaaacatggggcggcagacccgagaacgtgaacgcagctcagaccactctcttggcccgtgccaaggccaattcgttggctcagctcggaaaatacaccggtgagggtgagtccgaagaggctaaggagggcatgttcgtcaaagggtacacctattgaagagatgatgctgtgaaaaaagagatgaagcagatgttttaatcacatttgtttttgagtttgcttgttattaatcatgtcaaatcattattttctctgcttactttgcgttagctactccttttaataagttctattatattgaagttatctatctctcttgatcc

SEQ ID NO: 1452 - protein, 1445 aa, Arabidopsis thaliana
  misc_feature: PFam Name: Glycolytic; PFam Description:
  misc_feature: GI Number: 16226653; NR Description: AT4g38970/F19H22_70
  misc_feature: GI Number: 53828647; NR Description: At4g38970 [Arabidopsis thaliana] >gi|18420348|ref|NP_568049.1| fructose-bisphosphate
  misc_feature: GI Number: 42573227; NR Description: fructose-bisphosphate
  misc_feature: GI Number: 1781348; NR Description: homologous to plastidic aldolases [Solanum tuberosum] >gi|7436610|pir||T07418 probable fructose-bisphosphate aldolase (EC 4.1.2.13) precursor, chloroplast
  misc_feature: GI Number: 21311559; NR Description: latex plastidic
AAGGGTGGTGTCATAAGCGTTTACTGTGAGTCTCTCAAAGAAACCAAAGGCAGAGAAAAGAGATAACACACACAAAAAAAAATGGCATCAACCTCACTCCTCAAGGCTTCTCCGGTGTTGGACAAATCCGAATGGGTCAAGGGACAAAGCGTTCTCTTCCGTCAGCCTTCTTCCGCTTCTGTCGTCCTCCGCAACCGTGCCACCTCCCTCACCGTCCGTGCCGCTTCCTCCTACGCCGATGAGCTTGTTAAGACAGCGAAAACTATTGCGTCTCCCGGACGTGGAATCTTGGCGATGGACGAGTCAAACGCGACTTGCGGGAAACGTTTGGATTCGATAGGGCTAGAGAACACTGAGGCAAATCGTCAAGCTTTCCGGACTTTGCTGGTCTCTGCACCGGGACTCGGACAGTACGTCTCCGGCGCAATTCTATTTGAGGAGACTCTGTACCAGTCTACCACCGAAGGCAAGAAAATGGTCGACGTCCTCGTCGAGCAGAACATTGTCCCTGGTATCAAAGTCGACAAGGGTTTGGTGCCACTTGTTGGATCCAACAATGAGTCATGGGGCCAAGGACTAGATGGTCTATCATCTCGAACTGCTGCTTACTATCAACAGGGTGCGCGTTTCGCCAAATGGCGTACTGTCGTGAGCATTCCTAACGGTCCGTCTGCCCTCGCCGTCAAAGAAGCTGCTTGGGGTCTTGCTCGATACGCTGCCATTTCACAGGACAGCGGTTTGGTTCCGATTGTTGAGCCAGAGATCTTGTTGGATGGAGAACACGACATTGACAGAACATACGACGTAGCAGAGAAGGTTTGGGCTGAGGTTTTCTTTTACCTTGCTCAGAACAATGTCATGTTTGAAGGTATCCTCCTAAAACCGAGCATGGTGACTCCCGGAGCTGAGTCTAAAGACAGAGCTACTCCTGAACAAGTTGCCGCCTACACCCTCAAGCTCCTCCGCAACAGAGTCCCTCCCGCAGTCCCCGGAATCATGTTTTTGTCCGGAGGACAGTCGGAGGTGGAGGCAACACTCAACTTGAACGCAATGAACCAGGCACCAAACCCATGGCACGTGTCCTTCTCCTACGCACGTGCGTTGCAGAACACTTGTCTGAAAACATGGGGCGGCAGACCCGAGAACGTGAACGCAGCTCAGACCACTCTCTTGGCCCGTGCCAAGGCCAATTCGTTGGCTCAGCTCGGAAAATACACCGGTGAGGGTGAGTCCGAAGAGGCTAAGGAGGGCATGTTCGTCAAAGGGTACACCTATTGAAGAGATGATGCTGTGAAAAAAGAGATGAAGCAGATGTTTTAATCACATTTGTTTTTGAGTTTGCTTGTTATTAATCATGTCAAATCATTATTTTCTCTGCTTACTTTGCGTTAGCTACTCCTTTTAATAAGTTCTATTATATTGAAGTTATCTATCTCTCTTGATCC

SEQ ID NO: 1453 - DNA, 2062 bp, Arabidopsis thaliana
  misc_feature (1)..(2062): Ceres cDNA ID no. 12600320
  misc_feature (1)..(2062): Ceres CLONE  ID no. 1331623
  misc_feature (1)..(2062): Also known as  Ceres CDNA ID no. 12600320
gatggtagacccaattctctctctctctcttaacaacactctctcctctctctccctctctctatctatccccatttccatggaagcaagcagatgtgttcttacatctctttctctctctacagccttacatgaacagtgactgttctctctctttccctctccttccttttttcttctacttctccttccctttgcttcgaaaagggtatctcgtgatctttatcgctcaaaaatcttcactttcagatcaggccactcgttgatggaatctgtgacagtattgattactagagagtaaagacaagttctttaaatctcagggaagaaggaattggtgtttaagattgctctgtgttaatgatggcttcaaaaactccagaaggatcacttaccaattccagtcaaagtatgtcaatcaacactttagcagatcaagtatcttcgagtttgtctttcgctgatccaagtagtgatggcaaaaccggtaatagtaagatcaacgagcaaggtgagagtggaaagagtagcacttgtagaccaagtacaagcagtgatataagcgatgagagcacttgtagcagctttagtagcagtatcaacaaacctcacaaggctaatgatgtgagatgggaagctattcaagctgttagaactaaacatggtggtttgggtttgaatcattttaggctcttgaagaggttaggatgtggagatattggaactgttcatcttgctgagttgaatggaactaggtgttattttgcgatgaaggttatggataaaactgctttggctagccggaaaaagcttcttagggctcaaactgaaagagagatattgcagtgtcttgatcacccgtttcttccgactttgtatagtcattttgagacagagaagttctcttgtttggtgatggagttttgtcctggtggtgatttgcatacactaaggcagagacaacccgggaaacgcttcaccgagcaagcagctaagttttatgtcgcggaagtgcttcttgcaatggaatatttacacatgcttgggatcatttaccgtgatctgaaacccgagaacgttcttgtgagagatgatgggcacgtgatgctttcggattttgatctctccctgagatgtactgtgagcctctctatagtcagatcagctaatgttggatccgaaggcttgtcgaagaattcggtttcttgctcgcaacaacctgcatgcatccagcaaccatcttgcatctcaatggctccaacatcttgcttcggtcctcggttcttctcatcgaaatccaagaaagacaagaaaccgaaaaccgaaaacgggaaccaccaagtaactccgttaccagaactcgttgcagagcccacaggcgcccgttctatgtcttttgttggcacacacgagtacttagctccagagatcatcaaaggtgaaggacatggaagtgcagttgattggtggacctttgggatctttctttatgaactattgtttggtaaaacaccgtttaaagggtcaggaaatcgagcaacgctcttcaacgtggttggtcagcctcttagattccctgaatctccggttgttagcttcgcagctagggatttgataaggagtttgcttgtgaaggagccacaacatagattagcttataagcgtggagcaacagagataaagcaacatcctttctttgaaggagtgaattgggctctggttcgatgtgccagtccaccggagattcctaaaccggttgatcttgaagctttgaatcctactcctactgtgccagcagccgcatcttcgagtgtaagatctgatcagagtaattatcttgagtttgatttcttctgaagaaactgtttccacagttgatgattctcattattgtttctttgcaaattctgtttagtgttttctacaaatgtgtttctttttttttcttctttttaattttcacgtcttggaaaaagttatgagatttgtaatcattcttcaaagttgtgagacagtctctgtaccatcttcttgagtttaatgttagacacgaaccattgag

SEQ ID NO: 1454 - protein, 2062 aa, Arabidopsis thaliana
GATGGTAGACCCAATTCTCTCTCTCTCTCTTAACAACACTCTCTCCTCTCTCTCCCTCTCTCTATCTATCCCCATTTCCATGGAAGCAAGCAGATGTGTTCTTACATCTCTTTCTCTCTCTACAGCCTTACATGAACAGTGACTGTTCTCTCTCTTTCCCTCTCCTTCCTTTTTTCTTCTACTTCTCCTTCCCTTTGCTTCGAAAAGGGTATCTCGTGATCTTTATCGCTCAAAAATCTTCACTTTCAGATCAGGCCACTCGTTGATGGAATCTGTGACAGTATTGATTACTAGAGAGTAAAGACAAGTTCTTTAAATCTCAGGGAAGAAGGAATTGGTGTTTAAGATTGCTCTGTGTTAATGATGGCTTCAAAAACTCCAGAAGGATCACTTACCAATTCCAGTCAAAGTATGTCAATCAACACTTTAGCAGATCAAGTATCTTCGAGTTTGTCTTTCGCTGATCCAAGTAGTGATGGCAAAACCGGTAATAGTAAGATCAACGAGCAAGGTGAGAGTGGAAAGAGTAGCACTTGTAGACCAAGTACAAGCAGTGATATAAGCGATGAGAGCACTTGTAGCAGCTTTAGTAGCAGTATCAACAAACCTCACAAGGCTAATGATGTGAGATGGGAAGCTATTCAAGCTGTTAGAACTAAACATGGTGGTTTGGGTTTGAATCATTTTAGGCTCTTGAAGAGGTTAGGATGTGGAGATATTGGAACTGTTCATCTTGCTGAGTTGAATGGAACTAGGTGTTATTTTGCGATGAAGGTTATGGATAAAACTGCTTTGGCTAGCCGGAAAAAGCTTCTTAGGGCTCAAACTGAAAGAGAGATATTGCAGTGTCTTGATCACCCGTTTCTTCCGACTTTGTATAGTCATTTTGAGACAGAGAAGTTCTCTTGTTTGGTGATGGAGTTTTGTCCTGGTGGTGATTTGCATACACTAAGGCAGAGACAACCCGGGAAACGCTTCACCGAGCAAGCAGCTAAGTTTTATGTCGCGGAAGTGCTTCTTGCAATGGAATATTTACACATGCTTGGGATCATTTACCGTGATCTGAAACCCGAGAACGTTCTTGTGAGAGATGATGGGCACGTGATGCTTTCGGATTTTGATCTCTCCCTGAGATGTACTGTGAGCCTCTCTATAGTCAGATCAGCTAATGTTGGATCCGAAGGCTTGTCGAAGAATTCGGTTTCTTGCTCGCAACAACCTGCATGCATCCAGCAACCATCTTGCATCTCAATGGCTCCAACATCTTGCTTCGGTCCTCGGTTCTTCTCATCGAAATCCAAGAAAGACAAGAAACCGAAAACCGAAAACGGGAACCACCAAGTAACTCCGTTACCAGAACTCGTTGCAGAGCCCACAGGCGCCCGTTCTATGTCTTTTGTTGGCACACACGAGTACTTAGCTCCAGAGATCATCAAAGGTGAAGGACATGGAAGTGCAGTTGATTGGTGGACCTTTGGGATCTTTCTTTATGAACTATTGTTTGGTAAAACACCGTTTAAAGGGTCAGGAAATCGAGCAACGCTCTTCAACGTGGTTGGTCAGCCTCTTAGATTCCCTGAATCTCCGGTTGTTAGCTTCGCAGCTAGGGATTTGATAAGGAGTTTGCTTGTGAAGGAGCCACAACATAGATTAGCTTATAAGCGTGGAGCAACAGAGATAAAGCAACATCCTTTCTTTGAAGGAGTGAATTGGGCTCTGGTTCGATGTGCCAGTCCACCGGAGATTCCTAAACCGGTTGATCTTGAAGCTTTGAATCCTACTCCTACTGTGCCAGCAGCCGCATCTTCGAGTGTAAGATCTGATCAGAGTAATTATCTTGAGTTTGATTTCTTCTGAAGAAACTGTTTCCACAGTTGATGATTCTCATTATTGTTTCTTTGCAAATTCTGTTTAGTGTTTTCTACAAATGTGTTTCTTTTTTTTTCTTCTTTTTAATTTTCACGTCTTGGAAAAAGTTATGAGATTTGTAATCATTCTTCAAAGTTGTGAGACAGTCTCTGTACCATCTTCTTGAGTTTAATGTTAGACACGAACCATTGAG

SEQ ID NO: 1455 - DNA, 1469 bp, Arabidopsis thaliana
  misc_feature (1)..(1469): Ceres cDNA ID no. 12600655
  misc_feature (1)..(1469): Ceres CLONE  ID no. 1198726
  misc_feature (1)..(1469): Also known as  Ceres CDNA ID no. 23486541
agcttcagatccgaccaaacaatgacgatcgttaaaccgtcgcagttctcattctccggcggcggatcttcgccgttatgttcactcaaaagctcactcctcaccgtcgctattctcactttcatttccctcttctacctctctctcaattccttacgcacttcgccgccgtctcctgtcatcgtggtaacaccgattcatgttcctcataccttcgtgaatgagtataagactgataacgaaacaccgacgatggaagaagaaacctactccgatgtttatcactcaccggaggctttccgattgaattacgccgagatggagaagagattcaaggtttatatttatcccgacggcgatccaaatacgttttatcaaacgccgaggaaagtcaccggtaaatacgctagtgaggggtacttcttccagaacattagagagagtcgatttcgaaccctagatccagatgaagcagatctcttcttcattccaatctcttgtcacaagatgcgaggcaaaggaacatcatatgaaaatatgactgtgattgttcaaaactatgttgatggattgatagctaagtatccttattggaatagaactttaggagcagatcacttctttgttacatgtcatgatgttggtgttagagcatttgagggatctccgcttctgattaagaatactattagggttgtgtgctcacctagctacaatgttggtttcattcctcacaaagatgttgctttgcctcaagttcttcagccatttgctctccctgctggtggaaatgatgttgagaatcggacgactcttggtttttgggctggtcatcgaaattctaagatacgggttatacttgctcatgtgtgggaaaacgacacagagcttgatatttcaaacaacagaattaacagagctacagggcatttggtgtatcagaagagattctaccggactaaattctgcatatgccctggtggttctcaagtaaacagcgctcgcataacggactcgatccattacggatgtattcctgtcatattatcagactactacgacctccctttcaacgacatcctgaattggcgaaaatttgcggttgtactcagagagcaagatgtctataaccttaagcagatcctcaagaacatacctcactcagagtttgtttcgttgcataacaacttggtcaaggtgcagaagcattttcaatggaactcacctccagtcaaattcgacgcatttcacatgatcatgtatgaactatggttacgccaccatgtcgtcaagtactgatccaagactttttttttttgttttttttccttcttcaaccgcgtagatacggtcccaagccaaaaaaagctagcatgtacacctcttgtaagttttaaatatcatagcttatgacagtaacacggaacatcaacatttcattctttgaggaaaattcattatttttgtgt

SEQ ID NO: 1456 - protein, 1469 aa, Arabidopsis thaliana
  misc_feature: PFam Name: Exostosin; PFam Description: Exostosin family
  misc_feature: GI Number: 51535578; NR Description: pectin-glucuronyltransferase-like [Oryza sativa (japonica
  misc_feature: GI Number: 50905787; NR Description: putative pectin-glucuronyltransferase [Oryza sativa (japonica cultivar-group)] >gi|46390046|dbj|BAD15422.1| putative pectin-glucuronyltransferase [Oryza sativa (japonica
  misc_feature: GI Number: 15237526; NR Description: exostosin family protein / pentatricopeptide (PPR) repeat-containing protein [Arabidopsis
  misc_feature: GI Number: 34911614; NR Description: limonene cyclase-like protein [Oryza sativa (japonica cultivar-group)] >gi|20805119|dbj|BAB92790.1| limonene cyclase-like protein [Oryza
  misc_feature: GI Number: 55297176; NR Description: pectin-glucuronyltransferase-like [Oryza sativa (japonica
AGCTTCAGATCCGACCAAACAATGACGATCGTTAAACCGTCGCAGTTCTCATTCTCCGGCGGCGGATCTTCGCCGTTATGTTCACTCAAAAGCTCACTCCTCACCGTCGCTATTCTCACTTTCATTTCCCTCTTCTACCTCTCTCTCAATTCCTTACGCACTTCGCCGCCGTCTCCTGTCATCGTGGTAACACCGATTCATGTTCCTCATACCTTCGTGAATGAGTATAAGACTGATAACGAAACACCGACGATGGAAGAAGAAACCTACTCCGATGTTTATCACTCACCGGAGGCTTTCCGATTGAATTACGCCGAGATGGAGAAGAGATTCAAGGTTTATATTTATCCCGACGGCGATCCAAATACGTTTTATCAAACGCCGAGGAAAGTCACCGGTAAATACGCTAGTGAGGGGTACTTCTTCCAGAACATTAGAGAGAGTCGATTTCGAACCCTAGATCCAGATGAAGCAGATCTCTTCTTCATTCCAATCTCTTGTCACAAGATGCGAGGCAAAGGAACATCATATGAAAATATGACTGTGATTGTTCAAAACTATGTTGATGGATTGATAGCTAAGTATCCTTATTGGAATAGAACTTTAGGAGCAGATCACTTCTTTGTTACATGTCATGATGTTGGTGTTAGAGCATTTGAGGGATCTCCGCTTCTGATTAAGAATACTATTAGGGTTGTGTGCTCACCTAGCTACAATGTTGGTTTCATTCCTCACAAAGATGTTGCTTTGCCTCAAGTTCTTCAGCCATTTGCTCTCCCTGCTGGTGGAAATGATGTTGAGAATCGGACGACTCTTGGTTTTTGGGCTGGTCATCGAAATTCTAAGATACGGGTTATACTTGCTCATGTGTGGGAAAACGACACAGAGCTTGATATTTCAAACAACAGAATTAACAGAGCTACAGGGCATTTGGTGTATCAGAAGAGATTCTACCGGACTAAATTCTGCATATGCCCTGGTGGTTCTCAAGTAAACAGCGCTCGCATAACGGACTCGATCCATTACGGATGTATTCCTGTCATATTATCAGACTACTACGACCTCCCTTTCAACGACATCCTGAATTGGCGAAAATTTGCGGTTGTACTCAGAGAGCAAGATGTCTATAACCTTAAGCAGATCCTCAAGAACATACCTCACTCAGAGTTTGTTTCGTTGCATAACAACTTGGTCAAGGTGCAGAAGCATTTTCAATGGAACTCACCTCCAGTCAAATTCGACGCATTTCACATGATCATGTATGAACTATGGTTACGCCACCATGTCGTCAAGTACTGATCCAAGACTTTTTTTTTTTGTTTTTTTTCCTTCTTCAACCGCGTAGATACGGTCCCAAGCCAAAAAAAGCTAGCATGTACACCTCTTGTAAGTTTTAAATATCATAGCTTATGACAGTAACACGGAACATCAACATTTCATTCTTTGAGGAAAATTCATTATTTTTGTGT

SEQ ID NO: 1457 - DNA, 1117 bp, Arabidopsis thaliana
  misc_feature (1)..(1117): Ceres cDNA ID no. 12601085
  misc_feature (1)..(1117): Ceres CLONE  ID no. 1198883
  misc_feature (1)..(1117): Also known as  Ceres CDNA ID no. 23471620
gtttgtagtataaatatccttctcttcgtccctctcatcgcctgtctctcctcttcctcttcccgttccatttatccgcaaacggagcttgttttcggtgcacctgcttcagccacttcaaacttgaactgagaaggatgggaaacgaatcatatgaagacgccatcgaagctctcaagaagcttctcattgagaaggatgatctgaaggatgtagctgcggccaaggtgaagaagatcacggcggagcttcaggcagcctcgtcatcggacagcaaatcttttgatcccgtcgaacgaattaaggaaggcttcgtcaccttcaagaaggagaaatacgagaccaatcctgctttgtatggtgagctcgccaaaggtcaaagcccaaagtacatggtgtttgcttgttcggactcacgagtgtgcccatcacacgtactagacttccatcctggagatgccttcgtggttcgtaatatcgccaatatggttcctccttttgacaaggtcaaatatgcaggagttggagccgccattgaatacgctgtcttgcaccttaaggtggaaaacattgtggtgatagggcacagtgcatgtggtggcatcaaggggcttatgtcatttcctcttgacggaaacaactctactgacttcatagaggattgggtcaaaatctgtttaccagcaaagtcaaaagttttggcagaaagtgaaagttcagcatttgaagaccaatgtggccgatgcgaaagggaggcagtgaatgtgtcactagcaaacctattgacatatccatttgtgagagaaggagttgtgaaaggaacacttgctttgaagggaggctactatgactttgttaatggctcctttgagctttgggagctccagtttggaatttcccccgttcattctatatgaactaacacatcaccatcaccatcgctaccaccaccatcacaaacatcatcatcgtcgtcatcatcatgatcagcatcttcatatataaatgttttactcttatttaattgctacttgtaatggtatacatttacttgcgatgagcttcttttccttcattatccagttataaaataaataaataaatcatgtttactttc

SEQ ID NO: 1458 - protein, 1117 aa, Arabidopsis thaliana
  misc_feature: PFam Name: Pro_CA; PFam Description: Carbonic anhydrase
  misc_feature: PFam Name: Cation_efflux; PFam Description: Cation efflux family
  misc_feature: GI Number: 9755742; NR Description: CARBONIC ANHYDRASE 2 [Arabidopsis thaliana] >gi|30685030|ref|NP_568303.2| carbonic anhydrase 2 / carbonate dehydratase 2 (CA2) (CA18) [Arabidopsis thaliana] >gi|11357217|pir||T51419 CARBONIC ANHYDRASE 2 -
  misc_feature: GI Number: 438449; NR Description: carbonic anhydrase
  misc_feature: GI Number: 23397049; NR Description: putative carbonic anhydrase [Arabidopsis thaliana] >gi|23397027|gb|AAN31799.1| putative carbonic anhydrase [Arabidopsis thaliana] >gi|12642852|gb|AAK00368.1| putative carbonic anhydrase 2
  misc_feature: GI Number: 62320917; NR Description: carbonic anhydrase,
  misc_feature: GI Number: 6016709; NR Description: carbonic anhydrase, chloroplast precursor [Arabidopsis thaliana] >gi|15810273|gb|AAL07024.1| putative carbonic anhydrase, chloroplast precursor [Arabidopsis thaliana]
GTTTGTAGTATAAATATCCTTCTCTTCGTCCCTCTCATCGCCTGTCTCTCCTCTTCCTCTTCCCGTTCCATTTATCCGCAAACGGAGCTTGTTTTCGGTGCACCTGCTTCAGCCACTTCAAACTTGAACTGAGAAGGATGGGAAACGAATCATATGAAGACGCCATCGAAGCTCTCAAGAAGCTTCTCATTGAGAAGGATGATCTGAAGGATGTAGCTGCGGCCAAGGTGAAGAAGATCACGGCGGAGCTTCAGGCAGCCTCGTCATCGGACAGCAAATCTTTTGATCCCGTCGAACGAATTAAGGAAGGCTTCGTCACCTTCAAGAAGGAGAAATACGAGACCAATCCTGCTTTGTATGGTGAGCTCGCCAAAGGTCAAAGCCCAAAGTACATGGTGTTTGCTTGTTCGGACTCACGAGTGTGCCCATCACACGTACTAGACTTCCATCCTGGAGATGCCTTCGTGGTTCGTAATATCGCCAATATGGTTCCTCCTTTTGACAAGGTCAAATATGCAGGAGTTGGAGCCGCCATTGAATACGCTGTCTTGCACCTTAAGGTGGAAAACATTGTGGTGATAGGGCACAGTGCATGTGGTGGCATCAAGGGGCTTATGTCATTTCCTCTTGACGGAAACAACTCTACTGACTTCATAGAGGATTGGGTCAAAATCTGTTTACCAGCAAAGTCAAAAGTTTTGGCAGAAAGTGAAAGTTCAGCATTTGAAGACCAATGTGGCCGATGCGAAAGGGAGGCAGTGAATGTGTCACTAGCAAACCTATTGACATATCCATTTGTGAGAGAAGGAGTTGTGAAAGGAACACTTGCTTTGAAGGGAGGCTACTATGACTTTGTTAATGGCTCCTTTGAGCTTTGGGAGCTCCAGTTTGGAATTTCCCCCGTTCATTCTATATGAACTAACACATCACCATCACCATCGCTACCACCACCATCACAAACATCATCATCGTCGTCATCATCATGATCAGCATCTTCATATATAAATGTTTTACTCTTATTTAATTGCTACTTGTAATGGTATACATTTACTTGCGATGAGCTTCTTTTCCTTCATTATCCAGTTATAAAATAAATAAATAAATCATGTTTACTTTC

SEQ ID NO: 1459 - DNA, 1001 bp, Arabidopsis thaliana
  misc_feature (1)..(1001): Ceres cDNA ID no. 12602491
  misc_feature (1)..(1001): Ceres CLONE  ID no. 115693
  misc_feature (1)..(1001): Also known as  Ceres CDNA ID no. 23472145
tatttgaggagactctgtaccagtctaccaccgaaggcaagaaaatggtcgacgtcctcgtcgagcagaacattgtccctggtatcaaagtcgacaagggtttggtgccacttgttggatccaacaatgagtcatggtgccaaggactagatggtctatcatctcgaactgctgcttactatcaacagggtgcgcgtttcgccaaatggcgtactgtcgtgagcattcctaacggtccgtctgccctcgccgtcaaagaagctgcttggggtcttgctcgatacgctgccatttcacaggacagcggtttggttccgattgttgagccagagatcttgttggatggagaacacgacattgacagaacatacgacgtagcagagaaggtttgggctgaggttttcttttaccttgctcagaacaatgtcatgtttgaaggtatcctcctaaaaccgagcatggtgactcccggagctgagtctaaagacagagctactcctgaacaagttgccgcctacaccctcaagctcctccgcaacagagtccctcccgcagtccccggaatcatgtttttgtccggaggacagtcggaggtggaggcaacactcaacttgaacgcaatgaaccaggcaccaaacccatggcacgtgtccttctcctacgcacgtgcgttgcagaacacttgtctgaaaacatggggcggcagacccgagaacgtgaacgcagctcagaccactctcttggcccgtgccaaggccaattcgttggctcagctcggaaaatacaccggtgagggtgagtccgaagaggctaaggagggcatgttcgtcaaagggtacacctattgaagagatgatgctgtgaaaaaagagatgaagcagatgttttaatcacatttgtttttgagtttgcttgttattaatcatgtcaaatcattattttctctgcttactttgcgttagctactccttctaataagttctattatattgaagttatcc

SEQ ID NO: 1460 - protein, 1001 aa, Arabidopsis thaliana
  misc_feature: PFam Name: Glycolytic; PFam Description:
  misc_feature: GI Number: 16226653; NR Description: AT4g38970/F19H22_70
  misc_feature: GI Number: 53828647; NR Description: At4g38970 [Arabidopsis thaliana] >gi|18420348|ref|NP_568049.1| fructose-bisphosphate
  misc_feature: GI Number: 42573227; NR Description: fructose-bisphosphate
  misc_feature: GI Number: 1781348; NR Description: homologous to plastidic aldolases [Solanum tuberosum] >gi|7436610|pir||T07418 probable fructose-bisphosphate aldolase (EC 4.1.2.13) precursor, chloroplast
  misc_feature: GI Number: 21311559; NR Description: latex plastidic
TATTTGAGGAGACTCTGTACCAGTCTACCACCGAAGGCAAGAAAATGGTCGACGTCCTCGTCGAGCAGAACATTGTCCCTGGTATCAAAGTCGACAAGGGTTTGGTGCCACTTGTTGGATCCAACAATGAGTCATGGTGCCAAGGACTAGATGGTCTATCATCTCGAACTGCTGCTTACTATCAACAGGGTGCGCGTTTCGCCAAATGGCGTACTGTCGTGAGCATTCCTAACGGTCCGTCTGCCCTCGCCGTCAAAGAAGCTGCTTGGGGTCTTGCTCGATACGCTGCCATTTCACAGGACAGCGGTTTGGTTCCGATTGTTGAGCCAGAGATCTTGTTGGATGGAGAACACGACATTGACAGAACATACGACGTAGCAGAGAAGGTTTGGGCTGAGGTTTTCTTTTACCTTGCTCAGAACAATGTCATGTTTGAAGGTATCCTCCTAAAACCGAGCATGGTGACTCCCGGAGCTGAGTCTAAAGACAGAGCTACTCCTGAACAAGTTGCCGCCTACACCCTCAAGCTCCTCCGCAACAGAGTCCCTCCCGCAGTCCCCGGAATCATGTTTTTGTCCGGAGGACAGTCGGAGGTGGAGGCAACACTCAACTTGAACGCAATGAACCAGGCACCAAACCCATGGCACGTGTCCTTCTCCTACGCACGTGCGTTGCAGAACACTTGTCTGAAAACATGGGGCGGCAGACCCGAGAACGTGAACGCAGCTCAGACCACTCTCTTGGCCCGTGCCAAGGCCAATTCGTTGGCTCAGCTCGGAAAATACACCGGTGAGGGTGAGTCCGAAGAGGCTAAGGAGGGCATGTTCGTCAAAGGGTACACCTATTGAAGAGATGATGCTGTGAAAAAAGAGATGAAGCAGATGTTTTAATCACATTTGTTTTTGAGTTTGCTTGTTATTAATCATGTCAAATCATTATTTTCTCTGCTTACTTTGCGTTAGCTACTCCTTCTAATAAGTTCTATTATATTGAAGTTATCC

SEQ ID NO: 1461 - DNA, 1219 bp, Arabidopsis thaliana
  misc_feature (1)..(1219): Ceres cDNA ID no. 12603201
  misc_feature (1)..(1219): Ceres CLONE  ID no. 20946
  misc_feature (1)..(1219): Also known as  Ceres CDNA ID no. 12603201
attctaatcatccccttgaattttccaagttttctccttttgtcttctctaactattttcccttaaaataaaaatccaatttttctttgtttcagtcctctcttctgctcattgatcttttaattaactttgattctctccgtttatggattaaccatttgatcgagataactctccaagaaatcgactgagttcgtaacttgttgttgtctgatcttttaaagattcaaccttttttggtccgatcatggctgttgctgagaatgctggtgtcaaagtggactcttctggtcagaatttagacaacaacaacactgctgcttcagctaccgagacgacaaagccgccatgtcctgatgatgatcaaagccctaaatctgactcatccactcctcttaccatcgattcgactcctgaaactgacgatcggatcaatgagactgctcaaaaggttcagactttaaatgggtttagtggaaatggtgagagagataacaatggagagatcaaagatttggctgatgcgttttctaagcttaatccgatggctcaggagtttgttcctccttctcttgctcgaagtcaatctggggttttgagaaatggattagggtttactaacaattttgcagccccacctaaacttgctgatgggaatgatcattttcctagaaggagaaggagttttggccaagggaagcgaagaatgaacaaaaggacaagcttggctcagaaggatgatgtaatcaggacaactgtatatgtctctgacatcgaccaacaggttacagaggagaacctcgcaggtgtctttattaactgtggacaggttgttgattgtcgtgtatgcggtgatccaaattctgtccttcgtttcgctttcattgaatttaccaatgaagagggagctagagctgctttgagcatgtcgggtactgtgctaggtttttaccctcttaaggttcttccttccaaaacagctattgctcctgttaacccgacttttcttccacgatctgaggatgagcgtgagatgtgcgttaggactgtttactgtaccaacattgacaagcggatcactcaaattgacttgaaaggcttctttgaaatgctttgcggggaggttcatcgtctgaggcttggagactatcaccaccaaacccgtattgcttttgttgagtttgcgatggcggaaagcgcaattgctgcgcttcactgc

SEQ ID NO: 1462 - protein, 1219 aa, Arabidopsis thaliana
ATTCTAATCATCCCCTTGAATTTTCCAAGTTTTCTCCTTTTGTCTTCTCTAACTATTTTCCCTTAAAATAAAAATCCAATTTTTCTTTGTTTCAGTCCTCTCTTCTGCTCATTGATCTTTTAATTAACTTTGATTCTCTCCGTTTATGGATTAACCATTTGATCGAGATAACTCTCCAAGAAATCGACTGAGTTCGTAACTTGTTGTTGTCTGATCTTTTAAAGATTCAACCTTTTTTGGTCCGATCATGGCTGTTGCTGAGAATGCTGGTGTCAAAGTGGACTCTTCTGGTCAGAATTTAGACAACAACAACACTGCTGCTTCAGCTACCGAGACGACAAAGCCGCCATGTCCTGATGATGATCAAAGCCCTAAATCTGACTCATCCACTCCTCTTACCATCGATTCGACTCCTGAAACTGACGATCGGATCAATGAGACTGCTCAAAAGGTTCAGACTTTAAATGGGTTTAGTGGAAATGGTGAGAGAGATAACAATGGAGAGATCAAAGATTTGGCTGATGCGTTTTCTAAGCTTAATCCGATGGCTCAGGAGTTTGTTCCTCCTTCTCTTGCTCGAAGTCAATCTGGGGTTTTGAGAAATGGATTAGGGTTTACTAACAATTTTGCAGCCCCACCTAAACTTGCTGATGGGAATGATCATTTTCCTAGAAGGAGAAGGAGTTTTGGCCAAGGGAAGCGAAGAATGAACAAAAGGACAAGCTTGGCTCAGAAGGATGATGTAATCAGGACAACTGTATATGTCTCTGACATCGACCAACAGGTTACAGAGGAGAACCTCGCAGGTGTCTTTATTAACTGTGGACAGGTTGTTGATTGTCGTGTATGCGGTGATCCAAATTCTGTCCTTCGTTTCGCTTTCATTGAATTTACCAATGAAGAGGGAGCTAGAGCTGCTTTGAGCATGTCGGGTACTGTGCTAGGTTTTTACCCTCTTAAGGTTCTTCCTTCCAAAACAGCTATTGCTCCTGTTAACCCGACTTTTCTTCCACGATCTGAGGATGAGCGTGAGATGTGCGTTAGGACTGTTTACTGTACCAACATTGACAAGCGGATCACTCAAATTGACTTGAAAGGCTTCTTTGAAATGCTTTGCGGGGAGGTTCATCGTCTGAGGCTTGGAGACTATCACCACCAAACCCGTATTGCTTTTGTTGAGTTTGCGATGGCGGAAAGCGCAATTGCTGCGCTTCACTGC

SEQ ID NO: 1463 - DNA, 1696 bp, Arabidopsis thaliana
  misc_feature (1)..(1696): Ceres cDNA ID no. 12603956
  misc_feature (1)..(1696): Ceres CLONE  ID no. 1337951
  misc_feature (1)..(1696): Also known as  Ceres CDNA ID no. 23656162
tggtctggaggaaatagtaccagctaagctcgcagctcaaagctcagtgtttaataattgtatagcttttttggtgaacgaagagtcagatcggcgagcctgagatgggttggggttcggtgttgctattactggcggtggctcttctttgtcagagggcaagttcaatcggagctaactggggcacacaggcgtcgcacccacttccaccggacatagttgtgcggatgctaagagagaatggtattcagaaagtaaagctctttgacgccgaatacgacactctcagagctttgggcaaatccggaatcgaagtcatggttggtattcccaatgagatgcttgcgactctcgcctctagcctgaaagctgctgagaaatgggttgctaaaaatgtctctactcacatctccaccgacaacgtcaacatcagatatgtggctgttgggaatgaacctttcttgtctacttataatgggagctatctgagtactactttccctgcgttgaggaacatccaaattgcaattataaaggctggccttcagaaccaagtgaaggtcacttgtcccttgaacgctgatgtctatgacagctccaccacttttccttctggaggggacttcagggccaatatccgtgacctcatgatcactatcgtcaagttcttgagcgaaaatggcggtcctttcactgttaacatctacccttacatcagtctttacaccaaccccgatttcccagttgattacgccttctttgacggcaatgcacagcccctgaacgatggtgggactttttattacaacatgtttgatgcaaattacgacaccctagtccacgcgttggagaagaatgggtttggtaacatgcctatcattattggggaaattggttggcctactgatggggacagtaatgcgaatttggactacgctaagaagttcaaccaaggctttatggctcacatctcaggggggaaagggactccgaggagacctggccctatcgatgcatacctgttcagcttgatagacgaggacgccaagagtgttcagccaggatactttgagcgacactgggggatattcacatttgacggcttaccaaaatatgccttgaacctagggacaacgaacacaggagctctgatccaggccaaaggggtacgctacctagagaggaagtggtgtgtgatgaagccaaatgtgaggttggatgatccgcaggtagctccagccgtgagctacgcgtgtagccttggggactgtactagtcttggggttgggacgtcctgtgctaatcttgacgggaaacaaaacatatcgtatgcattcaacagttattatcagatacaggatcagcttgatacagcttgtaagttcccaaacatatcagaggtgaccaagacagatccatctactggaacttgcagatttccgattatgatagaaccttactacggtggggcagcccgggaacacgggttctttttcccactactgatggtggcagccatcgcagtctctattttttgatggtttcttcttgtcaatttgtaattctgtgtgatggcttgaactatttttttttcttcttgaattctgatttctcttccttacaccaagtgattattagagctgttttctgggaccaaactgaccttaaaacgatgccatattgccatgttcagtag

SEQ ID NO: 1464 - protein, 1696 aa, Arabidopsis thaliana
  misc_feature: PFam Name: Glyco_hydro_17; PFam Description: Glycosyl
  misc_feature: PFam Name: X8; PFam Description: X8 domain
  misc_feature: GI Number: 7270016; NR Description: 1, 3-beta-glucanase-like protein [Arabidopsis thaliana] >gi|38257777|sp|Q9M088|E135_ARATH Putative glucan endo-1,3-beta-glucosidase 5 precursor ((1->3)-beta-glucan endohydrolase) ((1->3)-beta-glucanase)
  misc_feature: GI Number: 23308419; NR Description: At5g58090/k21l19_70 [Arabidopsis thaliana] >gi|16604491|gb|AAL24251.1|
  misc_feature: GI Number: 9759535; NR Description: glucanase; glucan endo-1,3-beta-glucosidase [Arabidopsis thaliana] >gi|38257732|sp|Q93Z08|E136_ARATH Putative glucan endo-1,3-beta-glucosidase 6 precursor ((1->3)-beta-glucan
  misc_feature: GI Number: 15242078; NR Description: glycosyl hydrolase
  misc_feature: GI Number: 50921029; NR Description: putative 1,3-beta-glucanase [Oryza sativa (japonica cultivar-group)] >gi|30017525|gb|AAP12947.1| putative 1,3-beta-glucanase [Oryza
TGGTCTGGAGGAAATAGTACCAGCTAAGCTCGCAGCTCAAAGCTCAGTGTTTAATAATTGTATAGCTTTTTTGGTGAACGAAGAGTCAGATCGGCGAGCCTGAGATGGGTTGGGGTTCGGTGTTGCTATTACTGGCGGTGGCTCTTCTTTGTCAGAGGGCAAGTTCAATCGGAGCTAACTGGGGCACACAGGCGTCGCACCCACTTCCACCGGACATAGTTGTGCGGATGCTAAGAGAGAATGGTATTCAGAAAGTAAAGCTCTTTGACGCCGAATACGACACTCTCAGAGCTTTGGGCAAATCCGGAATCGAAGTCATGGTTGGTATTCCCAATGAGATGCTTGCGACTCTCGCCTCTAGCCTGAAAGCTGCTGAGAAATGGGTTGCTAAAAATGTCTCTACTCACATCTCCACCGACAACGTCAACATCAGATATGTGGCTGTTGGGAATGAACCTTTCTTGTCTACTTATAATGGGAGCTATCTGAGTACTACTTTCCCTGCGTTGAGGAACATCCAAATTGCAATTATAAAGGCTGGCCTTCAGAACCAAGTGAAGGTCACTTGTCCCTTGAACGCTGATGTCTATGACAGCTCCACCACTTTTCCTTCTGGAGGGGACTTCAGGGCCAATATCCGTGACCTCATGATCACTATCGTCAAGTTCTTGAGCGAAAATGGCGGTCCTTTCACTGTTAACATCTACCCTTACATCAGTCTTTACACCAACCCCGATTTCCCAGTTGATTACGCCTTCTTTGACGGCAATGCACAGCCCCTGAACGATGGTGGGACTTTTTATTACAACATGTTTGATGCAAATTACGACACCCTAGTCCACGCGTTGGAGAAGAATGGGTTTGGTAACATGCCTATCATTATTGGGGAAATTGGTTGGCCTACTGATGGGGACAGTAATGCGAATTTGGACTACGCTAAGAAGTTCAACCAAGGCTTTATGGCTCACATCTCAGGGGGGAAAGGGACTCCGAGGAGACCTGGCCCTATCGATGCATACCTGTTCAGCTTGATAGACGAGGACGCCAAGAGTGTTCAGCCAGGATACTTTGAGCGACACTGGGGGATATTCACATTTGACGGCTTACCAAAATATGCCTTGAACCTAGGGACAACGAACACAGGAGCTCTGATCCAGGCCAAAGGGGTACGCTACCTAGAGAGGAAGTGGTGTGTGATGAAGCCAAATGTGAGGTTGGATGATCCGCAGGTAGCTCCAGCCGTGAGCTACGCGTGTAGCCTTGGGGACTGTACTAGTCTTGGGGTTGGGACGTCCTGTGCTAATCTTGACGGGAAACAAAACATATCGTATGCATTCAACAGTTATTATCAGATACAGGATCAGCTTGATACAGCTTGTAAGTTCCCAAACATATCAGAGGTGACCAAGACAGATCCATCTACTGGAACTTGCAGATTTCCGATTATGATAGAACCTTACTACGGTGGGGCAGCCCGGGAACACGGGTTCTTTTTCCCACTACTGATGGTGGCAGCCATCGCAGTCTCTATTTTTTGATGGTTTCTTCTTGTCAATTTGTAATTCTGTGTGATGGCTTGAACTATTTTTTTTTCTTCTTGAATTCTGATTTCTCTTCCTTACACCAAGTGATTATTAGAGCTGTTTTCTGGGACCAAACTGACCTTAAAACGATGCCATATTGCCATGTTCAGTAG

(The sequence listing continues in the following parts.)

What is claimed is:

1. An isolated nucleic acid molecule comprising:
   a) a nucleic acid which is SEQ ID NO:3407; or
   b) a nucleic acid which encodes SEQ ID NO:3408.

2. The isolated nucleic acid molecule according to claim 1, which is SEQ ID NO:3407.

3. The isolated nucleic acid molecule according to claim 1, wherein said amino acid sequence comprises SEQ ID NO:3408.

4. A vector construct comprising:
   a) a first nucleic acid having a regulatory sequence capable of causing transcription and/or translation in a plant; and
   b) a second nucleic acid having the sequence of the isolated nucleic acid molecule according to claim 1;
      wherein said first and second nucleic acids are operably linked and
      wherein said second nucleic acid is heterologous to any element in said vector construct.

5. The vector construct according to claim 4, wherein said first nucleic acid is native to said second nucleic acid.

6. The vector construct according to claim 4, wherein said first nucleic acid is heterologous to said second nucleic acid.

7. A host cell comprising an isolated nucleic acid molecule according to claim 1 wherein said nucleic acid molecule is flanked by exogenous sequence.

8. A host cell comprising a vector construct according to claim 4.

9. A plant cell or plant which comprises a nucleic acid molecule according to claim 1 which is exogenous or heterologous to said plant or plant cell.

10. A plant cell or plant which comprises a vector construct according to claim 4.

11. A plant cell or plant according to claim 9, which is a transgenic plant, transgenic plant cell, transgenic plant material or transgenic seed of a plant.

12. A plant cell or plant according to claim 10, which is a transgenic plant, transgenic plant cell, transgenic plant material or transgenic seed of a plant.

13. A plant which has been regenerated from a transgenic plant cell or transgenic seed according to claim 11.

14. A plant which has been regenerated from a transgenic plant cell or transgenic seed according to claim 12.

15. An isolated nucleic acid sequence which is a full complement of SEQ ID NO:3407 or to a nucleic acid that encodes SEQ ID NO:3408.

* * * * *